US012606815B2

(12) United States Patent (10) Patent No.: US 12,606,815 B2
Zhang et al. (45) Date of Patent: Apr. 21, 2026

(54) SELF-DIVERSIFYING SYSTEMS AND METHODS OF USE THEREOF

(71) Applicants: THE BROAD INSTITUTE, INC., Cambridge, MA (US); MASSACHUSETTS INSTITUTE OF TECHNOLOGY, Cambridge, MA (US)

(72) Inventors: Feng Zhang, Cambridge, MA (US); Jonathan Leo Schmid-Burgk, Cambridge, MA (US)

(73) Assignees: The Board Institute, Inc., Cambridge, MA (US); Massachusetts Institute of Technology, Cambridge, MA (US)

( * ) Notice: Subject to any disclaimer, the term of this patent is extended or adjusted under 35 U.S.C. 154(b) by 650 days.

(21) Appl. No.: 16/904,529

(22) Filed: Jun. 17, 2020

(65) Prior Publication Data

US 2020/0392482 A1 Dec. 17, 2020

Related U.S. Application Data

(60) Provisional application No. 62/862,522, filed on Jun. 17, 2019, provisional application No. 62/912,602, filed on Oct. 8, 2019.

(51) Int. Cl.
| | |
|---|---|
| *C07H 21/02* | (2006.01) |
| *C07K 14/47* | (2006.01) |
| *C12N 9/12* | (2006.01) |
| *C12N 15/00* | (2006.01) |
| *C12N 15/10* | (2006.01) |

(52) U.S. Cl.
CPC ...... *C12N 15/1037* (2013.01); *C07K 14/4726* (2013.01); *C12N 9/1276* (2013.01); *C12N 15/00* (2013.01); *C12N 15/1024* (2013.01); *C12N 15/1027* (2013.01); *C12N 15/1031* (2013.01); *C12Y 207/07049* (2013.01); *C07K 2319/70* (2013.01); *C07K 2319/80* (2013.01); *C07K 2319/85* (2013.01)

(58) Field of Classification Search
USPC .................................. 536/23.1, 24.3, 24.33
See application file for complete search history.

(56) References Cited

U.S. PATENT DOCUMENTS

2010/0041033 A1 2/2010 Miller et al.

OTHER PUBLICATIONS

"Diversity-generating retroelements" from Wikipedia. Printed on Sep. 9, 2023.*
The definition "Retroelements". Printed on Sep. 9, 2023.*
Sequence alignment between SEQ ID No. 101 and Bacteroides faecis strain BFG-554 chromosome. Printed on Nov. 15, 2024.*
Sequence alignment between SEQ ID No. 115 and Bacteroides Ovatus strain BFG-179 chromosome. Printed on Nov. 15, 2024.*
"Polymorphism in bacteria chromosomes" from Google Search. Printed on Nov. 16, 2024.*
"What is a vector in biology?". Printed on Apr. 24, 2024.*
Overview: Gene regulation in bacteria (article) Khan Academy. Printed on Apr. 24, 2024.*
"Bacteroides faecis strain bfg554" from Google Search. Printed on Apr. 24, 2024.*
"Bacteroides ovatus strain BFG-179" from Google Search. Printed on Apr. 24, 2024.*
Guo, et al., "Diversity-Generating Retroelement Homing Regenerates Target Sequences for Repeated Rounds of Codon Rewriting and Protein Diversification," Molecular Cell 31, published Sep. 26, 2008, pp. 813-823.
Handa, et al., "Template-assisted synthesis of adenine-mutagenized cDNA by a retroelement protein complex," Nucleic Acids Research vol. 46, No. 18, published 2018, pp. 9711-9725.
Schillinger, et al., "Analysis of a comprehensive dataset of diversity generating retroelements generated by the program DiGReF," BMC Genomics 13:430, published 2012, all enclosed pages cited.

* cited by examiner

*Primary Examiner* — Frank W Lu
(74) *Attorney, Agent, or Firm* — F. Brent Nix, Esq.; Johnson, Marcou, Isaacs & Nix, LLC

(57) ABSTRACT

A diversity-generating system comprising: a polynucleotide comprising: a variable region within a sequence encoding a protein or polypeptide, wherein the system is configured to generate a library of diversified molecules with an efficiency of 80% as measured by number of the diversified molecules in total number of molecules. The system may further comprise a template region; and a reverse transcriptase or functional domain thereof.

19 Claims, 37 Drawing Sheets

Specification includes a Sequence Listing.

MATCH LINE TO FIG.

MATCH LINE TO FIG.

MATCH LINE TO FIG.

GCGCCTGCCGA (1,722 reads)

GCGCCTGCCGG (487 reads)

GCGCCTGCCGC (1,022 reads)

Theor. complexity: 4^22 = 1.76E+13

FIG. 5D

**Sequence of *DIV1* (27.3 kDa)**

MKKQSNQTVRMATPGQIKDVISAVVESIPVNNLTYEMAQYFIGRKKWLGTEMKKIFSVDNSHADLIADWQAFYCGLGIDC
DLSGVIIPDDPGGFGRVIIMAQGITPQSGYDLCAKFFPCWKYTDKNLDEVVSERTAKDVYAIRVRDRVEADEELRNRSY
NDLKRQGIIGITLEEREIFELKFFKETAGKHLDIKNWTFCLGSCYDGGNVPSASWRSGEFEVDWCNPGDVFDDLCSRQAVS*

Variable sequence

FIG. 6A

Ligand identification of *DIV1* by phage display

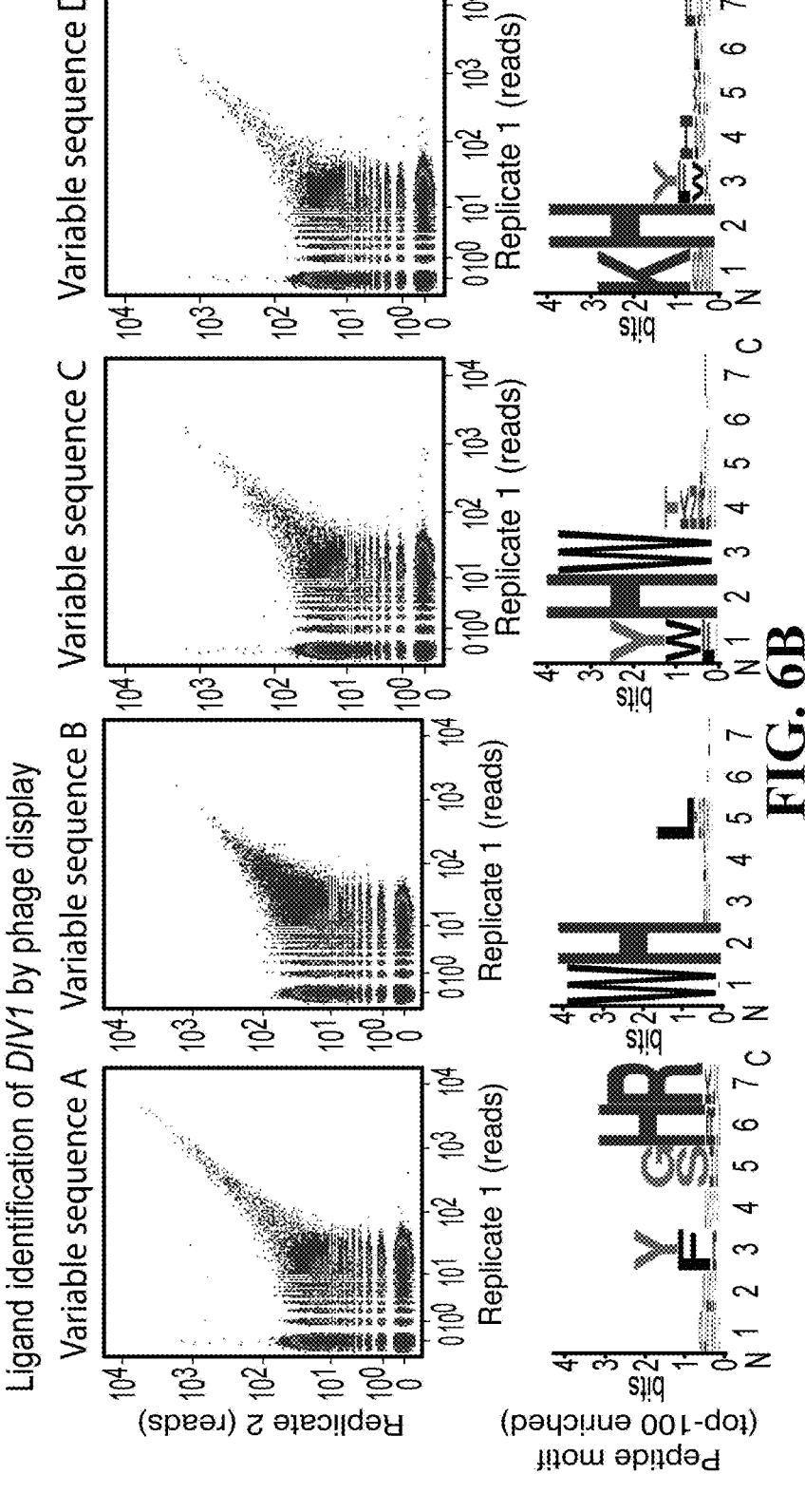

FIG. 6B

Sequence of *DIV18* (21.9 kDa)

MRTFEITEKEVAAAFREAESGEAKKILAALFCKEEMVKPTLDDYKTIRTYEDACKALGEPIFEDPNNLPNHIIALMKLET
ISRALWGRNFQPKPDGEGSKVYWYPWFALWTKKEVEDMNPEQRGAL*VSANADLGAPAGFGCLAALYRSSSADAGYGFRLC
QETEEEKAKYFGQQFIELWAEYILKFNPTVGNRLK*

Variable sequence

FIG. 7A

Ligand identification of *DIV18* by phage display

Variable sequence A

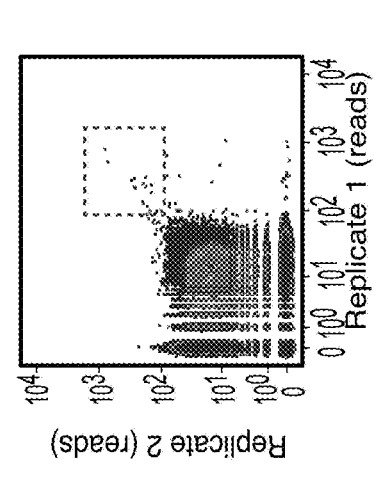

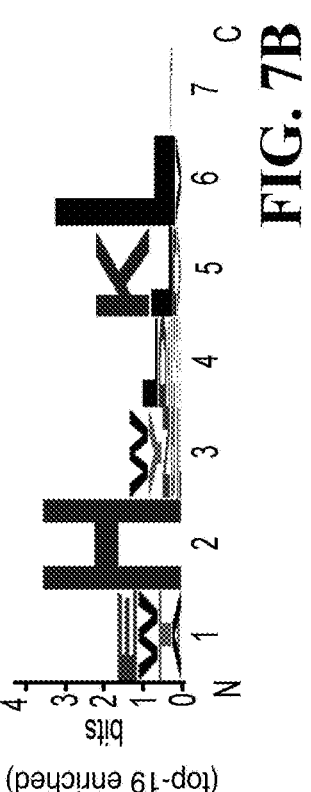

Peptide motif
(top-19 enriched)

FIG. 7B

SEQ ID NO: 1

```
ggagttattt ccgggaacga caaacaaccg gaaccctgaa aagtaagaat cgcattcaaa    60
ctacttctat atacatgagc agtccctaaa ttcccactct gctgcaaatc aacagccact   120
tgtttcataa acgaagtaaa actttccttt ttcattaaaa aataatttaa taattaatat   180
ttactaatnn cacaatttac tttagtaaaa tacgaaaata tatatacaaa gatttacata   240
tataaaatta taatattaaa aactgaaata ttcacattat ctatcaaatt tattttata   300
catttgcgca gttttttaaa caaataatca ttttaattac taaaaaacaa caaagttatg   360
aacaacaatg aaccagctgc cgaacactac agcatcaatg gattcaagta tttctccgag   420
ttggcgaaag aatattttcc agatctggca aacgcctctt ccgccagcaa aaaaatgcgc   480
aaacgcatca aagcagacaa gacgttgaac gaacaactgg ctgccgcgta ttacacctgc   540
caaacaatcg acatcagtcc cgaaatgcaa ctaatccttt accgccattg gggacctccc   600
cacatcgacc tgccgaccaa cgtttaatta cgtagtagaa aacgaaaaca tcgacaagga   660
ataaaaagaa aatcgaacta tatattttta aatatatcat ttatcttttt attgtttatt   720
atgtattcca ctttgcgttc accactttt tcggaaaaga agataactat catttataca   780
gctatttaca gaaagaaaaa agcgttccac aaagcgttcg gcaaaatgac cgtttttttc   840
attccaaaca gagcctccga atcctcccaa cgaaggctct gtttatctcc ggcagaagtt   900
ctatcaaaca caaacagagc atccgtttca tctcctgatc gcttcttcgc cccatgaaag   960
aaaacaaaaa tacaacaact tacgtaccac aactattctt cttcgtccac acccgtccac  1020
aaacagacac acccccttgca aaccgcacgg gaatagcgta cttttacaga aaatttaaat  1080
aacactcaat gaaaaatttc aattttcaag ccatgctgaa acatggtttt ctcattatcc  1140
ctaaagcctt actacagcag cagatagaag accgncacat gcaagaagga gaaatagaag  1200
ctctcctgaa aattctgatg aaggtcaatt attcggatac actctacaac gaccgtcaaa  1260
ataaaaactg cctgtgtaaa agaggcgaaa gcctgtttag ttatcgcgac tggagccaca  1320
tcttccactg gtctgtcgga aaagccttca ggttcataca cgagcttgcc acgctgggaa  1380
ttatagaaat catctctcac cccaacaatt cctccctgca tattcgtgtc gtcgaatacg  1440
ataaatggat gggagttccc gatagcgaca agcagaaaaa gaaagccgtc aacgaaaagt  1500
ttcacctgtt ctggaatgaa ttccacagca tcacacagct ccccaaagag aatatcgcca  1560
aagcacaacg cgaatggaaa aagttgggcg acaaggaaca gcaactcgcc atcgacagga  1620
tagaggaata ttatttccac caaacgaaca tcaatttcct tctccatgcc gccagctatt  1680
tatccaacaa agcttttctt aacgaatact gataatatga ataccgaaaa cagagtttcg  1740
ccacaggctc ccgaaataga agaagctatc atcggcgcct gcctgataga acaggggagcc  1800
ataccactgg tagccgacaa gctgcgtccc gaaatgttct acgtcctgcg ccatcaggtt  1860
atctatgccg ccatactggc catgtatcat gcaggaataa agatagacat cctcaccgta  1920
aaagaagagc tttcccaccg tggaaagctc gaagaggcgg gcggaccgtt cggcatcacc  1980
caattgagca gcaaggtggc aacctccgcc catnttgaat atcatgcgca gatcgtacac  2040
gagaaatacc tgcgacgcga aatgattctg gggttcaaca aactcctcgc ctgttcgcta  2100
gacgaaacga tggatattga cgactcactg gtagacgcgc ataacctgct cgaccgtctg  2160
gaaggcgaat tcggccataa caaccacatg cgcgacatgg atgaactaat gaccgccacc  2220
atggtagaag ccgaaggacg tatcgccaac aacaaaacg gagtaaccgg cctccctacc  2280
ggactggcgg atctggaccg catgacgtcc ggactacaga aaggcgagtt ggtggtggtc  2340
gccgccgtc ccggcgtagg aaaaacggca ttcgcactac acatggcacg aagcgcagca  2400
atggcagggt atgccgtagc tgtctacagc ctcgagatgc aagggaacg actagcagac  2460
cgatggctga cagcggtcag cgaaatcagc gcccgccatt ggcgatcggg aaccgtcagc  2520
caacaggaac tcgtagaggc acgcacaaca gccgctgacc tcaaacgcct gccgatacac  2580
gtagacgaca gcacatcggt caacatggaa catatacgtt ccagcgcgcg actgctgcaa  2640
agccaacatg cgtgcgatgc tattattatc gactacctgc aactctgcga catgacgacc  2700
ggtcaaaaca accgcaaccg cgaacaggaa gtggcacaag cnacccgcaa ggcaaaattg  2760
ctagccaaag aactgaatgt accagtcgta ctgcttagcc agctaaaccg cgaatcggaa  2820
aaccgccctg ccggccgtcc cgaactggct catctccgcg agagcggagc tattgaacag  2880
gatgcagacg tcgtcatgct gctctaccgt cccgcccttg caagggtgac gaccgaccgg  2940
gaaagtggtt atcccaccga aggtctggga gtagtcatca tagccaagca acgcaacgga  3000
```

FIG. 9B-1

```
gagacaggaa  acgtctattt  cagacataat  ccggaaatga  ccaagatcac  cgaatatgtc   3060
cctccgttag  agtatatgct  gaaacatgcc  aaataagaaa  cagttacact  aataatatac   3120
aattttatat  tacaacatat  agcataaatc  attttctcat  tttatttcat  tatacataca   3180
anatatatag  caaaacactt  gactttccct  ctcatatttc  gtatatttgt  aatgtcgtaa   3240
ggacagagaa  aattttatta  cttaaacctt  aactttttat  tgtatgaatg  tattagtgga   3300
gcgctatcag  cgcagaaagt  atgtgaatca  accggattca  cagatgttgt  attatgtacg   3360
ccagaaatcg  ggcacagtga  gagtgatgga  catcaacaag  ctggcggatg  ccatcgaagc   3420
gaactcctcg  ctcactgcag  gagacgtgaa  gcatgccatt  gaggcttttg  tcgagcagtt   3480
acgcctatcg  cttacccagg  gcgacaaggt  gaaggttgac  ggattgggta  cgtttcatat   3540
cacattgagc  agcgaggggg  cagaaaaaga  gaaagattgc  acggtcgcca  gcatccgcaa   3600
agtaaatgtc  cgtttcgtgg  cggacaaggc  gcttcaattg  gtaaatacga  gccatgccac   3660
tacccgaggc  gaaaataatg  tcgatttttat  cctggcagca  aagggcgacg  gagaaggtga   3720
cgatgacgga  aatagcggna  gcggtggaaa  cagcggcgga  agcggagaag  ctccggaccc   3780
ggcagcttaa  tctttaaaac  agcgccgcat  ggatattacg  gagtgatttc  tacagttact   3840
ctcnatgcgg  tttctgtttt  cttctacatt  tattttttaa  ttctcaattt  tcaatcctca   3900
atttattaaa  atgcttgata  aaatcataga  gatcattata  acgatcctgc  cctttctggg   3960
cagtaaccgc  aaaaagcgca  aagtaatggc  gcaagaagta                            4000
```

FIG. 9B-2

SEQ ID NO: 2

```
tacgccgggc  cgtctgggaa  actacatgga  tgacgaaggc  aaggaagagg  caggccccgc     60
tgccggcgcg  gcaggaaacg  cagcgggcgg  gaacagccag  cccgagcgta  tcatcgccct    120
ccttggcgga  cgggagaaca  ttgaatttgt  ggacgcctgc  atgaccaggc  tccgcgtgac    180
agtgaaggat  ctctccaagg  tggctgaact  tccggcgtgg  aaggcagagg  cgccatggg    240
ccttgtgaag  aaagacaacg  gcatccaggc  aatttacgga  cccaaggcgg  acgtgctgaa    300
atcggatatc  aacgatatcc  tgtaacaatt  cagcaccccg  gaaaaaatga  gtgaaatatg    360
aacggggagc  ctgctcaccg  ggcagatttt  gctcaatacg  cagaggaaag  aactatgaga    420
ctgcttacta  tcaatattca  cagccatgga  agtgactttg  aaccggaact  ttatcatcag    480
aagatgaagg  cgctggcggc  atttatgaag  gaagaagaga  tcgatgccgc  ggcgatccag    540
gaatgcagtg  aagaggagga  caggccggtg  gtctccggcc  ccctccccat  gcattgggtg    600
ccggccggac  cggactcccg  cgtccgggag  gataactgtg  cgctggtcct  ggcggaggaa    660
cttcaggccc  tgcagcagga  gtactggtgg  acctggaccg  gagcgaagct  cgggtacgga    720
aaatacaatg  agggtctggc  catcttcagc  cgccgccctg  ttacaggcgc  ggacagtttc    780
tatatttccg  gcgtccggga  cttctccaac  tggaagaccc  ggaaggcgct  ggcggcctgc    840
accgctgacg  ggcctgcctt  tttgagcgtc  cacatgggat  ggtggaatga  tccggaggaa    900
aacttccggg  ggcagatgga  acggctgcag  aaggcgctcc  gcgaaaggaa  gcttcgtccg    960
caggacggtt  ctgacagttt  ccttatggga  gatttcaaca  gtcccgcagc  gatccgcgga   1020
gagggaaggg  acatggtcct  ggacctcggg  tggcgggaca  gttatgagga  tgccgaaata   1080
aaagacagcg  gcatcaccgt  tccgggaaac  atcgacggat  ggagggacgg  tgaacatacg   1140
ggcatgcgcc  tggattatat  ctggaccgca  aaaaggcaca  gggtgcttca  gtcaaaggtg   1200
gtcctgaacg  ggatcagcgg  gccggtgctt  tccgaccatt  tcggagtcct  ggcggtgatc   1260
gaatgaataa  aggagcagac  agcatgagag  aaagtggaat  tcttcttgcc  atcagcagcc   1320
ttccttccga  atacgggatc  ggctgcttca  gcagggaagc  atatgagttt  gcggaccgcc   1380
tttcagaggc  gggccagagt  tactggcaga  tcctgccgct  ggggccggtg  ggatacggag   1440
attcaccgta  ccagtccttc  tccaccttcg  cggcaaccc  ttactacatt  tcacctgaga   1500
cgctggtgga  aaagggatgg  atcactgagg  cggactgccg  cgaagccggc  ctttcttccg   1560
acccgcgcgg  tgtggattac  gtgctgcagt  accaacgccg  ctatgagctg  ctccggaagg   1620
```

FIG. 9C-1

```
cgtacagaaa cagccggatc gaagagaatg agaagttccg ggcgttcacg gagaagacgg     1680
aatggcttcc ggactacgcg ctgttcatgg ctctgaagga agagaacgga ggaaggccct     1740
ggtacgaatg ggaagatccg ctgagactca gggatccgga agccttggcc gcggcgcggg     1800
aacgcctgga ggaaggcatc ggtttctgca gtttcctgca gtttgagttt tacgaagagt     1860
ggatgcagct gaaggactac gtgaaccgga agggaatacg gatcatcgga gacatcccga     1920
tctatgtatc cctggacagt tcagacgtct gggcggatcc ggaacttttc cngctggatg     1980
aaaaccgccg acagaccgcg gcggcgggct gcccgccgga tggcttcagc gctgtgggac     2040
agctctgggg caacccactc tatgactggg actatcacaa aaagacctgt tttgcctggt     2100
ggctgaaacg tcttaaaaac tgctttgata tttatgatgt gatgcggatc gaccatttcc     2160
gcggcttcga tgaatatttt tccattcctg ccggtgcgga ggacgcaaga gcaggccatt     2220
gggagaaggg accggcatg gatctgttcc ggaaggtctc ggaagccttc ccgggacggg     2280
agatcatcgc ggaggatctg gggtatgtga cggacagtgt ccggcagctg gtgaaggaca     2340
gcggctatcc cgggatgaag gtcctggaat ttgcctttga ctcaagagat tccggctgtg     2400
cggaggatta ccttccccac aattacgaaa agaacagtgt ggtctacacc ggcacccatg     2460
acaacgagac ggtgaccggc tggttttccg agggcctgaa gccggaggag aaggaggcag     2520
tcagagacta tttctgcgac catacgactc ccgacgccgg gatgcacata ccctgatct     2580
gcgccgccat gcgaagcgtc agcagactct gcatcatccc catgcaggac cttctggggt     2640
acggaaacga ggcaaggatg aacgctcctt ccacctacgg aaacaactgg aaatggcgtc     2700
ttctgaagga tgaattcgga gagaaggaag tgaagacgct gtatgagatc acgaagcggt     2760
acggaaggat cggaaaatga gaaaagagga nngnnnntnn nnnaanngnn nnntaccnnn     2820
nnnnagnnca ntnannnnnt nnnnnnntnn ttannncnnn ncanngnaat natcnnnnnn     2880
nnnnnnnnnt ntnnnnnnnn nnnnnnnnnn nnnnnnnnnn ncnnngntgt natnnnnnnn     2940
ntnnnnnncn nnancngnnn tnngntntnn tnnnnnnnnn annntnnnnc nnnagtannn     3000
nnnncncntn nnaannnnnn nnnannnnnn tnnnnnnnnn nnnnnnnnan nanannncna     3060
annnntnncn tcgnnnnnnt gnnnnnnnaa tnngnnntnn ntnnnnnnnc nnntnaannn     3120
nntnnttcnn nnnnnnnnnn nnnnnngnnn nnnnngntna nnnnaannnt ntnnaannan     3180
gnnnnannnn annnnngnna nnnnnnnnnn nnnntnnnnn nnnnannnnn nnnnnannnn     3240
nnnnnngnnn nnnnnannnn nnnnnnnnnn nnnnnnnnnn nnnnnnnnnn nnnnnnnnnn     3300
nnnnnnnnnn nnnnnnnnnn nnnnnnnnnn nnnnnnnnnn nnnnnnnnnn gnnnnannnn     3360
nnnnnnnnnn nnnnntnnnn tntnnnntnn nnnnnnncnn nnnnnttntt nnnnngcnnn     3420
nnnnnnannn nnnnngnnnn nnnnnnnnnn nnnnnnnnnn nnnnnnnnna nnnnnnnnnn     3480
nngnnnnnnn nnnnnnagnn ncnnnnnnnn nnnncnnncn nntnnnnnna ntannnnnnn     3540
nnnnnnnnnn nnnnnnnnnn nnnnnnnnnn nnnngnnnc nnnnnnnnnt nnnannnnnc     3600
nnnnnnnncn nnnncnncnn nnnncnnnn nnnnannann ncnnnnnnnn nnnnnnnnnn     3660
nnnnnnnnnn tntntnnnnn nnnnnnnnnn nnnnnnnngn nnnnnnnngn nnnnnnnnan     3720
gnnnnnnnnn nnnnnnnnnn nnnnnnnnnn nnnnnnnnnn tnnnnnnnnn nnnnnnnnnn     3780
nnnnnnnana nnnnnnnnnn nnnnnnnnnn nnnnnnnnnn nnnannnnnn nnnnnnnnnn     3840
nngnnnnnnn nnnnnnnnnn nnncnnnnnn nnnnnnnnnn nnnnnnnnnn nnnnnnnnnn     3900
nnnnnnnnnn nnnnnnannn nnnnnnnnnn nnnnnnnnnn nnnnnnnnnn nnnntnnnnn     3960
nnnnnnnnnn nnnnnnnnnn nnnnngnnnn nnnnnnnnnn                          4000
```

FIG. 9C-2

SEQ ID NO: 3
```
MKKQSNQTVR MATPGQIKDV ISAVVESIPV NNLTYEMAQY FIGRKKWLGT EMKKIFSVDN      60
SHADLIADWQ AFYCGLGIDC DLSGVIIPDD PGGFGRVIIM AQGITPQSGY DLCAKFFPCW     120
KYTDKNLDEV VVSERTAKDV YAIRVRDRVE ADEELRNRSY NDLKRQGIIG ITLEEREIFE     180
LKFFKETAGK HLDIKNWTFC LGSCYDGGNV PSASWRSGEF EVDWCNPGDV FDDLCSRQAV     240
S                                                                    241
```

FIG. 9D

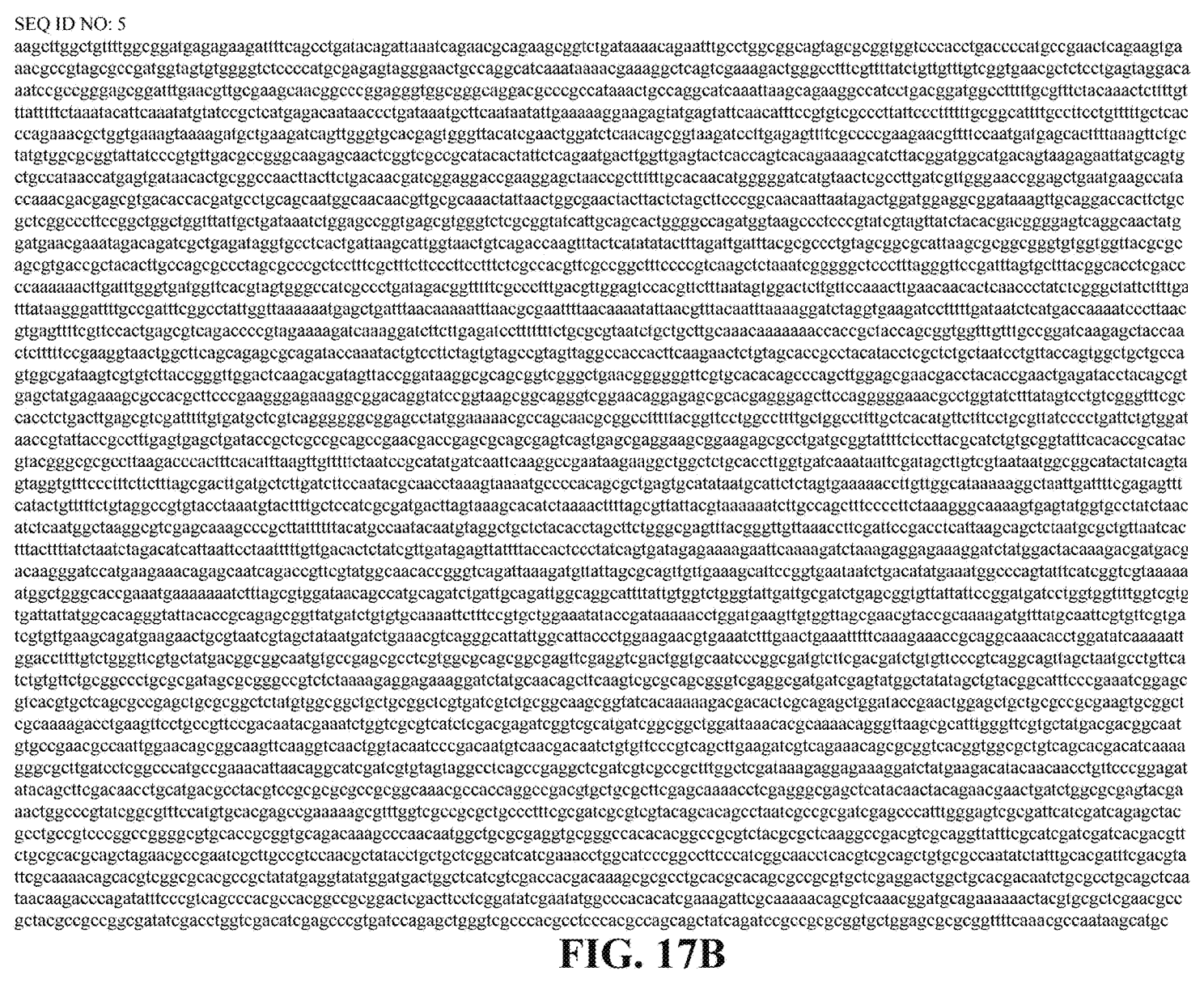

SEQ ID NO: 5 aagcttggctgtttggccggatgagagaagagattttcagcctgatacatcagaacgcagaagcggctcggatcagatttaaatcagataatttcctgccgccgcagtagccgcggtagccggtggtccaccgaccatgccgaactcagaagtga
aacgccgtagccgcgatggtagttggggtctcccatgcggaggaacctgcaggccatcaaaacgaaaggctcagtcgaaagactggccttcgttttatctgttgttgtcggtgaacgctctccgagtaggaca
aaccgccgccggagcggagattgaacgttgcgaagcaacgccggaagcgccgcgaggcgtggccgaccgcccgccataaactgccaggcatcaaattaagcagaaggccatcctgacggatggccttttcggccatttgccttccgttttggctcac
ttattttctaaataccattcaaatatgtatccgtcatgagacaataaccctgataaatgcttcaataatattcaacattccgttcgtcgcctattccctttaatccgtttcgcgcattttgccttccgtttccgattctgtttttcgctcac
ccagaaacgctggtgaaagtaaaagatgctgaagatcagttgggtgcacgagtgggttacatcgaactggatctcaacagcggtaagatcctttgatcaatgacttggttgagtactcaccagtcacagaaaagcatcttacggatggcatgacagtaagagaagattatgcagtg
tatgtggcgcggtattatcccgtgttgacgccgggcaagagcaactcggtcgccgcatacactattctcagaatgacttggttgagtactcaccagtcacagaaaagcatcttacggatggcatgacagtaagagaagattatgcagtg
ctgccataaccatgagtgataacactgcggccaacttacttctgacaacgatcgggaggaccgaaggagctaaccgcttttttgcacaacatgggggatcatgtaactcgccttgatcgttgggaaccggagctgaatgaagccataccaaa
ccaacgacgagcgtgacaccacgatgcctgcagcaatggcaacaacgttgcgcaaactattaactggcgaactacttactctagcttcccggcaacaattaatagactggatggaggcggataaagttgcaggaccacttctgc
gctcggcccttccgctggctggtttattgctgataaatctggagccggtgagcgtgggtctcgcggtatcattgcagcactggggccagatggtaagccctcccgtatcgtagttatctacacgacgggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagctatgaccatgattacgccaagcgcgcaattaaccctcactaaagggaacaaaagctggagctccaccgcggtggcggccgctctagaactagtggatcccccgggctgcaggaattcgatatcaagcttatcgataccgtcgacctcgagggggggcccggtacccagcttttgttccctttagtgagggttaattgcgcgcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggccctttcgtc

FIG. 17B

SEQ ID NO: 6

FIG. 17C

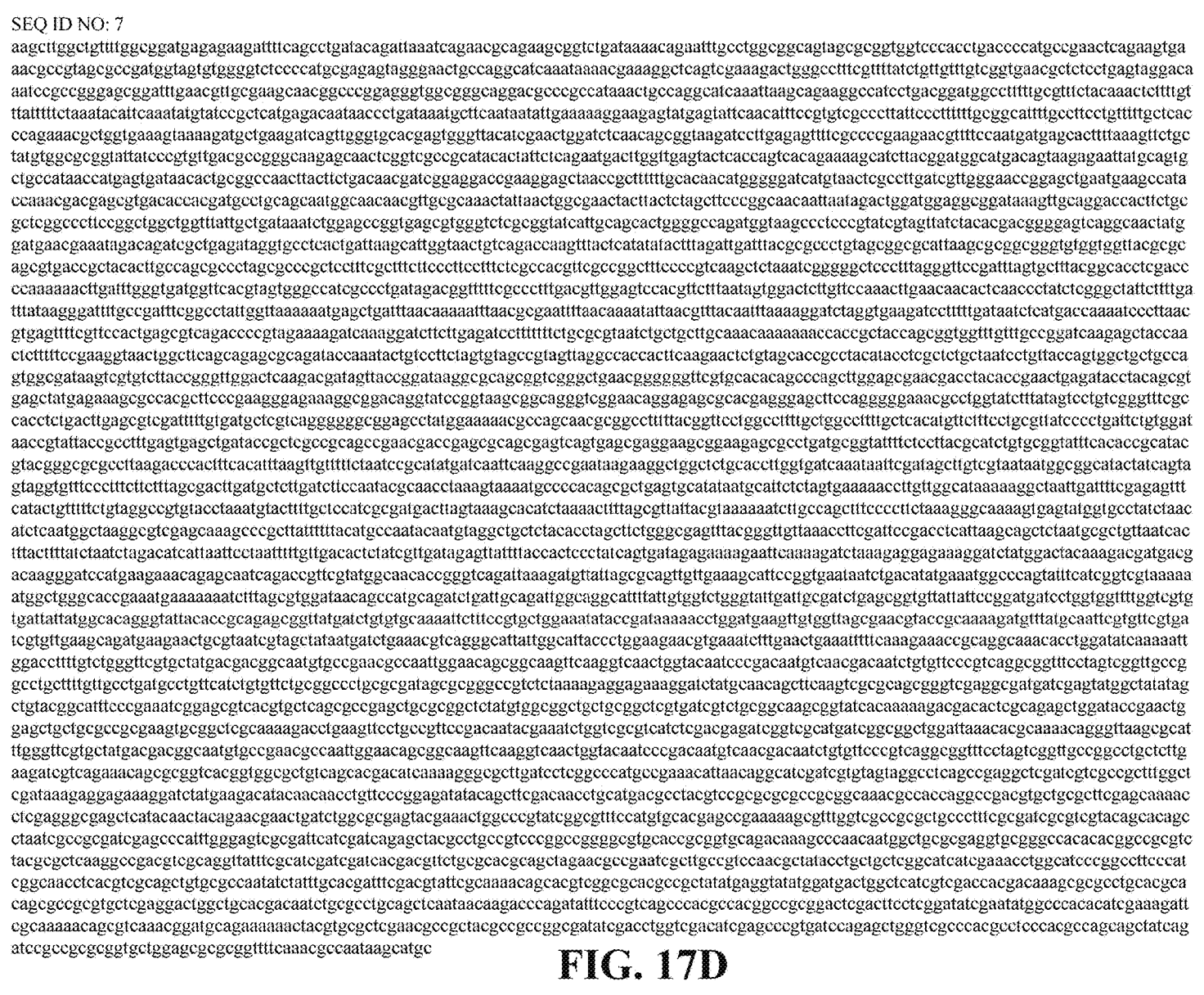

SEQ ID NO: 7 aagcttggctgtttggcggatgagagaagaattttcagcctgatacagattaaatcagaacgcagaagcggtctgataaaaacagaattgcctggcggcagtagctggagttccctcctcgagtaggaca
aacgccgtaggcgccgatggtagtgtgggtctcccatgccaggcaggtagggaactgccaggcatcaaataaaacgaaaggctcagtcgaagactgggccttcgttttatctgttttgtcggttctacaaactctttgt
aatccgccggagcggagccggattgaaccgttgcgaagcaacgcccgagcgccgccataaactgccaggcatcaaattaagcagaaggccatctgacggatggccttttgcggcatttgccttcctgttttgcttcac
ttattttctaaatacattcaaatatgtatccgctcatgagacaataaccctgataaatgcttcaataatattgaaaaaggaagagtatgagtattcaacatttccgtgtcgcccttattccctttttgcggcattttgccttcctgtttttgctcac
ccagaaacgctggtgaaagtaaaagatgctgaagatcagttgggtgcacgagtgggttacatcgaactggatctcaacagcggtaagatcctt...

FIG. 17D

SEQ ID NO: 8 aagcttggctgttttggccgatgagtgagagaagattttcagcctgatacagattaaatcagaacgcagaagyggttctgataaaaacagaatttgcctgtgcggcagtagtcgcggtgggttgtccgcactgacccatgccgaactcagaagtga
aacgccgtagccgcgatggtagtgtggggtctcccgatgcgagagtagtagaggaactgcaggccatcacaataaaacgaaaggctcagtcgaaagactggccttcgtttatcgtgtttgtcggtgaacgctcctcgagtaggaca
aatccgcgcgggaggcgagcgatttgaacgtgcgaagcaacgcccgcgaggtggcggccaggcatcaaattaagcaaagcagaaggccatcctgacggatggccttttgcgtttgccttcctccgtttttgctcac
ttattttctaaatacattcaaatatgtatccgtccatgagacaataacccctgataaaatgcttcaataattagtattcaacattccgtcgccctaattccttttgccgcattttgcggcattttgccttccttgtccctcctgtttttgctcac
ccagaaacgctggtgaaagtaaaagatgctgaagatcagttgggtgcacgagtgtggtttacatcgaactggatcttcaacacgggaactcttgagtgtttcgccccgaagaacgtttccaatgatgagcactttaaagttctgc
tatgtgggcggtattatcccgttgacgccgggcaagagcaactcggtcgccgcatacactatctcagaatgacttggttgagtactcaccagtcacagaaaagcatcttacggatggcatgacagtaagagaattatgcagtg
ctgccataaccatgagtgataaacactgcggccaacttactttgcgcaacgatcggaggaccgaaggagctcaaccgcttttgcacaacatggggatcatgtaactcgccttgatcgttgggaaccggagctgaatgaagccata
ccaaacgacgagcgtgacaccacgatgcctgcagcaatggcaacaacgttgcgcaaactattactggatggaggcggataaagttgcagatcttactgctatatcccaatccccgcatgcgctggtggtatcaatcgctaagctgcc
gctcggcccttccgcggtttattgctgataaatctggagccggtgagcgtggggtctcgcggtatcattgcagcactggggccagatggtaagccctcccgtatcgtagttatctacacgacggggagtcaggcaactatggatgaacgaaata
gatgaacgaaatagacagatcgctgagataggtgcctcactgattaagcattggtaactgtcagaccaagtttactcatatatactttagattgattactttgctacacccctcggttcctcctttactcttcctttacggcactctctcga
agcgtgaccgctacaccgcactgcctctctttcctccactttcgccacgctacgagatggtttcgccacatggctttaatgatggatcaatggctactgaccaagcagtacattagtcaagctgcttacctcctgatctcgggtttcgc
ccaaaaaacttgattttggttctccatatctttggatggcacgagtgcggtcactgcctaaaaagtgctgattactcactttacaaatattggatcaatcaacactcaacactcaccactatctcgggctattctttcctttga
ttttataaggaggttttgcgatttcgcattcggaaagacccgtagaaagatgctttaaccaaataattaacgttacatttaaaatgacttcatttaaaaagatcctttgatatccatcgataatctcatgaccaaaatcccttaac
gtgagttttcgttccactgagcgtcagaccccgtagaaaaagatcaaaggatcttcttgagatccttttttttctgcgcgtaatctgctgcttgcaaacaaaaaaaccaccgctaccagcggtggtttgtttgccggatcaagagctaccaa
ctcttttccgaaggtaactggcttcagcagagcgcagataccaaatactgttcttctagtgtagccgtagttaggccaccacttcaagaactctgtagcaccgcctacatacctcgctctgctaatcctgttaccagtggctgctgccca
gtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgt
gagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgc
cacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggat
aaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaccgatcat
gtacgggccgcctttaagccctttagggttccgatttagtgctttacgggcacctcgacccatcatttaagcatttctttaatatggctcataacaccccttgtattactgtttatgtaagcagacagttttattgttcatgatgatatatttttatctt
gtgaatgttcttccttttccttttcctttagcggctacctttgacctttacttatttctactgtctcacctttctgctttttgcgtcatggtaaagatgctaagagtagttgaaacctgataaagagtggtgcctactctaac
catcgttttttctgctgctgaggcctgcctccgaaggccgttttattcttttttacatgccaataacatgagtgctgtctacacctctcagattcttctctacaccctactctgtcggcaatataccatagagactgataggtctaatgcg
ttacttttaatcctactactatcaattttttgttggcactcctattcttgtaggtatcttacactctctatctctattgttttttacagtatgtagctgtctattccggcaatttctttccgttggctttctatacctgtctaaggctcaggcctctgagg
acaaggcgatttgaagaaacagagcaatcagactggcccgcagttatgagctgagtttacacttatttcctgacacctcagatataatatatcagcttagatagtgcaattgggccgagtttagtaatatatttagctggctctatagcttaatctaa
atgggcggcggcaccgaatttgaaaaaacttcatgctgccgacattagggtgagtttagggctctataattctcactcctcctctgcgttatctgtccctgcggagtataggtaagcaaagtggagcatttatttctcaaattcccgcatattccctagctgcttagctg
tgatttattaagcacaggtcgatccgcagaggcccgggcgagagttaattttgcggcgagttctgtccaatctcaaagccggcctttgtgccggcacggcttggtttgtccgagttacctctctgtatataggctgggtttaggtt
tcgtgttttcgctcggcttcgagagaggcgcggcgaggttgcgggtgtctagcagttcctgtccaccttcaatatcggctattttctgggttaaatcgagttctgggcgacggagttacctctgctctttcctcagatggcttattcagcacagt
catcgtgtcttcgcggcctgcggagacattgctaaagttcctggcggccctgagtagacagatctagaaaagagggtaatactggctgggatacgctctctgggtgggtttgcgctgagcttgctcgagcactgggggaagttgatatcgataaatgct
ggtcacggtgctctcagcggcgccgagtcgatcggctcatgtggtcgcttcaaacgtggctctcgcgtatcatccgacagtcgggatctctggagttcgttcacctgatctgcagaaagaagctgcagacctgcaagaagaaagtgcggaagttgg
ctcgcaaaagtggctctcgacatcggacgtttcctgccggttaccgaccaccatgccaatgctggctcgtgtagctgtaggaaaacacgggattaagacttaacaccgttcggttcttcgtatcgggtgctctatggcagcgcaa
tgtgccgaacgccaatgtgccaaggttcaaggtccacctgaccggctacaatcagtatcaatgcatacacagtgggttctgccgaattccgcacacagctctaatcgcatctcgccacacggctgctcatcagcaccataagagctcagccgga
aaagccgcttgaactgcacgatttggttgcagtttggacgacttcacaggggtaggccggttggaagcaaggtggatgactacaaagacgatgacgac
gatacagcttcgacaatctcggcatgctgacttaccggtgagcgagccggtcgaggcatcacaaccagaggtcgccacagcggagtcatacagcaacacgttcccgga
gaaactggccctatcgcgtttcatgcagcaggagaacagcccctttgctcgggcggttgcaccactgctggctcatcggctgtcatcggtctgggagcgagtctcgatcatcgtcatcgatcagagct
acgctcgcacgcagactagaaccgctttgcttgccaacgccaaagccgctccaacctcacgctgccacctcacgctcgccacatcgaaagttgcccacacatcgaaagttgcccacacatcgaaatattgccctcctcgattcgac
gttctgccacgcagtcagagctcagatcggctcgccacccaacgccgcaacctcacggtctgctctcgccacgctggtgtctcgaggactggctgcaggctgcagcagtcgccgcagatccccgtgctcgaggactggctgcctggaagct
gtcattaacacgacccagatattccgtccggcgtatatgccacgagccctccgaaacattgccccacatcgaatatgccccacaccgaatatgccccacacggaagttgcgcgagcacatcgcaacaccgtgctctcgaac
gccgctacgccgcggccgatattgacaatctcggccgattccgacagccccgttgatcccagcgtatcagacatcccgccacgctccccacgctcgccgattcagcagcgccggttgttgctgaagtgctgagcgccgctttcaacgccaataagcaatg
c

FIG. 17E

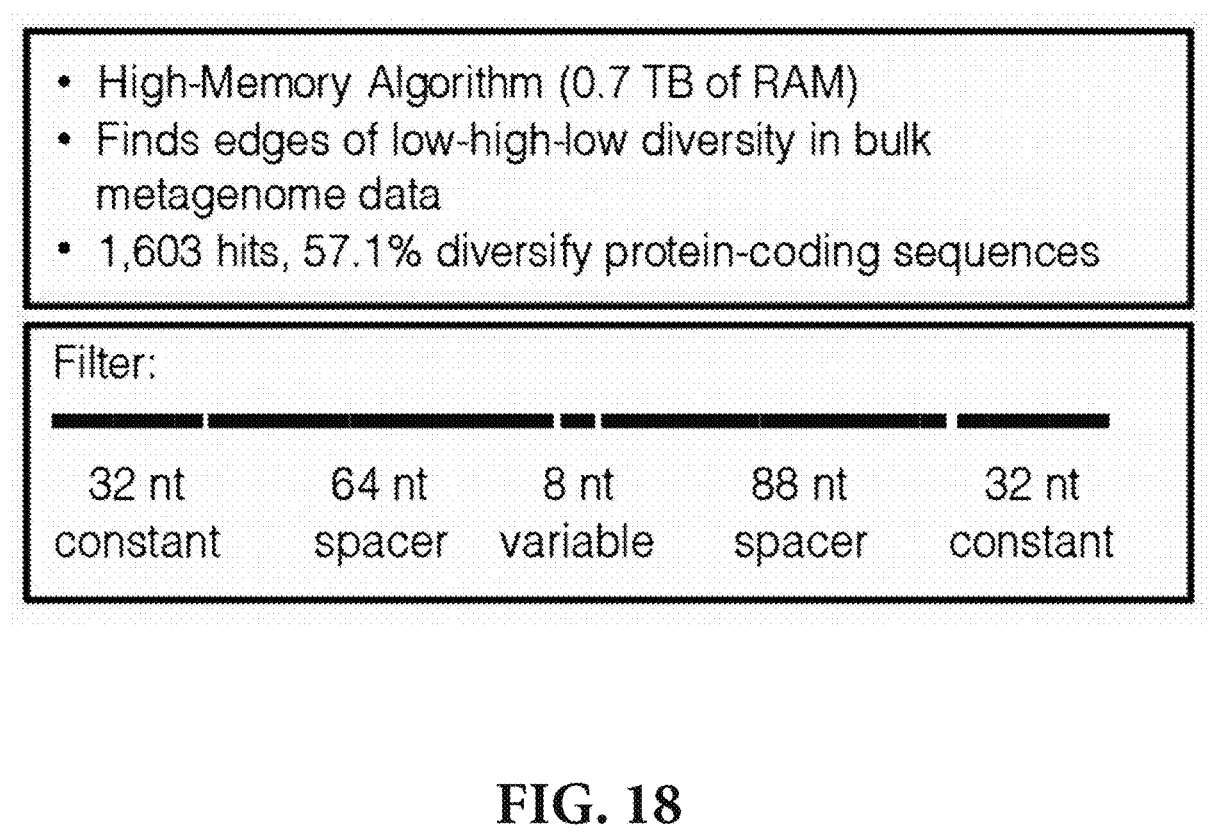

- High-Memory Algorithm (0.7 TB of RAM)
- Finds edges of low-high-low diversity in bulk metagenome data
- 1,603 hits, 57.1% diversify protein-coding sequences Filter:

| 32 nt constant | 64 nt spacer | 8 nt variable | 88 nt spacer | 32 nt constant |

FIG. 18

SELF-DIVERSIFYING SYSTEMS AND METHODS OF USE THEREOF

CROSS-REFERENCE TO RELATED APPLICATIONS

This application claims the benefit of U.S. Provisional Application Nos. 62/862,522, filed Jun. 17, 2019 and 62/912,602, filed Oct. 8, 2019. The entire contents of the above-identified applications are hereby fully incorporated herein by reference.

STATEMENT REGARDING FEDERALLY SPONSORED RESEARCH

This invention was made with government support under Grant Nos. MH110049 and HL 141201 awarded by the National Institutes of Health. The government has certain rights in the invention.

REFERENCE TO AN ELECTRONIC SEQUENCE LISTING

The contents of the electronic sequence listing ("BROD_4170US_ST25.txt"; Size is 19,914,482 bytes and it was created on Aug. 12, 2025) is herein incorporated by reference in its entirety.

TECHNICAL FIELD

The subject matter disclosed herein is generally directed to self-diversifying elements and methods of use thereof.

BACKGROUND

Bacteria and virus actively diversify their proteins and nucleic acids to adapt to changing environment. Such diversity mechanisms can be used to generate libraries of diversified molecules. Such molecules may be used for screening novel binding partners for antigens, pathogens, and other types of target molecules. However, there is a need for systems and methods for generating diversified molecules with high efficiency and sufficient degree of diversity.

SUMMARY

In one aspect, the present disclosure provides a self-diversifying system comprising a polynucleotide encoding one or more open reading frames that encode a diversified molecule, the diversified molecule comprising one or more variable regions, wherein the system is configured to generate a library of diversified molecules with an efficiency of at least 80% as measured by a number of the diversified molecules in a total number of molecules in the library.

In some embodiments, the polynucleotide further comprises a template region. In some embodiments, the self-diversifying system is a diversity generating retroelement (DGR) system. In some embodiments, the self-diversifying system is a non-DGR system. In some embodiments, the system further comprises a reverse transcriptase or functional domain thereof. In some embodiments, the polynucleotide comprises a sequence selected from SEQ ID NOs: 98-1699. In some embodiments, the sequence encodes c-type lectin fold or a fragment thereof. In some embodiments, the sequence encodes a protein or polypeptide capable of binding to a protein or a nucleic acid. In some embodiments, the variable region and the template region have a sequence homology of less than 80%. In some embodiments, the polynucleotide further comprises a regulatory sequence. In some embodiments, the regulatory sequence comprises one or more ribosomal binding sites. In some embodiments, the regulatory sequence comprises an inducible promoter. In some embodiments, the diversified molecules are proteins. In some embodiments, the diversified molecules are polynucleotides. In some embodiments, the sequence encodes DIV1 or a fragment thereof. In some embodiments, the sequence encodes DIV18 or a fragment thereof. In some embodiments, the sequence encodes a protein from Table 1 or the sequence is from Table 2. In some embodiments, the diversified molecules comprise one or more binding partners of a target molecule. In some embodiments, the target molecule is a protein. In some embodiments, the target molecule is an antigen. In some embodiments, the target molecule is a polynucleotide. In some embodiments, the system generates the library of diversified molecules when introduced to cells. In some embodiments, the variable region is within an open reading frame. In some embodiments, the system comprises a vector comprising the polynucleotide. In some embodiments, the system comprises a vector comprising the polynucleotide and a nucleic acid sequence encoding the reverse transcriptase. In some embodiments, the reverse transcriptase is error prone.

In another aspect, the present disclosure provides a method of generating a library of diversified molecules, comprising introducing the system herein in cells, wherein the system generates the library of diversified molecules in the cells. In some embodiments, the method generates the library of diversified molecules with an efficiency of 80%. In some embodiments, the cells are *E. coli* cells. In some embodiments, expression of Mutator S and/or Exodeoxyribonuclease 10 are reduced or depleted in the cells.

In another aspect, the present disclosure provides a method of identifying a diversity-generating system comprising a). identifying loci with higher diversity in contigs larger than 1 kb in a database; b). selecting contigs comprising the identified loci in a), wherein each selected contig comprises a sequence encoding a polypeptide of least 100 amino acids; and c). expressing polynucleotides comprising at least a portion of the polypeptide-encoding sequence in the selected contigs from b) in cells, thereby confirming self-diversifying function of the polynucleotides. In some embodiments, the database is a metagenome database. In some embodiments, the contigs in a) are larger than 3 kb.

In another aspect, the present disclosure provides a method of screening binding partners of a target molecule, comprising a). obtaining of a library of diversified molecules using the system herein; b). performing one or more assays to determine interaction between the diversified molecules and the target molecule; and c). selecting a subset of the diversified molecules based on results of the one or more assays. In some embodiments, the one or more assay comprise phage display, toxin inhibition assay, toxin survival assay, bacterial surface display, bacterial two-hybrid display assay, an enzyme-linked immunosorbent assay (ELISA), immunoprecipitation assay, or a combination thereof. In some embodiments, the target molecule is an antigen.

These and other aspects, objects, features, and advantages of the example embodiments will become apparent to those having ordinary skill in the art upon consideration of the following detailed description of illustrated example embodiments.

BRIEF DESCRIPTION OF THE DRAWINGS

An understanding of the features and advantages of the present invention will be obtained by reference to the following detailed description that sets forth illustrative embodiments, in which the principles of the invention may be utilized, and the accompanying drawings of which:

Figure 5A:
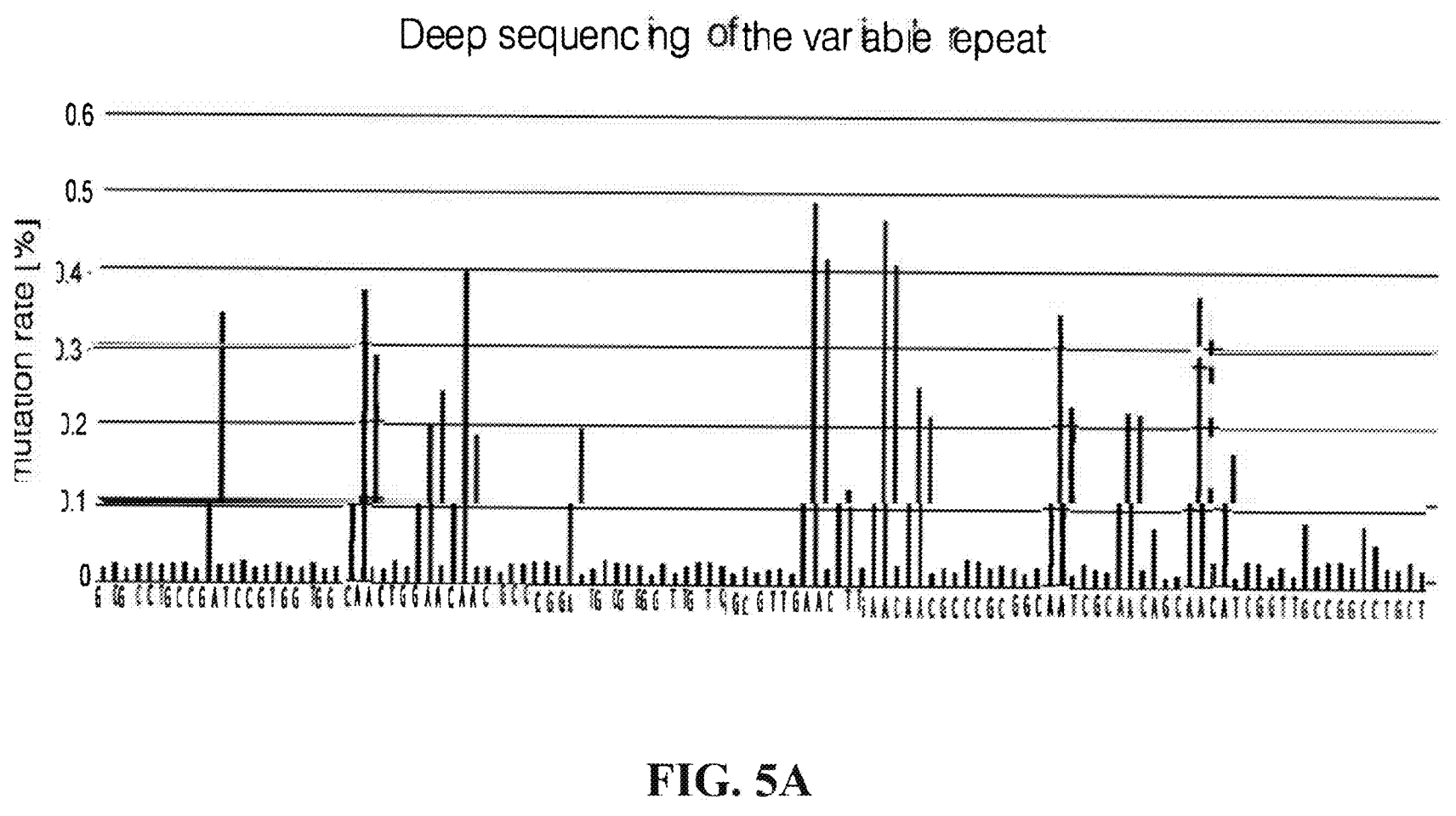
Figure 5C:
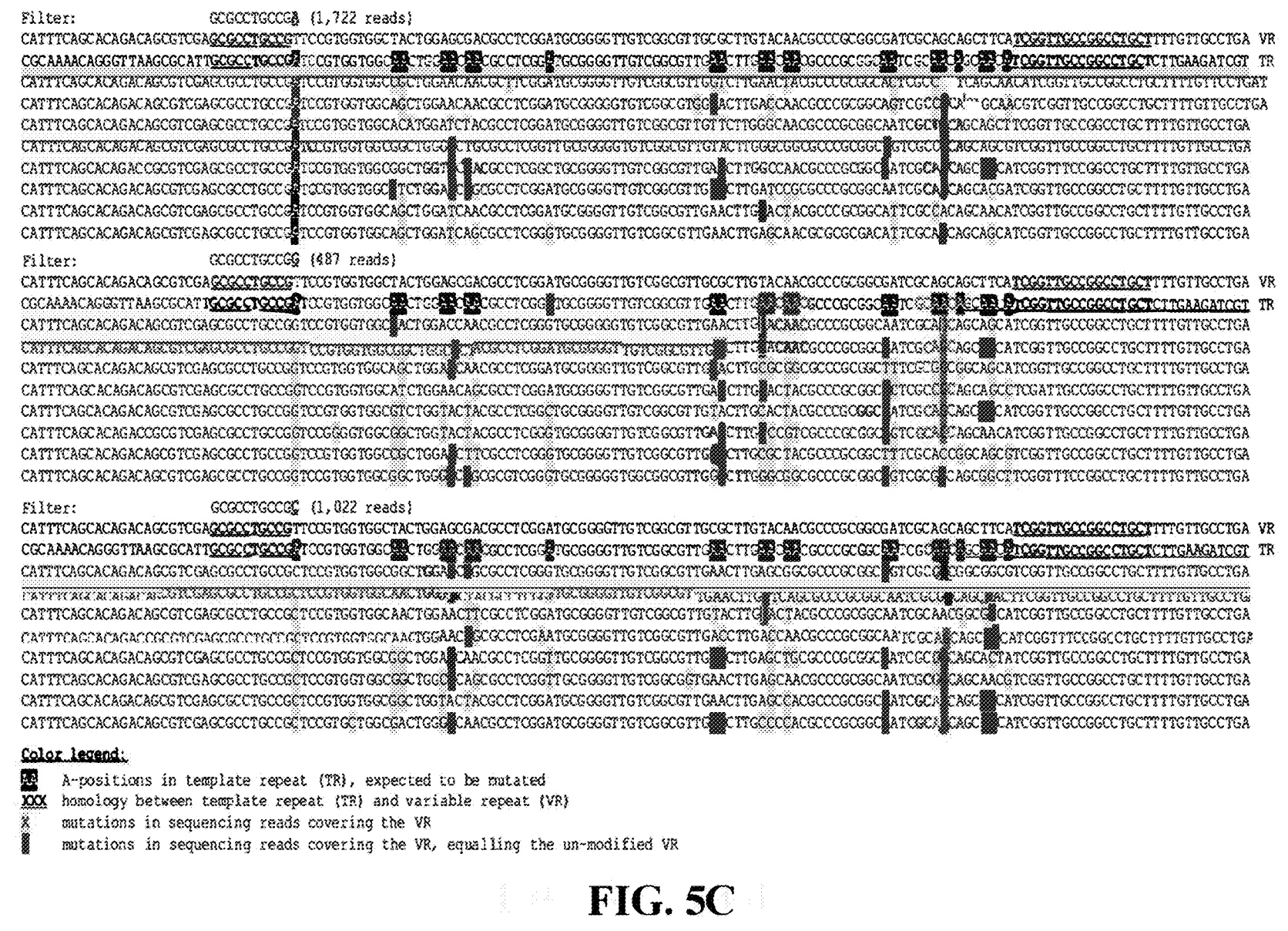
Figure 5D:
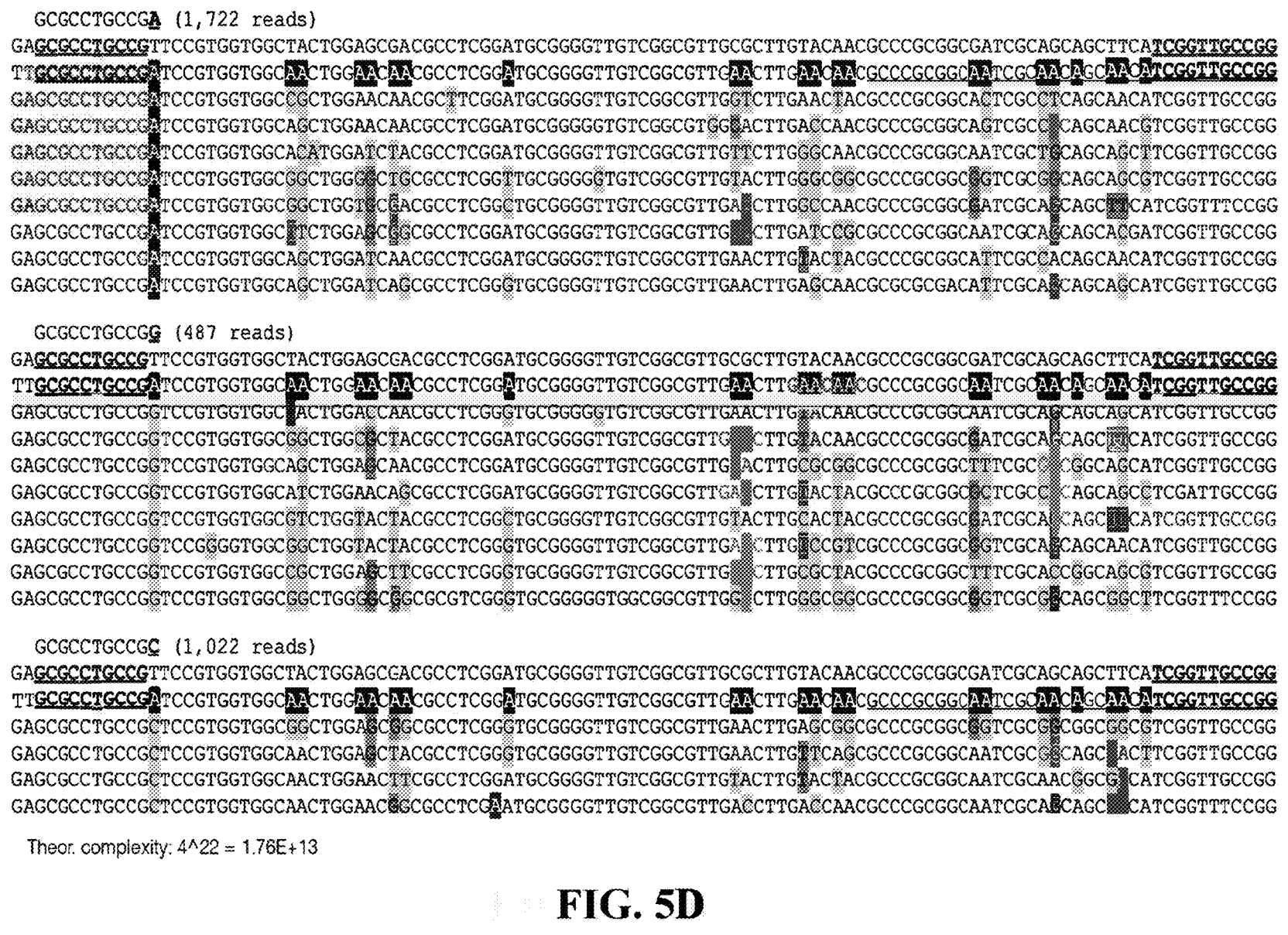

FIGS. 5A-5D show results from testing the selected diversity-generating system (SEQ ID NOs: 9-73).

FIGS. 6A-6C show the DIV1 sequence (SEQ ID NO: 3) and tested characteristics.

FIGS. 7A and 7B show the DIV18 sequence (SEQ ID NO: 4) and tested characteristics.

FIGS. 17A-17E show various constructs derived from Hit 214 and those components sufficient to drive self-diversification after 24 hrs (SEQ ID Nos: 5-8).

FIG. 18 shows an example search strategy for diversity generating systems.

Figure 1A:
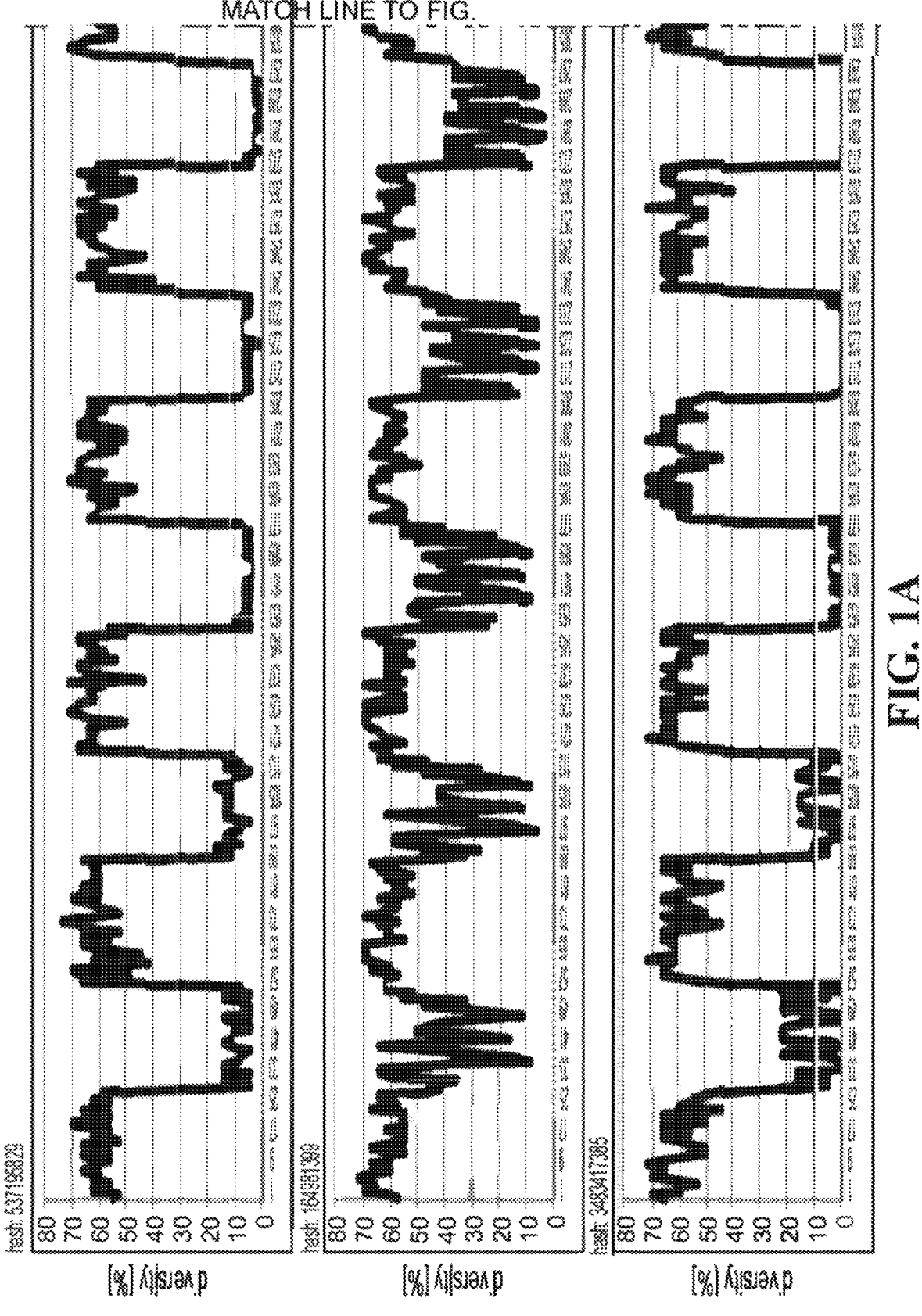
FIGS. 1A-1D show results from identifying potential diversifying systems from metagenome database (SEQ ID NOs: 98-1699).
Figure 1B:
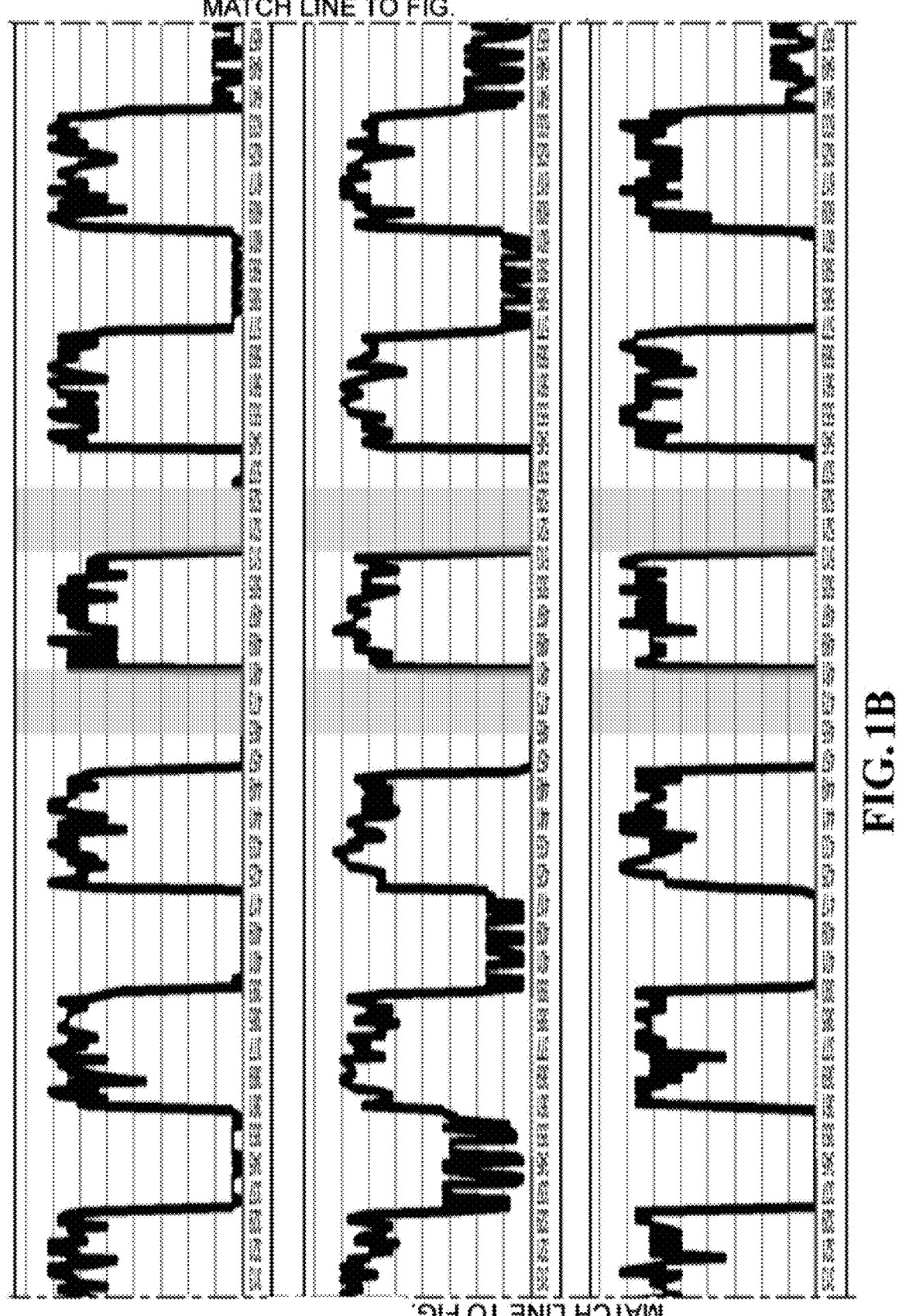
Figure 1C:
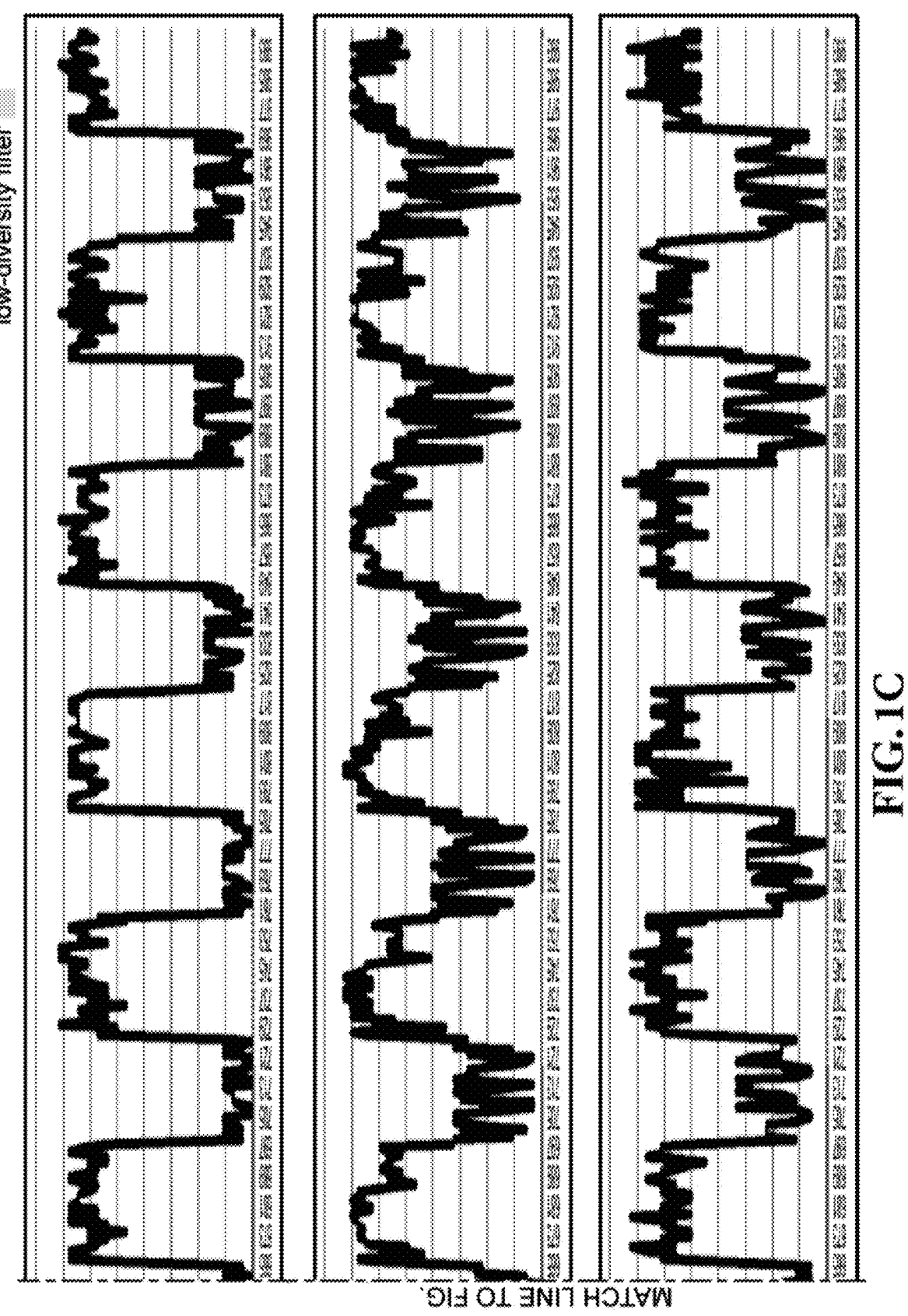
Figure 1D:
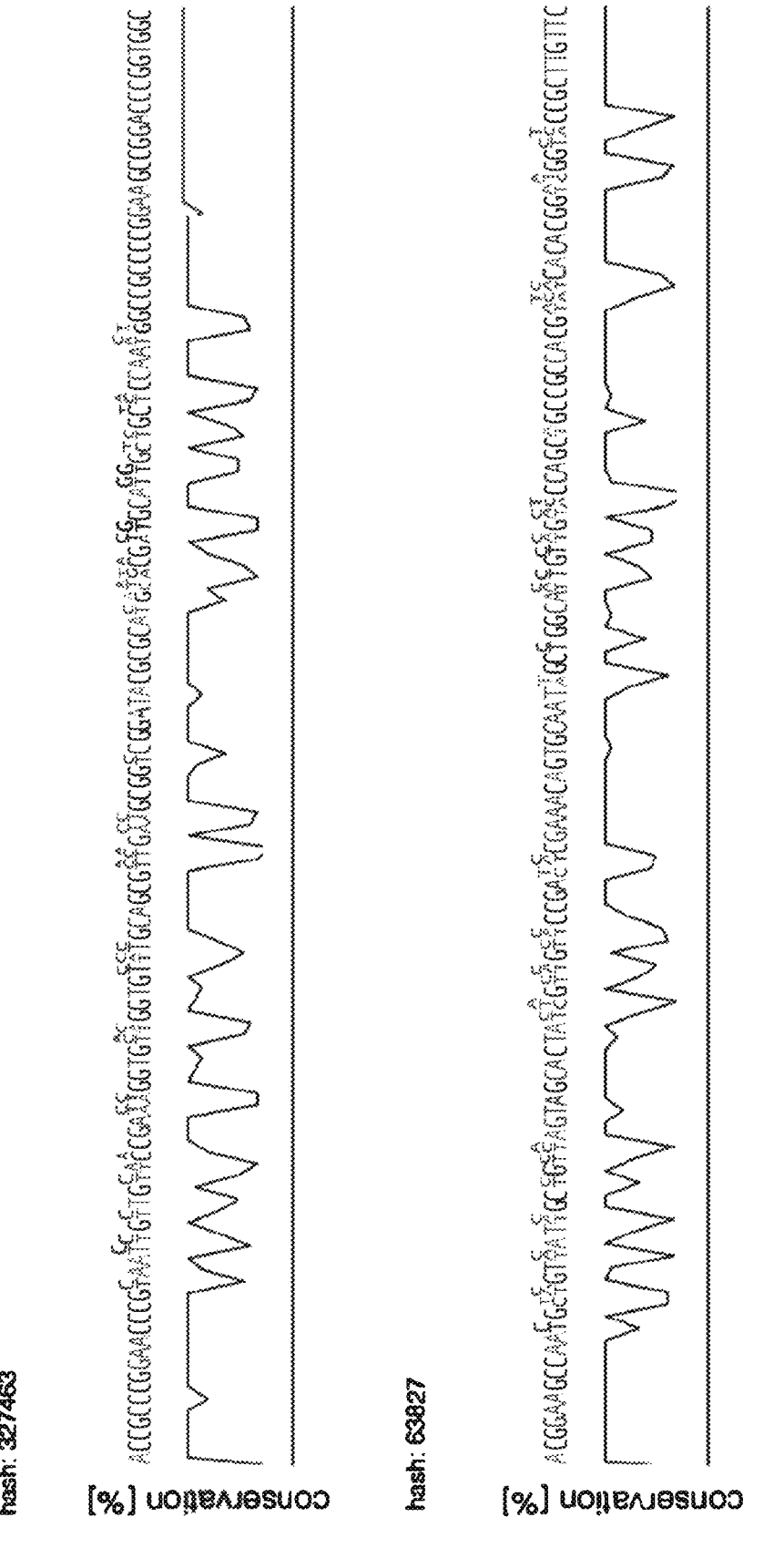

The figures herein are for illustrative purposes only and are not necessarily drawn to scale.

DETAILED DESCRIPTION OF THE EXAMPLE EMBODIMENTS

General Definitions

Unless defined otherwise, technical and scientific terms used herein have the same meaning as commonly understood by one of ordinary skill in the art to which this disclosure pertains. Definitions of common terms and techniques in molecular biology may be found in Molecular Cloning: A Laboratory Manual, $2^{nd}$ edition (1989) (Sambrook, Fritsch, and Maniatis); Molecular Cloning: A Laboratory Manual, $4^{th}$ edition (2012) (Green and Sambrook); Current Protocols in Molecular Biology (1987) (F. M. Ausubel et al. eds.); the series Methods in Enzymology (Academic Press, Inc.): PCR 2: A Practical Approach (1995) (M. J. MacPherson, B. D. Hames, and G. R. Taylor eds.): Antibodies, A Laboratory Manual (1988) (Harlow and Lane, eds.): Antibodies A Laboratory Manual, $2^{nd}$ edition 2013 (E.

A. Greenfield ed.); Animal Cell Culture (1987) (R. I. Freshney, ed.); Benjamin Lewin, Genes IX, published by Jones and Bartlet, 2008 (ISBN 0763752223); Kendrew et al. (eds.), The Encyclopedia of Molecular Biology, published by Blackwell Science Ltd., 1994 (ISBN 0632021829); Robert A. Meyers (ed.), Molecular Biology and Biotechnology: a Comprehensive Desk Reference, published by VCH Publishers, Inc., 1995 (ISBN 9780471185710); Singleton et al., Dictionary of Microbiology and Molecular Biology 2nd ed., J. Wiley & Sons (New York, N.Y. 1994), March, Advanced Organic Chemistry Reactions, Mechanisms and Structure 4th ed., John Wiley & Sons (New York, N.Y. 1992); and Marten H. Hofker and Jan van Deursen, Transgenic Mouse Methods and Protocols, $2^{nd}$ edition (2011).

As used herein, the singular forms "a", "an", and "the" include both singular and plural referents unless the context clearly dictates otherwise.

The term "optional" or "optionally" means that the subsequent described event, circumstance or substituent may or may not occur, and that the description includes instances where the event or circumstance occurs and instances where it does not.

The recitation of numerical ranges by endpoints includes all numbers and fractions subsumed within the respective ranges, as well as the recited endpoints.

The terms "about" or "approximately" as used herein when referring to a measurable value such as a parameter, an amount, a temporal duration, and the like, are meant to encompass variations of and from the specified value, such as variations of +/−5% from the specified value, insofar such variations are appropriate to perform in the disclosed invention. It is to be understood that the value to which the modifier "about" or "approximately" refers is itself also specifically, and preferably, disclosed.

As used herein, a "biological sample" may contain whole cells and/or live cells and/or cell debris. The biological sample may contain (or be derived from) a "bodily fluid". The present invention encompasses embodiments wherein the bodily fluid is selected from amniotic fluid, aqueous humour, vitreous humour, bile, blood serum, breast milk, cerebrospinal fluid, cerumen (earwax), chyle, chyme, endolymph, perilymph, exudates, feces, female ejaculate, gastric acid, gastric juice, lymph, mucus (including nasal drainage and phlegm), pericardial fluid, peritoneal fluid, pleural fluid, pus, rheum, saliva, sebum (skin oil), semen, sputum, synovial fluid, sweat, tears, urine, vaginal secretion, vomit and mixtures of one or more thereof. Biological samples include cell cultures, bodily fluids, cell cultures from bodily fluids. Bodily fluids may be obtained from a mammal organism, for example by puncture, or other collecting or sampling procedures.

The terms "subject," "individual," and "patient" are used interchangeably herein to refer to a vertebrate, preferably a mammal, more preferably a human. Mammals include, but are not limited to, murines, simians, humans, farm animals, sport animals, and pets. Tissues, cells and their progeny of a biological entity obtained in vivo or cultured in vitro are also encompassed.

The term "exemplary" is used herein to mean serving as an example, instance, or illustration. Any aspect or design described herein as "exemplary" is not necessarily to be construed as preferred or advantageous over other aspects or designs. Rather, use of the word exemplary is intended to present concepts in a concrete fashion.

Various embodiments are described hereinafter. It should be noted that the specific embodiments are not intended as an exhaustive description or as a limitation to the broader aspects discussed herein. One aspect described in conjunction with a particular embodiment is not necessarily limited to that embodiment and can be practiced with any other embodiment(s). Reference throughout this specification to "one embodiment", "an embodiment," "an example embodiment," means that a particular feature, structure or characteristic described in connection with the embodiment is included in at least one embodiment of the present invention. Thus, appearances of the phrases "in one embodiment," "in an embodiment," or "an example embodiment" in various places throughout this specification are not necessarily all referring to the same embodiment, but may. Furthermore, the particular features, structures or characteristics may be combined in any suitable manner, as would be apparent to a person skilled in the art from this disclosure, in one or more embodiments. Furthermore, while some embodiments described herein include some but not other features included in other embodiments, combinations of features of different embodiments are meant to be within the scope of the invention. For example, in the appended claims, any of the claimed embodiments can be used in any combination.

All publications, published patent documents, and patent applications cited herein are hereby incorporated by reference to the same extent as though each individual publication, published patent document, or patent application was specifically and individually indicated as being incorporated by reference.

Overview

The present disclosure provides engineered self-diversifying systems. A self-diversifying system comprises a self-diversifying polynucleotide. The self-diversifying polynucleotide may encode one or more open reading frames. At least one of those open reading frames may encode a self-diversifying element. The diversifying element may be a sequence or structural feature encoded by the self-diversifying polynucleotide that leads to generation of multiple sequence variants ("diversified molecules") from the self-diversifying polynucleotide. While the process of generating diversified molecules from a self-diversifying system may comprise processes like transcription or replication of the self-diversifying molecule, such processes are not necessarily limited to canonical replication or expression of a gene. For example, processing may refer to expression of a RNA transcript of the self-diversifying polynucleotide that may then be reverse transcribed. During the reverse transcription process, the self-diversifying element(s) may dictate a type or frequency of mutation resulting in a population of cDNAs generated. The diversified molecules may comprise such a population of cDNAs or polynucleotide or polypeptides expressed from such cDNAs. In yet other embodiments, diversified molecules may arise when such intermediate molecules, such as the aforementioned cDNAs, are re-incorporated into copies of the original self-diversifying polynucleotide. Thus, in certain example embodiments, diversified molecules may refer to a population of self-diversifying molecules that have gone through a process resulting in incorporation of variable sequences at one or more defined location in the self-diversifying polynucleotide sequence. In such contexts, the self-diversifying element may comprise multiple components, for example, a region that leads to generation of multiple sequence variants and a second component that defines where such sequence variants, once generated, are incorporated back into copies of the original self-diversifying polynucleotide. The systems described herein may comprises homologous engineered systems that incorporate self-diversifying elements arising from different naturally occurring systems or comprise naturally occurring systems that have been further engineered to increase the efficiency of self-diversification or increase the number of self-diversifying elements.

The systems herein may comprise one or more polynucleotides. As used herein, a polynucleotide may be DNA, RNA, or a hybrid thereof, including without limitation, cDNA, mRNA, genomic DNA, mitochondrial DNA, sgRNA, siRNA, shRNA, miRNA, tRNA, rRNA, snRNA, lncRNA, and synthetic (such as chemically synthesized) DNA or RNA or hybrids thereof. Nucleic acids can include natural nucleotides (such as A, T/U, C, and G), modified nucleotides, analogs of natural nucleotides, such as labeled nucleotides, or any combination thereof. In some examples, the polynucleotides may DNA. In some examples, the polynucleotides may be RNA.

The diversified molecules may be encoded by one or more open reading frames within the self-diversifying system. In certain cases, the polynucleotide may comprise one or more open reading frames or transcripts thereof. When the polynucleotide comprises multiple open reading frames, the orientations of the open reading frames may be the same.

The self-diversifying system may further comprise one or more additional open reading frames that encode accessory polynucleotides or polypeptides. An accessory polynucleotide or polypeptide may be a polynucleotide or polypeptide that when expressed is involved in processing or generating sequence variants of the diversified molecules. Example accessory polyproteins include, but are not limited to, reverse transcriptases, phage replisome organizers, histone-family DNA-binding proteins, endonuclease, exonucleases, phosphatases, or functional fragments thereof.

The self-diversifying system may further encode one or more regulatory elements such as one or more promoters and/or one or more ribosome binding sites that control expression of the one or more diversified molecules and/or one more accessory polynucleotides or polypeptides.

In some embodiments, the systems and methods allow for generation of diversified molecules with an efficiency at least about 5%, at least about 10%, at least about 20%, at least about 30%, at least about 40%, at least about 50%, at least about 60%, at least about 70%, at least about 80%, at least about 90%, at least about 95%, e.g., as measured by number of diversified molecules in the total number of molecules generated by the self-diversify system.

In certain example embodiments, the self-diversifying system may be based on one or more systems disclosed in SEQ ID NOs: 98-1699, or fragments of the sequences. That is, self-diversifying systems disclosed herein encompass both engineered variants of the example systems disclosed in SEQ ID NOs: 98-1699, or fragments of the sequences, or engineered variants comprising components combined from one or more example systems disclosed in SEQ ID NOs: 98-1699, or fragments of the sequences.

In some examples, such systems may be used for generating universal peptides or protein binders that can be quickly adapted for any given protein targets could replace antibody technology. The production of the diversified molecules may be scalable to allow for generating large repertoires of protein binders, with potential to transform biological research and peptide-based therapeutics, such as antibodies and vaccines.

Diversity Generating Retroelement-Based Systems

In certain example embodiments, the system may comprise one or more components of a diversity generating retroelement (DGR). In certain example embodiments, the self-diversifying system may comprise one or more open reading frames encoding one or more diversified molecules.

The system may further comprise one or more open reading frames encoding an accessory protein. The system may further encode one or more ribosome binding sites. The system may further encode one or more promoters. The diversified molecule and accessory protein open reading frames may be under the control of the same or different open reading frames.

Variable Regions

The one or more diversified proteins and/or their coding polypeptide may comprise one or more variable regions or variable repeats (VR). The variable region dictates one or more locations with the diversified molecule where sequence diversity is generated. The sequence diversity may be generated within the variable region, adjacent to the variable region, or both. The polynucleotide may comprise one or more, e.g., 1, 2, 3, 4, 5, 6, 7, 8, 9, 10, or more variable regions.

The variable region may encode or may be within a coding sequence for a peptide that is capable of binding to another molecule (e.g., proteins, nucleic acids, etc.). Alternatively or additionally, the variable region may encode or may be within a coding sequence for a polynucleotide (e.g., RNA) that is capable of binding to another molecule (e.g., proteins, nucleic acids, etc.).

Template Region

The DGR-based system may further comprise a template region or template repeat (TR). The template repeat may dictate the type and frequency of sequence variants generated within a variable region of the diversified molecules. For example, when transcribed, the template molecule (or cDNA variant thereof) may be integrated into the diversified molecule and certain nucleotides within the template region subject to mutagenesis by the incorporation of the random nucleotides across from certain nucleotides within the template molecule. For example, all adenosines (As) in the template molecule may be subject to mutagenesis by incorporation of random nucleotides opposite the A when the template molecule is integrated into the variable region. Likewise, mutagenesis may occur at T, G, or C nucleotides or at certain nucleotide motifs within the template region. This process may be referred to as mutagenic homing.

The template region may be transcribed into a RNA molecule. The RNA molecule may be reverse transcribed to a population of DNA templates. The reverse transcription may be error prone, e.g., the DNA templates may comprise one or more mutations compared to the original template region. The DNA templates may insert to or replace a sequence the variable region, thus introducing various mutations into the variable region.

The template region may have certain level of homology with the variable region. The term "homology" can refer to the number of positions with identical nucleotides or amino acids divided by the number of nucleotides or amino acids in the shorter of the two sequences wherein alignment of the two sequences can be determined in accordance with the Wilbur and Lipman algorithm (Wilbur & Lipman, Proc Natl Acad Sci USA 1983; 80:726, incorporated herein by reference). For example, the homology between the template region and the variable region may be at most 90%, at most 80%, at most 70%, at most 60%, at most 50%, at most 40%, at most 30%, or at most 20%. In certain examples, the homology between the template region and the variable region may be at most 80%.

The template region may comprise one or more adenines. In some cases, the one or more adenines are not found in the variable region. Such adenines may result in mutagenesis or diversification of corresponding positions in the variable region. In certain cases, the template region may comprise one or more insertions of nucleotides (e.g., adenines) compared to the corresponding variable region. In some examples, the template region may comprise at least 1, at least 2, at least 3, at least 4, at least 5, at least 6, at least 7, at least 8, at least 9, at least 10, at least 11, at least 12, at least 13, at least 14, at least 15, at least 16, at least 17, at least 18, at least 19, or at least 20 nucleotides inserted. The insertion of additional nucleotides may maintain the correct reading frame. As a non-limiting example, groups of three nucleotides (including one or more adenines) may be inserted in-frame into the template region to direct the insertion of a variable codon into the variable region.

In some embodiments, the diversification may be based upon non-adenine substitutions of nucleotides in the template region. For example, a nucleotide in the template region may be substituted with a non-adenine nucleotide such that the substitution is transferred to the corresponding position in variable region. As a non-limiting example, a cytosine (C) to guanine (G) substitution in a template region can be used to result in the same C to G substitution in the variable region. This may be referred to as substitution-mediated diversification.

In some embodiments, a variable region and a template region are comprised of a polynucleotide. The variable region and the template region may be operably linked. An operable linkage between a variable region and a template may refer to the ability of the template region to serve as the template for directional, site-specific mutagenesis or diversification of the sequence in the variable region. Thus in one example embodiment, a recombinant nucleic acid molecule may comprise a template region and a variable region that are physically attached in cis (in the same molecule such as polynucleotide) such that the template region serves as the template sequence to direct site-specific mutagenesis in the variable region. The separation between the template region and variable region may be of any distance so long as they remain operably linked.

In certain embodiments, the template region and variable region may not be linked on the same molecule. In such cases, however, the template region may still have the ability to direct site specific mutagenesis of the variable region. Thus the template region and variable region may be operably linked in trans, such that the sequences of each region are present on separate nucleic acid molecules The variable region (when on a polynucleotide) and template region may be physically and operably linked in cis or operably linked in trans. The separation between the two regions when linked in cis can range from about 100 base pairs to about 2000 base pairs, e.g., from about 100 to 300, from about 200 to about 400, from about 300 to about 500, from about 400 to about 600, from about 500 to about 700, from about 600 to about 800, from about 700 to about 900, from about 800 to about 1000, from about 900 to about 1100, from about 1000 to about 1200, from about 1100 to about 1300, from about 1200 to about 1300, from about 1200 to about 1400, from about 1300 to about 1500, from about 1400 to about 1600, from about 1500 to about 1700, from about 1600 to about 1800, from about 1700 to about 1900, or from about 1800 to about 2000 base pairs.

Regulatory Sequences

The polynucleotide may further comprise one or more regulatory sequences. In some cases, the regulatory sequences may direct the expression of the nucleic acids in specific types. The term "operably linked" as used herein refers to linkage of a regulatory sequence to from a DNA sequence such that the regulatory sequence regulates the mediates transcription of the DNA sequence. Regulatory sequences include transcription control sequences, e.g., sequences which control the initiation, elongation and termination of transcription. In some cases, regulatory sequences include those control transcriptions. Examples of such regulatory sequences include promoters, enhancers, operators, repressor, transcription terminator sequences.

The variable region (or the gene overlapping or including the variable region sequence), the template region, and the coding sequence for reverse transcriptase may be operably linked to the same regulatory sequence (e.g., promoter). Alternatively or additionally, the variable region (or the gene overlapping or including the variable region sequence), the template region, and the coding sequence for reverse transcriptase may be operably linked to different regulatory sequences. In some cases, the variable region (or the gene overlapping or including the variable region sequence) and the template region are operably linked to the same regulatory sequence; and the encoding sequence for reverse transcriptase is operably linked to a different regulatory sequence. In some cases, the template region and the coding sequence for reverse transcriptase are operably linked to the same regulatory sequence; and the variable region (or the gene overlapping or including the variable region sequence) is operably linked to a different regulatory sequence.

Promoters

In some examples, the regulatory sequences are promoters. The promoter may be suitable for expressing the component(s) in the systems, e.g., the variable region, the template region, and/or the reverse transcriptase in desired cells. A promoter refers to a nucleic acid sequence that directs the transcription of a operably linked sequence into mRNA. The promoter or promoter region may provide a recognition site for RNA polymerase and the other factors necessary for proper initiation of transcription when a sequence operably linked to a promoter is controlled or driven by the promoter. A promoter may include at least the Core promoter, e.g., a sequence for initiating transcription. The promoter may further at least the Proximal promoter, e.g., a proximal sequence upstream of the gene that tends to contain primary regulatory elements. The promoter may also include the Distal promoter, e.g., the distal sequence upstream of the gene that may contain additional regulatory elements. In some cases, the promoter may be a heterologous promoter, e.g., promoting expression of nucleic acids or proteins in cells that do not normally make the nucleic acids or proteins.

The promoters may be from about 50 to about 2000 base pairs (bp), from about 100 to about 1000, from about 50 to about 150, from about 100 to about 200, from about 150 to about 250, from about 200 to about 300, from about 250 to about 350, from about 300 to about 400, from about 350 to about 450, from about 400 to about 500, from about 450 to about 550, from about 500 to about 600, from about 550 to about 650, from about 600 to about 700, from about 650 to about 750, from about 700 to about 800, from about 750 to about 850, from about 800 to about 900, from about 850 to about 950, from about 900 to about 1000, from about 950 to about 1050, from about 1000 to about 1100 in length.

The promoters may include sequences that bind to regulatory proteins. In some examples, the regulatory sequences may be sequences that bind to transcription activators. In certain examples, the regulatory sequences may be sequences that bind to transcription repressors.

In some cases, the promoter may be a constitutive promoter, e.g., U6 and H1 promoters, retroviral Rous sarcoma virus (RSV) LTR promoter, cytomegalovirus (CMV) promoter, SV40 promoter, dihydrofolate reductase promoter, β-actin promoter, phosphoglycerol kinase (PGK) promoter, ubiquitin C, U5 snRNA, U7 snRNA, tRNA promoters or EF1α promoter. In certain cases, the promoter may be a tissue-specific promoter may direct expression primarily in a desired tissue of interest, such as muscle, neuron, bone, skin, blood, specific organs (e.g., liver, pancreas), or particular cell types (e.g. lymphocytes). Examples of tissue-specific promoters include lck, myogenin, or thy1 promoters. In some embodiments, the promoter may direct expression in a temporal-dependent manner, such as in a cell-cycle dependent or developmental stage-dependent manner, which may or may not also be tissue or cell-type specific.

In some cases, the promoters may be inducible promoters. The term "inducible promoter", as used herein, refers to a promoter that, in the absence of an inducer (such as a chemical and/or biological agent), does not direct expression, or directs low levels of expression of an operably linked gene (including cDNA), and, in response to an inducer, its ability to direct expression is enhanced. Examples of inducible promoters include, promoters that respond to heavy metals, to thermal shocks, to hormones, promoters that respond to chemical agents, such as glucose, lactose, galactose or antibiotic (e.g., tetracycline or doxycycline). Examples of inducible promoters also include Drug-inducible promoters, for example tetracycline/doxycycline inducible promoters, tamoxifen-inducible promoters, as well as promoters that depend on a recombination event in order to be active, for example the cre-mediated recombination of loxP sites. Examples of inducible promoters further include physically-inducible promoters, e.g., particular a temperature-inducible promoter or a light-inducible promoter.

The promoter may be suitable for expressing the component(s) in the systems, In desired types of cells. In some cases, the promoters are for expressing the component(s) in prokaryotic cells. Examples of such promoters include filamentous haemagglutinin promoter (fhaP), lac promoter, tac promoter, trc promoter, phoA promoter, lacUV5 promoter, and the araBAD promoter. In some cases, the promoters are for expressing the component(s) in eukaryotic cells. Examples of such promoters include the cytomegalovirus (CMV) promoter, human elongation factor-1E promoter, human ubiquitin C (UbC) promoter, and SV40 early promoter. In some examples, the promoters are for expressing the component(s) in yeasts. Examples of such promoters include Gal 11 promoter and Gal 1 promoter. In some cases, the promoters may be used for expressing the components in a cell-free system. In such cases, the promoters may be selected based upon the source of the cellular transcription components, such as RNA polymerase, that are used.

Ribosome Binding Sites

The polynucleotide may comprise one or more ribosome binding sites or sequences encoding one or more ribosome binding sites. A ribosome binding site may be a nucleotide sequence to which the ribosome binds upon the transcribed ribonucleic acid. For example, a ribosome binding site may be the sequence of mRNA at which assembly of the 30S and 50S subunits of the ribosome takes place to initiate translation of an encoded protein. A ribosome binding site may extend from the −20 to the +13 position with respect to the +1 position of the first nucleotide of the initiation codon. The ribosome binding site may comprise a Shine-Dalgarno (SD) sequence. The SD element may act by base pairing with an anti-SD sequence (5'-CCUCCUUA-3') near the 3' end of the 16S rRNA. The ribosome binding site may be a prokaryotic (e.g., *E. coli*) ribosome binding site.

In cases where the polynucleotide comprises a gene with multiple open reading frames, ribosome binding sites may be added in front of one or more (e.g., all) of the open reading frames. In certain cases, the orientations of the open reading frames are identical.

Initiation of Mutagenic Homing

The polynucleotides may comprise one or more initiation of mutagenic homing (IMH) sequences or functional analog thereof. An IMH sequence may functions in determining the direction of the template region to variable region transfer of sequence information. An IMH sequence may also support the use of the corresponding template region IMH-like sequence at the 3' end of the template region to prevent corruption of template region while the IMH directs variability to variable region. Furthermore, in variable region, the 5' boundary of information transfer may be established by the extent of homology between variable region and template region.

The polynucleotides may contain an IMH sequence located at the 3' end of the variable region and an IMH-like sequence at the end of the template region, Alternatively, the polynucleotides may contain an IMH sequence at the end of both the variable region and the template region such that the sequence of the template region may also vary to result in a highly efficient generating system.

In embodiments wherein a sequence of interest (or "desired variable region") to be diversified is not operably linked to the necessary template region, an IMH sequence may be operably located at the 3' of the desired variable region followed by operable linkage to an appropriate template region with its IMH-like 3'-region. A non-limiting example of such a system is seen in the case of a desired variable region which is all or part of a genomic sequence of a cell wherein insertion of an appropriate IMH and introduction of a template region containing construct with the appropriate corresponding IMH-like region, optionally with a cis linked reverse transcriptase coding sequence, is used to diversify the desired variable region. The template region may simply be a direct repeat of the desired variable region sequence to be diversified or mutagenized via the adenines present in the template region.

In certain systems may be engineered to modify the placement of the IMH to direct mutagenic homing to occur at a different position than that dictate by a naturally occurring diversity element. Likewise, the position, size, or sequence composition of the diversity element may be engineered to increase or decrease the rate of mutagenic homing. In certain example embodiments, the diversity generating element is a hairpin loop. In certain example embodiments the hairpin loop is a GC-rich hairpin loop. In certain example embodiments, the DGR-based systems comprise two or more diversity generating elements.

Examples of IMH sequences include those described in Miller J F et al., US20100041033A1, which is incorporated by reference herein in its entirety.

Reverse Transcriptases

The systems herein may further comprise a reverse transcriptase or a coding polynucleotide thereof. A reverse transcriptase refers to an enzyme capable of synthesizing DNA strand (that is, complementary DNA or cDNA) using RNA as a template. In some cases, the reverse transcriptase may have low proof-reading ability. For example, the reverse transcriptase may introduce one or more errors (i.e., nucleotides that are not complementary to the corresponding nucleotides on the template). Examples of reverse transcriptases include the transcriptases from *Vibrio harveyi* ML phage, *Bifidobacterium longum, Bacteroides thetaiotaonicron, Treponema denticola*, cyanobacteria, such as *Trichodesmium* erythrism, the genus *Nostoc*, or *Nostoc punctiforme*.

As used herein, reverse transcriptase may full-length reverse transcriptase or a functional fragment thereof. A functional fragment of a full-length reverse transcriptase may be a polypeptide that is shorter than the full-length reverse transcriptase but has reverse transcriptase activity. For example, a functional fragment of a full-length reverse transcriptase may have at least 50%, at least 60%, at least 70, % at least 80%, at least 90%, at least 95%, at least 99%, or at least 100% of the activity of the corresponding reverse transcriptase. The reverse transcriptase activity may be measured as amount of cDNA generated with certain amount of RNA template.

In some cases, the system may comprise a polynucleotide encoding the reverse transcriptase. In certain examples, the polynucleotide comprising the variable region and/or the template region may comprise a coding sequence for the reverse transcriptase. In some examples, the polynucleotide encoding the reverse transcriptase may be different from the polynucleotide comprising the variable region and/or the template region.

When associated via a cis or trans configuration, expression of the template region and operably linked reverse transcriptase region coding sequence may be under the control of an endogenous or heterologous promoters. When associated in trans, expression of the template region and operably linked reverse transcriptase coding sequences may be under the control of an endogenous or heterologous, regulatable promoter(s).

Figure 10:
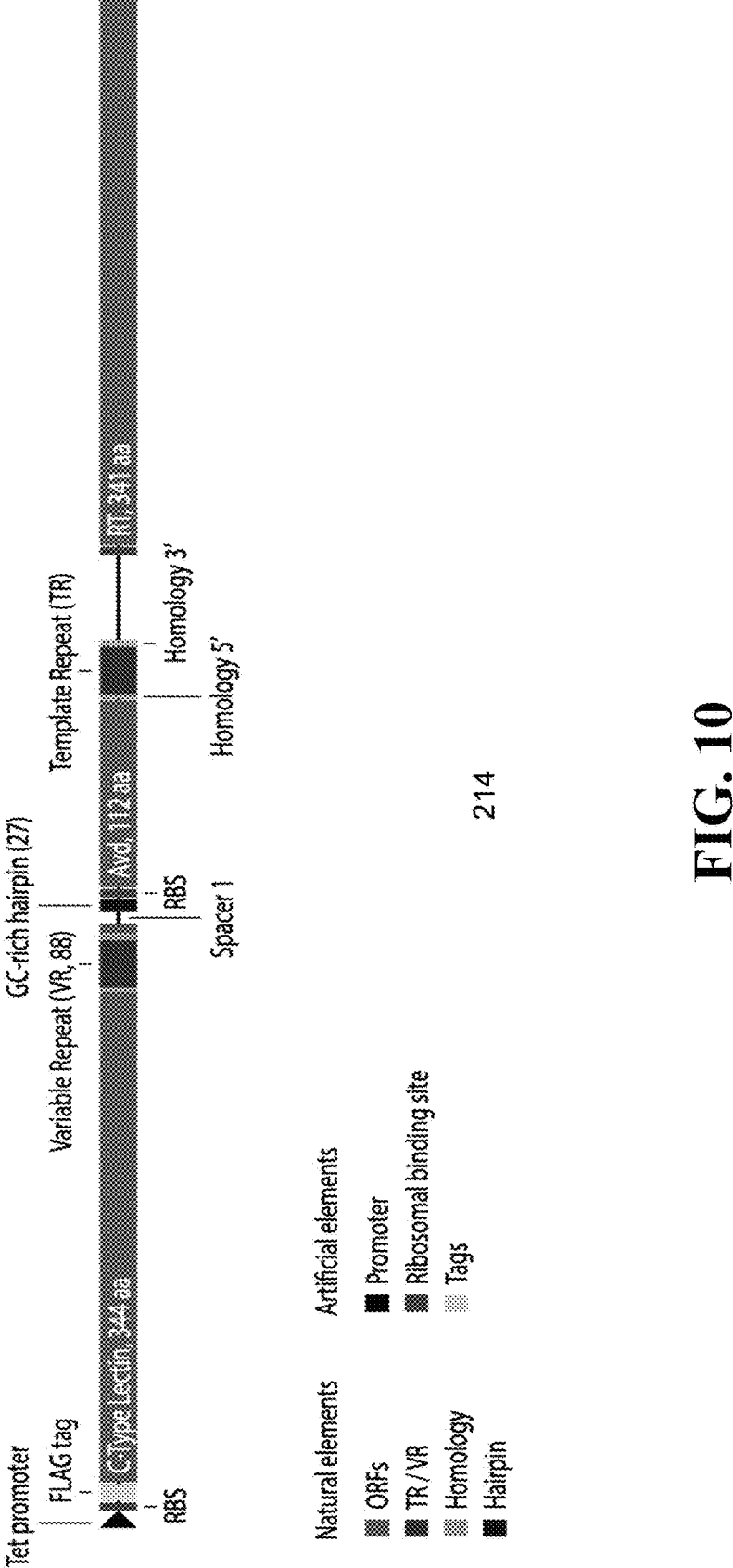
FIG. 10 show an example self-diversifying system (Hit 214).
Figure 16:
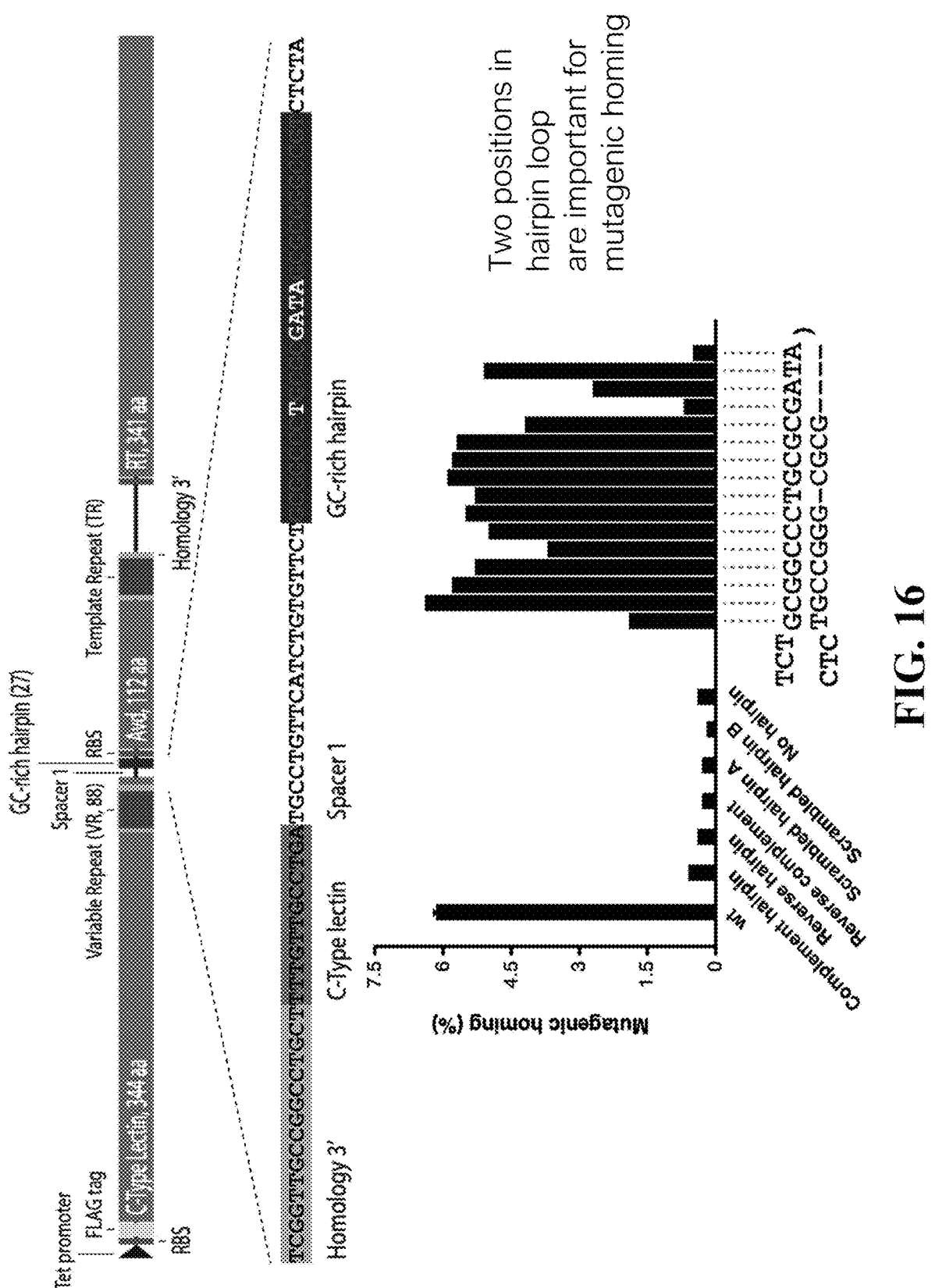
FIG. 16 shows a schematic of Hit 214 and importance of two positions in hairpin loop for mutagenic homing (SEQ ID NOs: 96, 97, and 1700). The sequence of the hairpin loop of Hit 214 is also shown (SEQ ID NO: 97).
Figure 17A:
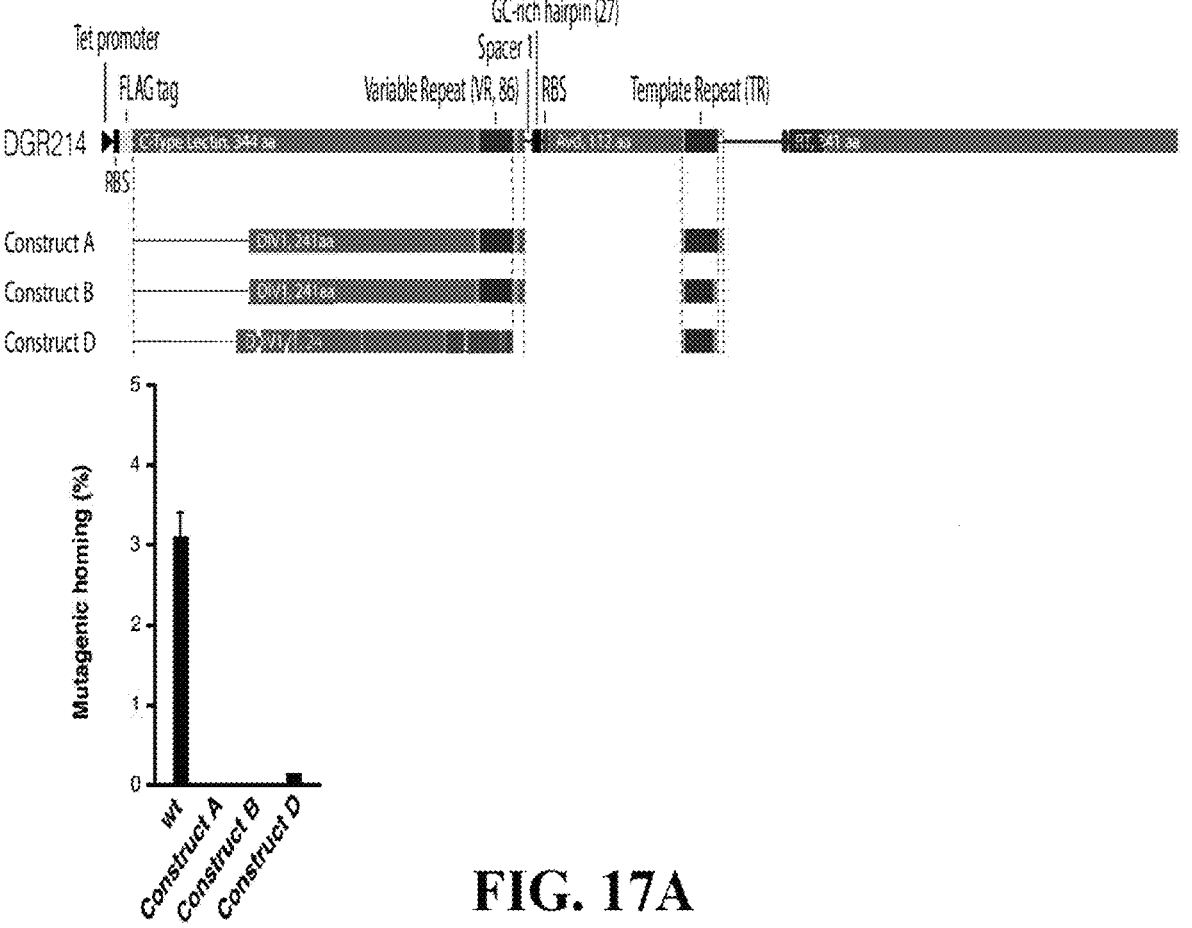
Figure 17C:
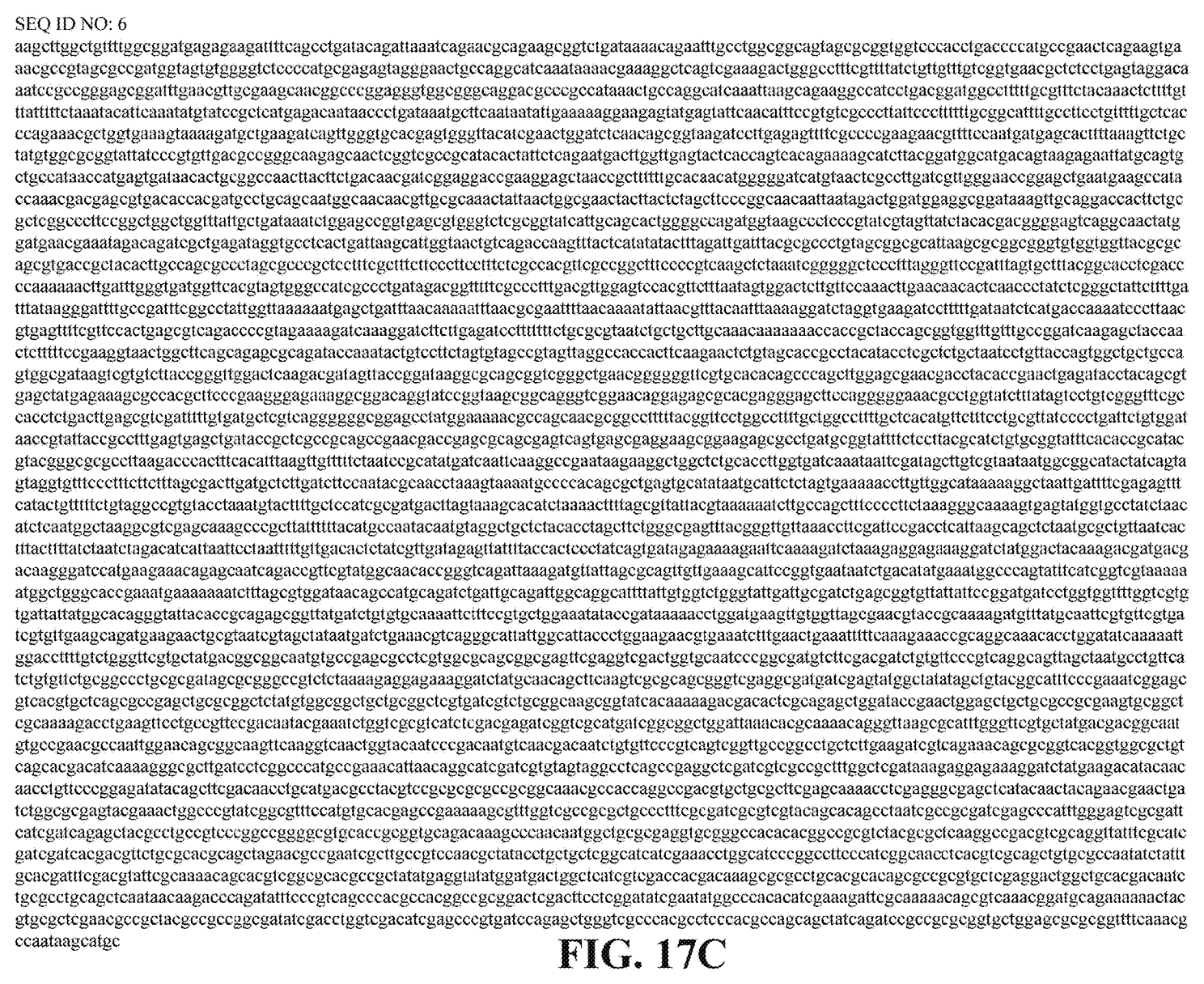

An example DGR system is shown in FIGS. 10 and 16 and further engineered variants thereof shown in FIGS. 17A-17E.

NON-DGR-Based Systems

In certain example embodiments, the self-diversifying system may be a non-DGR system. A non-DGR system may comprise elements capable of generating sequence variants but does not rely on the general structure and element of DGR systems described above. For example, a non-DGR system may comprise one or more self-diversifying elements (e.g. a variable region) but do not comprise a template region or reverse transcriptase. Example non-DGR systems are provided below.

TABLE 1

```
Non-DGR 25          1 GGAGTTATTT CCGGGAACGA CAAACAACCG GAACCCTGAA AAGTAAGAAT CGCATTCAAA
(SEQ ID NO: 1)     61 CTACTTCTAT ATACATGAGC AGTCCCTAAA TTCCCACTCT GCTGCAAATC AACAGCCACT
                  121 TGTTTCATAA ACGAAGTAAA ACTTTCCTTT TTCATTAAAA AATAATTTAA TAATTAATAT
                  181 TTACTAATNN CACAATTTAC TTTAGTAAAA tACGAAAATA TATATACAAA GATTTACATA
                  241 TATAAAATTA TAATATTAAA AACTGAAATA TTCACATTAT CTATCAAATT TATTTTTATA
                  301 CATTTGCGCA GTTTTTTAAA CAAATAATCA TTTTAATTAC TAAAAAACAA CAAAGTTATG
                  361 AACAACAATG AACCAGCTGC CGAACACTAC AGCATCAATG GATTCAAGTA TTTCTCCGAG
```

TABLE 1-continued

```
               421 TTGGCGAAAG AATATTTTCC AGATCTGGCA AACGCCTCTT CCGCCAGCAA AAAAATGCGC
               481 AAACGCATCA AAGCAGACAA GACGTTGAAC GAACAACTGG CTGCCGCGTA TTACACCTGC
               541 CAAACAATCG ACATCAGTCC CGAAATGCAA CTAATCCTTT ACCGCCATTG GGGACCTCCC
               601 CACATCGACC TGCCGACCAA CGTTTAATTA CGTAGTAGAA AACGAAAACA TCGACAAGGA
               661 ATAAAAAGAA AATCGAACTA TATATTTTTA AATATATCAT TTATCTTTTT ATTGTTTATT
               721 ATGTATTCCA CTTTGCGTTC ACCACTTTTT TCGGAAAAGA AGATAACTAT CATTTATACA
               781 GCTATTTACA GAAAgAAAAA AGCGTTCCAC AAAGCGTTCG GCAAAATGAC CGTTTTTTTC
               841 ATTCCAAACA GAGCCTCCGA ATCCTCCCAA CGAAGGCTCT GTTTATCTCC GGCAGAAGtT
               901 CTATCAAACA CAAACAGAGC ATCCGTTTCA TCTCCTGATC GCTTCTTCGC CCCATGAAAG
               961 AAAACAAAAA TACAACAACT TACGTACCAC AACTATTCTT CTTCGTCCAC ACCCGTCCAC
              1021 AAACAGACAC ACCCCTTGCA AACCGCACGG GAATAGCGTA CTTTTACAGA AAATTTAAAT
              1081 AACACTCAAT GAAAAATTTC AATTTTCAAG CCATGCTGAA ACATGGTTTT CTCATTATCC
              1141 CTAAAGCCTT ACTACAGCAG CAGATAGAAG ACCGNCACAT GCAAGAAGGA GAAATAGAAG
              1201 CTCTCCTGAA AATTCTGATG AAGGTCAATT ATTCGGATAC ACTCTACAAC GACCGTCAAA
              1261 ATAAAAACTG CCTGTGTAAA AGAGGCGAAA GCCTGTTTAG TTATCGCGAC TGGAGCCACA
              1321 TCTTCCACTG GTCTGTCGGA AAAGCCTTCA GGTTCATACA CGAGCTTGCC ACGCTGGGAA
              1381 TTATAGAAAT CATCTCTCAC CCCAACAATT CCTCCCTGCA TATTCGTGTC GTCGAATACG
              1441 ATAAATGGAT GGGAGTTCCC GATAGCGACA AGCAGAAAAA GAAAGCCGTC AACGAAAAGT
              1501 TTCACCTGTT CTGGAATGAA TTCCACAGCA TCACACAGCT CCCCAAAGAG AATATCGCCA
              1561 AAGCACAACG CGAATGGAAA AAGTTGGGCG ACAAGGAACA GCAACTCGCC ATCGACAGGA
              1621 TAGAGGAATA TTATTTCCAC CAAACGAACA TCAATTTCCT TCTCCATGCC GCCAGCTATT
              1681 TATCCAACAA AGCTTTTCTT AACGAATACT GATAATATGA ATACCGAAAA CAGAGTTTCG
              1741 CCACAGGCTC CCGAAATAGA AGAAGCTATC ATCGGCGCCT GCCTGATAGA ACAGGGAGCC
              1801 ATACCACTGG TAGCCGACAA GCTGCGTCCC GAAATGTTCT ACGTCCTGCG CCATCAGGTT
              1861 ATCTATGCCG CCATACTGGC CATGTATCAT GCAGGAATAA AGATAGACAT CCTCACCGTA
              1921 AAAGAAGAGC TTTCCCACCG TgGAAAGCTC GAAGAGGCGG GcGGacCGtt CGGcaTCaCC
              1981 CaatTgAgcA gCaAgGtGGc aacCtCCgCC CatNtTGAAT ATCATGCGCA GATCGTACAC
              2041 GAGAAATACC TGCGACGCGA AATGATTCTG GGGTTCAACA AACTCCTCGC CTGTTCGCTA
              2101 GACGAAACGA TGGATATTGA CGACTCACTG GTAGACGCGC ATAAcCTGCT CGACCGTCTG
              2161 GAAGGCGAAT TCGGCCATAA CAACCACATG CGCGACATGG ATGAACTAAT GACCGCCACC
              2221 ATGGTAGAAG CCGAAGGACG TATCGCCAAC AACAAAAACG GAGTAACCGg CCTCCCTACC
              2281 GGACTGGCGG ATCTGGACCG CATgACGTCC GGACTACAGA AAGGCGAGTT GGTGGTGGTC
              2341 GCCGCCCGTC CCGGCGTAGG AAAAACGGCA TTCGCACTAC ACATGGCACG AAGCGCAGCA
              2401 ATGGCAGGGT ATGCCGTAGC TGTCTACAGC CTCGAGATGC AAGGGGAACG ACTAGCAGAC
              2461 CGATGGCTGA CAGCGGTCAG CGAAATCAGC GCCCGCCATT GGCGATCGGG AACCGTCAGC
              2521 CAACAGGAAC TCGTAGAGGC ACGCACAACA GCCGCTGACC TCAAACGCCT GCCGATACAC
              2581 GTAGACGACA GCACATCGGT CAACATGGAA CATATACGTT CCAGCGCGCG ACTGCTGCAA
              2641 AGCCAACATG CGTGCGATGC TATTATTATC GACTACCTGC AACTCTGCGA CATGACGACC
              2701 GGTCAAAACA ACCGCAACCG CGAACAGGAA GTGGCACAAG CNACCCGCAA GGCAAAATTG
              2761 CTAGCCAAAG AACTGAATGT ACCAGTCGTA CTGCTTAGCC AGCTAAACCG CGAATCGGAA
              2821 AACCGCCCTG CCGGCCGTCC CGAACTGGCT CATCTCCGCG AGAGCGGAGC TATTGAACAG
              2881 GATGCAGACG TCGTCATGCT GCTCTACCGT CCCGCCCTTG CAAGGGTGAC GACCGACCGG
              2941 GAAAGTGGTT ATCCCACCGA AGGTCTGGGA GTAGTCATCA TAGCCAAGCA ACGCAACGGA
              3001 GAGACAGGAA ACGTCTATTT CAGACATAAT CCGGAAATGA CCAAGATCAC CGAATATGTC
              3061 CCTCCGTTAG AGTATATGCT GAAACATGCC AAATAAGAAA CAGTTACACT AATAATATAC
              3121 AATTTTATAT TACAACATAT AGCATAAATC ATTTTCTCAT TTTATTTCAT TATCATACA
              3181 ANATATATAG CAAAACACTT GACTTTCCCT CTCATATTTC GTATATTTGT AATGTCGTAA
              3241 GGACAGAGAA AATTTTATTA CTTAAACCTT AACTTTTTAT TGTATGAATG TATTAGTGGA
              3301 GCGCTATCAG CGCAGAAAGT ATGTGAATCA ACCGGATTCA CAGATGTTGT ATTATGTACG
              3361 CCAGAAATCG GGCACAGTGA GAGTGATGGA CATCAACAAG CTGGCGGATG CCATCGAAGC
              3421 GAACTCCTCG CTCACTGCAG GAGACGTGAA GCATGCCATT GAGGCTTTTG TCGAGCAGTT
              3481 ACGCCTATCG CTTACCCAGG GCGACAAGGT GAAGGTTGAC GGATTGGGTA CGTTTCATAT
              3541 CACATTGAGC AGCGAGGGGG CAGAAAAAGA GAAAGATTGC ACGGTGCGCA GCATCCGCAA
              3601 AGTAAATGTC CGTTTCGTGG CGGACAAGGC GCTTCAATTG GTAAATACGA GCCATGCCAC
              3661 TACCCGAGGC GAAAATAATG TCGATTTTAT CCTGgCAGCA AAGGGCGACG GAGAAGGTGA
              3721 CGATGACGGA AATAGCGGNA GCGGTGGAAA CAGCGGCGGA AGCGGAGAAG CTCCGGACCC
              3781 GGCAGCTTAA TCTTTAAAAC AGCGCCGCAT GGATATTACG GAGTGATTTC TACAGTTACT
              3841 CTCNATGCGG TTTCTGTTTT CTTCTACATT TATTTTTTAA TTCTCAATTT TCAATCCTCA
              3901 ATTTATTAAA ATGCTTGATA AAATCATAGA GATCATTATA ACGATCCTGC CCTTTCTGGG
              3961 CAGTAACCGC AAAAAGCGCA AAGTAATGGC GCAAGAAGTA
```

Non-DGR 1057
(SEQ ID NO: 2)
```
                 1 TACGCCGGGC CGTCTGGGAA ACTACATGGA TGACGAAGGC AAGGAAGAGG CAGGCCCCGC
                61 TGCCGGCGCG GCAGGAAACG CAGCGGGCGG GAACAGCCAG CCCGAGCGTA TCATCGCCCT
               121 CCTTGGCGGA CGGGAGAACA TTGAATTTGT GGACGCCTGC ATGACCAGGC TCCGCGTGAC
               181 AGTGAAGGAT CTCTCCAAGG TGGCTGAACT TCCGGCGTGG AAGGCAGAGG GCGCCATGGG
               241 CCTTGTGAAG AAAGACAACG GCATCCAGGC AATTTACGGA CCCAAGGCGG ACGTGCTGAA
               301 ATCGGATATC AAcGATATCC TGTAACAATT CAGCACCCCG GAAAAAATGA GTGAAAATaTG
               361 aaCGGGGAGC CTGCTCACCG GGCAGATTTT GCTCAATAcG CAGAGGAAAG AACTATGAGA
               421 CTGCTTACTA TCAATATTCA CAGCCATGGA AGTGACTTTG AACCGGAACT TTATCATCAG
               481 AAGATGAAGG CGCTGGCGGC ATTTATGAAG GAAGAAGAGA TCGATGCCGC GGCGATCCAG
               541 GAATGCAGTG AAGAGGAGGA CAGGCCGGTG GTCTCCGGCC CCCTCCCCAT GCATTGGGTG
               601 CCGGCCGGAC CGGACTCCCG CGTCCGGGAG GATAACTGTG CGCTGGTCCT GGCGGAGGAA
               661 CTTCAGGGCC TGCAGCAGGA GTACTGGTGG ACCTGGACCG GAGCGAAGCT CGGGTACGGA
               721 AAATACAATG AGGGTCTGGC CATCTTCAGC CGCCGCCCTG TTACAGGCGC GGACAGTTTC
               781 TATATTTCCG GCGTCCGGGA CTTCTCCAAC TGGAAGACCC GGAAGGCGT GGCGGCCTGG
               841 ACCGCTGACG GGCCTGCCTT TTTGAGCGTC CACATGGGAT GGTGGAATGA TCCGGAGGAA
               901 AACTTCCGGG GGCAGATGGA ACGGCTGCAG AAGGCGCTCC GCGAAAGGAA GCTTCGTCCG
               961 CAGGACGGTT CTGACAGTTT CCTTATGGGA GATTTCAACA GTCCCGCAGC GATCCGCGGA
              1021 GAGGGAAGGG ACATGGTCCT GGACCTCGGG TGGCGGGACA GTTATGAGGA TGCCGAAATA
              1081 AAAGACAGCG GCATCACCGT TCCGGGAAAC ATCGACGGAT GGAGGGACGG TGAACATACG
```

TABLE 1-continued

```
1141 GGCATGCGCC TgGATTATAT CTGGACCGCA AAAAGGCACA GGGTGCTTCA GTCAAAGGTG
1201 GTCCTGAACG GGATCAGCGG GCCGGTGCTT TCCGACCATT TCGGAGTCCT GGCGGTGATC
1261 GAATGAATAA AGGAGCAGAC AGCATGAGAG AAAGTGGAAT TCTTCTTGCC ATCAGCAGCC
1321 TTCCTTCCGA ATACGGGATC GGCTGCTTCA GCAGGGAAGC ATATGAGTTT GCGGACCGCC
1381 TTTCAGAGGC GGGCCAGAGT TACTGGCAGA TCCTGCCGCT GGGGCCGGTG GGATACGGAG
1441 ATTCACCGTA CCAGTCCTTC TCCACCTTCG CGGGCAACCC TTACTACATT TCACCTGAGA
1501 CGCTGGTGGA AAAGGGATGG ATCACTGAGG CGGACTGCCG CGAAGCCGGC CTTTCTTCCG
1561 ACCCGCGCGG TGTGGATTAC GTGCTGCAGT ACCAACGCCG CTATGAGCTG CTCCGGAAGG
1621 CGTACAGAAA CAGCCGgATc GAAGAGAATG AGAAGTTCCG GGCGTTCACG GAGAAGACGG
1681 AATGGCTTCC GGACTACGCG CTGTTCATGG CTCTGAAGGA AGAGAACGGA GGAAGGCCCT
1741 GGTACGAATG GGAAGATCCG CTGAGACTCA GGGATCCGGA AGCCTTGGCC GCGGCGCGGG
1801 AACGCCTGGA GGAAGGCATC GGTTTCTGCA GTTTCCTGCA GTTTGAGTTT TaCGAAGAGT
1861 GGATGCAGCT GAAGGACTAC GTGAACCGGA AGGGAATACG GATCATCGGA GACATCCCGA
1921 TCTATGTAtC CCTGGACAGT TCAGACGTCT GGGCGGATCC GGAaCTTttC CNGCTGGAtG
1981 AAAaCCGCCG ACAGaCCGCG GCGGCGGGct GcCCgCCgga tGGcttCagc GCtGtGGGac
2041 aGctctgGGG caaCCCaCTC TATGACTGGG ACTATCACAA AAAGACCTGT TTTGCCTGGT
2101 GGCTGAAACG TCTTAAAAAC TGCTTTGATA TTTATGATGT GATGCGGATC GACCATTTCC
2161 GCGGCTTCGA TGAATATTTT TCCATTCCTG CCGGTGCGGA GGACGCAAGA GCAGGCCATT
2221 GGGAGAAGGG ACCCGGCATG GATCTGTTCC GGAAGGTCTC GGAAGCCTTc CCGGGACGGG
2281 AGATCATCGC GGAGGATCTG GGGTATGTGA CGGACAGTGT CCGGCAGCTG GTGAAGGACA
2341 GCGGCTATCC CGGGATGAAG GTCCTGGAAT TTGCCTTTGA CTCAAGAGAT TCCGGCTGTG
2401 CGGAGGATTA CCTTCCCCAC AATTACGAAA AGAACAGTGT GGTCTACACC GGCACCCATG
2461 ACAACGAGAC GGTGACCGGC TGGTTTTCCG AGGGCCTGAA GCCGGAGGAG AAGGAGGCAG
2521 TCAGAGACTA TTTCTGCGAC CATACGACTC CCGACGCCGG GATGCACATA CCCCTGATCT
2581 GCGCCGCCAT GCGAAGCGTC AGCAGACTCT GCATCATcCC CATGCAGGAC CTTCTGGGGT
2641 ACGGAAACGA GGCAAGGATG AACGCTCCTT CCACCTACGG AAACAACTGG AAATGGCGTC
2701 TTCTGAAGGA TGAATTCGGA GAGAAGGAAG TGAAGACGCT GTATGAgATC ACGAAGCGGT
2761 ACGGAAGGAT CGGAAAATGA GAAAAGAGGA NNGNNNNTNN NNNAANNGNN NNNTACCNNN
2821 NNNNAGNNCA NTNANNNNNT NNNNNNNTNN TTANNNCNNN NCANNGNAAT NATCNNNNNN
2881 NNNNNNNNNNT NTNNNNNNNN NNNNNNNNNN NNNNNNNNNN NCNNNGNTGT NATNNNNNNN
2941 NtNNNNNNCN NNaNCNgNNN tNNGNTNtNN TNNNNNNNNN aNNNtNNNNc NNNagtaNNN
3001 NNNNcNcNtN NNaaNNNNNN NNNaNNNNNN tNNNNNNNNN NNNNNNNNNaN NaNaNNNcNa
3061 aNNNNtNNcN tcgNNNNNNt gNNNNNNNaa tNNgNNNtNN NtNNNNNNNc NNNtNaaNNN
3121 NNtNNttcNN NNNNNNNNNN NNNNNNgNNN NNNNNgNtNa NNNNaaNNNt NtNNaaNNaN
3181 gNNNNaNNNN aNNNNNgNNa NNNNNNNNNN NNNNtNNNNN NNNNaNNNNN NNNNNaNNNN
3241 NNNNNNgNNN NNNNNaNNNN NNNNNNNNNN NNNNNNNNNN NNNNNNNNNN NNNNNNNNNN
3301 NNNNNNNNNN NNNNNNNNNN NNNNNNNNNN NNNNNNNNNN NNNNNNNNNN gNNNNaNNNN
3361 NNNNNNNNNN NNNNNtNNNN tNtNNNNtNN NNNNNNNcNN NNNNNttNtt NNNNNgcNNN
3421 NNNNNNaNNN NNNNNgNNNN NNNNNNNNNN NNNNNNNNNN NNNNNNNNNa NNNNNNNNNN
3481 NNgNNNNNNN NNNNNNagNN NcNNNNNNNN NNNNcNNNcN NNtNNNNNNa NtaNNNNNNN
3541 NNNNNNNNNN NNNNNNNNNN NNNNNNNNNN NNNNNgNNNc NNNNNNNNNt NNNaNNNNNc
3601 NNNNNNNcN NNNNcNNcNN NNNNNcNNNN NNNaNNaNN NcNNNNNNNN NNNNNNNNNN
3661 NNNNNNNNNN tNtNtNNNNN NNNNNNNNNN NNNNNNNNgN NNNNNNNNgN NNNNNNNNaN
3721 gNNNNNNNNN NNNNNNNNNN NNNNNNNNNN NNNNNNNNNN tNNNNNNNNN NNNNNNNNNN
3781 NNNNNNNaNa NNNNNNNNNN NNNNNNNNNN NNNNNNNNNN NNNaNNNNNN NNNNNNNNNN
3841 NNgNNNNNNN NNNNNNNNNN NNNcNNNNNN NNNNNNNNNN NNNNNNNNNN NNNNNNNNNN
3901 NNNNNNNNNN NNNNNNaNNN NNNNNNNNNN NNNNNNNNNN NNNNNNNNNN NNNNtNNNNN
3961 NNNNNNNNNN NNNNNNNNNN NNNNNNgNNN NNNNNNNNNN
```

Vectors

The systems may comprise one or more vectors for delivering the components (e.g., polynucleotides) into cells. For example, the polynucleotides in the systems may be on a vector. A vector refers to a nucleic acid molecule capable of transporting another nucleic acid to which it has been linked. A vector may be a replicon, such as a plasmid, phage, or cosmid, into which another DNA segment may be inserted so as to bring about the replication of the inserted segment. Generally, a vector is capable of replication when associated with the proper control elements. Examples of vectors include nucleic acid molecules that are single-stranded, double-stranded, or partially double-stranded; nucleic acid molecules that comprise one or more free ends, no free ends (e.g. circular); nucleic acid molecules that comprise DNA, RNA, or both; and other varieties of poly-nucleotides known in the art. A vector may be a plasmid, e.g., a circular double stranded DNA loop into which additional DNA segments can be inserted, such as by standard molecular cloning techniques.

Certain vectors may be capable of directing the expression of genes to which they are operatively-linked. Such vectors are referred to herein as "expression vectors." Common expression vectors of utility in recombinant DNA techniques are often in the form of plasmids. A vector may be a recombinant expression vector that comprises a nucleic acid of the invention in a form suitable for expression of the nucleic acid in a host cell, which means that the recombinant expression vectors include one or more regulatory elements, which may be selected on the basis of the host cells to be used for expression, that is operatively-linked to the nucleic acid sequence to be expressed. As used herein, "operably linked" is intended to mean that the nucleotide sequence of interest is linked to the regulatory element(s) in a manner that allows for expression of the nucleotide sequence (e.g. in an in vitro transcription/translation system or in a host cell when the vector is introduced into the host cell).

A vector may be a viral vector, wherein virally-derived DNA or RNA sequences are present in the vector for packaging into a virus. Viral vectors also include polynucle-otides carried by a virus for transfection into a host cell. Certain vectors are capable of autonomous replication in a host cell into which they are introduced (e.g. bacterial vectors having a bacterial origin of replication and episomal mammalian vectors). Other vectors (e.g., non-episomal mammalian vectors) are integrated into the genome of a host cell upon introduction into the host cell, and thereby are replicated along with the host genome.

In some embodiments, the polynucleotide herein may be a part of a vector or a pair of vectors that is/are introduced into cells for inducing diversification (e.g., site-specific mutagenesis) of the variable region and/or support replication of the molecules. Non-limiting examples of vectors include plasmids and virus based vectors, including vectors for phage display that may be used to express a diversified variable region sequence. Other non-limiting embodiments are vectors containing variable sequences that have been subjected to the methods of the instant invention and then removed from an operably linked template region, including by preventing the expression of template regions, so as to produce without further diversification quantities of the variable region-encoded protein for uses including as a diagnostic, prognostic, or therapeutic product.

Methods of Generating Libraries of Diversified Molecules

Provided herein include methods of generating libraries of diversified molecules. In general, the methods comprise introducing one or more components of the system herein in cells, wherein diversified molecules are generated. In some embodiments, a polynucleotide comprising a variable region and a template region is introduced in cells. An RNA molecule may be transcribed from the template region. The RNA molecule may then be reverse transcribed into a population of cDNA molecules. The reverse transcription may be error prone, i.e., the cDNA molecules may comprise one or more mutations compared to the template region in the polynucleotide. Due to the homology between the template region and the variable region, the cDNA molecules may insert to and/or replace a target sequence of the variable region (e.g., the entire variable region). Thus, the mutations in the cDNA molecules may be introduced into the variable region. In some examples, the variable region is within a gene. The gene may be expressed to generate a population of nucleic acids or proteins that carry the mutations. The libraries of diversified molecules may comprise such nucleic acids or proteins with the mutations. The diversified molecules may be proteins or polypeptides. The diversified molecules may be antibodies or fragments thereof. The diversified may be antigens or fragments thereof. The diversified molecules may be nucleic acids or polynucleotides, e.g., DNA, RNA, a hybrid thereof.

The systems and the methods herein may allow for generating libraries of diversified molecules with high efficiency. The efficiency refers to number of diversified molecules generated relative in the total number of molecules generated by a given self-diversifying system. In some embodiments, the efficiency of diversified molecules generation is at least at least 5%, at least 10%, at least 20%, at least 30%, at least 40%, at least 50%, at least 60%, at least 70%, at least 80%, at least 90%, or at least 95%.

A library ("population") of diversified molecules may comprise a plurality of unique sequence variants. For example, a library of diversified molecules may comprise at least $1 \times 10^8$, at least $2 \times 10^8$, at least $4 \times 10^8$, at least $6 \times 10^8$, at least $8 \times 10^8$, at least $1 \times 10^9$, at least $2 \times 10^9$, at least $4 \times 10^9$, at least $6 \times 10^9$, at least $8 \times 10^{10}$, at least $1 \times 10^{11}$, at least $2 \times 10^{11}$, at least $4 \times 10^{11}$, at least $6 \times 10^{11}$, at least $8 \times 10^{11}$, at least $1 \times 10^{12}$, at least $2 \times 10^{12}$, at least $4 \times 10^{12}$, at least $6 \times 10^{12}$, at least $8 \times 10^{12}$, at least $1 \times 10^{13}$, at least $2 \times 10^{13}$, at least $4 \times 10^{13}$, at least $6 \times 10^{13}$, at least $8 \times 10^{13}$, or at least $1 \times 10^{14}$ different molecules.

Diversified Molecules

Embodiments disclosed herein further encompass diversified molecules generated using the self-diversifying systems disclosed herein. In certain example embodiments, the diversified molecule is a polynucleotide-binding protein or a polypeptide-binding protein. Such proteins may be engineered to bind target polynucleotides in a sequence specific manner.

The variable region may be within an open reading frame of the gene. In some examples, the sequence may encode DIV1 or DIV18.

Examples of DIV1 and DIV18 are proteins in Table 2 below (SEQ ID NO: 3 and SEQ ID NO: 4).

TABLE 2

| DIV1 | MKKQSNQTVRMATPGQIKDVISAVVESIPVNNLTYEMAQYF<br>IGRKKWLGTEMKKIFSVDNSHADLIADWQAFYCGLGIDCDL<br>SGVIIPDDPGGFGRVIIMAQGITPQSGYDLCAKFFPCWKYT<br>DKNLDEVVVSERTAKDVYAIRVRDRVEADEELRNRSYNDLK<br>RQGIIGITLEEREIFELKFFKETAGKHLDIKNWTFCLGSCY<br>DGGNVPSASWRSGEFEVDWCNPGDVFDDLCSRQAVS |
|------|------|
| DIV18 | MRTFEITEKEVAAAFREAESGEAKKILAALFCKEEMVKPTL<br>DDYKTIRTYEDACKALGEPIFEDPNNLPNHIIALMKLETIS<br>RALWGRNFQPKPDGEGSKVYWYPWFALWTKKEVEDMNPEQR<br>GALVSANADLGAFAGFGCLAALYRSSSADAGIGFRLCQETE<br>EKAKYFGQQFIELWAEYLKFNFTVGNRL |

Examples of DIV1 and DIV18 also include the orthologs and homologs of the proteins in Table 1. The terms "orthologue" (also referred to as "ortholog" herein) and "homologue" (also referred to as "homolog" herein) are well known in the art. By means of further guidance, a "homologue" of a protein as used herein is a protein of the same species which performs the same or a similar function as the protein it is a homologue of. Homologous proteins may but need not be structurally related, or are only partially structurally related. An "orthologue" of a protein as used herein is a protein of a different species which performs the same or a similar function as the protein it is an orthologue of. Orthologous proteins may but need not be structurally related, or are only partially structurally related. Homologs and orthologs may be identified by homology modelling (see, e.g., Greer, Science vol. 228 (1985) 1055, and Blundell et al. Eur J Biochem vol 172 (1988), 513) or "structural BLAST" (Dey F, Cliff Zhang Q, Petrey D, Honig B. Toward a "structural BLAST": using structural relationships to infer function. Protein Sci. 2013 April; 22 (4): 359-66. doi: 10.1002/pro.2225.). See also Shmakov et al. (2015) for application in the field of CRISPR-Cas loci. Homologous proteins may but need not be structurally related, or are only partially structurally related.

Binding Partners and Target Molecules

The diversified molecules may comprise binding partners of a target molecule. Target molecules may be any molecules which is of interest to a skilled person practicing the invention. Examples of target molecules include polypeptides, cell surface molecules, carbohydrates, lipids, hormones, growth or differentiation factors, cellular receptors, a ligand of a receptor, bacterial proteins or surface components, cell wall molecules, viral particles, immunity or immune tolerance factors, MHC molecules (such as Class I or II), tumor antigens found in or on tumor cells, and others as desired by a skilled practitioner and/or described herein.

The binding partners (e.g., encoded at least in part by the variable regions) may be any polypeptide which, upon expression, binds to the target molecule, such as under physiological conditions or laboratory (in vivo, in vitro, or in culture) conditions. In some cases, the binding partners may be nucleic acids. In certain examples, the binding partner may be aptamers or derivatives thereof.

Libraries of binding partners of various types may be generated using the systems and methods herein. Examples of binding partners include antibodies (e.g., antibodies (Ab) and monoclonal antibodies (MAb)), antigens, hormones, receptor proteins, ligands to receptors, amylin, THF-γ2, adrenomedullin, insulin, VEGF, PDGF, echistatin, human growth hormone, MMP, fibronectin, integrins, calmodulin, selectins, HBV proteins, HBV antigens, HBV core antigens, tryptases, proteases, mast cell protease, Src, Lyn, cyclin D, cyclin D kinase (Cdk), p16$^{INK4}$, SH2/SH3 domains, SH3 antagonists, ras effector domain, farnesyl transferase, p21$^{WAF}$, Mdm2, vinculin, components of complement, C3b, C4 binding protein (C4BP), receptors, urokinase receptor, tumor necrosis factor (TNF), TNFα receptor, CTLA4 MAb, interleukins, IL-1, IL-2, IL-3, IL-4, IL-5, IL-6, IL-7, IL-8, IL-9, IL-10, IL-1, IL-12, IL-13, IL-17, interferons, LIF, OSM, CNTF, GCSF, interleukin receptors, IL-1 receptor, c-MpI, erythropoietin (EPO), the EPO receptor, T cell receptor, CD4 receptor, B cell receptor, CD30-L, CD40L, CD27L, leptin, CTLA-4, PF-4, SDF-1, M-CSF, FGF, EGF. In some examples, the binding partner may be a bacteriocin (including a vibriocin, pyocin, or colicin), a bacteriophage protein (including a tail component that determines host specificity), capsid or surface membrane component, a ligand for a cell surface factor or an identified drug or diagnostic target molecule. In some examples, a binding partner may be part of a fusion protein such that it is produced as a chimeric protein comprising another polypeptide. Examples of the other polypeptide member of the fusion protein may include bacteriophage tail fibers, toxins, neurotoxins, antibodies, growth factors, chemokines, cytokines, neural growth factors.

In some cases, libraries of diversified molecules may also include barcodes (e.g., for connectomics analysis). The libraries of diversified molecules may include enzymes, antibodies, nanobodies, non-coding RNAs, barcode sequences, regulatory sequences (e.g., enhancers, promoters).

Delivery of Diversifying Systems to Cells

The one or more components of the systems herein may be introduced to cells for expression. Examples of methods of introducing the components into cell include lipofection, nucleofection, microinjection, biolistics, virosomes, liposomes, immunoliposomes, polycation or lipid: nucleic acid conjugates, naked DNA, artificial virions, and agent-enhanced uptake of DNA. Lipofection is described in e.g., U.S. Pat. Nos. 5,049,386, 4,946,787; and 4,897,355) and lipofection reagents are sold commercially (e.g., Transfectam™ and Lipofectin™). Cationic and neutral lipids that are suitable for efficient receptor-recognition lipofection of polynucleotides include those of Felgner, WO 91/17424; WO 91/16024. Delivery can be to cells (e.g. in vitro or ex vivo administration) or target tissues (e.g. in vivo administration). Physical methods of introducing polynucleotides may also be used. Examples of such methods include injection of a solution containing the polynucleotides, bombardment by particles covered by the polynucleotides, soaking a cell, tissue sample or organism in a solution of the polynucleotides, or electroporation of cell membranes in the presence of the polynucleotides. Examples of delivery methods and vehicles include viruses, nanoparticles, exosomes, nanoclews, liposomes, lipids (e.g., LNPs), supercharged proteins, cell permeabilizing peptides, and implantable devices. The nucleic acids, proteins and other molecules, as well as cells described herein may be delivered to cells, tissues, organs, or subjects using methods described in paragraphs to of Feng Zhang et al., (WO2016106236A1), which is incorporated by reference herein in its entirety.

Host Cells

In some cases, the cells where the diversified molecules are generated are bacterial cells. The cells may be bacteria, archaea, yeasts, fungi, protists, plant cells and animal cells. For example, the cells may be microorganisms, e.g., bacteria, archaea, fungi, protozoans, *mycoplasma*, and parasitic organisms. In a particular example, the cells are *E. coli*.

In some examples, the cells may be bacteria. The terms "bacteria" and "bacterium" refer to all prokaryotic organisms, including those within all of the phyla in the kingdom Procaryotae. It is intended that the term encompass all microorganisms considered to be bacteria including *Mycoplasma, Chlamydia, Actinomyces, Streptomyces*, and *Rickettsia*. All forms of bacteria are included within this definition including cocci, bacilli, spirochetes, spheroplasts, protoplasts, etc. Also included within this term are prokaryotic organisms which are gram negative or gram positive. In certain examples, the cells may be fungi. As used herein, the term "fungi" is used in reference to eukaryotic organisms such as the molds and yeasts, including dimorphic fungi.

In some cases, the cells are *E. coli*. The cells may be of specific strain of *E. coli*. In some cases, the cells are not NEB5α or stb13 bacteria.

Genetically Modified Cells

The cells used herein may be genetically modified. The genetic modification may allow for highly efficient generation of diversified molecules. The genetic modification may include reduction or depletion of expression of one or more genes in the cells (e.g., *E. coli* cells). In some examples, the expression of mutator S is reduced or depleted in the cells (e.g., *E. coli* cells). In some cases, the expression of Exodeoxyribonuclease 10 is reduced or depleted in the cells (e.g., *E. coli* cells). In some cases, the expression of both mutator S and Exodeoxyribonuclease 10 is reduced or depleted in the cells. In certain cases, the cells used herein may be wild type cells.

Methods of Screening Binding Partners for a Target Protein

The present disclosure also provides methods for screening binding partners for a target molecule. The binding partners may be screened from one or more libraries of diversified molecules generated using the methods and systems herein. In some cases, the method of screening binding partners of a target molecule, comprising obtaining of a library of diversified molecules using the system herein, performing one or more assays to determine interaction between the diversified molecules and the target molecule; and selecting a subset of the diversified molecules based on results of the one or more assays.

One or more assays may be performed for testing the interaction between candidate binding partners and the target molecule. Examples of the assays include phage display, toxin inhibition assay, toxin survival assay, bacterial surface display, bacterial two-hybrid display assay, bacterial three-hybrid display, yeast two-hybrid assay, yeast three-hybrid assay, an enzyme-linked immunosorbent assay (ELISA), immunoprecipitation assay, or a combination thereof.

In certain examples, the assay may be phage display. Phage display may be the display of functional foreign peptides or small proteins on the surface of bacteriophage or phagemid particles. Genetically engineered phage may be used to present peptides as segments of their native surface proteins. Peptide libraries may be produced by populations of phage with different gene sequences.

With the assay(s), affinity between the candidate binding partners and the target molecule may be determined. Binding partners with desired affinity (e.g., those with highest affinity) with the target molecule may be selected.

Methods of Identifying Diversity Generation Systems

The present disclosure also provides methods for identifying diversity-generating systems herein. In general, the methods may comprise identifying loci with higher diversity in contigs larger than 1 kb in a database, compared to average diversity in the sequences in the database.

For example, the database may be a metagenome database. As used herein, the term "metagenome" refers to genomic material obtained directly from a microbe or microbial population, instead of from culture. A metagenome database includes sequence information of metagenome.

The term "contig" is used in connection with DNA sequence analysis, and refers to reassembled contiguous stretches of DNA derived from two or more DNA fragments having contiguous nucleotide sequences. Thus, a contig may be a set of overlapping DNA fragments that provides a (partial) contiguous sequence of a genomic region of interest. A contig may also be a set of DNA fragments that, when aligned to a reference sequence, may form a contiguous nucleotide sequence. For example, the term "contig" encompasses a series of (ligated) DNA fragment(s) which are ordered in such a way as to have sequence overlap of each (ligated) DNA fragment(s) with at least one of its neighbors. The linked or coupled (ligated) DNA fragment(s), may be ordered either manually or, preferably, using appropriate computer programs such as FPC, PHRAP, CAP3 etc., and may also be grouped into separate contigs.

The contigs in the methods herein may be at least 0.5 kilobase (kb), at least 1 kb, at least 1.5 kb, at least 2 kb, at least 2.5 kb, at least 3 kb, at least 3.5 kb, or at least 4 kb in length. In some examples, the contigs may be at least 3 kb in size.

The contigs comprising the identified loci may then be selected. In some cases, the selected contigs encode a polypeptide of at least 50, at least 60, at least 70, at least 80, at least 90, at least 100, at least 120, at least 140, at least 160, at least 180, or at least 200 amino acids in length.

The methods may further comprise confirming whether the system is able to generate diversified molecules in cells. The presence of diversified molecules in the cells may be determined by sequencing. Generally, the sequencing can be performed using automated Sanger sequencing (AB13730xl genome analyzer), pyrosequencing on a solid support (454 sequencing, Roche), sequencing-by-synthesis with reversible terminations (ILLUMINA® Genome Analyzer), sequencing-by-ligation (ABI SOLID®) or sequencing-by-synthesis with virtual terminators (HELISCOPE®); Moleculo sequencing (see Voskoboynik et al. eLife 2013 2: e00569 and U.S. patent application Ser. No. 13/608,778, filed Sep. 10, 2012); DNA nanoball sequencing; Single molecule real time (SMRT) sequencing; Nanopore DNA sequencing; Sequencing by hybridization; Sequencing with mass spectrometry; and Microfluidic Sanger sequencing. Examples of information that can be obtained from the disclosed methods and the analysis of the results thereof, include without limitation uni- or multiplex, 3 dimensional genome mapping, genome assembly, one dimensional genome mapping, the use of single nucleotide polymorphisms to phase genome maps, for example to determine the patterns of chromosome inactivation, such as for analysis of genomic imprinting, the use of specific junctions to determine karyotypes, including but not limited to chromosome number alterations (such as unisomies, uniparental disomies, and trisomies), translocations, inversions, duplications, deletions and other chromosomal rearrangements, the use of specific junctions correlated with disease to aid in diagnosis. As would be apparent, forward and reverse sequencing primer sites that are compatible with a selected next generation sequencing platform can be added to the ends of the fragments during the amplification step. In certain embodiments, the fragments may be amplified using PCR primers that hybridize to the tags that have been added to the fragments, where the primer used for PCR have 5' tails that are compatible with a particular sequencing platform. In certain cases, the primers used may contain a molecular barcode (an "index") so that different pools can be pooled together before sequencing, and the sequence reads can be traced to a particular sample using the barcode sequence.

The present application also provides aspects and embodiments as set forth in the following numbered Statements:

Statement 1. A self-diversifying system, comprising a polynucleotide encoding one or more open reading frames, at least one open reading frame comprising a diversifying element, the diversifying element resulting in generation of diversified molecules from the polynucleotide, wherein the system is configured to generate a population of diversified molecules with an efficiency of at least 80% as measured by a number of diversified molecules in a population relative to the total number of molecules generated in the population.

Statement 2. The system of Statement 1, wherein the self-diversifying element comprises a template region and/or a variable region.

Statement 3. The system of Statement 1 or 2, wherein the self-diversifying system is a diversity generating retroelement (DGR) system.

Statement 4. The system of any one of the proceeding Statements, wherein the self-diversifying system is a non-DGR system.

Statement 5. The system of any one of the proceeding Statements, further comprising a reverse transcriptase or functional domain thereof.

Statement 6. The system of any one of the proceeding Statements, wherein the polynucleotide comprises a sequence selected from SEQ ID NOs. 98-1699.

Statement 7. The system of any one of the proceeding Statements, wherein the sequence encodes c-type lectin fold or a fragment thereof.

Statement 8. The system of any one of the proceeding Statements, wherein the sequence encodes a protein or polypeptide capable of binding to a protein or a nucleic acid.

Statement 9. The system of any one of the proceeding Statements, wherein the variable region and the template region have a sequence homology of less than 80%.

Statement 10. The system any one of the proceeding Statements, wherein the polynucleotide further comprises a regulatory sequence.

Statement 11. The system of Statement 10, wherein the regulatory sequence comprises one or more ribosomal binding sites.

Statement 12. The system of Statement 10 or 11, wherein the regulatory sequence comprises an inducible promoter.

Statement 13. The system of any one of the proceeding Statements, wherein the diversified molecules are proteins.

Statement 14. The system of any one of the proceeding Statements, wherein the diversified molecules are polynucleotides.

Statement 15. The system of any one of the proceeding Statements, wherein the sequence encodes DIV1 or a fragment thereof.

Statement 16. The system of any one of the proceeding Statements, wherein the sequence encodes DIV18 or a fragment thereof.

Statement 17. The system of any one of the proceeding Statements, wherein the sequence is from Table 1 or the sequence encodes a protein from Table 2.

Statement 18. The system of any one of the proceeding Statements, wherein the diversified molecules comprise one or more binding partners of a target molecule.

Statement 19. The system of Statement 18, wherein the target molecule is a protein.

Statement 20. The system of any one of Statements 18-19, wherein the target molecule is an antigen.

Statement 21. The system of any one of Statements 18-20, wherein the target molecule is a polynucleotide.

Statement 22. The system of any one of the proceeding Statements, wherein the system generates the library of diversified molecules when introduced to cells.

Statement 23. The system of any one of the proceeding Statements, wherein the variable region is within an open reading frame.

Statement 24. The system of any one of the proceeding Statements, wherein the system comprises a vector comprising the polynucleotide.

Statement 25. The system of any one of the proceeding Statements, wherein the system comprises a vector comprising the polynucleotide and a nucleic acid sequence encoding the reverse transcriptase.

Statement 26. The system of any one of the proceeding Statements, wherein the reverse transcriptase is error prone.

Statement 27. A method of generating a library of diversified molecules, comprising introducing the system of any one of Statements 1 to 26 in cells, wherein the system generates the library of diversified molecules in the cells.

Statement 28. The method of Statement 27, wherein the method generates the library of diversified molecules with an efficiency of 80%.

Statement 29. The method of Statement 27 or 28, wherein the cells are *E. coli* cells.

Statement 30. The method of Statement 27, 28, or 29, wherein expression of Mutator S and/or Exodeoxyribonuclease 10 are reduced or depleted in the cells.

Statement 31. A method of identifying a diversity-generating system, comprising: identifying loci with higher diversity in contigs larger than 1 kb in a database; selecting contigs comprising the identified loci in a), wherein each selected contig comprises a sequence encoding a polypeptide of least 100 amino acids; and expressing polynucleotides comprising at least a portion of the polypeptide-encoding sequence in the selected contigs from b) in cells, thereby confirming self-diversifying function of the polynucleotides.

Statement 32. The method of Statement 31, wherein the database is a metagenome database.

Statement 33. The method of Statement 31 or 32, wherein the contigs in a) are larger than 3 kb.

Statement 34. A method of screening binding partners of a target molecule, comprising: obtaining a library of diversified molecules using the system of any one of Statements 1 to 26, performing one or more assays to determine interaction between the diversified molecules and the target molecule; and selecting a subset of the diversified molecules based on results of the one or more assays.

Statement 35. The method of Statement 34, wherein the one or more assay comprise phage display, toxin inhibition assay, toxin survival assay, bacterial surface display, bacterial two-hybrid display assay, an enzyme-linked immunosorbent assay (ELISA), immunoprecipitation assay, or a combination thereof.

Statement 36. The method of Statement 34 or 35, wherein the target molecule is an antigen.

EXAMPLES

Example 1

Bacteria actively diversify endogenous proteins to adapt changing environment. This examples demonstrate an exemplary approach to use the diversification mechanism to generate protein binders at large scale.

Figure 2:
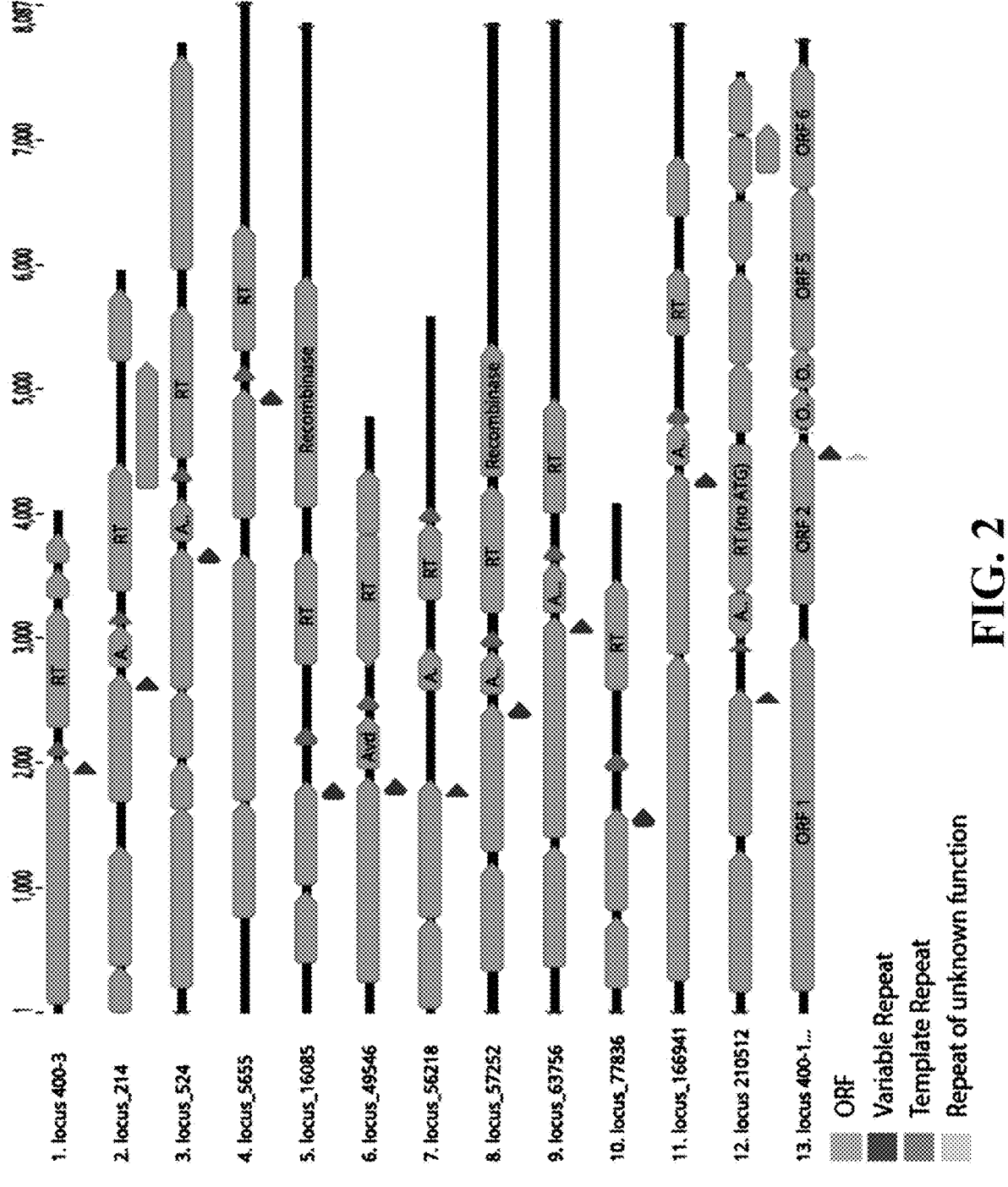
FIG. 2 shows selected candidate diversity-generating systems.
Figure 3:
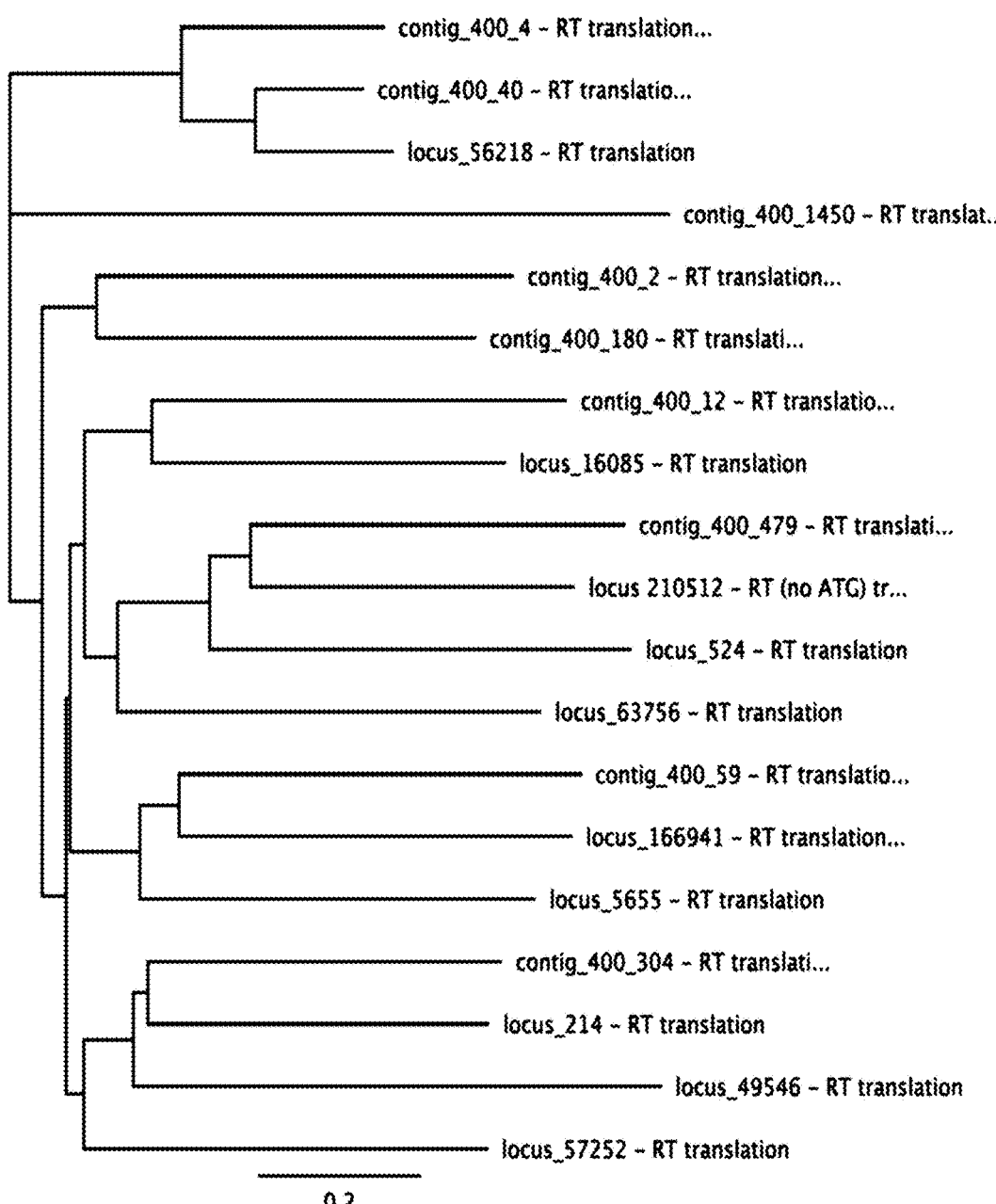
FIG. 3 shows diversity of reverse transcriptases in the candidate diversity-generating systems.

In general, edges of low-high-low diversity in DNA sequences in metagenome database of *E. coli* were found. All contigs larger than 3 kb in public JGI metagenome database for edges of low-high-low diversity regions. A algorithm and a computer with (800 GB of RAM) were used for the scan. Overlapping protein-coding sequences of at least 100 amino acid residues were filtered, and approximately 200 potential hits were found. Many of the hits had reverse transcriptase coding sequences and a template regions similar sequences to known classes of diversity-generating retroelements (DGRs) (FIGS. 1A-1D). A subset of the identified hits were selected for further analysis (FIG. 2). The reverse transcriptase in these hits showed diversity (FIG. 3)

Figure 4A:
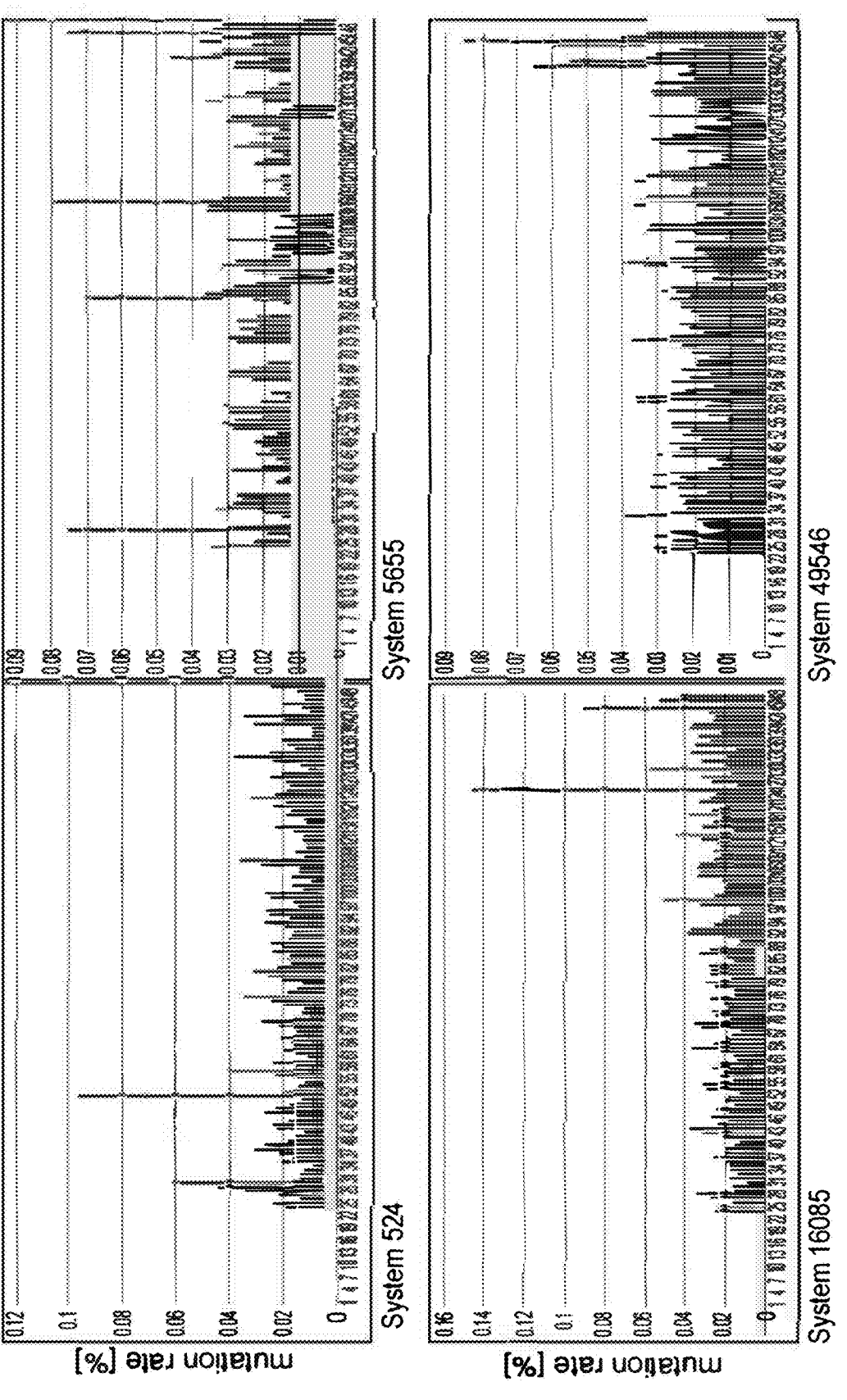
FIGS. 4A and 4B show results from testing the selected candidate diversity-generating systems of FIG. 2.
Figure 4B:
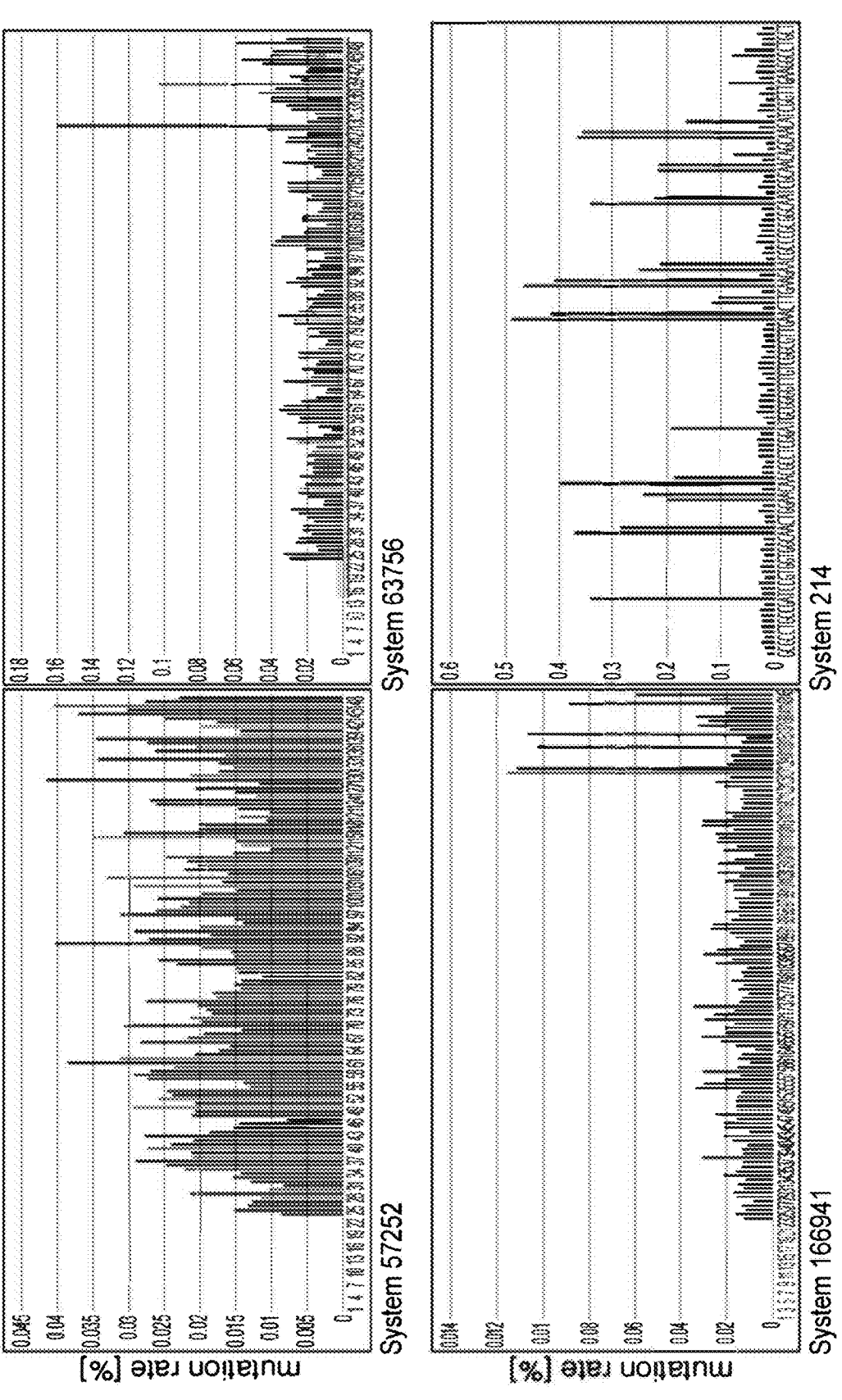
Figure 5B:
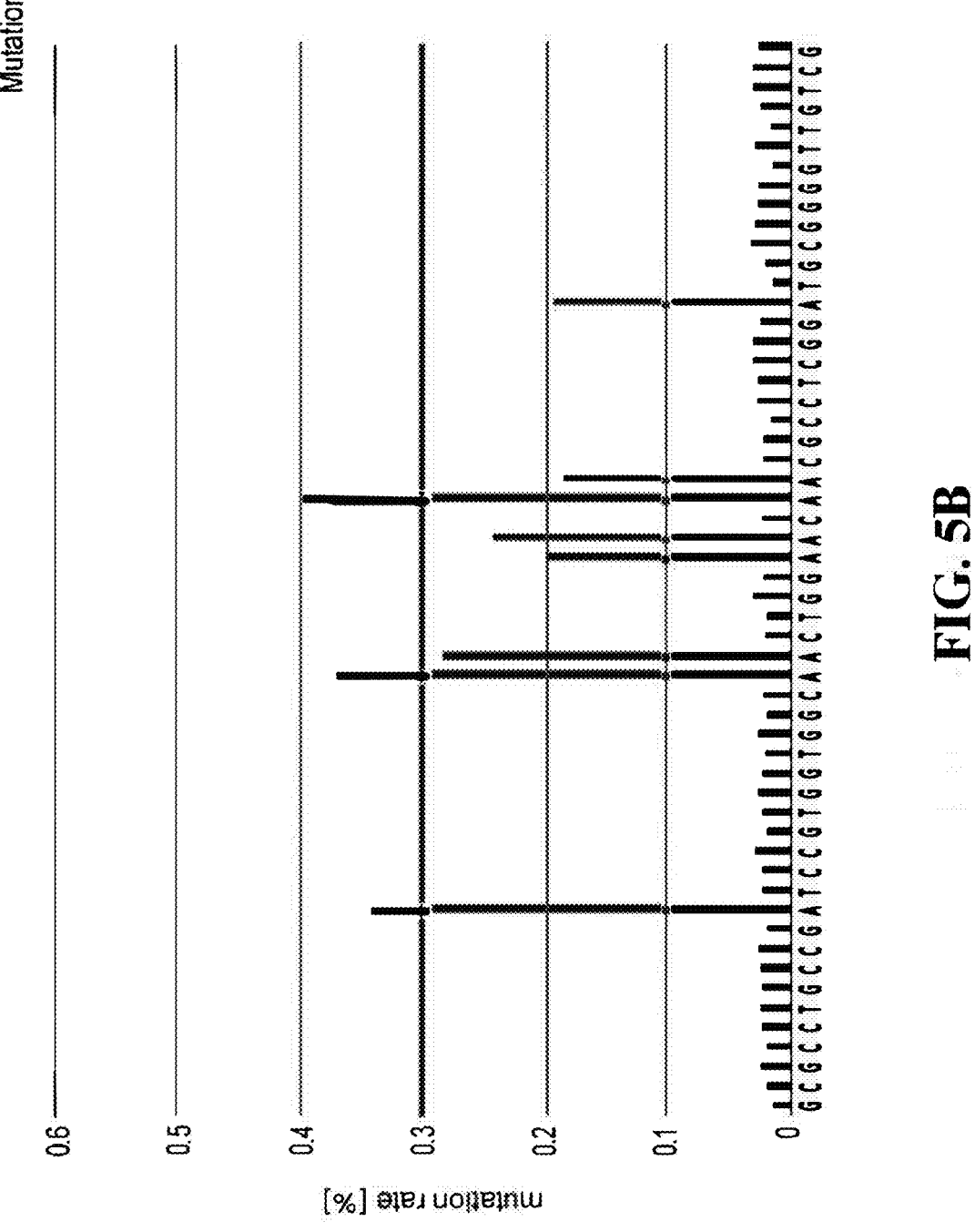
Figure 6C:
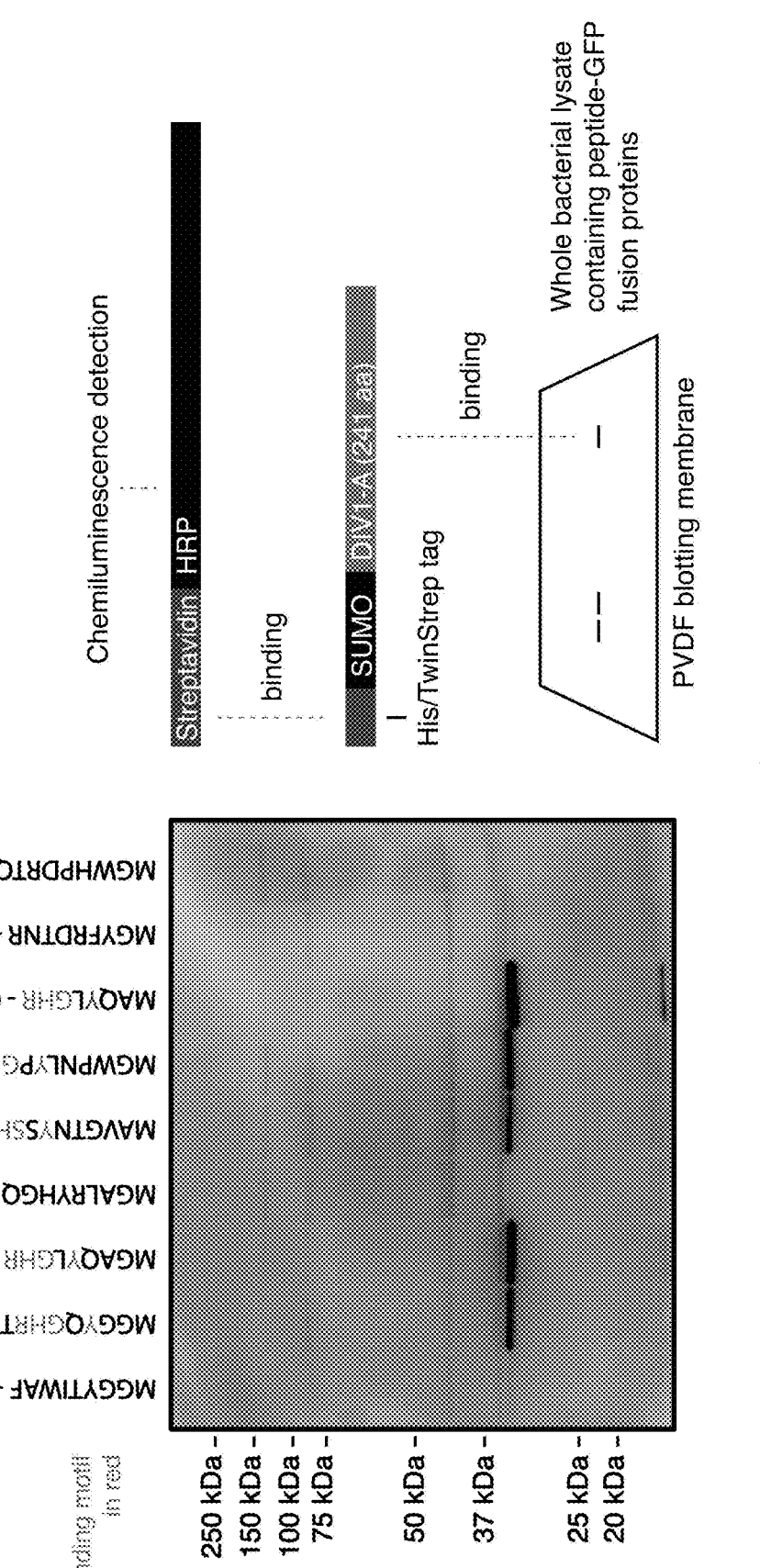

Polynucleotides systems comprising selected hits (FIG. 2) were synthesized on DNA plasmids. On the synthesized DNA plasmids, *E. coli* ribosome binding sites were added in front of every open reading frame to aid expression, equalized orientation of the open reading frames. The plasmids were transformed into *E. coli* strain with ExoX and MutS knocked out. The expression of the systems was induced by chemicals. Paired-end deep sequencing of the potential self-diversification at the natural sites of diversity was performed to detect self-diversification. The test results were shown in FIGS. 4A and 4B.

Among the selected systems, one system showed efficient self-diversification. The diversity was restricted to Adenine (A)-templated positions as predicted by the metagenome sequences. The overall diversification rate at A-templated positions was approximately 1%. Co-diversification rate of the independent positions was approximately 50%. The complexity of this system may be about $1.8 \times 10^{13}$ variants (same range as human antibodies/T-cell receptors). The test results were shown in FIGS. 5A-5D.

The analysis revealed that the system comprises the C-type lectin fold gene and had homology to human FGE enzyme (known to bind and covalently modify specific target peptides).

The system is allowed to diversify itself. Variants with intended function (e.g., binding/enzymatic targeting activity) were pulled out and further validated. The validation may be performed using phage display, a toxin inhibition/survival, bacterial surface display, bacterial-two-hybrid screening, or other means.

The generated diversified molecules may be used as high-complexity barcoding in human cells for connectomics, diversification of non-natural target genes, evolution of e.g. enzymes, antibodies, nanobodies, non-coding RNAs, barcodes, enhancers, and/or promoters.

Example 2

DIV1, a 27.3 kDa protein was identified to be diversified by a DGR in metagenome data from the Crystal Geyser in Utah and found to bind specific linear peptide motifs on a western blot membrane and displayed on M13 phage (FIGS.

6A-6C). DIV1 may be used to replace antibodies in diagnostic, therapeutic, and basic research applications.

Another DGR-diversified protein (DIV18) was also identified and found to bind specific peptide motifs as indicated by phage display data (FIGS. 7A and 7B). This protein is smaller than DIV1 and also may be used for programmable antibody-like peptide binding. Sequences of DIV1 and DIV18 are shown in Table 2.

Example 3

Figures 8A, 8B:
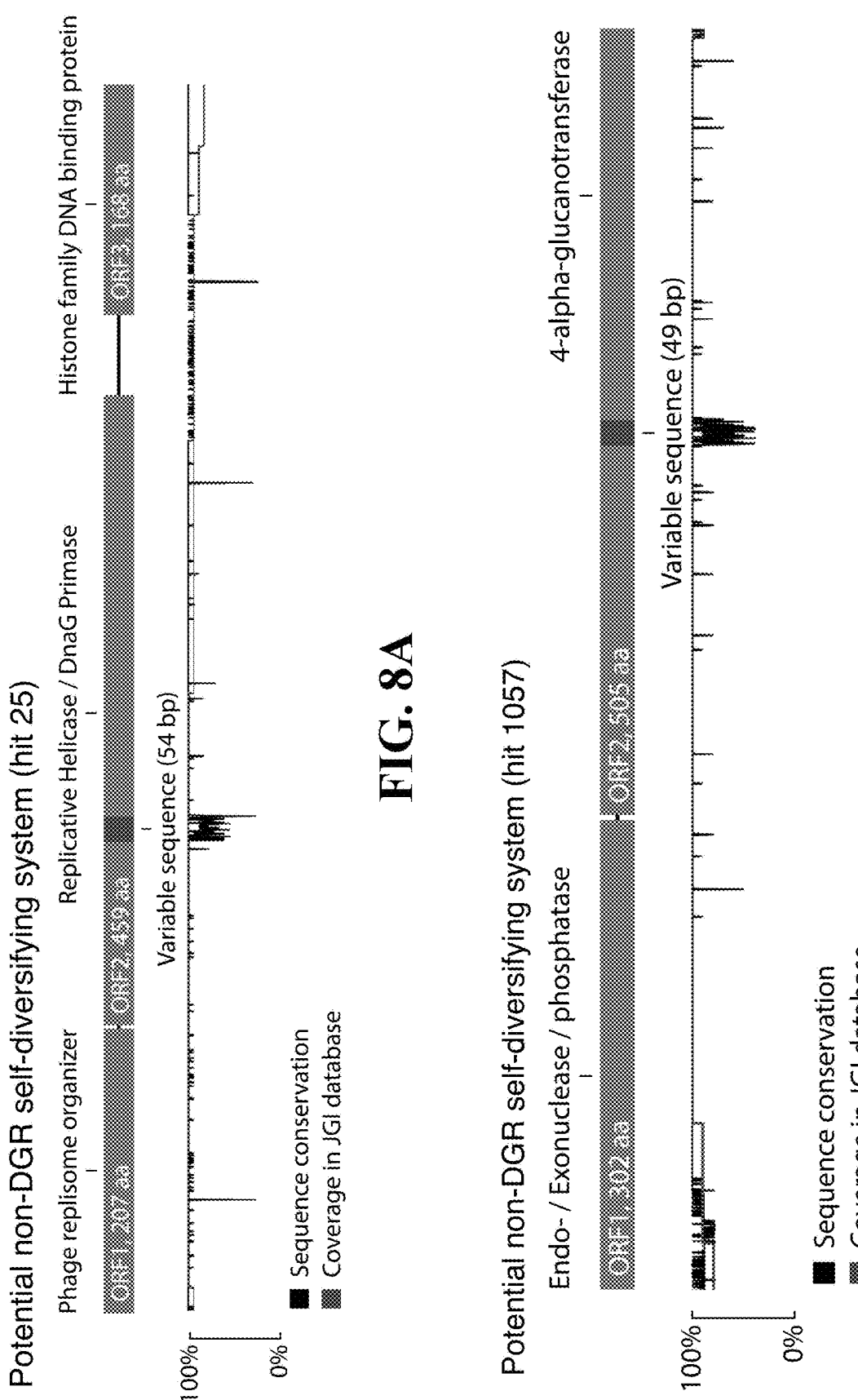
FIGS. 8A and 8B shows two exemplary non-DGR diversifying systems.

Two diversity generating systems (Non-DGR 25 and Non-DGR 1057) that are not diversity generating retroelements were also identified. The two non-DGR systems were found to self-diversify based on JGI metagenome data and contain nucleic-acid interacting proteins (FIGS. 8A and 8B). Sequences of the two systems are shown in Table 1.

Figure 9A:
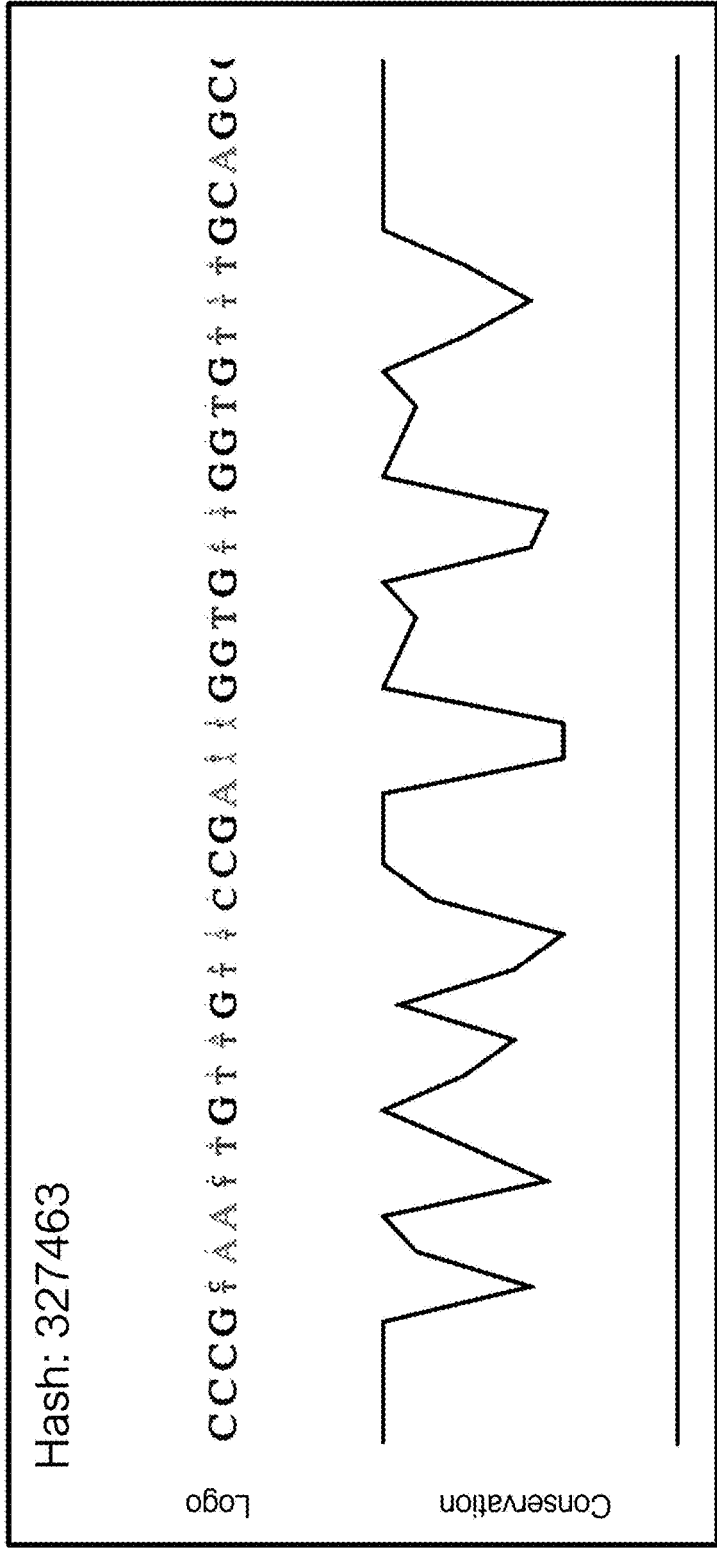
FIG. 9 shows exemplary hit (SEQ ID NOs: 1-3).

An example hit is shown in FIG. 9 (SEQ ID NOs 1-2).

Example 4

Figure 11:
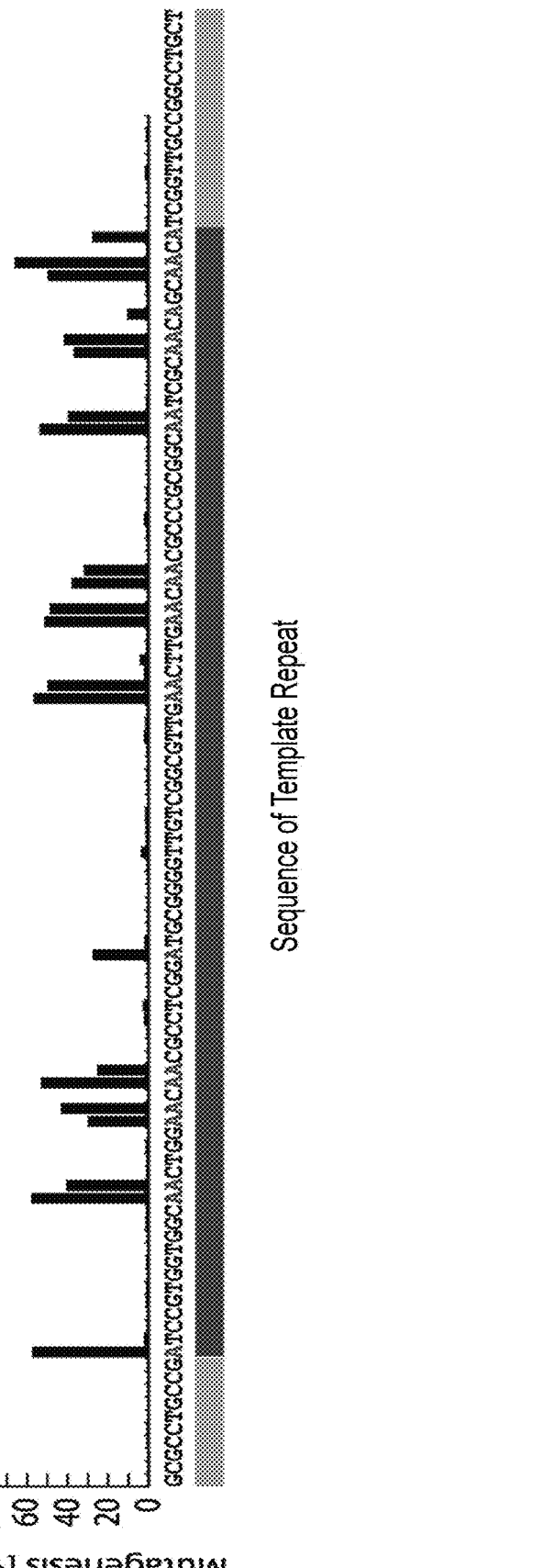
FIG. 11 shows that Hit 214 self-diversified in *E. coli* (SEQ ID NO: 85).

An exemplary self-diversifying system (Hit 214) is shown in FIG. 10. Hit 214 self-diversified in *E. coli* (FIG. 11).

Figure 12:
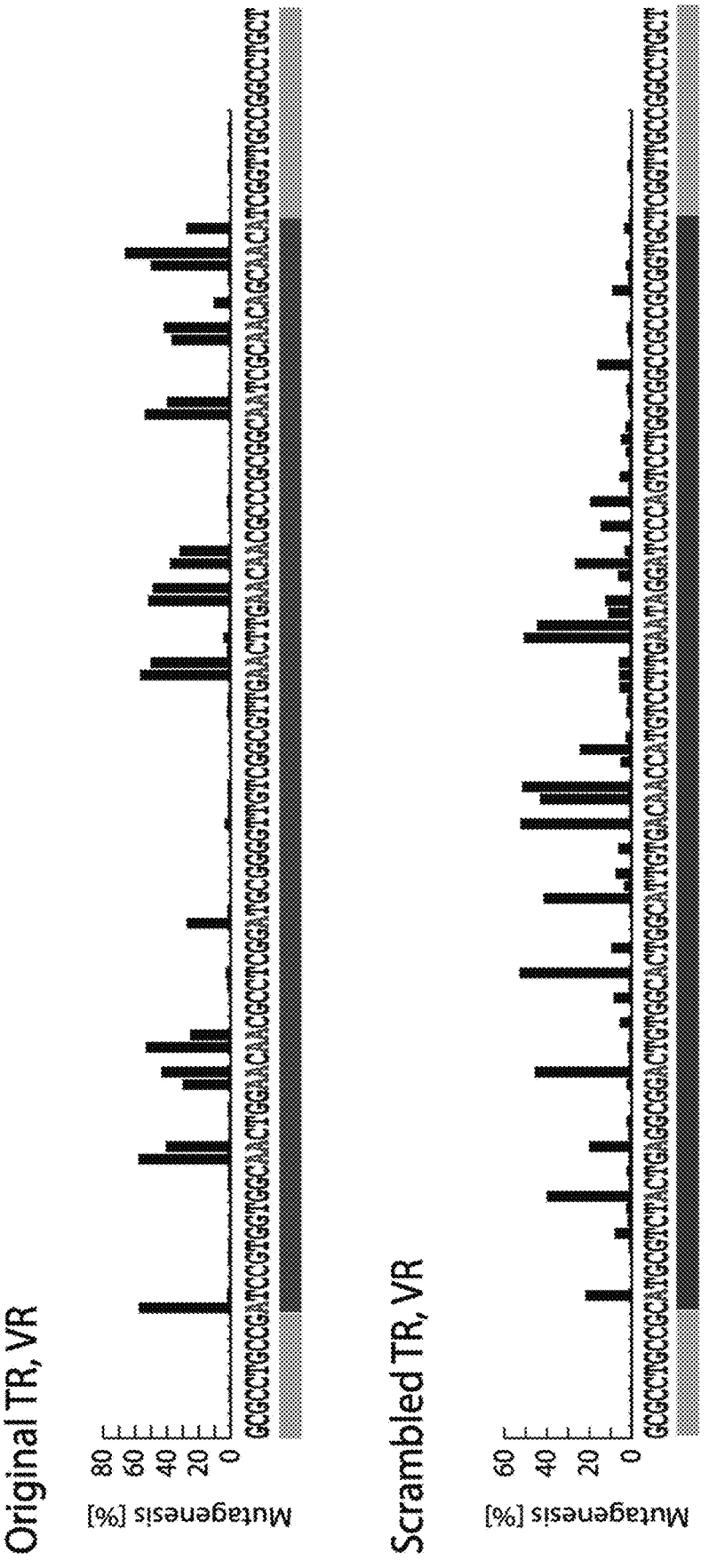
FIG. 12 show that Hit 214 underwent dA-dependent diversification (SEQ ID NOs: 86 and 87).
Figure 13:
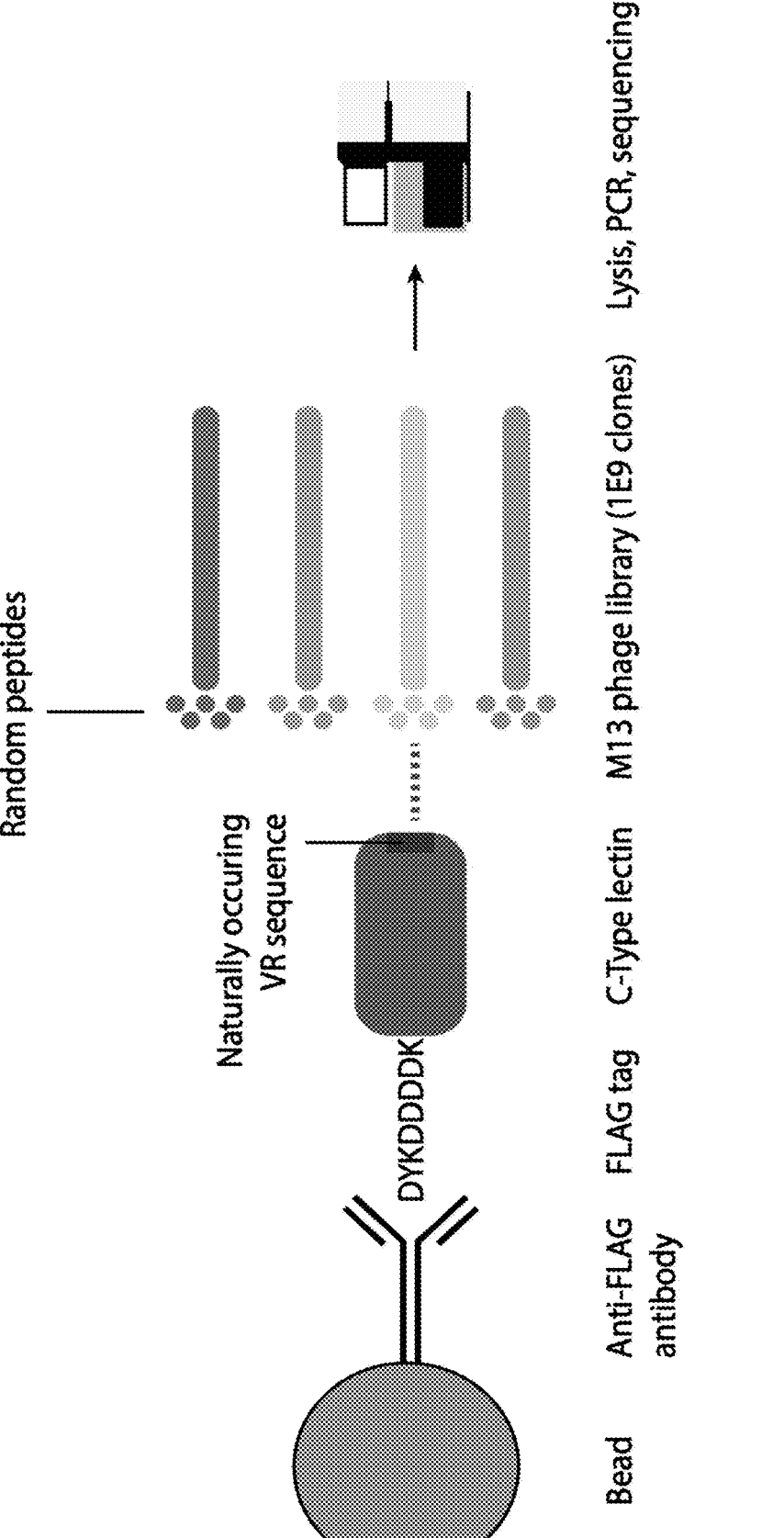
FIG. 13 shows an example 1-step phage display for screening binding molecules derived from diversity generating systems disclosed herein (SEQ ID NO: 88).
Figure 14:
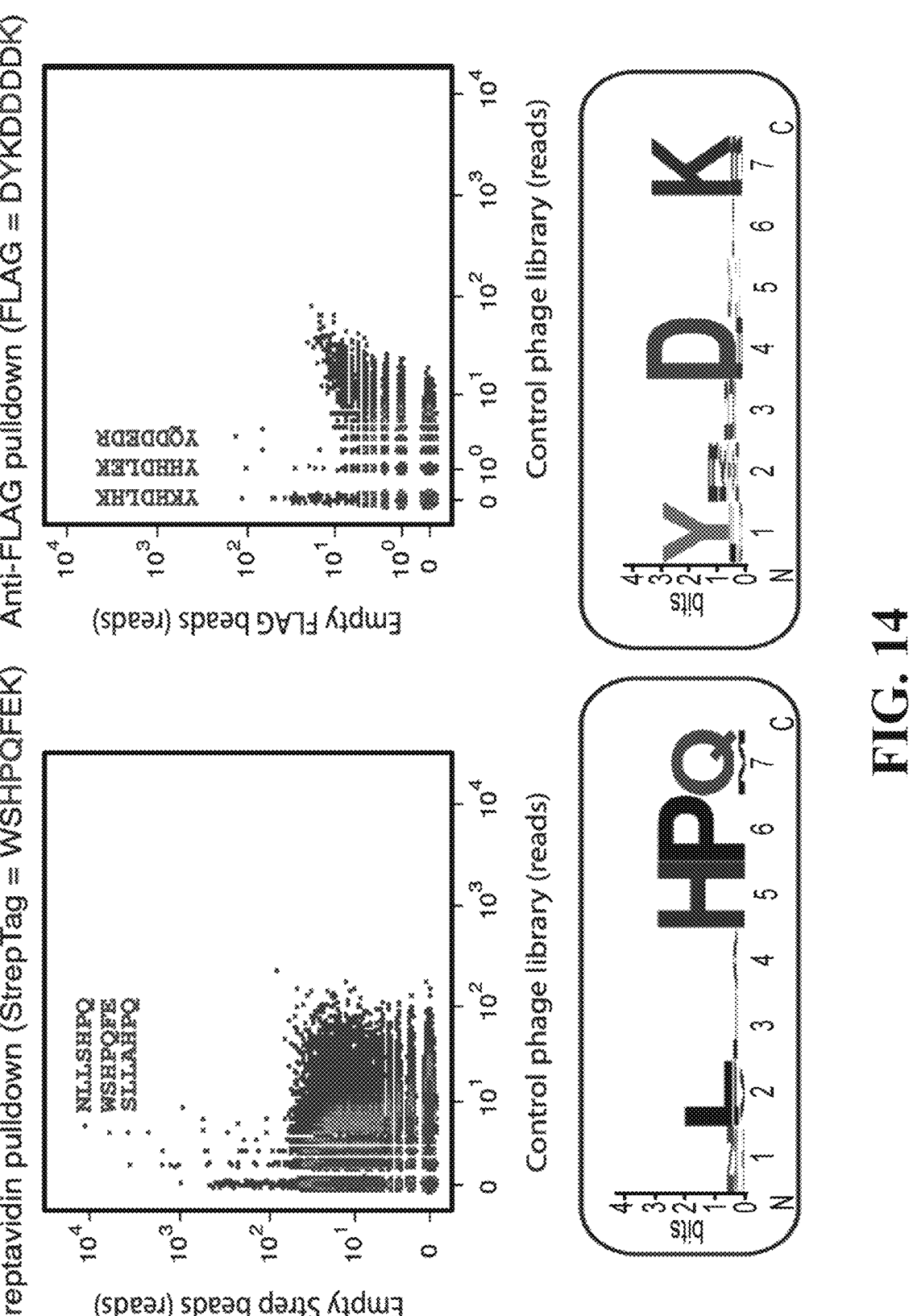
FIG. 14 shows example results of 2 positive controls from a 1-step phage display screen (SEQ ID NOs: 89 and 88) (SEQ ID NOs: 90-95).
Figure 15:
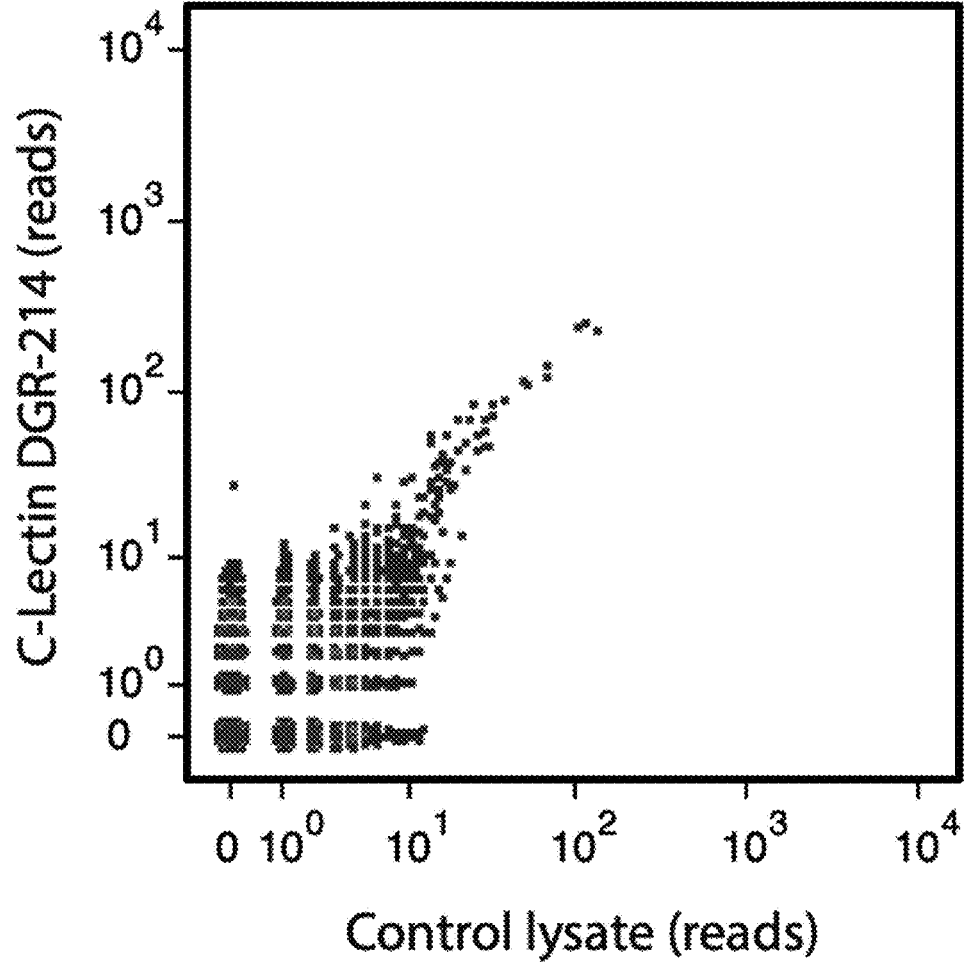
FIG. 15 shows binding assays were performed to identify peptide ligands that bound to Hit 214.

Hit214 underwent dA-dependent diversification, which was reprogrammable (FIG. 12). The diversified protein in Hit 214 is c-type lectin fold. It is homologous to human formylglycin-generating enzyme (FGE). Its variable region overlaps with predicted target-peptide binding site. A 1-step phage display assay was used to determine the binding of a self-diversified protein with a target molecule (FIG. 13). Two positive controls were used in the binding assay (FIG. 14). Binding assays were performed to identify peptide ligands that bound to Hit 214 (FIG. 15).

Hit 214 may be reprogramed (FIG. 16). Two positions in the hairpin loop were found to be important for mutagenic homing (FIG. 16). Hit 214 was reprogramed with three constructs of DIV1 (FIGS. 17A-17E). Fusion construct D self-diversified at A-positions after 24 hours of induction (0.15% homing) (FIGS. 17A-17E).

An exemplary search strategy is shown in FIG. 18.

Figure 19:
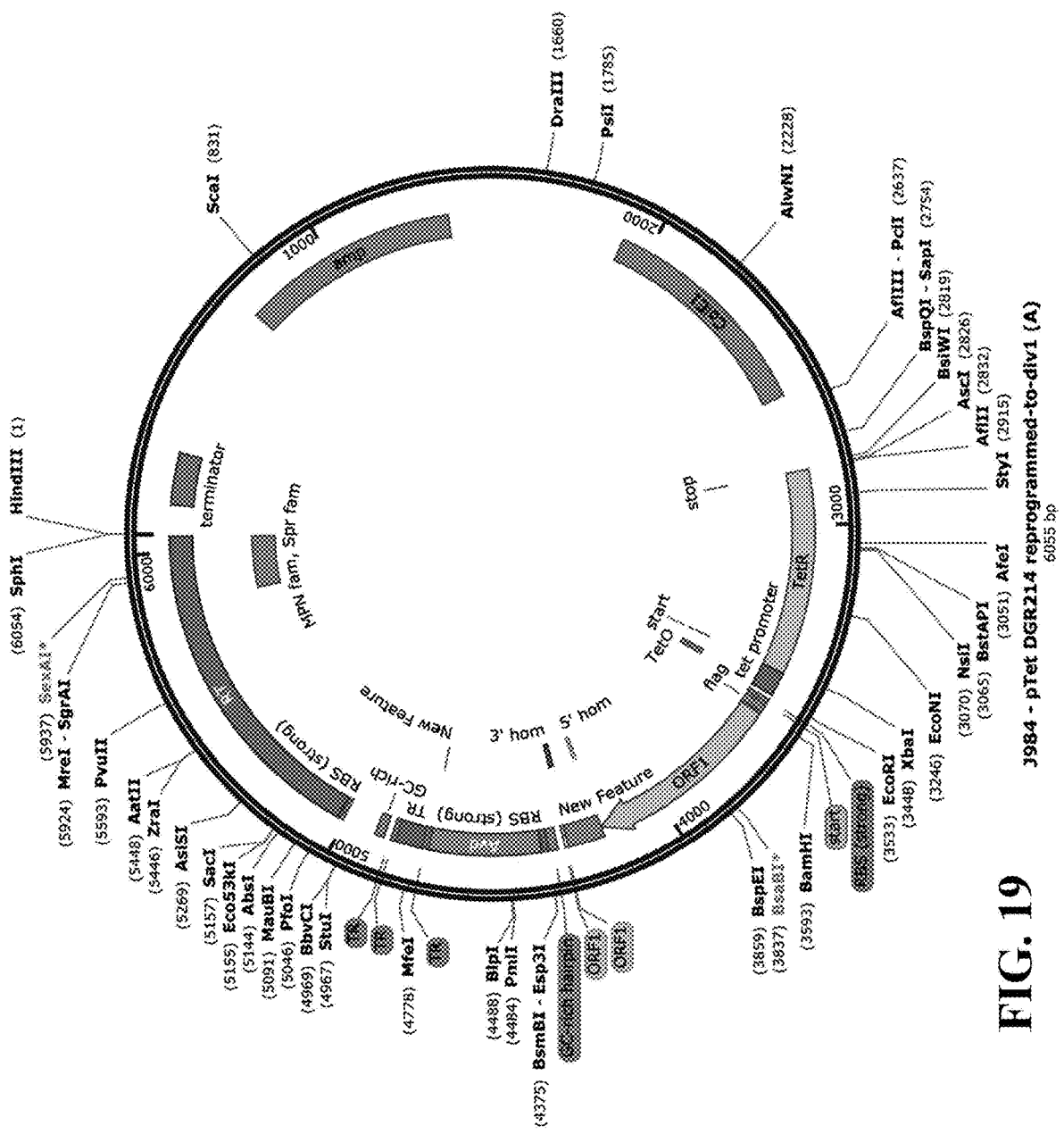
FIGS. 19-22 show maps of the constructs-DIV1 A, DIV1 B, DIV1 D, and DIV1 G.
Figure 20:
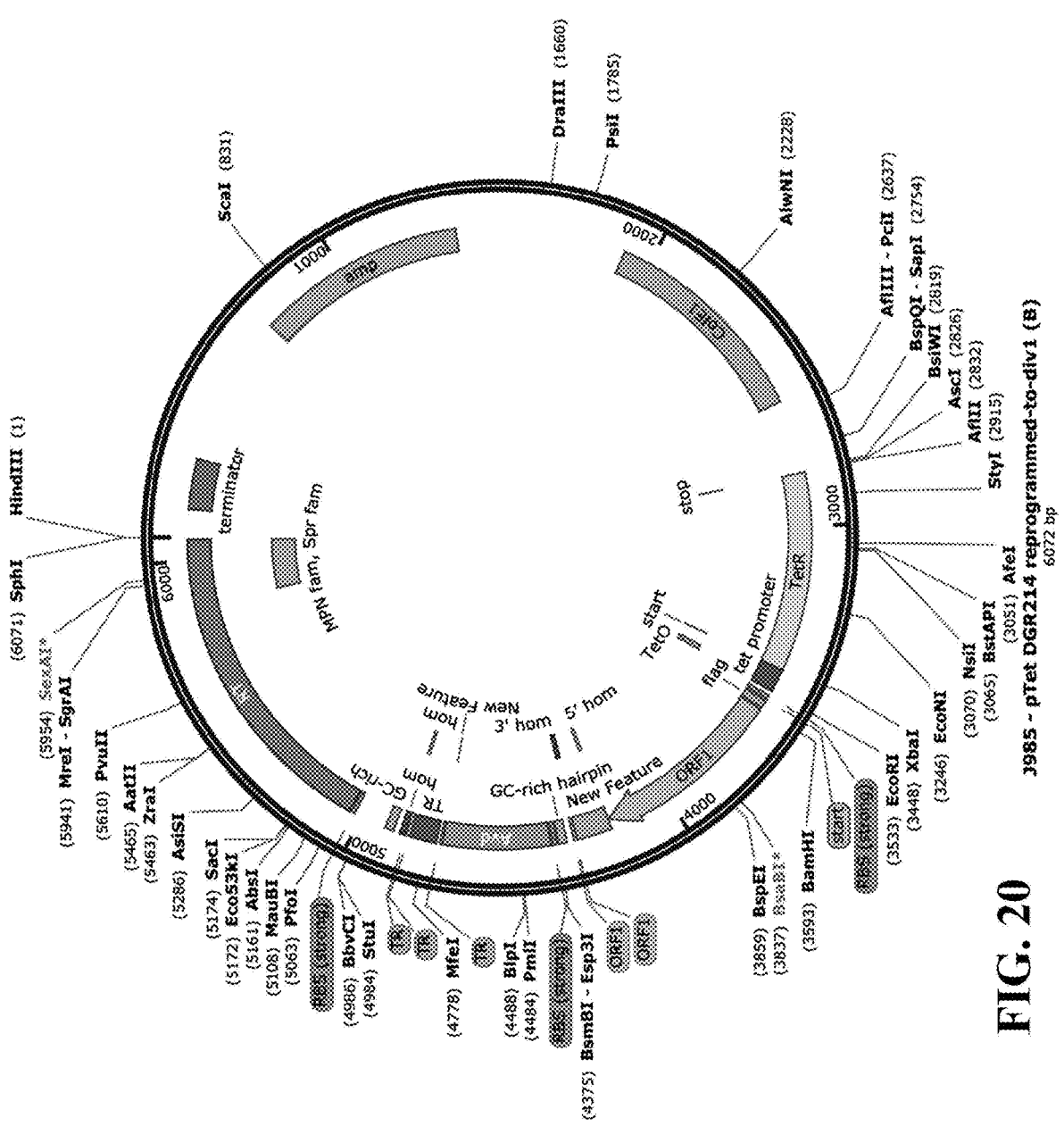
Figure 21:
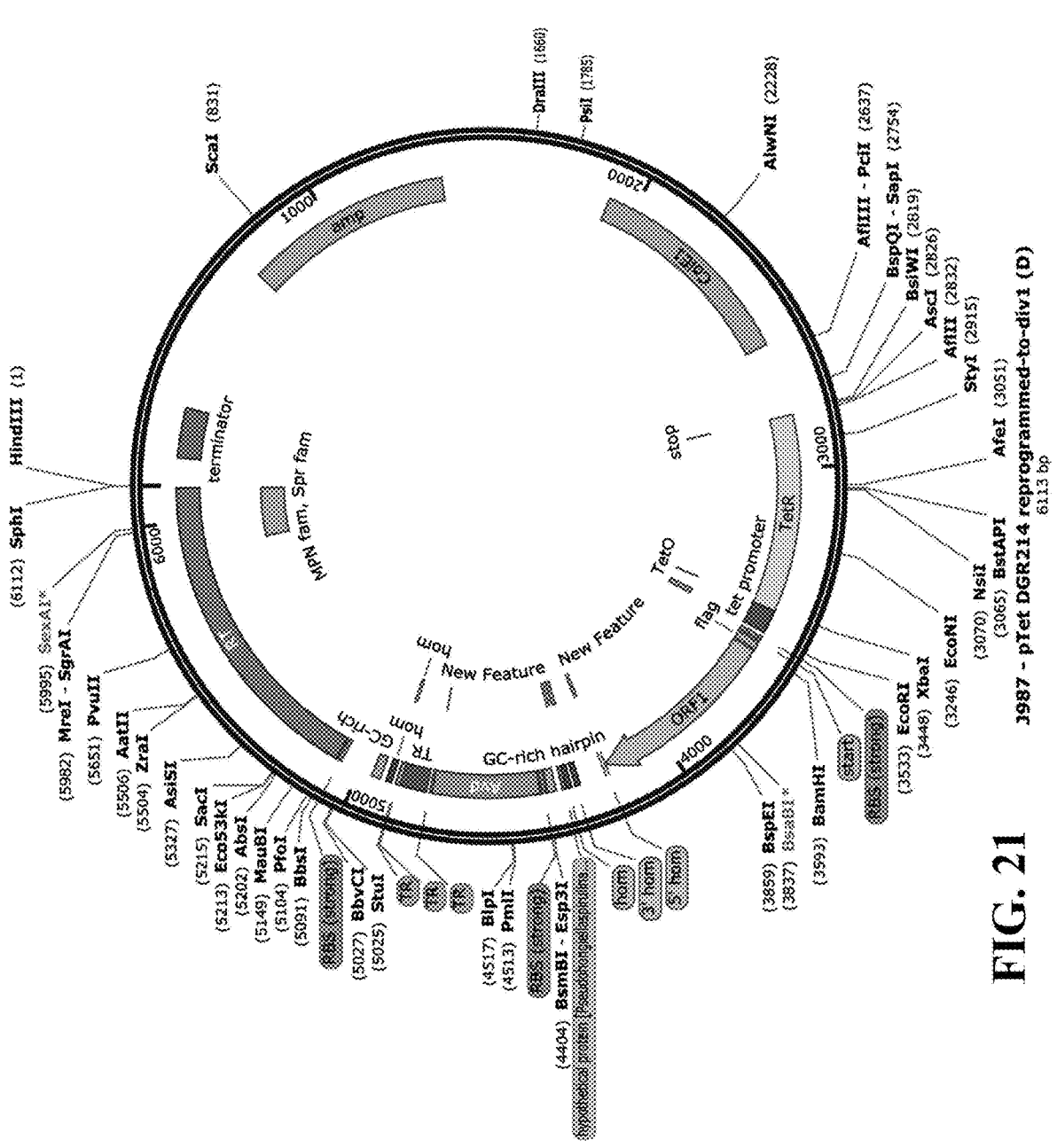
Figure 22:
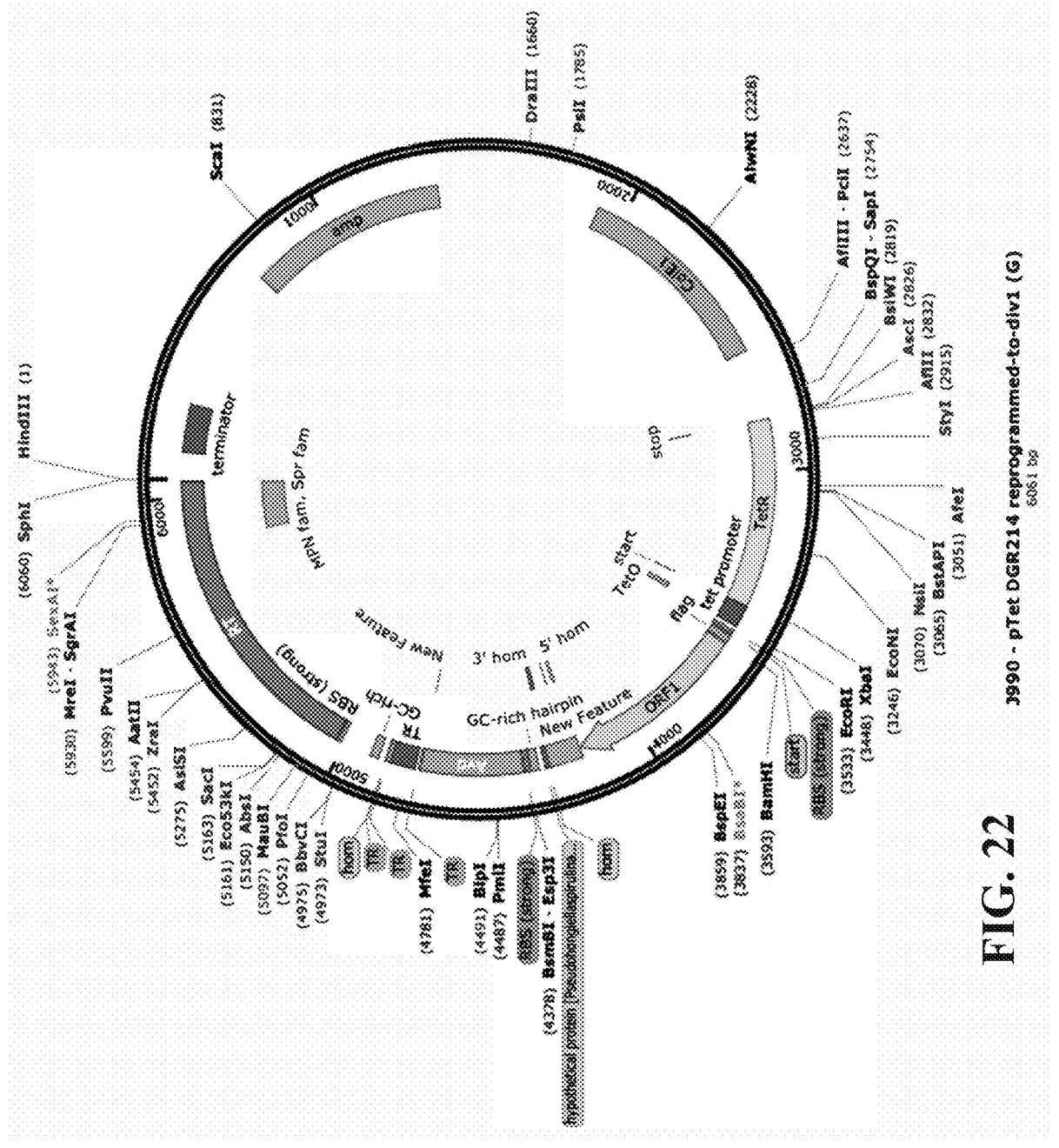

The sequences (on pTet plasmid) of reprogramed Hit 214 with DIV1 constructs A, B, D, and G are shown below. The maps of the constructs are shown in FIG. 19 (DIV1 A), FIG. 20 (DIV1 B), FIG. 21 (DIV1 D), and FIG. 22 (DIV1 G).

TABLE 3

```
7984-pTet DGR214          1 AAGCTTGGCT GTTTTGGCGG ATGAGAGAAG ATTTTCAGCC TGATACAGAT TAAATCAGAA
reprogrammed-to-div1 (A)  61 CGCAGAAGCG GTCTGATAAA ACAGAATTTG CCTGGCGGCA GTAGCGCGGT GGTCCCACCT
(SEQ ID NO: 5)           121 GACCCCATGC CGAACTCAGA AGTGAAACGC CGTAGCGCCG ATGGTAGTGT GGGGTCTCCC
                         181 CATGCGAGAG TAGGGAACTG CCAGGCATCA AATAAAACGA AAGGCTCAGT CGAAAGACTG
                         241 GGCCTTTCGT TTTATCTGTT GTTTGTCGGT GAACGCTCTC CTGAGTAGGA CAAATCCGCC
                         301 GGGAGCGGAT TTGAACGTTG CGAAGCAACG GCCCGGAGGG TGGCGGGCAG GACGCCCGCC
                         361 ATAAACTGCC AGGCATCAAA TTAAGCAGAA GGCCATCCTG ACGGATGGCC TTTTTGCGTT
                         421 TCTACAAACT CTTTTGTTTA TTTTTCTAAA TACATTCAAA TATGTATCCG CTCATGAGAC
                         481 AATAACCCTG ATAAATGCTT CAATAATATT GAAAAAGGAA GAGTATGAGT ATTCAACATT
                         541 TCCGTGTCGC CCTTATTCCC TTTTTTGCGG CATTTTGCCT TCCTGTTTTT GCTCACCCAG
                         601 AAACGCTGGT GAAAGTAAAA GATGCTGAAG ATCAGTTGGG TGCACGAGTG GGTTACATCG
                         661 AACTGGATCT CAACAGCGGT AAGATCCTTG AGAGTTTTCG CCCCGAAGAA CGTTTTCCAA
                         721 TGATGAGCAC TTTTAAAGTT CTGCTATGTG GCGCGGTATT ATCCCGTGTT GACGCCGGGC
                         781 AAGAGCAACT CGGTCGCCGC ATACACTATT CTCAGAATGA CTTGGTTGAG TACTCACCAG
                         841 TCACAGAAAA GCATCTTACG GATGGCATGA CAGTAAGAGA ATTATGCAGT GCTGCCATAA
                         901 CCATGAGTGA TAACACTGCG GCCAACTTAC TTCTGACAAC GATCGGAGGA CCGAAGGAGC
                         961 TAACCGCTTT TTTGCACAAC ATGGGGGATC ATGTAACTCG CCTTGATCGT TGGGAACCGG
                        1021 AGCTGAATGA AGCCATACCA AACGACGAGC GTGACACCAC GATGCCTGCA GCAATGGCAA
                        1081 CAACGTTGCG CAAACTATTA ACTGGCGAAC TACTTACTCT AGCTTCCCGG CAACAATTAA
                        1141 TAGACTGGAT GGAGGCGGAT AAAGTTGCAG GACCACTTCT GCGCTCGGCC CTTCCGGCTG
                        1201 GCTGGTTTAT TGCTGATAAA TCTGGAGCCG GTGAGCGTGG GTCTCGCGGT ATCATTGCAG
                        1261 CACTGGGGCC AGATGGTAAG CCCTCCCGTA TCGTAGTTAT CTACACGACG GGGAGTCAGG
                        1321 CAACTATGGA TGAACGAAAT AGACAGATCG CTGAGATAGG TGCCTCACTG ATTAAGCATT
                        1381 GGTAACTGTC AGACCAAGTT TACTCATATA TACTTTAGAT TGATTTACGC GCCCTGTAGC
                        1441 GGCGCATTAA GCGCGGCGGG TGTGGTGGTT ACGCGCAGCG TGACCGCTAC ACTTGCCAGC
                        1501 GCCCTAGCGC CCGCTCCTTT CGCTTTCTTC CCTTCCTTTC TCGCCACGTT CGCCGGCTTT
                        1561 CCCCGTCAAG CTCTAAATCG GGGGCTCCCT TTAGGGTTCC GATTTAGTGC TTTACGGCAC
                        1621 CTCGACCCCA AAAAACTTGA TTTGGGTGAT GGTTCACGTA GTGGGCCATC GCCCTGATAG
                        1681 ACGGTTTTTC GCCCTTTGAC GTTGGAGTCC ACGTTCTTTA ATAGTGGACT CTTGTTCCAA
                        1741 ACTTGAACAA CACTCAACCC TATCTCGGGC TATTCTTTTG ATTTATAAGG GATTTTGCCG
                        1801 ATTTCGGCCT ATTGGTTAAA AAATGAGCTG ATTTAACAAA AATTTAACGC GAATTTTAAC
                        1861 AAAATATTAA CGTTTACAAT TTAAAAGGAT CTAGGTGAAG ATCCTTTTTG ATAATCTCAT
                        1921 GACCAAAATC CCTTAACGTG AGTTTTCGTT CCACTGAGCG TCAGACCCCG TAGAAAAGAT
                        1981 CAAAGGATCT TCTTGAGATC CTTTTTTTCT GCGCGTAATC TGCTGCTTGC AAACAAAAAA
                        2041 ACCACCGCTA CCAGCGGTGG TTTGTTTGCC GGATCAAGAG CTACCAACTC TTTTTCCGAA
                        2101 GGTAACTGGC TTCAGCAGAG CGCAGATACC AAATACTGTC CTTCTAGTGT AGCCGTAGTT
                        2161 AGGCCACCAC TTCAAGAACT CTGTAGCACC GCCTACATAC CTCGCTCTGC TAATCCTGTT
                        2221 ACCAGTGGCT GCTGCCAGTG GCGATAAGTC GTGTCTTACC GGGTTGGACT CAAGACGATA
                        2281 GTTACCGGAT AAGGCGCAGC GGTCGGGCTG AACGGGGGGT TCGTGCACAC AGCCCAGCTT
                        2341 GGAGCGAACG ACCTACACCG AACTGAGATA CCTACAGCGT GAGCTATGAG AAAGCGCCAC
                        2401 GCTTCCCGAA GGGAGAAAGG CGGACAGGTA TCCGGTAAGC GGCAGGGTCG GAACAGGAGA
                        2461 GCGCACGAGG GAGCTTCCAG GGGGAAACGC CTGGTATCTT TATAGTCCTG TCGGGTTTCG
                        2521 CCACCTCTGA CTTGAGCGTC GATTTTTGTG ATGCTCGTCA GGGGGGCGGA GCCTATGGAA
                        2581 AAACGCCAGC AACGCGGCCT TTTTACGGTT CCTGGCCTTT TGCTGGCCTT TTGCTCACAT
                        2641 GTTCTTTCCT GCGTTATCCC CTGATTCTGT GGATAACCGT ATTACCGCCT TTGAGTGAGC
                        2701 TGATACCGCT CGCCGCAGCC GAACGACCGA GCGCAGCGAG TCAGTGAGCG AGGAAGCGGA
                        2761 AGAGCGCCTG ATGCGGTATT TTCTCCTTAC GCATCTGTGC GGTATTTCAC ACCGCATACG
                        2821 TACGGGCGCG CCTTAAGACC CACTTTCACA TTTAAGTTGT TTTTCTAATC CGCATATGAT
                        2881 CAATTCAAGG CCGAATAAGA AGGCTGGCTC TGCACCTTGG TGATCAAATA ATTCGATAGC
                        2941 TTGTCGTAAT AATGGCGGCA TACTATCAGT AGTAGGTGTT TCCCTTTCTT CTTTAGCGAC
                        3001 TTGATGCTCT TGATCTTCCA ATACGCAACC TAAAGTAAAA TGCCCCACAG CGCTGAGTGC
```

TABLE 3-continued

```
3061 ATATAATGCA TTCTCTAGTG AAAAACCTTG TTGGCATAAA AAGGCTAATT GATTTTCGAG
3121 AGTTTCATAC TGTTTTTCTG TAGGCCGTGT ACCTAAATGT ACTTTTGCTC CATCGCGATG
3181 ACTTAGTAAA GCACATCTAA AACTTTTAGC GTTATTACGT AAAAAATCTT GCCAGCTTTC
3241 CCCTTCTAAA GGGCAAAAGT GAGTATGGTG CCTATCTAAC ATCTCAATGG CTAAGGCGTC
3301 GAGCAAAGCC CGCTTATTTT TTACATGCCA ATACAATGTA GGCTGCTCTA CACCTAGCTT
3361 CTGGGCGAGT TTACGGGTTG TTAAACCTTC GATTCCGACC TCATTAAGCA GCTCTAATGC
3421 GCTGTTAATC ACTTTACTTT TATCTAATCT AGACATCATT AATTCCTAAT TTTTGTTGAC
3481 ACTCTATCGT TGATAGAGTT ATTTTACCAC TCCCTATCAG TGATAGAGAA AAGAATTCAA
3541 AAGATCTAAA GAGGAGAAAG GATCTATGGA CTACAAAGAC GATGACGACA AGggatccAT
3601 GAAGAAACAG AGCAATCAGA CCGTTCGTAT GGCAACACCG GGTCAGATTA AAGATGTTAT
3661 TAGCGCAGTT GTTGAAAGCA TTCCGGTGAA TAATCTGACA TATGAAATGG CCCAGTATTT
3721 CATCGGTCGT AAAAAATGGC TGGGCACCGA AATGAAAAAA ATCTTTAGCG TGGATAACAG
3781 CCATGCAGAT CTGATTGCAG ATTGGCAGGC ATTTTATTGT GGTCTGGGTA TTGATTGCGA
3841 TCTGAGCGGT GTTATTATTC CGGATGATCC TGGTGGTTTT GGTCGTGTGA TTATTATGGC
3901 ACAGGGTATT ACACCGCAGA GCGGTTATGA TCTGTGTGCA AAATTCTTTC CGTGCTGGAA
3961 ATATACCGAT AAAAACCTGG ATGAAGTTGT GGTTAGCGAA CGTACCGCAA AAGATGTTTA
4021 TGCAATTCGT GTTCGTGATC GTGTTGAAGC AGATGAAGAA CTGCGTAATC GTAGCTATAA
4081 TGATCTGAAA CGTCAGGGCA TTATTGGCAT TACCCTGGAA GAACGTGAAA TCTTTGAACT
4141 GAAATTTTTC AAAGAAACCG CAGGCAAACA CCTGGATATC AAAAATTGGA CCTTTTGTCT
4201 GGGTTCGTGC TATGACGGCG GCAATGTGCC GAGCGCCTCG TGGCGCAGCG GCGAGTTCGA
4261 GGTCGACTGG TGCAATCCCG GCGATGTCTT CGACGATCTG TGTTCCCGTC AGGCAGTTAG
4321 CTAATGCCTG TTCATCTGTG TTCTGCGGCC CTGCGCGATA GCGCGGGCCG TCTCTAAAAG
4381 AGGAGAAAGG ATCTATGCAA CAGCTTCAAG TCGCGCAGCG GGTCGAGGCG ATGATCGAGT
4441 ATGGCTATAT AGCTGTACGG CATTTCCCGA AATCGGAGCG TCACGTGCTC AGCGCCGAGC
4501 TGCGCGGCTC TATGTGGCGG CTGCTGCGGC TCGTGATCGT CTGCGGCAAG CGGTATCACA
4561 AAAAGACGAC ACTCGCAGAG CTGGATACCG AACTGGAGCT GCTGCGCCGC GAAGTGCGGC
4621 TCGCAAAAGA CCTGAAGTTC CTGCCGTTCC GACAATACGA AATCTGGTCG CGTCATCTCG
4681 ACGAGATCGG TCGCATGATC GGCGGCTGGA TTAAACACGC AAAACAGGGT TAAGCGCATT
4741 TGGGTTCGTG CTATGACGAC GGCAATGTGC CGAACGCCAA TTGGAACAGC GGCAAGTTCA
4801 AGGTCAACTG GTACAATCCC gACAATGTCA ACGACAATCT GTGTTCCCGT CAGCTTGAAG
4861 ATCGTCAGAA ACAGCGCGGT CACGGTGGCG CTGTCAGCAC GACATCAAAA GGGCGCTTGA
4921 TCCTCGGCCC ATGCCGAAAC ATTAACAGGC ATCGATCGTG TAGTAGGCCT CAGCCGAGGC
4981 TCGATCGTCG CCGCTTTGGC TCGATAAAGA GGAGAAAGGA TCTATGAAGA CATACAACAA
5041 CCTGTTCCCG GAGATATACA GCTTCGACAA CCTGCATGAC GCCTACGTCC GCGCGCGCCG
5101 CGGCAAACGC CACCAGGCCG ACGTGCTGCG CTTCGAGCAA AACCTCGAGG GCGAGCTCAT
5161 ACAACTACAG AACGAACTGA TCTGGCGCGA GTACGAAACT GGCCCGTATC GGCGTTTCCA
5221 TGTGCACGAG CCGAAAAAGC GTTTGGTCGC CGCGCTGCCC TTTCGCGATC GCGTCGTACA
5281 GCACAGCCTA ATCGCCGCGA TCGAGCCCAT TTGGGAGTCG CGATTCATCG ATCAGAGCTA
5341 CGCCTGCCGT CCCGGCCGGG GCGTGCACCG CGGTGCAGAC AAAGCCCAAC AATGGCTGCG
5401 CGAGGTGCGG GCCACACACG GCCGCGTCTA CGCGCTCAAG GCCGACGTCG CAGGTTATTT
5461 CGCATCGATC GATCACGACG TTCTGCGCAC GCAGCTAGAA CGCCGAATCG CTTGCCGTCC
5521 AACGCTATAC CTGCTGCTCG GCATCATCGA AACCTGGCAT CCCGGCCTTC CCATCGGCAA
5581 CCTCACGTCG CAGCTGTGCG CCAATATCTA TTTGCACGAT TTCGACGTAT TCGCAAAACA
5641 GCACGTCGGC GCACGCCGCT ATATGAGGTA TATGGATGAC TGGCTCATCG TCGACCACGA
5701 CAAAGCGCGC CTGCACGCAC AGCGCCGCGT GCTCGAGGAC TGGCTGCACG ACAATCTGCG
5761 CCTGCAGCTC AATAACAAGA CCCAGATATT TCCCGTCAGC CCACGCCACG GCCGCGGACT
5821 CGACTTCCTC GGATATCGAA TATGCCCCAC ACATCGAAAG ATTCGCAAAA ACAGCGTCAA
5881 ACGgATGCAG AAAAAACTAC GTGCGCTCGA ACGCCGCTAC GCCGCCGGCG ATATCGACCT
5941 GGTCGACATC GAGCCCGTGA TCCAGAGCTG GGTCGCCCAC GCCTCCCACG CCAGCAGCTA
6001 TCAGATCCGC CGCGCGGTGC TGGAGCGCGC GGTTTTCAAA CGCCAATAAG CATGC
```

J985-pTet DGR214
reprogrammed-to-div1 (B)
(SEQ ID NO: 6)

```
   1 AAGCTTGGCT GTTTTGGCGG ATGAGAGAAG ATTTTCAGCC TGATACAGAT TAAATCAGAA
  61 CGCAGAAGCG GTCTGATAAA ACAGAATTTG CCTGGCGGCA GTAGCGCGGT GGTCCCACCT
 121 GACCCCATGC CGAACTCAGA AGTGAAACGC CGTAGCGCCG ATGGTAGTGC GGGGTCTCCC
 181 CATGCGAGAG TAGGGAACTG CCAGGCATCA AATAAAACGA AAGGCTCAGT CGAAAGACTG
 241 GGCCTTTCGT TTTATCTGTT GTTTGTCGGT GAACGCTCTC CTGAGTAGGA CAAATCCGCC
 301 GGGAGCGGAT TTGAACGTTG CGAAGCAACG GCCCGGAGGG TGGCGGGCAG GACGCCCGCC
 361 ATAAACTGCC AGGCATCAAA TTAAGCAGAA GGCCATCCTG ACGGATGGCC TTTTTGCGTT
 421 TCTACAAACT CTTTTGTTTA TTTTTCTAAA TACATTCAAA TATGTATCCG CTCATGAGAC
 481 AATAACCCTG ATAAATGCTT CAATAATATT GAAAAAGGAA GAGTATGAGT ATTCAACATT
 541 TCCGTGTCGC CCTTATTCCC TTTTTTGCGG CATTTTGCCT TCCTGTTTTT GCTCACCCAG
 601 AAACGCTGGT GAAAGTAAAA GATGCTGAAG ATCAGTTGGG TGCACGAGTG GGTTACATCG
 661 AACTGGATCT CAACAGCGGT AAGATCCTTG AGAGTTTTCG CCCCGAAGAA CGTTTTCCAA
 721 TGATGAGCAC TTTTAAAGTT CTGCTATGTG GCGCGGTATT ATCCCGTGTT GACGCCGGGC
 781 AAGAGCAACT CGGTCGCCGC ATACACTATT CTCAGAATGA CTTGGTTGAG TACTCACCAG
 841 TCACAGAAAA GCATCTTACG GATGGCATGA CAGTAAGAGA ATTATGCAGT GCTGCCATAA
 901 CCATGAGTGA TAACACTGCG GCCAACTTAC TTCTGACAAC GATCGGAGGA CCGAAGGAGC
 961 TAACCGCTTT TTTGCACAAC ATGGGGGATC ATGTAACTCG CCTTGATCGT TGGGAACCGG
1021 AGCTGAATGA AGCCATACCA AACGACGAGC GTGACACCAC GATGCCTGCA GCAATGGCAA
1081 CAACGTTGCG CAAACTATTA ACTGGCGAAC TACTTACTCT AGCTTCCCGG CAACAATTAA
1141 TAGACTGGAT GGAGGCGGAT AAAGTTGCAG GACCACTTCT GCGCTCGGCC CTTCCGGCTG
1201 GCTGGTTTAT TGCTGATAAA TCTGGAGCCG GTGAGCGTGG GTCTCGCGGT ATCATTGCAG
1261 CACTGGGGCC AGATGGTAAG CCCTCCCGTA TCGTAGTTAT CTACACGACG GGGAGTCAGG
1321 CAACTATGGA TGAACGAAAT AGACAGATCG CTGAGATAGG TGCCTCACTG ATTAAGCATT
1381 GGTAACTGTC AGACCAAGTT TACTCATATA TACTTTAGAT TGATTTACGC GCCCTGTAGC
1441 GGCGCATTAA GCGCGGCGGG TGTGGTGGTT ACGCGCAGCG TGACCGCTAC ACTTGCCAGC
1501 GCCCTAGCGC CCGCTCCTTT CGCTTTCTTC CCTTCCTTTC TCGCCACGTT CGCCGGCTTT
1561 CCCCGTCAAG CTCTAAATCG GGGGCTCCCT TTAGGGTTCC GATTTAGTGC TTTACGGCAC
1621 CTCGACCCCA AAAAACTTGA TTTGGGTGAT GGTTCACGTA GTGGGCCATC GCCCTGATAG
1681 ACGGTTTTTC GCCCTTTGAC GTTGGAGTCC ACGTTCTTTA ATAGTGGACT CTTGTTCCAA
```

TABLE 3-continued

```
1741 ACTTGAACAA CACTCAACCC TATCTCGGGC TATTCTTTTG ATTTATAAGG GATTTTGCCG
1801 ATTTCGGCCT ATTGGTTAAA AAATGAGCTG ATTTAACAAA AATTTAACGC GAATTTTAAC
1861 AAAATATTAA CGTTTACAAT TTAAAAGGAT CTAGGTGAAG ATCCTTTTTG ATAATCTCAT
1921 GACCAAAATC CCTTAACGTG AGTTTTCGTT CCACTGAGCG TCAGACCCCG TAGAAAAGAT
1981 CAAAGGATCT TCTTGAGATC CTTTTTTTCT GCGCGTAATC TGCTGCTTGC AAACAAAAAA
2041 ACCACCGCTA CCAGCGGTGG TTTGTTTGCC GGATCAAGAG CTACCAACTC TTTTTCCGAA
2101 GGTAACTGGC TTCAGCAGAG CGCAGATACC AAATACTGTC CTTCTAGTGT AGCCGTAGTT
2161 AGGCCACCAC TTCAAGAACT CTGTAGCACC GCCTACATAC CTCGCTCTGC TAATCCTGTT
2221 ACCAGTGGCT GCTGCCAGTG GCGATAAGTC GTGTCTTACC GGGTTGGACT CAAGACGATA
2281 GTTACCGGAT AAGGCGCAGC GGTCGGGCTG AACGGGGGGT TCGTGCACAC AGCCCAGCTT
2341 GGAGCGAACG ACCTACACCG AACTGAGATA CCTACAGCGT GAGCTATGAG AAAGCGCCAC
2401 GCTTCCCGAA GGGAGAAAGG CGGACAGGTA TCCGGTAAGC GGCAGGGTCG GAACAGGAGA
2461 GCGCACGAGG GAGCTTCCAG GGGGAAACGC CTGGTATCTT TATAGTCCTG TCGGGTTTCG
2521 CCACCTCTGA CTTGAGCGTC GATTTTTGTG ATGCTCGTCA GGGGGGCGGA GCCTATGGAA
2581 AAACGCCAGC AACGCGGCCT TTTTACGGTT CCTGGCCTTT TGCTGGCCTT TTGCTCACAT
2641 GTTCTTTCCT GCGTTATCCC CTGATTCTGT GGATAACCGT ATTACCGCCT TTGAGTGAGC
2701 TGATACCGCT CGCCGCAGCC GAACGACCGA GCGCAGCGAG TCAGTGAGCG AGGAAGCGGA
2761 AGAGCGCCTG ATGCGGTATT TTCTCCTTAC GCATCTGTGC GGTATTTCAC ACCGCATACG
2821 TACGGGCGCG CCTTAAGACC CACTTTCACA TTTAAGTTGT TTTTCTAATC CGCATATGAT
2881 CAATTCAAGG CCGAATAAGA AGGCTGGCTC TGCACCTTGG TGATCAAATA ATTCGATAGC
2941 TTGTCGTAAT AATGGCGGCA TACTATCAGT AGTAGGTGTT TCCCTTTCTT CTTTAGCGAC
3001 TTGATGCTCT TGATCTTCCA ATACGCAACC TAAAGTAAAA TGCCCCACAG CGCTGAGTGC
3061 ATATAATGCA TTCTCTAGTG AAAAACCTTG TTGGCATAAA AAGGCTAATT GATTTTCGAG
3121 AGTTTCATAC TGTTTTTCTG TAGGCCGTGT ACCTAAATGT ACTTTTGCTC CATCGCGATG
3181 ACTTAGTAAA GCACATCTAA AACTTTTAGC GTTATTACGT AAAAAATCTT GCCAGCTTTC
3241 CCCTTCTAAA GGGCAAAAGT GAGTATGGTG CCTATCTAAC ATCTCAATGG CTAAGGCGTC
3301 GAGCAAAGCC CGCTTATTTT TTACATGCCA ATACAATGTA GGCTGCTCTA CACCTAGCTT
3361 CTGGGCGAGT TTACGGGTTG TTAAACCTTC GATTCCGACC TCATTAAGCA GCTCTAATGC
3421 GCTGTTAATC ACTTTACTTT TATCTAATCT AGACATCATT AATTCCTAAT TTTTGTTGAC
3481 ACTCTATCGT TGATAGAGTT ATTTTACCAC TCCCTATCAG TGATAGAGAA AAGAATTCAA
3541 AAGATCTAAA GAGGAGAAAG GATCTATGGA CTACAAAGAC GATGACGACA AGggatccAT
3601 GAAGAAACAG AGCAATCAGA CCGTTCGTAT GGCAACACCG GGTCAGATTA AGATGTTAT
3661 TAGCGCAGTT GTTGAAAGCA TTCCGGTGAA TAATCTGACA TATGAAATGG CCCAGTATTT
3721 CATCGGTCGT AAAAAATGGC TGGGCACCGA AATGAAAAAA ATCTTTAGCG TGGATAACAG
3781 CCATGCAGAT CTGATTGCAG ATTGGCAGGC ATTTTATTGT GGTCTGGGTA TTGATTGCGA
3841 TCTGAGCGGT GTTATTATTC CGGATGATCC TGGTGGTTTT GGTCGTGTGA TTATTATGGC
3901 ACAGGGTATT ACACCGCAGA GCGGTTATGA TCTGTGTGCA AAATTCTTTC CGTGCTGGAA
3961 ATATACCGAT AAAAACCTGG ATGAAGTTGT GGTTAGCGAA CGTACCGCAA AAGATGTTTA
4021 TGCAATTCGT GTTCGTGATC GTGTTGAAGC AGATGAAGAA CTGCGTAATC GTAGCTATAA
4081 TGATCTGAAA CGTCAGGGCA TTATTGGCAT TACCCTGGAA GAACGTGAAA TCTTTGAACT
4141 GAAATTTTTC AAAGAAACCG CAGGCAAACA CCTGGATATC AAAAATTGGA CCTTTTGTCT
4201 GGGTTCGTGC TATGACGGCG GCAATGTGCC GAGCGCCTCG TGGCGCAGCG GCGAGTTCGA
4261 GGTCGACTGG TGCAATCCCG GCGATGTCTT CGACGATCTG TGTTCCCGTC AGGCAGTTAG
4321 CTAATGCCTG TTCATCTGTG TTCTGCGGCC CTGCGCGATA GCGCGGGCCG TCTCTAAAAG
4381 AGGAGAAAGG ATCTATGCAA CAGCTTCAAG TCGCGCAGCG GGTCGAGGCG ATGATCGAGT
4441 ATGGCTATAT AGCTGTACGG CATTTCCCGA AATCGGAGCG TCACGTGCTC AGCGCCGAGC
4501 TGCGCGGCTC TATGTGGCGG CTGCTGCGGC TCGTGATCGT CTGCGGCAAG CGGTATCACA
4561 AAAAGACGAC ACTCGCAGAG CTGGATACCG AACTGGAGCT GCTGCGCCGC GAAGTGCGGC
4621 TCGCAAAAGA CCTGAAGTTC CTGCCGTTCC GACAATACGA AATCTGGTCG CGTCATCTCG
4681 ACGAGATCGG TCGCATGATC GGCGGCTGGA TTAAACACGA AAAACAGGGT TAAGCGCATT
4741 TGGGTTCGTG CTATGACGAC GGCAATGTGC CGAACGCCAA TTGGAACAGC GGCAAGTTCA
4801 AGGTCAACTG GTACAATCCC gACAATGTCA ACGACAATCT GTGTTCCCGT CAGTCGGTTG
4861 CCGGCCTGCT CTTGAAGATC GTCAGAAACA GCGCGGTCAC GGTGGCGCTG TCAGCACGAC
4921 ATCAAAAGGG CGCTTGATCC TCGGCCCATG CCGAAACATT AACAGGCATC GATCGTGTAG
4981 TAGGCCTCAG CCGAGGCTCG ATCGTCGCCG CTTTGGCTCG ATAAAGAGGA GAAAGGATCT
5041 ATGAAGACAT ACAACAACCT GTTCCCGGAG ATATACAGCT TCGACAACCT GCATGACGCC
5101 TACGTCCGCG CGCGCCGCGG CAAACGCCAC CAGGCCGACG TGCTGCGCTT CGAGCAAAAC
5161 CTCGAGGGCG AGCTCATACA ACTACAGAAC GAACTGATCT GGCGCGAGTA CGAAACTGGC
5221 CCGTATCGGC GTTTCCATGT GCACGAGCCG AAAAAGCGTT TGGTCGCCGC GCTGCCCTTT
5281 CGCGATCGCG TCGTACAGCA CAGCCTAATC GCCGCGATCG AGCCCATTTG GGAGTCGCGA
5341 TTCATCGATC AGAGCTACGC CTGCCGTCCC GGCCGGGGCG TGCACCGCGG TGCAGACAAA
5401 GCCCAACAAT GGCTGCGCGA GGTGCGGGCC ACACACGGCC GCGTCTACGC GCTCAAGGCC
5461 GACGTCGCAG GTTATTTCGC ATCGATCGAT CACGACGTTC TGCGCACGCA GCTAGAACGC
5521 CGAATCGCTT GCCGTCCAAC GCTATACCTG CTGCTCGGCA TCATCGAAAC CTGGCATCCC
5581 GGCCTTCCCA TCGGCAACCT CACGTCGCAG CTGTGCGCCA ATATCTATTT GCACGATTTC
5641 GACGTATTCG CAAAACAGCA CGTCGGCGCA CGCCGCTATA TGAGGTATAT GGATGACTGG
5701 CTCATCGTCG ACCACGACAA AGCGCGCCTG CACGCACAGC GCCGCGTGCT CGAGGACTGG
5761 CTGCACGACA ATCTGCGCCT GCAGCTCAAT AACAAGACCC AGATATTTCC CGTCAGCCCA
5821 CGCCACGGCC GCGGACTCGA CTTCCTCGGA TATCGAATAT GGCCCACACA TCGAAAGATT
5881 CGCAAAAACA GCGTCAAACG gATGCAGAAA AAACTACGTG CGCTCGAACG CCGCTACGCC
5941 GCCGGCGATA TCGACCTGGT CGACATCGAG CCCGTGATCC AGAGCTGGGT CGCCCACGCC
6001 TCCCACGCCA GCAGCTATCA GATCCGCCGC GCGGTGCTGG AGCGCGCGGT TTTCAAACGC
6061 CAATAAGCAT GC
```

J987-pTet DGR214
reprogrammed-to-div1 (D)
(SEQ ID NO: 7)

```
  1 AAGCTTGGCT GTTTTGGCGG ATGAGAGAAG ATTTTCAGCC TGATACAGAT TAAATCAGAA
 61 CGCAGAAGCG GTCTGATAAA ACAGAATTTG CCTGGCGGCA GTAGCGCGGT GGTCCCACCT
121 GACCCCATGC CGAACTCAGA AGTGAAACGC CGTAGCGCCG ATGGTAGTGT GGGGTCTCCC
181 CATGCGAGAG TAGGGAACTG CCAGGCATCA AATAAAACGA AAGGCTCAGT CGAAAGACTG
241 GGCCTTTCGT TTTATCTGTT GTTTGTCGGT GAACGCTCTC CTGAGTAGGA CAAATCCGCC
301 GGGAGCGGAT TTGAACGTTG CGAAGCAACG GCCCGGAGGG TGGCGGGCAG GACGCCCGCC
```

TABLE 3-continued

```
 361 ATAAACTGCC AGGCATCAAA TTAAGCAGAA GGCCATCCTG ACGGATGGCC TTTTTGCGTT
 421 TCTACAAACT CTTTTGTTTA TTTTTCTAAA TACATTCAAA TATGTATCCG CTCATGAGAC
 481 AATAACCCTG ATAAATGCTT CAATAATATT GAAAAAGGAA GAGTATGAGT ATTCAACATT
 541 TCCGTGTCGC CCTTATTCCC TTTTTTGCGG CATTTTGCCT TCCTGTTTTT GCTCACCCAG
 601 AAACGCTGGT GAAAGTAAAA GATGCTGAAG ATCAGTTGGG TGCACGAGTG GGTTACATCG
 661 AACTGGATCT CAACAGCGGT AAGATCCTTG AGAGTTTTCG CCCCGAAGAA CGTTTTCCAA
 721 TGATGAGCAC TTTTAAAGTT CTGCTATGTG GCGCGGTATT ATCCCGTGTT GACGCCGGGC
 781 AAGAGCAACT CGGTCGCCGC ATACACTATT CTCAGAATGA CTTGGTTGAG TACTCACCAG
 841 TCACAGAAAA GCATCTTACG GATGGCATGA CAGTAAGAGA ATTATGCAGT GCTGCCATAA
 901 CCATGAGTGA TAACACTGCG GCCAACTTAC TTCTGACAAC GATCGGAGGA CCGAAGGAGC
 961 TAACCGCTTT TTTGCACAAC ATGGGGGATC ATGTAACTCG CCTTGATCGT TGGGAACCGG
1021 AGCTGAATGA AGCCATACCA AACGACGAGC GTGACACCAC GATGCCTGCA GCAATGGCAA
1081 CAACGTTGCG CAAACTATTA ACTGGCGAAC TACTTACTCT AGCTTCCCGG CAACAATTAA
1141 TAGACTGGAT GGAGGCGGAT AAAGTTGCAG GACCACTTCT GCGCTCGGCC CTTCCGGCTG
1201 GCTGGTTTAT TGCTGATAAA TCTGGAGCCG GTGAGCGTGG GTCTCGCGGT ATCATTGCAG
1261 CACTGGGGGC AGATGGTAAG CCCTCCCGTA TCGTAGTTAT CTACACGACG GGGAGTCAGG
1321 CAACTATGGA TGAACGAAAT AGACAGATCG CTGAGATAGG TGCCTCACTG ATTAAGCATT
1381 GGTAACTGTC AGACCAAGTT TACTCATATA TACTTTAGAT TGATTTACGC GCCCTGTAGC
1441 GGCGCATTAA GCGCGGCGGG TGTGGTGGTT ACGCGCAGCG TGACCGCTAC ACTTGCCAGC
1501 GCCCTAGCGC CCGCTCCTTT CGCTTTCTTC CCTTCCTTTC TCGCCACGTT CGCCGGCTTT
1561 CCCCGTCAAG CTCTAAATCG GGGGCTCCCT TTAGGGTTCC GATTTAGTGC TTTACGGCAC
1621 CTCGACCCCA AAAAACTTGA TTTGGGTGAT GGTTCACGTA GTGGGCCATC GCCCTGATAG
1681 ACGGTTTTTC GCCCTTTGAC GTTGGAGTCC ACGTTCTTTA ATAGTGGACT CTTGTTCCAA
1741 ACTTGAACAA CACTCAACCC TATCTCGGGC TATTCTTTTG ATTTATAAGG GATTTTGCCG
1801 ATTTCGGCCT ATTGGTTAAA AAATGAGCTG ATTTAACAAA AATTTAACGC GAATTTTAAC
1861 AAAATATTAA CGTTTACAAT TTAAAAGGAT CTAGGTGAAG ATCCTTTTTG ATAATCTCAT
1921 GACCAAAATC CCTTAACGTG AGTTTTCGTT CCACTGAGCG TCAGACCCCG TAGAAAAGAT
1981 CAAAGGATCT TCTTGAGATC CTTTTTTTCT GCGCGTAATC TGCTGCTTGC AAACAAAAAA
2041 ACCACCGCTA CCAGCGGTGG TTTGTTTGCC GGATCAAGAG CTACCAACTC TTTTTCCGAA
2101 GGTAACTGGC TTCAGCAGAG CGCAGATACC AAATACTGTC CTTCTAGTGT AGCCGTAGTT
2161 AGGCCACCAC TTCAAGAACT CTGTAGCACC GCCTACATAC CTCGCTCTGC TAATCCTGTT
2221 ACCAGTGGCT GCTGCCAGTG GCGATAAGTC GTGTCTTACC GGGTTGGACT CAAGACGATA
2281 GTTACCGGAT AAGGCGCAGC GGTCGGGCTG AACGGGGGGT TCGTGCACAC AGCCCAGCTT
2341 GGAGCGAACG ACCTACACCG AACTGAGATA CCTACAGCGT GAGCTATGAG AAAGCGCCAC
2401 GCTTCCCGAA GGGAGAAAGG CGGACAGGTA TCCGGTAAGC GGCAGGGTCG GAACAGGAGA
2461 GCGCACGAGG GAGCTTCCAG GGGGAAACGC CTGGTATCTT TATAGTCCTG TCGGGTTTCG
2521 CCACCTCTGA CTTGAGCGTC GATTTTTGTG ATGCTCGTCA GGGGGGCGGA GCCTATGGAA
2581 AAACGCCAGC AACGCGGCCT TTTTACGGTT CCTGGCCTTT TGCTGGCCTT TTGCTCACAT
2641 GTTCTTTCCT GCGTTATCCC CTGATTCTGT GGATAACCGT ATTACCGCCT TTGAGTGAGC
2701 TGATACCGCT CGCCGCAGCC GAACGACCGA GCGCAGCGAG TCAGTGAGCG AGGAAGCGGA
2761 AGAGCGCCTG ATGCGGTATT TTCTCCTTAC GCATCTGTGC GGTATTTCAC ACCGCATACG
2821 TACGGGCGCG CCTTAAGACC CACTTTCACA TTTAAGTTGT TTTTCTAATC CGCATATGAT
2881 CAATTCAAGG CCGAATAAGA AGGCTGGCTC TGCACCTTGG TGATCAAATA ATTCGATAGC
2941 TTGTCGTAAT AATGGCGGCA TACTATCAGT AGTAGGTGTT TCCCTTTCTT CTTTAGCGAC
3001 TTGATGCTCT TGATCTTCCA ATACGCAACC TAAAGTAAAA TGCCCCACAG CGCTGAGTGC
3061 ATATAATGCA TTCTCTAGTG AAAAACCTTG TTGGCATAAA AAGGCTAATT GATTTTCGAG
3121 AGTTTCATAC TGTTTTTCTG TAGGCCGTGT ACCTAAATGT ACTTTTGCTC CATCGCGATG
3181 ACTTAGTAAA GCACATCTAA AACTTTTAGC GTTATTACGT AAAAAATCTT GCCAGCTTTC
3241 CCCTTCTAAA GGGCAAAAGT GAGTATGGTG CCTATCTAAC ATCTCAATGG CTAAGGCGTC
3301 GAGCAAAGCC CGCTTATTTT TTACATGCCA ATACAATGTA GGCTGCTCTA CACCTAGCTT
3361 CTGGGCGAGT TTACGGGTTG TTAAACCTTC GATTCCGACC TCATTAAGCA GCTCTAATGC
3421 GCTGTTAATC ACTTTACTTT TATCTAATCT AGACATCATT AATTCCTAAT TTTTGTTGAC
3481 ACTCTATCGT TGATAGAGTT ATTTTACCAC TCCCTATCAG TGATAGAGAA AAGAATTCAA
3541 AAGATCTAAA GAGGAGAAAG GATCTATGGA CTACAAAGAC GATGACGACA AGggatccAT
3601 GAAGAAACAG AGCAATCAGA CCGTTCGTAT GGCAACACCG GGTCAGATTA AAGATGTTAT
3661 TAGCGCAGTT GTTGAAAGCA TTCCGGTGAA TAATCTGACA TATGAAATGG CCCAGTATTT
3721 CATCGGTCGT AAAAAATGGC TGGGCACCGA AATGAAAAAA ATCTTTAGCG TGGATAACAG
3781 CCATGCAGAT CTGATTGCAG ATTGGCAGGC ATTTTATTGT GGTCTGGGTA TTGATTGCGA
3841 TCTGAGCGGT GTTATTATTC CGGATGATCC TGGGTGGTTTT GGTCGTGTGA TTATTATGGC
3901 ACAGGGTATT ACACCGCAGA GCGGTTATGA TCTGTGTGCA AAATTCTTTC CGTGCTGGAA
3961 ATATACCGAT AAAAACCTGG ATGAAGTTGT GGTTAGCGAA CGTACCGCAA AAGATGTTTA
4021 TGCAATTCGT GTTCGTGATC GTGTTGAAGC AGATGAAGAA CTGCGTAATC GTAGCTATAA
4081 TGATCTGAAA CGTCAGGGCA TTATTGGCAT TACCCTGGAA GAACGTGAAA TCTTTGAACT
4141 GAAATTTTTC AAAGAAACCG CAGGCAAACA CCTGGATATC AAAAATTGGA CCTTTTGTCT
4201 GGGTTCGTGC TATGACGACG GCAATGTGCC GAACGCCAAT TGGAACAGCG GCAAGTTCAA
4261 GGTCAACTGG TACAATCCCg ACAATGTCAA CGACAATCTG TGTTCCCGTC AGGCGGTTTC
4321 CTAGTCGGTT GCCGGCCTGC TTTTGTTGCC TGATGCCTGT TCATCTGTTG TCTGCGGCCC
4381 TGCGCGATAG CGCGGGCCGT CTCTAAAAGA GGAGAAAGGA TCTATGCAAC AGCTTCAAGT
4441 CGCGCAGCGG GTCGAGGCGA TGATCGAGTA TGGCTATATA GCTGTACGGC ATTTCCCGAA
4501 ATCGGAGCGT CACGTGCTCA GCGCCGAGCT GCGCGGCTCT ATGTGGCGGC TGCTGCGGCT
4561 CGTGATCGTC TGCGGCAAGC GGTATCACAA AAAGACGACA CTCGCAGAGC TGGATACCGA
4621 ACTGGAGCTG CTGCGCCGCG AAGTGCGGCT CGCAAAAGAC CTGAAGTTCC TGCCGTTCCG
4681 ACAATCGAA ATCTGGTCGC GTCATCTCGA CGAGATCGGT CGCATGATCG GCGGCTGGAT
4741 TAAACACGCA AAACAGGGTT AAGCGCATTT GGGTTCGTGC TATGACGACG GCAATGTGCC
4801 GAACGCCAAT TGGAACAGCG GCAAGTTCAA GGTCAACTGG TACAATCCCg ACAATGTCAA
4861 CGACAATCTG TGTTCCCGTC AGGCGGTTTC CTAGTCGGTT GCCGGCCTGC TCTTGAAGAT
4921 CGTCAGAAAC AGCGCGGTCA CGGTGGCGCT GTCAGCACGA CATCAAAAGG GCGCTTGATC
4981 CTCGGCCCAT GCCGAAACAT TAACAGGCAT CGATCGTGTA GTAGGCCTCA GCCGAGGCTC
5041 GATCGTCGCC GCTTTGGCTC GATAAAGAGG AGAAAGGATC TATGAAGACA TACAACAACC
5101 TGTTCCCGGA GATATACAGC TTCGACAACC TGCATGACGC CTACGTCCGC GCGCGCCGCG
```

TABLE 3-continued

```
5161 GCAAACGCCA CCAGGCCGAC GTGCTGCGCT TCGAGCAAAA CCTCGAGGGC GAGCTCATAC
5221 AACTACAGAA CGAACTGATC TGGCGCGAGT ACGAAACTGG CCCGTATCGG CGTTTCCATG
5281 TGCACGAGCG GAAAAAGCGT TTGGTCGCCG CGCTGCCCTT TCGCGATCGC GTCGTACAGC
5341 ACAGCCTAAT CGCCGCGATC GAGCCCATTT GGGAGTCGCG ATTCATCGAT CAGAGCTACG
5401 CCTGCCGTCC CGGCCGGGGC GTGCACCGCG GTGCAGACAA AGCCCAACAA TGGCTGCGCG
5461 AGGTGCGGGC CACACACGGC CGCGTCTACG CGCTCAAGGC CGACGTCGCA GGTTATTTCG
5521 CATCGATCGA TCACGACGTT CTGCGCACGC AGCTAGAACG CCGAATCGCT TGCCGTCCAA
5581 CGCTATACCT GCTGCTCGGC ATCATCGAAA CCTGGCATCC CGGCCTTCCC ATCGGCAACC
5641 TCACGTCGCA GCTGTGCGCC AATATCTATT TGCACGATTT CGACGTATTC GCAAAACAGC
5701 ACGTCGGCGC ACGCCGCTAT ATGAGGTATA TGGATGACTG GCTCATCGTC GACCACGACA
5761 AAGCGCGCCT GCACGCACAG CGCCGCGTGC TCGAGGACTG GCTGCACGAC AATCTGCGCC
5821 TGCAGCTCAA TAACAAGACC CAGATATTTC CCGTCAGCCC ACGCCACGGC CGCGGACTCG
5881 ACTTCCTCGG ATATCGAATA TGGCCCACAC ATCGAAAGAT TCGCAAAAAC AGCGTCAAAC
5941 GgATGCAGAA AAAACTACGT GCGCTCGAAC GCCGCTACGC CGCCGGCGAT ATCGACCTGG
6001 TCGACATCGA GCCCGTGATC CAGAGCTGGG TCGCCCACGC CTCCCACGCC AGCAGCTATC
6061 AGATCCGCCG CGCGGTGCTG GAGCGCGCGG TTTTCAAACG CCAATAAGCA TGC
```

J990-pTet DGR214
reprogrammed-to-div1 (G)
(SEQ ID NO: 8)

```
   1 AAGCTTGGCT GTTTTGGCGG ATGAGAGAAG ATTTTCAGCC TGATACAGAT TAAATCAGAA
  61 CGCAGAAGCG GTCTGATAAA ACAGAATTTG CCTGGCGGCA GTAGCGCGGT GGTCCCACCT
 121 GACCCCATGC CGAACTCAGA AGTGAAACGC CGTAGCGCCG ATGGTAGTGT GGGGTCTCCC
 181 CATGCGAGAG TAGGGAACTG CCAGGCATCA AATAAAACGA AAGGCTCAGT CGAAAGACTG
 241 GGCCTTTCGT TTTATCTGTT GTTTGTCGGT GAACGCTCTC CTGAGTAGGA CAAATCCGCC
 301 GGGAGCGGAT TTGAACGTTG CGAAGCAACG GCCCGGAGGG TGGCGGGCAG GACGCCCGCC
 361 ATAAACTGCC AGGCATCAAA TTAAGCAGAA GGCCATCCTG ACGGATGGCC TTTTTGCGTT
 421 TCTACAAACT CTTTTGTTTA TTTTTCTAAA TACATTCAAA TATGTATCCG CTCATGAGAC
 481 AATAACCCTG ATAAATGCTT CAATAATATT GAAAAAGGAA GAGTATGAGT ATTCAACATT
 541 TCCGTGTCGC CCTTATTCCC TTTTTTGCGG CATTTTGCCT TCCTGTTTTT GCTCACCCAG
 601 AAACGCTGGT GAAAGTAAAA GATGCTGAAG ATCAGTTGGG TGCACGAGTG GGTTACATCG
 661 AACTGGATCT CAACAGCGGT AAGATCCTTG AGAGTTTTCG CCCCGAAGAA CGTTTTCCAA
 721 TGATGAGCAC TTTTAAAGTT CTGCTATGTG GCGCGGTATT ATCCCGTGTT GACGCCGGGC
 781 AAGAGCAACT CGGTCGCCGC ATACACTATT CTCAGAATGA CTTGGTTGAG TACTCACCAG
 841 TCACAGAAAA GCATCTTACG GATGGCATGA CAGTAAGAGA ATTATGCAGT GCTGCCATAA
 901 CCATGAGTGA TAACACTGCG GCCAACTTAC TTCTGACAAC GATCGGAGGA CCGAAGGAGC
 961 TAACCGCTTT TTTGCACAAC ATGGGGGATC ATGTAACTCG CCTTGATCGT TGGGAACCGG
1021 AGCTGAATGA AGCCATACCA AACGACGAGC GTGACACCAC GATGCCTGCA GCAATGGCAA
1081 CAACGTTGCG CAAACTATTA ACTGGCGAAC TACTTACTCT AGCTTCCCGG CAACAATTAA
1141 TAGACTGGAT GGAGGCGGAT AAAGTTGCAG GACCACTTCT GCGCTCGGCC CTTCCGGCTG
1201 GCTGGTTTAT TGCTGATAAA TCTGGAGCCG GTGAGCGTGG GTCTCGCGGT ATCATTGCAG
1261 CACTGGGGCC AGATGGTAAG CCCTCCCGTA TCGTAGTTAT CTACACGACG GGGAGTCAGG
1321 CAACTATGGA TGAACGAAAT AGACAGATCG CTGAGATAGG TGCCTCACTG ATTAAGCATT
1381 GGTAACTGTC AGACCAAGTT TACTCATATA TACTTTAGAT TGATTTACGC GCCCTGTAGC
1441 GGCGCATTAA GCGCGGCGGG TGTGGTGGTT ACGCGCAGCG TGACCGCTAC ACTTGCCAGC
1501 GCCCTAGCGC CCGCTCCTTT CGCTTTCTTC CCTTCCTTTC TCGCCACGTT CGCCGGCTTT
1561 CCCCGTCAAG CTCTAAATCG GGGGCTCCCT TTAGGGTTCC GATTTAGTGC TTTACGGCAC
1621 CTCGACCCCA AAAAACTTGA TTTGGGTGAT GGTTCACGTA GTGGGCCATC GCCCTGATAG
1681 ACGGTTTTTC GCCCTTTGAC GTTGGAGTCC ACGTTCTTTA ATAGTGGACT CTTGTTCCAA
1741 ACTTGAACAA CACTCAACCC TATCTCGGGC TATTCTTTTG ATTTATAAGG GATTTTGCCG
1801 ATTTCGGCCT ATTGGTTAAA AAATGAGCTG ATTTAACAAA AATTTAACGC GAATTTTAAC
1861 AAAATATTAA CGTTTACAAT TTAAAAGGAT CTAGGTGAAG ATCCTTTTTG ATAATCTCAT
1921 GACCAAAATC CCTTAACGTG AGTTTTCGTT CCACTGAGCG TCAGACCCCG TAGAAAAGAT
1981 CAAAGGATCT TCTTGAGATC CTTTTTTTCT GCGCGTAATC TGCTGCTTGC AAACAAAAAA
2041 ACCACCGCTA CCAGCGGTGG TTTGTTTGCC GGATCAAGAG CTACCAACTC TTTTTCCGAA
2101 GGTAACTGGC TTCAGCAGAG CGCAGATACC AAATACTGTC CTTCTAGTGT AGCCGTAGTT
2161 AGGCCACCAC TTCAAGAACT CTGTAGCACC GCCTACATAC CTCGCTCTGC TAATCCTGTT
2221 ACCAGTGGCT GCTGCCAGTG GCGATAAGTC GTGTCTTACC GGGTTGGACT CAAGACGATA
2281 GTTACCGGAT AAGGCGCAGC GGTCGGGCTG AACGGGGGGT TCGTGCACAC AGCCCAGCTT
2341 GGAGCGAACG ACCTACACCG AACTGAGATA CCTACAGCGT GAGCTATGAG AAAGCGCCAC
2401 GCTTCCCGAA GGGAGAAAGG CGGACAGGTA TCCGGTAAGC GGCAGGGTCG GAACAGGAGA
2461 GCGCACGAGG GAGCTTCCAG GGGGAAACGC CTGGTATCTT TATAGTCCTG TCGGGTTTCG
2521 CCACCTCTGA CTTGAGCGTC GATTTTTGTG ATGCTCGTCA GGGGGGCGGA GCCTATGGAA
2581 AAACGCCAGC AACGCGGCCT TTTTACGGTT CCTGGCCTTT TGCTGGCCTT TTGCTCACAT
2641 GTTCTTTCCT GCGTTATCCC CTGATTCTGT GGATAACCGT ATTACCGCCT TTGAGTGAGC
2701 TGATACCGCT CGCCGCAGCC GAACGACCGA GCGCAGCGAG TCAGTGAGCG AGGAAGCGGA
2761 AGAGCGCCTG ATGCGGTATT TTCTCCTTAC GCATCTGTGC GGTATTTCAC ACCGCATACG
2821 TACGGGCGCG CCTTAAGACC CACTTTCACA TTTAAGTTGT TTTTCTAATC CGCATATGAT
2881 CAATTCAAGG CCGAATAAGA AGGCTGGCTC TGCACCTTGG TGATCAAATA ATTCGATAGC
2941 TTGTCGTAAT AATGGCGGCA TACTATCAGT AGTAGGTGTT TCCCTTTCTT CTTTAGCGAC
3001 TTGATGCTCT TGATCTTCCA ATACGCAACC TAAAGTAAAA TGCCCCACAG CGCTGAGTGC
3061 ATATAATGCA TTCTCTAGTG AAAAACCTTG TTGGCATAAA AAGGCTAATT GATTTTCGAG
3121 AGTTTCATAC TGTTTTTCTG TAGGCCGTGT ACCTAAATGT ACTTTTGCTC CATCGCGATG
3181 ACTTAGTAAA GCACATCTAA AACTTTTAGC GTTATTACGT AAAAAATCTT GCCAGCTTTC
3241 CCCTTCTAAA GGGCAAAAGT GAGTATGGTG CCTATCTAAC ATCTCAATGG CTAAGGCGTC
3301 GAGCAAAGCC CGCTTATTTT TTACATGCCA ATACAATGTA GGCTGCTCTA CACCTAGCTT
3361 CTGGGCGAGT TTACGGGTTG TTAAACCTTC GATTCCGACC TCATTAAGCA GCTCTAATGC
3421 GCTGTTAATC ACTTTACTTT TATCTAATCT AGACATCATT AATTCCTAAT TTTTGTTGAC
3481 ACTCTATCGT TGATAGAGTT ATTTTACCAC TCCCTATCAG TGATAGAGAA AAGAATTCAA
3541 AAGATCTAAA GAGGAGAAAG GATCTATGGA CTACAAAGAC GATGACGACA AGggatccAT
3601 GAAGAAACAG AGCAATCAGA CCGTTCGTAT GGCAACACCG GGTCAGATTA AGATGTTTAT
3661 TAGCGCAGTT GTTGAAAGCA TTCCGGTGAA TAATCTGACA TATGAAATGG CCCAGTATTT
3721 CATCGGTCGT AAAAAATGGC TGGGCACCGA AATGAAAAAA ATCTTTAGCG TGGATAACAG
```

TABLE 3-continued

```
3781  CCATGCAGAT CTGATTGCAG ATTGGCAGGC ATTTTATTGT GGTCTGGGTA TTGATTGCGA
3841  TCTGAGCGGT GTTATTATTC CGGATGATCC TGGTGGTTTT GGTCGTGTGA TTATTATGGC
3901  ACAGGGTATT ACACCGCAGA GCGGTTATGA TCTGTGTGCA AAATTCTTTC CGTGCTGGAA
3961  ATATACCGAT AAAAACCTGG ATGAAGTTGT GGTTAGCGAA CGTACCGCAA AAGATGTTTA
4021  TGCAATTCGT GTTCGTGATC GTGTTGAAGC AGATGAAGAA CTGCGTAATC GTAGCTATAA
4081  TGATCTGAAA CGTCAGGGCA TTATTGGCAT TACCCTGGAA GAACGTGAAA TCTTTGAACT
4141  GAAATTTTTC AAAGAAACCG CAGGCAAACA CCTGGATATC AAAAATTGGA CCTTTTGTCT
4201  GGGTTCGTGC TATGACGGCG GCAATGTGCC GAGCGCCTCG TGGCGCAGCG GCGAGTTCGA
4261  GGTCGACTGG TGCAATCCCG GCGATGTCTT CGACGATCTG TGTTCCCGTC AGGCTTTTGT
4321  TGCCTGATGC CTGTTCATCT GTGTTCTGCG GCCCTGCGCG ATAGCGCGGG CCGTCTCTAA
4381  AAGAGGAGAA AGGATCTATG CAACAGCTTC AAGTCGCGCA GCGGGTCGAG GCGATGATCG
4441  AGTATGGCTA TATAGCTGTA CGGCATTTCC CGAAATCGGA GCGTCACGTG CTCAGCGCCG
4501  AGCTGCGCGG CTCTATGTGG CGGCTGCTGC GGCTCGTGAT CGTCTGCGGC AAGCGGTATC
4561  ACAAAAAGAC GACACTCGCA GAGCTGGATA CCGAACTGGA GCTGCTGCGC CGCGAAGTGC
4621  GGCTCGCAAA AGACCTGAAG TTCCTGCCGT TCCGACAATA CGAAATCTGG TCGCGTCATC
4681  TCGACGAGAT CGGTCGCATG ATCGGCGGCT GGATTAAACA CGCAAAACAG GGTTAAGCGC
4741  ATTTGGGTTC GTGCTATGAC GACGGCAATG TGCCGAACGC CAATTGGAAC AGCGGCAAGT
4801  TCAAGGTCAA CTGGTACAAT CCCgACAATG TCAACGACAA TCTGTGTTCC CGTCAGGCTC
4861  TTGAAGATCG TCAGAAACAG CGCGGTCACG GTGGCGCTGT CAGCACGACA TCAAAAGGGC
4921  GCTTGATCCT CGGCCCATGC CGAAACATTA ACAGGCATCG ATCGTGTAGT AGGCCTCAGC
4981  CGAGGCTCGA TCGTCGCCGC TTTGGCTCGA TAAAGAGGAG AAAGGATCTA TGAAGACATA
5041  CAACAACCTG TTCCCGGAGA TATACAGCTT CGACAACCTG CATGACGCCT ACGTCCGCGC
5101  GCGCCGCGGC AAACGCCACC AGGCCGACGT GCTGCGCTTC GAGCAAAACC TCGAGGGCGA
5161  GCTCATACAA CTACAGAACG AACTGATCTG GCGCGAGTAC GAAACTGGCC CGTATCGGCG
5221  TTTCCATGTG CACGAGCCGA AAAAGCGTTT GGTCGCCGCG CTGCCCTTTC GCGATCGCGT
5281  CGTACAGCAC AGCCTAATCG CCGCGATCGA GCCCATTTGG GAGTCGCGAT TCATCGATCA
5341  GAGCTACGCC TGCCGTCCCG GCCGGGGCGT GCACCGCGGT GCAGACAAAG CCCAACAATG
5401  GCTGCGCGAG GTGCGGGCCA CACACGGCCG CGTCTACGCG CTCAAGGCCG ACGTCGCAGG
5461  TTATTTCGCA TCGATCGATC ACGACGTTCT GCGCACGCAG CTAGAACGCC GAATCGCTTG
5521  CCGTCCAACG CTATACCTGC TGCTCGGCAT CATCGAAACC TGGCATCCCG GCCTTCCCAT
5581  CGGCAACCTC ACGTCGCAGC TGTGCGCCAA TATCTATTTG CACGATTTCG ACGTATTCGC
5641  AAAACAGCAC GTCGGCGCAC GCCGCTATAT GAGGTATATG GATGACTGGC TCATCGTCGA
5701  CCACGACAAA GCGCGCCTGC ACGCACAGCG CCGCGTGCTC GAGGACTGGC TGCACGACAA
5761  TCTGCGCCTG CAGCTCAATA ACAAGACCCA GATATTTCCC GTCAGCCCAC GCCACGGCCG
5821  CGGACTCGAC TTCCTCGGAT ATCGAATATG GCCCACACAT CGAAAGATTC GCAAAAACAG
5881  CGTCAAACGg ATGCAGAAAA AACTACGTGC GCTCGAACGC CGCTACGCCG CCGGCGATAT
5941  CGACCTGGTC GACATCGAGC CCGTGATCCA GAGCTGGGTC GCCCACGCCT CCCACGCCAG
6001  CAGCTATCAG ATCCGCCGCG CGGTGCTGGA GCGCGCGGTT TTCAAACGCC AATAAGCATG
6061  C
```

35

Example 5

A method/algorithm for identifying self-diversifying systems:

Parameters:

D=distance of two constant flanking 32-mers, typically 192 or 160 bases

T=minimum number of diverse instances for a hash to be retained, typically 6

R=number of scanning rounds, typically 3

Method/Algorithm:

1. A large amount of memory (e.g. 512 GB) was allocated to an array of 16 bit-integers (named A).

2. The source sequence database was parsed base-by-base in both sense and reverse-complement orientation.

At every source position, a hash H1 was calculated of the input 32-mer sequence at that position concatenated by the input 32-mer sequence that was D bases downstream of the first 32-mer.

Hash H1 was reduced to the available number of index bits of A by a modulo or other function.

A second hash H2 was calculated from an 8-mer sequence positioned D/2 downstream of the first 32-mer, or at a defined position between the two 32-mers that were used to calculate H1.

Hash H2 was reduced to 4 bits by a modulo or other function.

The element at address H1 in array A was altered by an OR operation with the value 2/\H2.

3. All elements of array A, in which at least T bits were positive, were copied to a separate table A2.

4. Steps 1-3 here were repeated for a total of R rounds, wherein only source sequences were considered whose hash H1 had been retained in the previous round. In every round, a different hash function was used to calculate the new H1 for aggregating in array A.

5. After the last round was completed, the source sequence database was parsed base-by-base again in both sense and reverse-complement orientation, aggregating sequence logos for each retained hash value separately.

6. Sequence logos were stored, optionally filtered for redundant sequences, optionally filtered for a minimum length of highly conserved sequence, and optionally filtered for an arbitrary diversity score calculated from each logo.

Various modifications and variations of the described methods, pharmaceutical compositions, and kits of the invention will be apparent to those skilled in the art without departing from the scope and spirit of the invention. Although the invention has been described in connection with specific embodiments, it will be understood that it is capable of further modifications and that the invention as claimed should not be unduly limited to such specific embodiments. Indeed, various modifications of the described modes for carrying out the invention that are obvious to those skilled in the art are intended to be within the scope of the invention. This application is intended to cover any variations, uses, or adaptations of the invention following, in general, the principles of the invention and including such departures from the present disclosure come within known customary practice within the art to which the invention pertains and may be applied to the essential features herein before set forth.

SEQUENCE LISTING (1700 sequences)

SEQ ID NO: 1 - DNA, 4000 bp, Escherichia coli
  misc_feature (189)..(190): n is a, c, g, or t
  misc_feature (1175)..(1175): n is a, c, g, or t
  misc_feature (2014)..(2014): n is a, c, g, or t
  misc_feature (2742)..(2742): n is a, c, g, or t
  misc_feature (3182)..(3182): n is a, c, g, or t
  misc_feature (3739)..(3739): n is a, c, g, or t
  misc_feature (3844)..(3844): n is a, c, g, or t
ggagttatttccgggaacgacaaacaaccggaaccctgaaaagtaagaatcgcattcaaactacttctatatacatgagcagtccctaaattcccactctgctgcaaatcaacagccacttgtttcataaacgaagtaaaactttcctttttcattaaaaaataatttaataattaatatttactaatnncacaatttactttagtaaaatacgaaaatatatatacaaagatttacatatataaaattataatattaaaaactgaaatattcacattatctatcaaatttatttttatacatttgcgcagttttttaaacaaataatcattttaattactaaaaaacaacaaagttatgaacaacaatgaaccagctgccgaacactacagcatcaatggattcaagtatttctccgagttggcgaaagaatattttccagatctggcaaacgcctcttccgccagcaaaaaaatgcgcaaacgcatcaaagcagacaagacgttgaacgaacaactggctgccgcgtattacacctgccaaacaatcgacatcagtcccgaaatgcaactaatcctttaccgccattggggacctccccacatcgacctgccgaccaacgtttaattacgtagtagaaaacgaaaacatcgacaaggaataaaaagaaaatcgaactatatatttttaaatatatcatttatctttttattgtttattatgtattccactttgcgttcaccacttttttcggaaaagaagataactatcatttatacagctatttacagaaagaaaaaagcgttccacaaagcgttcggcaaaatgaccgtttttttcattccaaacagagcctccgaatcctcccaacgaaggctctgtttatctccggcagaagttctatcaaacacaaacagagcatccgtttcatctcctgatcgcttcttcgccccatgaaagaaaacaaaaatacaacaacttacgtaccacaactattcttcttcgtccacacccgtccacaaacagacacaccccttgcaaaccgcacgggaatagcgtacttttacagaaaatttaaataacactcaatgaaaaatttcaattttcaagccatgctgaaacatggttttctcattatccctaaagccttactacagcagcagatagaagaccgncacatgcaagaaggagaaatagaagctctcctgaaaattctgatgaaggtcaattattcggatacactctacaacgaccgtcaaaataaaaactgcctgtgtaaaagaggcgaaagcctgtttagttatcgcgactggagccacatcttccactggtctgtcggaaaagccttcaggttcatacacgagcttgccacgctgggaattatagaaatcatctctcaccccaacaattcctccctgcatattcgtgtcgtcgaatacgataaatggatgggagttcccgatagcgacaagcagaaaaagaaagccgtcaacgaaaagtttcacctgttctggaatgaattccacagcatcacacagctccccaaagagaatatcgccaaagcacaacgcgaatggaaaaagttgggcgacaaggaacagcaactcgccatcgacaggatagaggaatattatttccaccaaacgaacatcaatttccttctccatgccgccagctatttatccaacaaagcttttcttaacgaatactgataatatgaataccgaaaacagagtttcgccacaggctcccgaaatagaagaagctatcatcggcgcctgcctgatagaacagggagccataccactggtagccgacaagctgcgtcccgaaatgttctacgtcctgcgccatcaggttatctatgccgccatactggccatgtatcatgcaggaataaagatagacatcctcaccgtaaaagaagagctttcccaccgtggaaagctcgaagaggcgggcggaccgttcggcatcacccaattgagcagcaaggtggcaacctccgcccatnttgaatatcatgcgcagatcgtacacgagaaatacctgcgacgcgaaatgattctggggttcaacaaactcctcgcctgttcgctagacgaaacgatggatattgacgactcactggtagacgcgcataacctgctcgaccgtctggaaggcgaattcggccataacaaccacatgcgcgacatggatgaactaatgaccgccaccatggtagaagccgaaggacgtatcgccaacaacaaaaacggagtaaccggcctccctaccggactggcggatctggaccgcatgacgtccggactacagaaaggcgagttggtggtggtcgccgcccgtcccggcgtaggaaaaacggcattcgcactacacatggcacgaagcgcagcaatggcagggtatgccgtagctgtctacagcctcgagatgcaaggggaacgactagcagaccgatggctgacagcggtcagcgaaatcagcgcccgccattggcgatcgggaaccgtcagccaacaggaactcgtagaggcacgcacaacagccgctgacctcaaacgcctgccgatacacgtagacgacagcacatcggtcaacatggaacatatacgttccagcgcgcgactgctgcaaagccaacatgcgtgcgatgctattattatcgactacctgcaactctgcgacatgacgaccggtcaaaacaaccgcaaccgcgaacaggaagtggcacaagcnacccgcaaggcaaaattgctagccaaagaactgaatgtaccagtcgtactgcttagccagctaaaccgcgaatcggaaaaccgccctgccggccgtcccgaactggctcatctccgcgagagcggagctattgaacaggatgcagacgtcgtcatgctgctctaccgtcccgcccttgcaagggtgacgaccgaccgggaaagtggttatcccaccgaaggtctgggagtagtcatcatagccaagcaacgcaacggagagacaggaaacgtctatttcagacataatccggaaatgaccaagatcaccgaatatgtccctccgttagagtatatgctgaaacatgccaaataagaaacagttacactaataatatacaattttatattacaacatatagcataaatcattttctcattttatttcattatacatacaanatatatagcaaaacacttgactttccctctcatatttcgtatatttgtaatgtcgtaaggacagagaaaattttattacttaaaccttaactttttattgtatgaatgtattagtggagcgctatcagcgcagaaagtatgtgaatcaaccggattcacagatgttgtattatgtacgccagaaatcgggcacagtgagagtgatggacatcaacaagctggcggatgccatcgaagcgaactcctcgctcactgcaggagacgtgaagcatgccattgaggcttttgtcgagcagttacgcctatcgcttacccagggcgacaaggtgaaggttgacggattgggtacgtttcatatcacattgagcagcgagggggcagaaaaagagaaagattgcacggtgcgcagcatccgcaaagtaaatgtccgtttcgtggcggacaaggcgcttcaattggtaaatacgagccatgccactacccgaggcgaaaataatgtcgattttatcctggcagcaaagggcgacggagaaggtgacgatgacggaaatagcggnagcggtggaaacagcggcggaagcggagaagctccggacccggcagcttaatctttaaaacagcgccgcatggatattacggagtgatttctacagttactctcnatgcggtttctgttttcttctacatttattttttaattctcaattttcaatcctcaatttattaaaatgcttgataaaatcatagagatcattataacgatcctgccctttctgggcagtaaccgcaaaaagcgcaaagtaatggcgcaagaagta

SEQ ID NO: 2 - DNA, 4000 bp, Escherichia coli
  misc_feature (1972)..(1972): n is a, c, g, or t
  misc_feature (2791)..(2792): n is a, c, g, or t
  misc_feature (2794)..(2797): n is a, c, g, or t
  misc_feature (2799)..(2803): n is a, c, g, or t
  misc_feature (2806)..(2807): n is a, c, g, or t
  misc_feature (2809)..(2813): n is a, c, g, or t
  misc_feature (2818)..(2824): n is a, c, g, or t
  misc_feature (2827)..(2828): n is a, c, g, or t
  misc_feature (2831)..(2831): n is a, c, g, or t
  misc_feature (2833)..(2833): n is a, c, g, or t
  misc_feature (2835)..(2839): n is a, c, g, or t
  misc_feature (2841)..(2847): n is a, c, g, or t
  misc_feature (2849)..(2850): n is a, c, g, or t
  misc_feature (2854)..(2856): n is a, c, g, or t
  misc_feature (2858)..(2861): n is a, c, g, or t
  misc_feature (2864)..(2865): n is a, c, g, or t
  misc_feature (2867)..(2867): n is a, c, g, or t
  misc_feature (2871)..(2871): n is a, c, g, or t
  misc_feature (2875)..(2889): n is a, c, g, or t
  misc_feature (2891)..(2891): n is a, c, g, or t
  misc_feature (2893)..(2921): n is a, c, g, or t
  misc_feature (2923)..(2925): n is a, c, g, or t
  misc_feature (2927)..(2927): n is a, c, g, or t
  misc_feature (2931)..(2931): n is a, c, g, or t
  misc_feature (2934)..(2941): n is a, c, g, or t
  misc_feature (2943)..(2948): n is a, c, g, or t
  misc_feature (2950)..(2952): n is a, c, g, or t
  misc_feature (2954)..(2954): n is a, c, g, or t
  misc_feature (2956)..(2956): n is a, c, g, or t
  misc_feature (2958)..(2960): n is a, c, g, or t
  misc_feature (2962)..(2963): n is a, c, g, or t
  misc_feature (2965)..(2965): n is a, c, g, or t
  misc_feature (2967)..(2967): n is a, c, g, or t
  misc_feature (2969)..(2970): n is a, c, g, or t
  misc_feature (2972)..(2980): n is a, c, g, or t
  misc_feature (2982)..(2984): n is a, c, g, or t
  misc_feature (2986)..(2989): n is a, c, g, or t
  misc_feature (2991)..(2993): n is a, c, g, or t
  misc_feature (2998)..(3004): n is a, c, g, or t
  misc_feature (3006)..(3006): n is a, c, g, or t
  misc_feature (3008)..(3008): n is a, c, g, or t
  misc_feature (3010)..(3012): n is a, c, g, or t
  misc_feature (3015)..(3023): n is a, c, g, or t
  misc_feature (3025)..(3030): n is a, c, g, or t
  misc_feature (3032)..(3048): n is a, c, g, or t
  misc_feature (3050)..(3051): n is a, c, g, or t
  misc_feature (3053)..(3053): n is a, c, g, or t
  misc_feature (3055)..(3057): n is a, c, g, or t
  misc_feature (3059)..(3059): n is a, c, g, or t
  misc_feature (3062)..(3065): n is a, c, g, or t
  misc_feature (3067)..(3068): n is a, c, g, or t
  misc_feature (3070)..(3070): n is a, c, g, or t
  misc_feature (3074)..(3079): n is a, c, g, or t
  misc_feature (3082)..(3088): n is a, c, g, or t
  misc_feature (3092)..(3093): n is a, c, g, or t
  misc_feature (3095)..(3097): n is a, c, g, or t
  misc_feature (3099)..(3101): n is a, c, g, or t
  misc_feature (3103)..(3109): n is a, c, g, or t
  misc_feature (3111)..(3113): n is a, c, g, or t
  misc_feature (3115)..(3115): n is a, c, g, or t
  misc_feature (3118)..(3122): n is a, c, g, or t
  misc_feature (3124)..(3125): n is a, c, g, or t
  misc_feature (3129)..(3146): n is a, c, g, or t
  misc_feature (3148)..(3155): n is a, c, g, or t
  misc_feature (3157)..(3157): n is a, c, g, or t
  misc_feature (3159)..(3159): n is a, c, g, or t
  misc_feature (3161)..(3164): n is a, c, g, or t
  misc_feature (3167)..(3169): n is a, c, g, or t
  misc_feature (3171)..(3171): n is a, c, g, or t
  misc_feature (3173)..(3174): n is a, c, g, or t
  misc_feature (3177)..(3178): n is a, c, g, or t
  misc_feature (3180)..(3180): n is a, c, g, or t
  misc_feature (3182)..(3185): n is a, c, g, or t
  misc_feature (3187)..(3190): n is a, c, g, or t
  misc_feature (3192)..(3196): n is a, c, g, or t
  misc_feature (3198)..(3199): n is a, c, g, or t
  misc_feature (3201)..(3214): n is a, c, g, or t
  misc_feature (3216)..(3224): n is a, c, g, or t
  misc_feature (3226)..(3235): n is a, c, g, or t
  misc_feature (3237)..(3246): n is a, c, g, or t
  misc_feature (3248)..(3255): n is a, c, g, or t
  misc_feature (3257)..(3350): n is a, c, g, or t
  misc_feature (3352)..(3355): n is a, c, g, or t
  misc_feature (3357)..(3375): n is a, c, g, or t
  misc_feature (3377)..(3380): n is a, c, g, or t
  misc_feature (3382)..(3382): n is a, c, g, or t
  misc_feature (3384)..(3387): n is a, c, g, or t
  misc_feature (3389)..(3397): n is a, c, g, or t
  misc_feature (3399)..(3405): n is a, c, g, or t
  misc_feature (3408)..(3408): n is a, c, g, or t
  misc_feature (3411)..(3415): n is a, c, g, or t
  misc_feature (3418)..(3426): n is a, c, g, or t
  misc_feature (3428)..(3435): n is a, c, g, or t
  misc_feature (3437)..(3469): n is a, c, g, or t
  misc_feature (3471)..(3482): n is a, c, g, or t
  misc_feature (3484)..(3496): n is a, c, g, or t
  misc_feature (3499)..(3501): n is a, c, g, or t
  misc_feature (3503)..(3514): n is a, c, g, or t
  misc_feature (3516)..(3518): n is a, c, g, or t
  misc_feature (3520)..(3522): n is a, c, g, or t
  misc_feature (3524)..(3529): n is a, c, g, or t
  misc_feature (3531)..(3531): n is a, c, g, or t
  misc_feature (3534)..(3575): n is a, c, g, or t
  misc_feature (3577)..(3579): n is a, c, g, or t
  misc_feature (3581)..(3589): n is a, c, g, or t
  misc_feature (3591)..(3593): n is a, c, g, or t
  misc_feature (3595)..(3599): n is a, c, g, or t
  misc_feature (3601)..(3608): n is a, c, g, or t
  misc_feature (3610)..(3614): n is a, c, g, or t
  misc_feature (3616)..(3617): n is a, c, g, or t
  misc_feature (3619)..(3625): n is a, c, g, or t
  misc_feature (3627)..(3634): n is a, c, g, or t
  misc_feature (3636)..(3637): n is a, c, g, or t
  misc_feature (3639)..(3641): n is a, c, g, or t
  misc_feature (3643)..(3670): n is a, c, g, or t
  misc_feature (3672)..(3672): n is a, c, g, or t
  misc_feature (3674)..(3674): n is a, c, g, or t
  misc_feature (3676)..(3698): n is a, c, g, or t
  misc_feature (3700)..(3708): n is a, c, g, or t
  misc_feature (3710)..(3718): n is a, c, g, or t
  misc_feature (3720)..(3720): n is a, c, g, or t
  misc_feature (3722)..(3760): n is a, c, g, or t
  misc_feature (3762)..(3787): n is a, c, g, or t
  misc_feature (3789)..(3789): n is a, c, g, or t
  misc_feature (3791)..(3823): n is a, c, g, or t
  misc_feature (3825)..(3842): n is a, c, g, or t
  misc_feature (3844)..(3863): n is a, c, g, or t
  misc_feature (3865)..(3916): n is a, c, g, or t
  misc_feature (3918)..(3954): n is a, c, g, or t
  misc_feature (3956)..(3986): n is a, c, g, or t
  misc_feature (3988)..(4000): n is a, c, g, or t
tacgccgggccgtctgggaaactacatggatgacgaaggcaaggaagaggcaggccccgctgccggcgcggcaggaaacgcagcgggcgggaacagccagcccgagcgtatcatcgccctccttggcggacgggagaacattgaatttgtggacgcctgcatgaccaggctccgcgtgacagtgaaggatctctccaaggtggctgaacttccggcgtggaaggcagagggcgccatgggccttgtgaagaaagacaacggcatccaggcaatttacggacccaaggcggacgtgctgaaatcggatatcaacgatatcctgtaacaattcagcaccccggaaaaaatgagtgaaatatgaacggggagcctgctcaccgggcagattttgctcaatacgcagaggaaagaactatgagactgcttactatcaatattcacagccatggaagtgactttgaaccggaactttatcatcagaagatgaaggcgctggcggcatttatgaaggaagaagagatcgatgccgcggcgatccaggaatgcagtgaagaggaggacaggccggtggtctccggccccctccccatgcattgggtgccggccggaccggactcccgcgtccgggaggataactgtgcgctggtcctggcggaggaacttcagggcctgcagcaggagtactggtggacctggaccggagcgaagctcgggtacggaaaatacaatgagggtctggccatcttcagccgccgccctgttacaggcgcggacagtttctatatttccggcgtccgggacttctccaactggaagacccggaaggcgctggcggcctgcaccgctgacgggcctgcctttttgagcgtccacatgggatggtggaatgatccggaggaaaacttccgggggcagatggaacggctgcagaaggcgctccgcgaaaggaagcttcgtccgcaggacggttctgacagtttccttatgggagatttcaacagtcccgcagcgatccgcggagagggaagggacatggtcctggacctcgggtggcgggacagttatgaggatgccgaaataaaagacagcggcatcaccgttccgggaaacatcgacggatggagggacggtgaacatacgggcatgcgcctggattatatctggaccgcaaaaaggcacagggtgcttcagtcaaaggtggtcctgaacgggatcagcgggccggtgctttccgaccatttcggagtcctggcggtgatcgaatgaataaaggagcagacagcatgagagaaagtggaattcttcttgccatcagcagccttccttccgaatacgggatcggctgcttcagcagggaagcatatgagtttgcggaccgcctttcagaggcgggccagagttactggcagatcctgccgctggggccggtgggatacggagattcaccgtaccagtccttctccaccttcgcgggcaacccttactacatttcacctgagacgctggtggaaaagggatggatcactgaggcggactgccgcgaagccggcctttcttccgacccgcgcggtgtggattacgtgctgcagtaccaacgccgctatgagctgctccggaaggcgtacagaaacagccggatcgaagagaatgagaagttccgggcgttcacggagaagacggaatggcttccggactacgcgctgttcatggctctgaaggaagagaacggaggaaggccctggtacgaatgggaagatccgctgagactcagggatccggaagccttggccgcggcgcgggaacgcctggaggaaggcatcggtttctgcagtttcctgcagtttgagttttacgaagagtggatgcagctgaaggactacgtgaaccggaagggaatacggatcatcggagacatcccgatctatgtatccctggacagttcagacgtctgggcggatccggaacttttccngctggatgaaaaccgccgacagaccgcggcggcgggctgcccgccggatggcttcagcgctgtgggacagctctggggcaacccactctatgactgggactatcacaaaaagacctgttttgcctggtggctgaaacgtcttaaaaactgctttgatatttatgatgtgatgcggatcgaccatttccgcggcttcgatgaatatttttccattcctgccggtgcggaggacgcaagagcaggccattgggagaagggacccggcatggatctgttccggaaggtctcggaagccttcccgggacgggagatcatcgcggaggatctggggtatgtgacggacagtgtccggcagctggtgaaggacagcggctatcccgggatgaaggtcctggaatttgcctttgactcaagagattccggctgtgcggaggattaccttccccacaattacgaaaagaacagtgtggtctacaccggcacccatgacaacgagacggtgaccggctggttttccgagggcctgaagccggaggagaaggaggcagtcagagactatttctgcgaccatacgactcccgacgccgggatgcacatacccctgatctgcgccgccatgcgaagcgtcagcagactctgcatcatccccatgcaggaccttctggggtacggaaacgaggcaaggatgaacgctccttccacctacggaaacaactggaaatggcgtcttctgaaggatgaattcggagagaaggaagtgaagacgctgtatgagatcacgaagcggtacggaaggatcggaaaatgagaaaagagganngnnnntnnnnnaanngnnnnntaccnnnnnnnagnncantnannnnntnnnnnnntnnttannncnnnncanngnaatnatcnnnnnnnnnnnnnnntntnnnnnnnnnnnnnnnnnnnnnnnnnnnnncnnngntgtnatnnnnnnnntnnnnnncnnnancngnnntnngntntnntnnnnnnnnnannntnnnncnnnagtannnnnnncncntnnnaannnnnnnnnannnnnntnnnnnnnnnnnnnnnnnannanannncnaannnntnncntcgnnnnnntgnnnnnnnaatnngnnntnnntnnnnnnncnnntnaannnnntnnttcnnnnnnnnnnnnnnnnnngnnnnnnnngntnannnnaannntntnnaannangnnnnannnnannnnngnnannnnnnnnnnnnnntnnnnnnnnnannnnnnnnnnannnnnnnnnngnnnnnnnnannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngnnnnannnnnnnnnnnnnnnnnnntnnnntntnnnntnnnnnnnnncnnnnnnnttnttnnnnngcnnnnnnnnnannnnnnnngnnnnnnnnnnnnnnnnnnnnnnnnnnnnnnnnnannnnnnnnnnnngnnnnnnnnnnnnnagnnncnnnnnnnnnnnncnnncnnntnnnnnnantannnnnnnnnnnnnnnnnnnnnnnnnnnnnnnnnnnnnnnnnngnnncnnnnnnnnntnnnannnnncnnnnnnnncnnnnncnncnnnnnnncnnnnnnnnannannncnnnnnnnnnnnnnnnnnnnnnnnnnnnntntntnnnnnnnnnnnnnnnnnnnnnnngnnnnnnnnngnnnnnnnnnangnnnnnnnnnnnnnnnnnnnnnnnnnnnnnnnnnnnnnnntnnnnnnnnnnnnnnnnnnnnnnnnnnanannnnnnnnnnnnnnnnnnnnnnnnnnnnnnnnnannnnnnnnnnnnnnnnnngnnnnnnnnnnnnnnnnnnnncnnnnnnnnnnnnnnnnnnnnnnnnnnnnnnnnnnnnnnnnnnnnnnnnnnnnannnnnnnnnnnnnnnnnnnnnnnnnnnnnnnnnnnnntnnnnnnnnnnnnnnnnnnnnnnnnnnnnnnngnnnnnnnnnnnnn

SEQ ID NO: 3 - protein, 241 aa, Artificial Sequence
  Synthetic
MKKQSNQTVRMATPGQIKDVISAVVESIPVNNLTYEMAQYFIGRKKWLGTEMKKIFSVDNSHADLIADWQAFYCGLGIDCDLSGVIIPDDPGGFGRVIIMAQGITPQSGYDLCAKFFPCWKYTDKNLDEVVVSERTAKDVYAIRVRDRVEADEELRNRSYNDLKRQGIIGITLEEREIFELKFFKETAGKHLDIKNWTFCLGSCYDGGNVPSASWRSGEFEVDWCNPGDVFDDLCSRQAVS

SEQ ID NO: 4 - protein, 192 aa, Artificial Sequence
  Synthetic
MRTFEITEKEVAAAFREAESGEAKKILAALFCKEEMVKPTLDDYKTIRTYEDACKALGEPIFEDPNNLPNHIIALMKLETISRALWGRNFQPKPDGEGSKVYWYPWFALWTKKEVEDMNPEQRGALVSANADLGAFAGFGCLAALYRSSSADAGIGFRLCQETEEKAKYFGQQFIELWAEYLKFNFTVGNRL

SEQ ID NO: 5 - DNA, 6055 bp, Escherichia coli
aagcttggctgttttggcggatgagagaagattttcagcctgatacagattaaatcagaacgcagaagcggtctgataaaacagaatttgcctggcggcagtagcgcggtggtcccacctgaccccatgccgaactcagaagtgaaacgccgtagcgccgatggtagtgtggggtctccccatgcgagagtagggaactgccaggcatcaaataaaacgaaaggctcagtcgaaagactgggcctttcgttttatctgttgtttgtcggtgaacgctctcctgagtaggacaaatccgccgggagcggatttgaacgttgcgaagcaacggcccggagggtggcgggcaggacgcccgccataaactgccaggcatcaaattaagcagaaggccatcctgacggatggcctttttgcgtttctacaaactcttttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtgttgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgcagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgatttgggtgatggttcacgtagtgggccatcgccctgatagacggtttttcgccctttgacgttggagtccacgttctttaatagtggactcttgttccaaacttgaacaacactcaaccctatctcgggctattcttttgatttataagggattttgccgatttcggcctattggttaaaaaatgagctgatttaacaaaaatttaacgcgaattttaacaaaatattaacgtttacaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcctgatgcggtattttctccttacgcatctgtgcggtatttcacaccgcatacgtacgggcgcgccttaagacccactttcacatttaagttgtttttctaatccgcatatgatcaattcaaggccgaataagaaggctggctctgcaccttggtgatcaaataattcgatagcttgtcgtaataatggcggcatactatcagtagtaggtgtttccctttcttctttagcgacttgatgctcttgatcttccaatacgcaacctaaagtaaaatgccccacagcgctgagtgcatataatgcattctctagtgaaaaaccttgttggcataaaaaggctaattgattttcgagagtttcatactgtttttctgtaggccgtgtacctaaatgtacttttgctccatcgcgatgacttagtaaagcacatctaaaacttttagcgttattacgtaaaaaatcttgccagctttccccttctaaagggcaaaagtgagtatggtgcctatctaacatctcaatggctaaggcgtcgagcaaagcccgcttattttttacatgccaatacaatgtaggctgctctacacctagcttctgggcgagtttacgggttgttaaaccttcgattccgacctcattaagcagctctaatgcgctgttaatcactttacttttatctaatctagacatcattaattcctaatttttgttgacactctatcgttgatagagttattttaccactccctatcagtgatagagaaaagaattcaaaagatctaaagaggagaaaggatctatggactacaaagacgatgacgacaagggatccatgaagaaacagagcaatcagaccgttcgtatggcaacaccgggtcagattaaagatgttattagcgcagttgttgaaagcattccggtgaataatctgacatatgaaatggcccagtatttcatcggtcgtaaaaaatggctgggcaccgaaatgaaaaaaatctttagcgtggataacagccatgcagatctgattgcagattggcaggcattttattgtggtctgggtattgattgcgatctgagcggtgttattattccggatgatcctggtggttttggtcgtgtgattattatggcacagggtattacaccgcagagcggttatgatctgtgtgcaaaattctttccgtgctggaaatataccgataaaaacctggatgaagttgtggttagcgaacgtaccgcaaaagatgtttatgcaattcgtgttcgtgatcgtgttgaagcagatgaagaactgcgtaatcgtagctataatgatctgaaacgtcagggcattattggcattaccctggaagaacgtgaaatctttgaactgaaatttttcaaagaaaccgcaggcaaacacctggatatcaaaaattggaccttttgtctgggttcgtgctatgacggcggcaatgtgccgagcgcctcgtggcgcagcggcgagttcgaggtcgactggtgcaatcccggcgatgtcttcgacgatctgtgttcccgtcaggcagttagctaatgcctgttcatctgtgttctgcggccctgcgcgatagcgcgggccgtctctaaaagaggagaaaggatctatgcaacagcttcaagtcgcgcagcgggtcgaggcgatgatcgagtatggctatatagctgtacggcatttcccgaaatcggagcgtcacgtgctcagcgccgagctgcgcggctctatgtggcggctgctgcggctcgtgatcgtctgcggcaagcggtatcacaaaaagacgacactcgcagagctggataccgaactggagctgctgcgccgcgaagtgcggctcgcaaaagacctgaagttcctgccgttccgacaatacgaaatctggtcgcgtcatctcgacgagatcggtcgcatgatcggcggctggattaaacacgcaaaacagggttaagcgcatttgggttcgtgctatgacgacggcaatgtgccgaacgccaattggaacagcggcaagttcaaggtcaactggtacaatcccgacaatgtcaacgacaatctgtgttcccgtcagcttgaagatcgtcagaaacagcgcggtcacggtggcgctgtcagcacgacatcaaaagggcgcttgatcctcggcccatgccgaaacattaacaggcatcgatcgtgtagtaggcctcagccgaggctcgatcgtcgccgctttggctcgataaagaggagaaaggatctatgaagacatacaacaacctgttcccggagatatacagcttcgacaacctgcatgacgcctacgtccgcgcgcgccgcggcaaacgccaccaggccgacgtgctgcgcttcgagcaaaacctcgagggcgagctcatacaactacagaacgaactgatctggcgcgagtacgaaactggcccgtatcggcgtttccatgtgcacgagccgaaaaagcgtttggtcgccgcgctgccctttcgcgatcgcgtcgtacagcacagcctaatcgccgcgatcgagcccatttgggagtcgcgattcatcgatcagagctacgcctgccgtcccggccggggcgtgcaccgcggtgcagacaaagcccaacaatggctgcgcgaggtgcgggccacacacggccgcgtctacgcgctcaaggccgacgtcgcaggttatttcgcatcgatcgatcacgacgttctgcgcacgcagctagaacgccgaatcgcttgccgtccaacgctatacctgctgctcggcatcatcgaaacctggcatcccggccttcccatcggcaacctcacgtcgcagctgtgcgccaatatctatttgcacgatttcgacgtattcgcaaaacagcacgtcggcgcacgccgctatatgaggtatatggatgactggctcatcgtcgaccacgacaaagcgcgcctgcacgcacagcgccgcgtgctcgaggactggctgcacgacaatctgcgcctgcagctcaataacaagacccagatatttcccgtcagcccacgccacggccgcggactcgacttcctcggatatcgaatatggcccacacatcgaaagattcgcaaaaacagcgtcaaacggatgcagaaaaaactacgtgcgctcgaacgccgctacgccgccggcgatatcgacctggtcgacatcgagcccgtgatccagagctgggtcgcccacgcctcccacgccagcagctatcagatccgccgcgcggtgctggagcgcgcggttttcaaacgccaataagcatgc

SEQ ID NO: 6 - DNA, 6072 bp, Escherichia coli
aagcttggctgttttggcggatgagagaagattttcagcctgatacagattaaatcagaacgcagaagcggtctgataaaacagaatttgcctggcggcagtagcgcggtggtcccacctgaccccatgccgaactcagaagtgaaacgccgtagcgccgatggtagtgtggggtctccccatgcgagagtagggaactgccaggcatcaaataaaacgaaaggctcagtcgaaagactgggcctttcgttttatctgttgtttgtcggtgaacgctctcctgagtaggacaaatccgccgggagcggatttgaacgttgcgaagcaacggcccggagggtggcgggcaggacgcccgccataaactgccaggcatcaaattaagcagaaggccatcctgacggatggcctttttgcgtttctacaaactcttttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtgttgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgcagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgatttgggtgatggttcacgtagtgggccatcgccctgatagacggtttttcgccctttgacgttggagtccacgttctttaatagtggactcttgttccaaacttgaacaacactcaaccctatctcgggctattcttttgatttataagggattttgccgatttcggcctattggttaaaaaatgagctgatttaacaaaaatttaacgcgaattttaacaaaatattaacgtttacaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcctgatgcggtattttctccttacgcatctgtgcggtatttcacaccgcatacgtacgggcgcgccttaagacccactttcacatttaagttgtttttctaatccgcatatgatcaattcaaggccgaataagaaggctggctctgcaccttggtgatcaaataattcgatagcttgtcgtaataatggcggcatactatcagtagtaggtgtttccctttcttctttagcgacttgatgctcttgatcttccaatacgcaacctaaagtaaaatgccccacagcgctgagtgcatataatgcattctctagtgaaaaaccttgttggcataaaaaggctaattgattttcgagagtttcatactgtttttctgtaggccgtgtacctaaatgtacttttgctccatcgcgatgacttagtaaagcacatctaaaacttttagcgttattacgtaaaaaatcttgccagctttccccttctaaagggcaaaagtgagtatggtgcctatctaacatctcaatggctaaggcgtcgagcaaagcccgcttattttttacatgccaatacaatgtaggctgctctacacctagcttctgggcgagtttacgggttgttaaaccttcgattccgacctcattaagcagctctaatgcgctgttaatcactttacttttatctaatctagacatcattaattcctaatttttgttgacactctatcgttgatagagttattttaccactccctatcagtgatagagaaaagaattcaaaagatctaaagaggagaaaggatctatggactacaaagacgatgacgacaagggatccatgaagaaacagagcaatcagaccgttcgtatggcaacaccgggtcagattaaagatgttattagcgcagttgttgaaagcattccggtgaataatctgacatatgaaatggcccagtatttcatcggtcgtaaaaaatggctgggcaccgaaatgaaaaaaatctttagcgtggataacagccatgcagatctgattgcagattggcaggcattttattgtggtctgggtattgattgcgatctgagcggtgttattattccggatgatcctggtggttttggtcgtgtgattattatggcacagggtattacaccgcagagcggttatgatctgtgtgcaaaattctttccgtgctggaaatataccgataaaaacctggatgaagttgtggttagcgaacgtaccgcaaaagatgtttatgcaattcgtgttcgtgatcgtgttgaagcagatgaagaactgcgtaatcgtagctataatgatctgaaacgtcagggcattattggcattaccctggaagaacgtgaaatctttgaactgaaatttttcaaagaaaccgcaggcaaacacctggatatcaaaaattggaccttttgtctgggttcgtgctatgacggcggcaatgtgccgagcgcctcgtggcgcagcggcgagttcgaggtcgactggtgcaatcccggcgatgtcttcgacgatctgtgttcccgtcaggcagttagctaatgcctgttcatctgtgttctgcggccctgcgcgatagcgcgggccgtctctaaaagaggagaaaggatctatgcaacagcttcaagtcgcgcagcgggtcgaggcgatgatcgagtatggctatatagctgtacggcatttcccgaaatcggagcgtcacgtgctcagcgccgagctgcgcggctctatgtggcggctgctgcggctcgtgatcgtctgcggcaagcggtatcacaaaaagacgacactcgcagagctggataccgaactggagctgctgcgccgcgaagtgcggctcgcaaaagacctgaagttcctgccgttccgacaatacgaaatctggtcgcgtcatctcgacgagatcggtcgcatgatcggcggctggattaaacacgcaaaacagggttaagcgcatttgggttcgtgctatgacgacggcaatgtgccgaacgccaattggaacagcggcaagttcaaggtcaactggtacaatcccgacaatgtcaacgacaatctgtgttcccgtcagtcggttgccggcctgctcttgaagatcgtcagaaacagcgcggtcacggtggcgctgtcagcacgacatcaaaagggcgcttgatcctcggcccatgccgaaacattaacaggcatcgatcgtgtagtaggcctcagccgaggctcgatcgtcgccgctttggctcgataaagaggagaaaggatctatgaagacatacaacaacctgttcccggagatatacagcttcgacaacctgcatgacgcctacgtccgcgcgcgccgcggcaaacgccaccaggccgacgtgctgcgcttcgagcaaaacctcgagggcgagctcatacaactacagaacgaactgatctggcgcgagtacgaaactggcccgtatcggcgtttccatgtgcacgagccgaaaaagcgtttggtcgccgcgctgccctttcgcgatcgcgtcgtacagcacagcctaatcgccgcgatcgagcccatttgggagtcgcgattcatcgatcagagctacgcctgccgtcccggccggggcgtgcaccgcggtgcagacaaagcccaacaatggctgcgcgaggtgcgggccacacacggccgcgtctacgcgctcaaggccgacgtcgcaggttatttcgcatcgatcgatcacgacgttctgcgcacgcagctagaacgccgaatcgcttgccgtccaacgctatacctgctgctcggcatcatcgaaacctggcatcccggccttcccatcggcaacctcacgtcgcagctgtgcgccaatatctatttgcacgatttcgacgtattcgcaaaacagcacgtcggcgcacgccgctatatgaggtatatggatgactggctcatcgtcgaccacgacaaagcgcgcctgcacgcacagcgccgcgtgctcgaggactggctgcacgacaatctgcgcctgcagctcaataacaagacccagatatttcccgtcagcccacgccacggccgcggactcgacttcctcggatatcgaatatggcccacacatcgaaagattcgcaaaaacagcgtcaaacggatgcagaaaaaactacgtgcgctcgaacgccgctacgccgccggcgatatcgacctggtcgacatcgagcccgtgatccagagctgggtcgcccacgcctcccacgccagcagctatcagatccgccgcgcggtgctggagcgcgcggttttcaaacgccaataagcatgc

SEQ ID NO: 7 - DNA, 6113 bp, Escherichia coli
aagcttggctgttttggcggatgagagaagattttcagcctgatacagattaaatcagaacgcagaagcggtctgataaaacagaatttgcctggcggcagtagcgcggtggtcccacctgaccccatgccgaactcagaagtgaaacgccgtagcgccgatggtagtgtggggtctccccatgcgagagtagggaactgccaggcatcaaataaaacgaaaggctcagtcgaaagactgggcctttcgttttatctgttgtttgtcggtgaacgctctcctgagtaggacaaatccgccgggagcggatttgaacgttgcgaagcaacggcccggagggtggcgggcaggacgcccgccataaactgccaggcatcaaattaagcagaaggccatcctgacggatggcctttttgcgtttctacaaactcttttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtgttgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgcagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgatttgggtgatggttcacgtagtgggccatcgccctgatagacggtttttcgccctttgacgttggagtccacgttctttaatagtggactcttgttccaaacttgaacaacactcaaccctatctcgggctattcttttgatttataagggattttgccgatttcggcctattggttaaaaaatgagctgatttaacaaaaatttaacgcgaattttaacaaaatattaacgtttacaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcctgatgcggtattttctccttacgcatctgtgcggtatttcacaccgcatacgtacgggcgcgccttaagacccactttcacatttaagttgtttttctaatccgcatatgatcaattcaaggccgaataagaaggctggctctgcaccttggtgatcaaataattcgatagcttgtcgtaataatggcggcatactatcagtagtaggtgtttccctttcttctttagcgacttgatgctcttgatcttccaatacgcaacctaaagtaaaatgccccacagcgctgagtgcatataatgcattctctagtgaaaaaccttgttggcataaaaaggctaattgattttcgagagtttcatactgtttttctgtaggccgtgtacctaaatgtacttttgctccatcgcgatgacttagtaaagcacatctaaaacttttagcgttattacgtaaaaaatcttgccagctttccccttctaaagggcaaaagtgagtatggtgcctatctaacatctcaatggctaaggcgtcgagcaaagcccgcttattttttacatgccaatacaatgtaggctgctctacacctagcttctgggcgagtttacgggttgttaaaccttcgattccgacctcattaagcagctctaatgcgctgttaatcactttacttttatctaatctagacatcattaattcctaatttttgttgacactctatcgttgatagagttattttaccactccctatcagtgatagagaaaagaattcaaaagatctaaagaggagaaaggatctatggactacaaagacgatgacgacaagggatccatgaagaaacagagcaatcagaccgttcgtatggcaacaccgggtcagattaaagatgttattagcgcagttgttgaaagcattccggtgaataatctgacatatgaaatggcccagtatttcatcggtcgtaaaaaatggctgggcaccgaaatgaaaaaaatctttagcgtggataacagccatgcagatctgattgcagattggcaggcattttattgtggtctgggtattgattgcgatctgagcggtgttattattccggatgatcctggtggttttggtcgtgtgattattatggcacagggtattacaccgcagagcggttatgatctgtgtgcaaaattctttccgtgctggaaatataccgataaaaacctggatgaagttgtggttagcgaacgtaccgcaaaagatgtttatgcaattcgtgttcgtgatcgtgttgaagcagatgaagaactgcgtaatcgtagctataatgatctgaaacgtcagggcattattggcattaccctggaagaacgtgaaatctttgaactgaaatttttcaaagaaaccgcaggcaaacacctggatatcaaaaattggaccttttgtctgggttcgtgctatgacgacggcaatgtgccgaacgccaattggaacagcggcaagttcaaggtcaactggtacaatcccgacaatgtcaacgacaatctgtgttcccgtcaggcggtttcctagtcggttgccggcctgcttttgttgcctgatgcctgttcatctgtgttctgcggccctgcgcgatagcgcgggccgtctctaaaagaggagaaaggatctatgcaacagcttcaagtcgcgcagcgggtcgaggcgatgatcgagtatggctatatagctgtacggcatttcccgaaatcggagcgtcacgtgctcagcgccgagctgcgcggctctatgtggcggctgctgcggctcgtgatcgtctgcggcaagcggtatcacaaaaagacgacactcgcagagctggataccgaactggagctgctgcgccgcgaagtgcggctcgcaaaagacctgaagttcctgccgttccgacaatacgaaatctggtcgcgtcatctcgacgagatcggtcgcatgatcggcggctggattaaacacgcaaaacagggttaagcgcatttgggttcgtgctatgacgacggcaatgtgccgaacgccaattggaacagcggcaagttcaaggtcaactggtacaatcccgacaatgtcaacgacaatctgtgttcccgtcaggcggtttcctagtcggttgccggcctgctcttgaagatcgtcagaaacagcgcggtcacggtggcgctgtcagcacgacatcaaaagggcgcttgatcctcggcccatgccgaaacattaacaggcatcgatcgtgtagtaggcctcagccgaggctcgatcgtcgccgctttggctcgataaagaggagaaaggatctatgaagacatacaacaacctgttcccggagatatacagcttcgacaacctgcatgacgcctacgtccgcgcgcgccgcggcaaacgccaccaggccgacgtgctgcgcttcgagcaaaacctcgagggcgagctcatacaactacagaacgaactgatctggcgcgagtacgaaactggcccgtatcggcgtttccatgtgcacgagccgaaaaagcgtttggtcgccgcgctgccctttcgcgatcgcgtcgtacagcacagcctaatcgccgcgatcgagcccatttgggagtcgcgattcatcgatcagagctacgcctgccgtcccggccggggcgtgcaccgcggtgcagacaaagcccaacaatggctgcgcgaggtgcgggccacacacggccgcgtctacgcgctcaaggccgacgtcgcaggttatttcgcatcgatcgatcacgacgttctgcgcacgcagctagaacgccgaatcgcttgccgtccaacgctatacctgctgctcggcatcatcgaaacctggcatcccggccttcccatcggcaacctcacgtcgcagctgtgcgccaatatctatttgcacgatttcgacgtattcgcaaaacagcacgtcggcgcacgccgctatatgaggtatatggatgactggctcatcgtcgaccacgacaaagcgcgcctgcacgcacagcgccgcgtgctcgaggactggctgcacgacaatctgcgcctgcagctcaataacaagacccagatatttcccgtcagcccacgccacggccgcggactcgacttcctcggatatcgaatatggcccacacatcgaaagattcgcaaaaacagcgtcaaacggatgcagaaaaaactacgtgcgctcgaacgccgctacgccgccggcgatatcgacctggtcgacatcgagcccgtgatccagagctgggtcgcccacgcctcccacgccagcagctatcagatccgccgcgcggtgctggagcgcgcggttttcaaacgccaataagcatgc

SEQ ID NO: 8 - DNA, 6061 bp, Escherichia coli
aagcttggctgttttggcggatgagagaagattttcagcctgatacagattaaatcagaacgcagaagcggtctgataaaacagaatttgcctggcggcagtagcgcggtggtcccacctgaccccatgccgaactcagaagtgaaacgccgtagcgccgatggtagtgtggggtctccccatgcgagagtagggaactgccaggcatcaaataaaacgaaaggctcagtcgaaagactgggcctttcgttttatctgttgtttgtcggtgaacgctctcctgagtaggacaaatccgccgggagcggatttgaacgttgcgaagcaacggcccggagggtggcgggcaggacgcccgccataaactgccaggcatcaaattaagcagaaggccatcctgacggatggcctttttgcgtttctacaaactcttttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtgttgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgcagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgatttgggtgatggttcacgtagtgggccatcgccctgatagacggtttttcgccctttgacgttggagtccacgttctttaatagtggactcttgttccaaacttgaacaacactcaaccctatctcgggctattcttttgatttataagggattttgccgatttcggcctattggttaaaaaatgagctgatttaacaaaaatttaacgcgaattttaacaaaatattaacgtttacaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcctgatgcggtattttctccttacgcatctgtgcggtatttcacaccgcatacgtacgggcgcgccttaagacccactttcacatttaagttgtttttctaatccgcatatgatcaattcaaggccgaataagaaggctggctctgcaccttggtgatcaaataattcgatagcttgtcgtaataatggcggcatactatcagtagtaggtgtttccctttcttctttagcgacttgatgctcttgatcttccaatacgcaacctaaagtaaaatgccccacagcgctgagtgcatataatgcattctctagtgaaaaaccttgttggcataaaaaggctaattgattttcgagagtttcatactgtttttctgtaggccgtgtacctaaatgtacttttgctccatcgcgatgacttagtaaagcacatctaaaacttttagcgttattacgtaaaaaatcttgccagctttccccttctaaagggcaaaagtgagtatggtgcctatctaacatctcaatggctaaggcgtcgagcaaagcccgcttattttttacatgccaatacaatgtaggctgctctacacctagcttctgggcgagtttacgggttgttaaaccttcgattccgacctcattaagcagctctaatgcgctgttaatcactttacttttatctaatctagacatcattaattcctaatttttgttgacactctatcgttgatagagttattttaccactccctatcagtgatagagaaaagaattcaaaagatctaaagaggagaaaggatctatggactacaaagacgatgacgacaagggatccatgaagaaacagagcaatcagaccgttcgtatggcaacaccgggtcagattaaagatgttattagcgcagttgttgaaagcattccggtgaataatctgacatatgaaatggcccagtatttcatcggtcgtaaaaaatggctgggcaccgaaatgaaaaaaatctttagcgtggataacagccatgcagatctgattgcagattggcaggcattttattgtggtctgggtattgattgcgatctgagcggtgttattattccggatgatcctggtggttttggtcgtgtgattattatggcacagggtattacaccgcagagcggttatgatctgtgtgcaaaattctttccgtgctggaaatataccgataaaaacctggatgaagttgtggttagcgaacgtaccgcaaaagatgtttatgcaattcgtgttcgtgatcgtgttgaagcagatgaagaactgcgtaatcgtagctataatgatctgaaacgtcagggcattattggcattaccctggaagaacgtgaaatctttgaactgaaatttttcaaagaaaccgcaggcaaacacctggatatcaaaaattggaccttttgtctgggttcgtgctatgacggcggcaatgtgccgagcgcctcgtggcgcagcggcgagttcgaggtcgactggtgcaatcccggcgatgtcttcgacgatctgtgttcccgtcaggcttttgttgcctgatgcctgttcatctgtgttctgcggccctgcgcgatagcgcgggccgtctctaaaagaggagaaaggatctatgcaacagcttcaagtcgcgcagcgggtcgaggcgatgatcgagtatggctatatagctgtacggcatttcccgaaatcggagcgtcacgtgctcagcgccgagctgcgcggctctatgtggcggctgctgcggctcgtgatcgtctgcggcaagcggtatcacaaaaagacgacactcgcagagctggataccgaactggagctgctgcgccgcgaagtgcggctcgcaaaagacctgaagttcctgccgttccgacaatacgaaatctggtcgcgtcatctcgacgagatcggtcgcatgatcggcggctggattaaacacgcaaaacagggttaagcgcatttgggttcgtgctatgacgacggcaatgtgccgaacgccaattggaacagcggcaagttcaaggtcaactggtacaatcccgacaatgtcaacgacaatctgtgttcccgtcaggctcttgaagatcgtcagaaacagcgcggtcacggtggcgctgtcagcacgacatcaaaagggcgcttgatcctcggcccatgccgaaacattaacaggcatcgatcgtgtagtaggcctcagccgaggctcgatcgtcgccgctttggctcgataaagaggagaaaggatctatgaagacatacaacaacctgttcccggagatatacagcttcgacaacctgcatgacgcctacgtccgcgcgcgccgcggcaaacgccaccaggccgacgtgctgcgcttcgagcaaaacctcgagggcgagctcatacaactacagaacgaactgatctggcgcgagtacgaaactggcccgtatcggcgtttccatgtgcacgagccgaaaaagcgtttggtcgccgcgctgccctttcgcgatcgcgtcgtacagcacagcctaatcgccgcgatcgagcccatttgggagtcgcgattcatcgatcagagctacgcctgccgtcccggccggggcgtgcaccgcggtgcagacaaagcccaacaatggctgcgcgaggtgcgggccacacacggccgcgtctacgcgctcaaggccgacgtcgcaggttatttcgcatcgatcgatcacgacgttctgcgcacgcagctagaacgccgaatcgcttgccgtccaacgctatacctgctgctcggcatcatcgaaacctggcatcccggccttcccatcggcaacctcacgtcgcagctgtgcgccaatatctatttgcacgatttcgacgtattcgcaaaacagcacgtcggcgcacgccgctatatgaggtatatggatgactggctcatcgtcgaccacgacaaagcgcgcctgcacgcacagcgccgcgtgctcgaggactggctgcacgacaatctgcgcctgcagctcaataacaagacccagatatttcccgtcagcccacgccacggccgcggactcgacttcctcggatatcgaatatggcccacacatcgaaagattcgcaaaaacagcgtcaaacggatgcagaaaaaactacgtgcgctcgaacgccgctacgccgccggcgatatcgacctggtcgacatcgagcccgtgatccagagctgggtcgcccacgcctcccacgccagcagctatcagatccgccgcgcggtgctggagcgcgcggttttcaaacgccaataagcatgc

SEQ ID NO: 9 - DNA, 109 bp, Escherichia coli
gcgcctgccgatccgtggtggcaactggaacaacgcctcggatgcggggttgtcggcgttgaacttgaacaacgcccgcggcaatcgcaacagcaacatcggttgccgg

SEQ ID NO: 10 - DNA, 55 bp, Escherichia coli
gcgcctgccgatccgtggtggcaactggaacaacgcctcggatgcggggttgtcg

SEQ ID NO: 11 - DNA, 11 bp, Escherichia coli
gcgcctgccga

SEQ ID NO: 12 - DNA, 150 bp, Escherichia coli
catttcagcacagacagcgtcgagcgcctgccgttccgtggtggctactggagcgacgcctcggatgcggggttgtcggcgttgcgcttgtacaacgcccgcggcgatcgcagcagcttcatcggttgccggcctgcttttgttgcctga

SEQ ID NO: 13 - DNA, 150 bp, Escherichia coli
cgcaaaacagggttaagcgcattgcgcctgccgatccgtggtggcaactggaacaacgcctcggatgcggggttgtcggcgttgaacttgaacaacgcccgcggcaatcgcaacagcaacatcggttgccggcctgctcttgaagatcgt

SEQ ID NO: 14 - DNA, 150 bp, Escherichia coli
catttcagcacagacagcgtcgagcgcctgccgatccgtggtggccgctggaacaacgcttcggatgcggggttgtcggcgttggtcttgaactacgcccgcggcactcgcctcagcaacatcggttgccggcctgcttttgttcctgat

SEQ ID NO: 15 - DNA, 150 bp, Escherichia coli
catttcagcacagacagcgtcgagcgcctgccgatccgtggtggcagctggaacaacgcctcggatgcgggggtgtcggcgtggcacttgaccaacgcccgcggcagtcgccgcagcaacgtcggttgccggcctgcttttgttgcctga

SEQ ID NO: 16 - DNA, 414 bp, Escherichia coli
ctgaaccccgacaacagcgacgtggacaagctgttcatccagctggtgcagacctacaaccagctgttcgaggaaaaccccatcaacgccagcggcgtggacgccaaggccatcctgtctgccagactgagcaagagcagacggctggaaaatctgatcgcccagctgcccggcgagaagaagaatggcctgttcggaaacctgattgccctgagcctgggcctgacccccaacttcaagagcaacttcgacctggccgaggatgccaaactgcagctgagcaaggacacctacgacgacgacctggacaacctgctggcccagatcggcgaccagtacgccgacctgtttctggccgccaagaacctgtccgacgccatcctgctgagcgacatcctgagagtgaacaccgag

SEQ ID NO: 17 - DNA, 150 bp, Escherichia coli
catttcagcacagacagcgtcgagcgcctgccgatccgtggtggcacatggatctacgcctcggatgcggggttgtcggcgttgttcttgggcaacgcccgcggcaatcgctgcagcagcttcggttgccggcctgcttttgttgcctga

SEQ ID NO: 18 - DNA, 150 bp, Escherichia coli
catttcagcacagacagcgtcgagcgcctgccgatccgtggtggcggctggggctgcgcctcggttgcgggggtgtcggcgttgtacttgggcggcgcccgcggcggtcgcggcagcagcgtcggttgccggcctgcttttgttgcctga

SEQ ID NO: 19 - DNA, 150 bp, Escherichia coli
catttcagcacagaccgcgtcgagcgcctgccgatccgtggtggcggctggtgcgacgcctcggctgcggggttgtcggcgttgagcttggccaacgcccgcggcgatcgcagcagcttcatcggtttccggcctgcttttgttgcctga

SEQ ID NO: 20 - DNA, 150 bp, Escherichia coli
catttcagcacagacagcgtcgagcgcctgccgatccgtggtggcttctggagcggcgcctcggatgcggggttgtcggcgttgcgcttgatccgcgcccgcggcaatcgcagcagcacgatcggttgccggcctgcttttgttgcctga

SEQ ID NO: 21 - DNA, 150 bp, Escherichia coli
catttcagcacagacagcgtcgagcgcctgccgatccgtggtggcagctggatcaacgcctcggatgcggggttgtcggcgttgaacttgtactacgcccgcggcattcgccacagcaacatcggttgccggcctgcttttgttgcctga

SEQ ID NO: 22 - DNA, 150 bp, Escherichia coli
catttcagcacagacagcgtcgagcgcctgccgatccgtggtggcagctggatcagcgcctcgggtgcggggttgtcggcgttgaacttgagcaacgcgcgcgacattcgcagcagcagcatcggttgccggcctgcttttgttgcctga

SEQ ID NO: 23 - DNA, 11 bp, Escherichia coli
gcgcctgccgg

SEQ ID NO: 24 - DNA, 150 bp, Escherichia coli; identical to SEQ ID NO: 12

SEQ ID NO: 25 - DNA, 150 bp, Escherichia coli; identical to SEQ ID NO: 13

SEQ ID NO: 26 - DNA, 150 bp, Escherichia coli
catttcagcacagacagcgtcgagcgcctgccggtccgtggtggctactggaccaacgcctcgggtgcgggggtgtcggcgttgaacttgtacaacgcccgcggcaatcgcagcagcagcatcggttgccggcctgcttttgttgcctga

SEQ ID NO: 27 - DNA, 150 bp, Escherichia coli
catttcagcacagacagcgtcgagcgcctgccggtccgtggtggcggctggcgctacgcctcggatgcggggttgtcggcgttgcgcttgtacaacgcccgcggcgatcgcagcagcttcatcggttgccggcctgcttttgttgcctga

SEQ ID NO: 28 - DNA, 150 bp, Escherichia coli
catttcagcacagacagcgtcgagcgcctgccggtccgtggtggcagctggagcaacgcctcggatgcggggttgtcggcgttgcacttgcgcggcgcccgcggctttcgcggcggcagcatcggttgccggcctgcttttgttgcctga

SEQ ID NO: 29 - DNA, 150 bp, Escherichia coli
catttcagcacagacagcgtcgagcgcctgccggtccgtggtggcatctggaacagcgcctcggatgcggggttgtcggcgttgagcttgtactacgcccgcggcgctcgccgcagcagcctcgattgccggcctgcttttgttgcctga

SEQ ID NO: 30 - DNA, 150 bp, Escherichia coli
catttcagcacagacagcgtcgagcgcctgccggtccgtggtggcgtctggtactacgcctcggctgcggggttgtcggcgttgtacttgcactacgcccgcggcgatcgcagcagcttcatcggttgccggcctgcttttgttgcctga

SEQ ID NO: 31 - DNA, 150 bp, Escherichia coli
catttcagcacagaccgcgtcgagcgcctgccggtccggggtggcggctggtactacgcctcgggtgcggggttgtcggcgttgagcttgtccgtcgcccgcggcggtcgcagcagcaacatcggttgccggcctgcttttgttgcctga

SEQ ID NO: 32 - DNA, 150 bp, Escherichia coli
catttcagcacagacagcgtcgagcgcctgccggtccgtggtggccgctggagcttcgcctcgggtgcggggttgtcggcgttgcgcttgcgctacgcccgcggctttcgcaccggcagcgtcggttgccggcctgcttttgttgcctga

SEQ ID NO: 33 - DNA, 150 bp, Escherichia coli
catttcagcacagacagcgtcgagcgcctgccggtccgtggtggcggctggggcggcgcgtcgggtgcgggggtggcggcgttgggcttgggcggcgcccgcggcggtcgcggcagcggcttcggtttccggcctgcttttgttgcctga

SEQ ID NO: 34 - DNA, 11 bp, Escherichia coli
gcgcctgccgc

SEQ ID NO: 35 - DNA, 150 bp, Escherichia coli; identical to SEQ ID NO: 12

SEQ ID NO: 36 - DNA, 150 bp, Escherichia coli; identical to SEQ ID NO: 13

SEQ ID NO: 37 - DNA, 150 bp, Escherichia coli
catttcagcacagacagcgtcgagcgcctgccgctccgtggtggcggctggagcggcgcctcgggtgcggggttgtcggcgttgaacttgagcggcgcccgcggcggtcgcggcggcggcgtcggttgccggcctgcttttgttgcctga

SEQ ID NO: 38 - DNA, 150 bp, Escherichia coli
catttcagcacagacagcgtcgagcgcctgccgctccgtggtggcaactggagctacgcctcgggtgcggggttgtcggcgttgaacttgttcagcgcccgcggcaatcgcggcagctacttcggttgccggcctgcttttgttgcctga

SEQ ID NO: 39 - DNA, 150 bp, Escherichia coli
catttcagcacagacagcgtcgagcgcctgccgctccgtggtggcaactggaacttcgcctcggatgcggggttgtcggcgttgtacttgtactacgcccgcggcaatcgcaacggcgtcatcggttgccggcctgcttttgttgcctga

SEQ ID NO: 40 - DNA, 150 bp, Escherichia coli
catttcagcacagaccgcgtcgagcgcctgccgctccgtggtggcaactggaacggcgcctcgaatgcggggttgtcggcgttgaccttgaccaacgcccgcggcaatcgcagcagcttcatcggtttccggcctgcttttgttgcctga

SEQ ID NO: 41 - DNA, 150 bp, Escherichia coli
catttcagcacagacagcgtcgagcgcctgccgctccgtggtggcggctggagcaacgcctcggttgcggggttgtcggcgttgcgcttgagctgcgcccgcggcgatcgcggcagcactatcggttgccggcctgcttttgttgcctga

SEQ ID NO: 42 - DNA, 150 bp, Escherichia coli
catttcagcacagacagcgtcgagcgcctgccgctccgtggtggcggctggcgcagcgcctcggttgcggggttgtcggcggtgaacttgagcaacgcccgcggcaatcgcggcagcaacgtcggttgccggcctgcttttgttgcctga

SEQ ID NO: 43 - DNA, 150 bp, Escherichia coli
catttcagcacagacagcgtcgagcgcctgccgctccgtggtggcggctggtactacgcctcggatgcggggttgtcggcgttgaacttgagccacgcccgcggcgatcgcagcagcttcatcggttgccggcctgcttttgttgcctga

SEQ ID NO: 44 - DNA, 150 bp, Escherichia coli
catttcagcacagacagcgtcgagcgcctgccgctccgtgctggcgactggggcaacgcctcggatgcggggttgtcggcgttgcgcttgccccacgcccgcggcgatcgcagcagcttcatcggttgccggcctgcttttgttgcctga

SEQ ID NO: 45 - DNA, 11 bp, Escherichia coli
gcgcctgccga

SEQ ID NO: 46 - DNA, 111 bp, Escherichia coli
gagcgcctgccgttccgtggtggctactggagcgacgcctcggatgcggggttgtcggcgttgcgcttgtacaacgcccgcggcgatcgcagcagcttcatcggttgccgg

SEQ ID NO: 47 - DNA, 111 bp, Escherichia coli
ttgcgcctgccgatccgtggtggcaactggaacaacgcctcggatgcggggttgtcggcgttgaacttgaacaacgcccgcggcaatcgcaacagcaacatcggttgccgg

SEQ ID NO: 48 - DNA, 111 bp, Escherichia coli
gagcgcctgccgatccgtggtggccgctggaacaacgcttcggatgcggggttgtcggcgttggtcttgaactacgcccgcggcactcgcctcagcaacatcggttgccgg

SEQ ID NO: 49 - DNA, 111 bp, Escherichia coli
gagcgcctgccgatccgtggtggcagctggaacaacgcctcggatgcgggggtgtcggcgtggcacttgaccaacgcccgcggcagtcgccgcagcaacgtcggttgccgg

SEQ ID NO: 50 - DNA, 111 bp, Escherichia coli
gagcgcctgccgatccgtggtggcacatggatctacgcctcggatgcggggttgtcggcgttgttcttgggcaacgcccgcggcaatcgctgcagcagcttcggttgccgg

SEQ ID NO: 51 - DNA, 111 bp, Escherichia coli
gagcgcctgccgatccgtggtggcggctggggctgcgcctcggttgcgggggtgtcggcgttgtacttgggcggcgcccgcggcggtcgcggcagcagcgtcggttgccgg

SEQ ID NO: 52 - DNA, 111 bp, Escherichia coli
gagcgcctgccgatccgtggtggcggctggtgcgacgcctcggctgcggggttgtcggcgttgagcttggccaacgcccgcggcgatcgcagcagcttcatcggtttccgg

SEQ ID NO: 53 - DNA, 111 bp, Escherichia coli
gagcgcctgccgatccgtggtggcttctggagcggcgcctcggatgcggggttgtcggcgttgcgcttgatccgcgcccgcggcaatcgcagcagcacgatcggttgccgg

SEQ ID NO: 54 - DNA, 111 bp, Escherica coli
gagcgcctgccgatccgtggtggcagctggatcaacgcctcggatgcggggttgtcggcgttgaacttgtactacgcccgcggcattcgccacagcaacatcggttgccgg

SEQ ID NO: 55 - DNA, 111 bp, Escherichia coli
gagcgcctgccgatccgtggtggcagctggatcagcgcctcgggtgcggggttgtcggcgttgaacttgagcaacgcgcgcgacattcgcagcagcagcatcggttgccgg

SEQ ID NO: 56 - DNA, 11 bp, Escherichia coli
gcgcctgccgg

SEQ ID NO: 57 - DNA, 111 bp, Escherichia coli; identical to SEQ ID NO: 46

SEQ ID NO: 58 - DNA, 111 bp, Escherichia coli; identical to SEQ ID NO: 47

SEQ ID NO: 59 - DNA, 111 bp, Escherichia coli
gagcgcctgccggtccgtggtggctactggaccaacgcctcgggtgcgggggtgtcggcgttgaacttgtacaacgcccgcggcaatcgcagcagcagcatcggttgccgg

SEQ ID NO: 60 - DNA, 111 bp, Escherichia coli
gagcgcctgccggtccgtggtggcggctggcgctacgcctcggatgcggggttgtcggcgttgcgcttgtacaacgcccgcggcgatcgcagcagcttcatcggttgccgg

SEQ ID NO: 61 - DNA, 111 bp, Escherichia coli
gagcgcctgccggtccgtggtggcagctggagcaacgcctcggatgcggggttgtcggcgttgcacttgcgcggcgcccgcggctttcgcggcggcagcatcggttgccgg

SEQ ID NO: 62 - DNA, 111 bp, Escherichia coli
gagcgcctgccggtccgtggtggcatctggaacagcgcctcggatgcggggttgtcggcgttgagcttgtactacgcccgcggcgctcgccgcagcagcctcgattgccgg

SEQ ID NO: 63 - DNA, 111 bp, Escherichia coli
gagcgcctgccggtccgtggtggcgtctggtactacgcctcggctgcggggttgtcggcgttgtacttgcactacgcccgcggcgatcgcagcagcttcatcggttgccgg

SEQ ID NO: 64 - DNA, 111 bp, Escherichia coli
gagcgcctgccggtccggggtggcggctggtactacgcctcgggtgcggggttgtcggcgttgagcttgtccgtcgcccgcggcggtcgcagcagcaacatcggttgccgg

SEQ ID NO: 65 - DNA, 111 bp, Escherichia coli
gagcgcctgccggtccgtggtggccgctggagcttcgcctcgggtgcggggttgtcggcgttgcgcttgcgctacgcccgcggctttcgcaccggcagcgtcggttgccgg

SEQ ID NO: 66 - DNA, 111 bp, Escherichia coli
gagcgcctgccggtccgtggtggcggctggggcggcgcgtcgggtgcgggggtggcggcgttgggcttgggcggcgcccgcggcggtcgcggcagcggcttcggtttccgg

SEQ ID NO: 67 - DNA, 11 bp, Escherichia coli
gcgcctgccgc

SEQ ID NO: 68 - DNA, 111 bp, Escherichia coli; identical to SEQ ID NO: 46

SEQ ID NO: 69 - DNA, 111 bp, Escherichia coli; identical to SEQ ID NO: 47

SEQ ID NO: 70 - DNA, 111 bp, Escherichia coli
gagcgcctgccgctccgtggtggcggctggagcggcgcctcgggtgcggggttgtcggcgttgaacttgagcggcgcccgcggcggtcgcggcggcggcgtcggttgccgg

SEQ ID NO: 71 - DNA, 111 bp, Escherichia coli
gagcgcctgccgctccgtggtggcaactggagctacgcctcgggtgcggggttgtcggcgttgaacttgttcagcgcccgcggcaatcgcggcagctacttcggttgccgg

SEQ ID NO: 72 - DNA, 111 bp, Escherichia coli
gagcgcctgccgctccgtggtggcaactggaacttcgcctcggatgcggggttgtcggcgttgtacttgtactacgcccgcggcaatcgcaacggcgtcatcggttgccgg

SEQ ID NO: 73 - DNA, 111 bp, Escherichia coli
gagcgcctgccgctccgtggtggcaactggaacggcgcctcgaatgcggggttgtcggcgttgaccttgaccaacgcccgcggcaatcgcagcagcttcatcggtttccgg

SEQ ID NO: 74 - protein, 241 aa, Escherichia coli; identical to SEQ ID NO: 3

SEQ ID NO: 75 - protein, 9 aa, Escherichia coli
MGGYTIWAF

SEQ ID NO: 76 - protein, 9 aa, Escherichia coli
MGGYQGHRT

SEQ ID NO: 77 - protein, 9 aa, Escherichia coli
MGAQYLGHR

SEQ ID NO: 78 - protein, 9 aa, Escherichia coli
MGALRYHGQ

SEQ ID NO: 79 - protein, 13 aa, Escherichia coli
MAVGTNYSSHRQR

SEQ ID NO: 80 - protein, 14 aa, Escherichia coli
MGWPNLYPGHRSLQ

SEQ ID NO: 81 - protein, 8 aa, Escherichia coli
MAQYLGHR

SEQ ID NO: 82 - protein, 9 aa, Escherichia coli
MGYFRDTNR

SEQ ID NO: 83 - protein, 9 aa, Escherichia coli
MGWHPDRTQ

SEQ ID NO: 84 - protein, 193 aa, Escherichia coli
MRTFEITEKEVAAAFREAESGEAKKILAALFCKEEMVKPTLDDYKTIRTYEDACKALGEPIFEDPNNLPNHIIALMKLETISRALWGRNFQPKPDGEGSKVYWYPWFALWTKKEVEDMNPEQRGALVSANADLGAFAGFGCLAALYRSSSADAGIGFRLCQETEEKAKYFGQQFIELWAEYLKFNFTVGNRLK

SEQ ID NO: 85 - DNA, 115 bp, Escherichia coli
gcgcctgccgatccgtggtggcaactggaacaacgcctcggatgcggggttgtcggcgttgaacttgaacaacgcccgcggcaatcgcaacagcaacatcggttgccggcctgct

SEQ ID NO: 86 - DNA, 115 bp, Escherichia coli; identical to SEQ ID NO: 85

SEQ ID NO: 87 - DNA, 115 bp, Escherichia coli
gcgcctgccgcatgcgtctactgaggcggactgtggcactggcattgtgacaaccatgtccttgaataggatcccagtcctggcggccgccgcggtgctcggttgccggcctgct

SEQ ID NO: 88 - protein, 8 aa, Escherichia coli
DYKDDDDK

SEQ ID NO: 89 - protein, 8 aa, Escherichia coli
WSHPQFEK

SEQ ID NO: 90 - protein, 7 aa, Escherichia coli
NLLSHPQ

SEQ ID NO: 91 - protein, 7 aa, Escherichia coli
WSHPQFE

SEQ ID NO: 92 - protein, 7 aa, Escherichia coli
SLLAHPQ

SEQ ID NO: 93 - protein, 7 aa, Escherichia coli
YKHDLHK

SEQ ID NO: 94 - protein, 7 aa, Escherichia coli
YHHDLEK

SEQ ID NO: 95 - protein, 7 aa, Escherichia coli
YQDDEDR

SEQ ID NO: 96 - DNA, 64 bp, Escherichia coli
tttgttgcctgatgcctgttcatctgtgttctgcggccctgcgcgatagcgcgggccgtctcta

SEQ ID NO: 97 - DNA, 33 bp, Escherichia coli
tctgcggccctgcgcgatagcgcgggccgtctc

SEQ ID NO: 98 - DNA, 4000 bp, Escherichia coli
  variation (1)..(636): n is a, c, g, or t
  misc_feature (1)..(636): n is a, c, g, or t
  variation (788)..(788): n is a, c, g, or t
  misc_feature (788)..(788): n is a, c, g, or t
  variation (792)..(793): n is a, c, g, or t
  misc_feature (792)..(793): n is a, c, g, or t
  variation (797)..(798): n is a, c, g, or t
  misc_feature (797)..(798): n is a, c, g, or t
  variation (800)..(800): n is a, c, g, or t
  misc_feature (800)..(800): n is a, c, g, or t
  variation (803)..(804): n is a, c, g, or t
  misc_feature (803)..(804): n is a, c, g, or t
  variation (806)..(810): n is a, c, g, or t
  misc_feature (806)..(810): n is a, c, g, or t
  variation (812)..(815): n is a, c, g, or t
  misc_feature (812)..(815): n is a, c, g, or t
  variation (817)..(818): n is a, c, g, or t
  misc_feature (817)..(818): n is a, c, g, or t
  variation (820)..(821): n is a, c, g, or t
  misc_feature (820)..(821): n is a, c, g, or t
  variation (823)..(824): n is a, c, g, or t
  misc_feature (823)..(824): n is a, c, g, or t
  variation (826)..(828): n is a, c, g, or t
  misc_feature (826)..(828): n is a, c, g, or t
  variation (849)..(849): n is a, c, g, or t
  misc_feature (849)..(849): n is a, c, g, or t
  variation (970)..(971): n is a, c, g, or t
  misc_feature (970)..(971): n is a, c, g, or t
  variation (973)..(973): n is a, c, g, or t
  misc_feature (973)..(973): n is a, c, g, or t
  variation (975)..(975): n is a, c, g, or t
  misc_feature (975)..(975): n is a, c, g, or t
  variation (977)..(977): n is a, c, g, or t
  misc_feature (977)..(977): n is a, c, g, or t
  variation (979)..(979): n is a, c, g, or t
  misc_feature (979)..(979): n is a, c, g, or t
  variation (989)..(989): n is a, c, g, or t
  misc_feature (989)..(989): n is a, c, g, or t
  variation (992)..(992): n is a, c, g, or t
  misc_feature (992)..(992): n is a, c, g, or t
  variation (996)..(996): n is a, c, g, or t
  misc_feature (996)..(996): n is a, c, g, or t
  variation (998)..(1001): n is a, c, g, or t
  misc_feature (998)..(1001): n is a, c, g, or t
  variation (1004)..(1005): n is a, c, g, or t
  misc_feature (1004)..(1005): n is a, c, g, or t
  variation (1009)..(1009): n is a, c, g, or t
  misc_feature (1009)..(1009): n is a, c, g, or t
  variation (1011)..(1012): n is a, c, g, or t
  misc_feature (1011)..(1012): n is a, c, g, or t
  variation (1016)..(1016): n is a, c, g, or t
  misc_feature (1016)..(1016): n is a, c, g, or t
  variation (1018)..(1018): n is a, c, g, or t
  misc_feature (1018)..(1018): n is a, c, g, or t
  variation (1021)..(1023): n is a, c, g, or t
  misc_feature (1021)..(1023): n is a, c, g, or t
  variation (1026)..(1027): n is a, c, g, or t
  misc_feature (1026)..(1027): n is a, c, g, or t
  variation (1031)..(1031): n is a, c, g, or t
  misc_feature (1031)..(1031): n is a, c, g, or t
  variation (1041)..(1041): n is a, c, g, or t
  misc_feature (1041)..(1041): n is a, c, g, or t
  variation (1045)..(1046): n is a, c, g, or t
  misc_feature (1045)..(1046): n is a, c, g, or t
  variation (1051)..(1051): n is a, c, g, or t
  misc_feature (1051)..(1051): n is a, c, g, or t
  variation (1053)..(1053): n is a, c, g, or t
  misc_feature (1053)..(1053): n is a, c, g, or t
  variation (1058)..(1058): n is a, c, g, or t
  misc_feature (1058)..(1058): n is a, c, g, or t
  variation (1060)..(1061): n is a, c, g, or t
  misc_feature (1060)..(1061): n is a, c, g, or t
  variation (1068)..(1068): n is a, c, g, or t
  misc_feature (1068)..(1068): n is a, c, g, or t
  variation (1072)..(1072): n is a, c, g, or t
  misc_feature (1072)..(1072): n is a, c, g, or t
  variation (1076)..(1076): n is a, c, g, or t
  misc_feature (1076)..(1076): n is a, c, g, or t
  variation (1080)..(1080): n is a, c, g, or t
  misc_feature (1080)..(1080): n is a, c, g, or t
  variation (1082)..(1082): n is a, c, g, or t
  misc_feature (1082)..(1082): n is a, c, g, or t
  variation (1983)..(1983): n is a, c, g, or t
  misc_feature (1983)..(1983): n is a, c, g, or t
  variation (1992)..(1992): n is a, c, g, or t
  misc_feature (1992)..(1992): n is a, c, g, or t
  variation (1994)..(1994): n is a, c, g, or t
  misc_feature (1994)..(1994): n is a, c, g, or t
  variation (2004)..(2004): n is a, c, g, or t
  misc_feature (2004)..(2004): n is a, c, g, or t
  variation (2023)..(2023): n is a, c, g, or t
  misc_feature (2023)..(2023): n is a, c, g, or t
  variation (2038)..(2038): n is a, c, g, or t
  misc_feature (2038)..(2038): n is a, c, g, or t
  variation (2056)..(2056): n is a, c, g, or t
  misc_feature (2056)..(2056): n is a, c, g, or t
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaaaaaaaaaaaaaaaaaaaaaaaaaaaaaaaaaaaaaaaaaaaaaaaaaaaaaaaaaaaaaatttaaaaaaaaaaaaaaaaaaaaaagaaaaaattcaattagaacaaaaatgaaaataaatagataaataaatacaaattaaataaatanaaannaaannanaannannnnnannnnannannannannnaaaaaaaaaaaaaaaaaaaantttaaaaaaaaaaaaaaaaaaaaaagaaaaaattcaattagaacaaaaatgaaaataaatagataaataaatacaaattaaataaatacaaattaaattataattatttctattggattannantntntntttatttatnttntatntnnnnttnntttntnntttntnttnnnttnntttnttatttaaanaatnnttaananttttntnnaaaaatntttnattntttnanaatttttttttttttttttttttaatttcattgaataatcatgataatgacaattgttattcattcataatgatattgtttttatctatttttactatttaacttatatatgagttaatgcattacatgtttaattttatttaagaaaagaaaaagaataaataacaattaattttgtgtgtcatatttatatcttaaagaatatataccggtaattattggtttttattggtttagttctatggtattttggtagtgaatcattattagtatttcaatttaaaaaactaccagaatattattggtaataaattattaaataatagtattataagtttaaaaaaaaaaaaaaacaatgataacaacaataataattaataactattaatgtttaaaaatatttattatttcttttttttatggtgtaaaggttttttaaattaatataaagtatagacaacgtatcaataaaatcacaataacctatttaaaaatacaataacaaataatattaaaatatttaattaataatcaatatttttttataattaaagtttttcagttactgatcaatattataaattatttttaaatgataaacattttatatattaatatattaatattgattaatataacctgagataactggtctcgaacctagcccaaatgtcattttttatactatagcctttcgcaaaagatgtttttcatcagaaacaatatgaatagtttttatatatgtacacgtgattttcatatgaaatatattaaatatatttttctataaacataataattatttaaataataaaaatatttttttaaaggttaacaattaataaaaagaaaaataaaaaaagtaattgttaataaaaaaaaaaaaaaaaaaaaaaaaaanttatttaantnttttattatnataatggatatattttttnaaaaaaaaaaatatntttttactcaatactatntttattaaaaaaaaaaaaaaaaaaaacatctctctatttcataataattatttattctactgaacaaaaactgtattgtattttcgaataaatgttcaaattcagaagtaaattaagtaagattatgattatactttatttatcagtattttcaattttcattcaattcaaacaaacaaacaatcaaactaccttttttatatagtctttttctgtattcaaagtattactaattgtttgttttttagttactattaccgttaaaaatataaaagcgattgttttttatttttttttttctgttaattattattaattaataaatattattatattattatatattaccaataaaataattaataataaaaattattatataaatataattaaatattgtttattattattataattattattattattagaatgaaatatagttaaatttctaattaatattattattaatattatattaaaaggtatacataacgatattaaggataaaaaatactattatagaaattgtctacctataaattaaaaattttcgtggtagatatttacctaaaaaaaatttttttttattctttacgtattacttaattgaaatttagaaatgttttttttataattaattttttttttttttgtataaaatcccacaccctacttcattttatttttctaataatgattcatctatttcatctataggtttttttttttaatattgaactaatacaattaatatatatactaatattttattcattttttattcatgtataattgtttttatgtaataaatgtatattattaatttatgcacaattgtattattattatttttttttatgtaataattgtaaatagtttgatattccaaataaagttaatagatgaaattaaattaacccttctcccttttttatatatatatattatttatttttttttaaaaaatattgattttctgtttaaagttaatagttttgtcccttaaaaaaattttttttatctttttgatgaataattttgaaacaaaagtttatttaataataaaattgttatccagattttttactttgaaatcttatattaaaaataaattaaatttaattaattattcagaaatcactatttacggtgtgccaagagcattatgtatcattataaatgaaatggaatattaatatagtcaaaaaacaataaaaacataacaaattgattcaaatatatttatttatatatttatttatatatgaatcaatttaataaatttttattagtaaaattgtttacttttttattttccataaaaaatgaaaaaataaatttaatattccgtaaataataagattccttgttttaaaaatatatgcataaaaaaataaagaaagagaaaatggggttgaataataaatacatccatttgaataataaagaaaaaaaagagataaaaataatataaatttaataataataatagtaataataataaaaaagagttcagttaaacatcaaaatatatactttggtgaactctttttaatagtttatcaaatggctgtatctttttaatatatattatatccaattagaatctagtataactgtatttttttaaataaaaaatttccccatgattctgtgttttaaagcggagtgataatacaaaaaagaaaagagaaaaaaagaatatcaaaaataattttttaatatatatgattttaaatgattgttatttatttatttatttattaaaatgtttgatcataaatgtattaatgtgttaatttttaaaacaataataatcaatattattaatgataaatggataaataataaaataagagttactatttcgtctataatttaatgctatattttttattagtatttcttttaaaaaataagaaaaataatataataaaatat

SEQ ID NO: 99 - DNA, 4000 bp, Escherichia coli
  misc_feature (1967)..(1967): n is a, c, g, or t
  misc_feature (1972)..(1973): n is a, c, g, or t
  misc_feature (1978)..(1979): n is a, c, g, or t
  misc_feature (1990)..(1991): n is a, c, g, or t
  misc_feature (2003)..(2003): n is a, c, g, or t
  misc_feature (2017)..(2018): n is a, c, g, or t
  misc_feature (2026)..(2026): n is a, c, g, or t
  misc_feature (2029)..(2029): n is a, c, g, or t
ggcggtaatggggagaaccgtgcagtaatcaaccaagaatctttggaaccaggcttggattctaatgttgggttttgaggttgagccgtagagaatttcctctaatgaaatgacgcttaaggcgatcgacgaaacagttgcactccaagtcaatacgccgtgatttggttgcaagcgagccaattcgctgatgatgttggtatcacagaggaaggtcatgaggactttcggcgaagggattggcacgatcctcacgcggaggcgtttcaaggctgtaattttcctcagcacaaagctcacgcaactctacgaaggcgctggctaaagaggctttctgggattgctgttgccaaaggagaaatgcctgaaacacatcagctttcaccactgctgcaaccaattggttttgatcgtagattagctgaggctcttcaacagccgcatggatcagttcagagaatttctgttttgcgtcctcaagtttccagggcatcgttttatgagcgagacagcattgctctaaattgtagctttacaacgatcgccccttcacactatgacgatcgccgctgacaaacgctgaaccagcgatcgctcctttcaactctattaacaatcgcccctgcatgattgactcaagggcgatcgcccctctcaacgataccgataatcgccccaggatgattggctcaagcgcgatcgcgcgcgcttggggaaacagggtcatgaggcttaaggcagatcttcaaacaaagcagtcaaatcctgatagccactcactaccctgagcacttcgatagcgtcgttgagcaaacggtaaaaaatgaggtactgcgtgtagggcaaactgcgtgagccaggataaagttcatctcgtttgcgaccaatttgaggaaactgagccatccgttgaagggtggaatcgatgccgctcagaaaccgttcggcgctggttaaactactttgaaccgcaagataatctgcaatggcttcaatatctcgactggcgaggcgtgtaagccgacaagctcgactcatatttaggaagagcgctggcgtaatcgttgacgaatcgcttcgatttcagtcacagcatccaggagttctccccgttcggcggcttcgactcccagcagcacctcacggcgcaatgcttcaaaccgcccctgataaacctgctctcgctctgctaatgcttgcagtcccgcaagaaggatttcttctaacgaggcgtatttcccactggcaatctggcgatcggcaaactgctgtaaatcctgcggcagtggcatagtcattgttgtactcgaacgtgggcactcattttttcagtttaacgtacctgtggaatcgcccctgcatgattggctcaagggcgatcgcgctgacgcaaacctccgaggttttaacaagcatggaaccgcatgaccaacctcgatctgaaacctccgaggttttggcacaaactcaatgagccggacgagtcttcggcgaacctaccaacccatccggctcggttttatgtttggaggttgttgccttcctcgctgggaaaggtctggactcttctgtgtacgcccggacaattcccattgcccagttctgacggtagaagagtgctggaaaaaccgaacacaccacccgaaaaccaacattgttgttgcggttggcgggagcattatagttgcggttggcagagcgacagttcaccggattgttgttccaggaaccgccacgtttaccgatgccgatcccaactcaggtctcgacgggcgagaagactgagtgcaatgagtatacggcatgatgggtgagaagccagttttgtgaaaataatttgatcgcgctacgcgcggaagaagagcaagaagggtaaagagcaagaagagaagagggcaagagggcaagagggtaaagggctaggagagtcctggaaaaaccgaacacaccacccgaaaaccaacatngttgnngcggnnggcgggagcannatagttgcggtnggcagagcgacagnncaccggantgnagttccaggaaccgccacgtatgacccgttgttcactatcgccattcgtcgtccaggcactttcgtccgttggagcgccctgataattctgatgccaatggtcggcgcaccattcccacacgttgccgtgcacatcgtatagcccaaaggtatttgctgagaagctgcccacatcggttgttcgcttacgatacgtgcctttaggagcatcgccataaatatagttgccatcgtagtttgccagctcaggcgtgatcgtttcaccaaaatggaagggagttgtggtgccagctctacaggcgtattcccattcggcttcgctcggcaaacgataggacttgcctgttttttgcgacagttgggtgcaaaaggcaatcgcctcctcccacgacacctgctctactggacgctgtgcccctttgaaattggagggattgctgccgacgatcgcttcgtactgcgcctgcgtcacggaatatttgcccatgaaaaacggctctatggtcacggcatgaatcggcttctcgcgaccatactcatctgcccccatctgaaaagtgccgccaggaatggcaatcatatctagcgtgaccccattgcccaggtcttcagcaaaatactcggctcgtccacggctacgattaatctcaacggttgttttaccgccaaacaagccctgttttttggcaatgaccagctttgcagtctcaaattcaaacggttgaagcggcacgcctggtcctaacttacggtttggcggcggattaactactggtagcaatcgttgactttgtgctgccagttcttgttgccgctctaaggctttttgtttctgctgttcctgttctagcttttgccgcgttgcttgttcctgctgccgtttctcctgtccctgacgtaccagttctgcttgctgtcgctcatactcagcttgtttgggggcaagaaacggtgcttcgattgcactcacgtcttcatcacgcaaactcaaaagctgttggattcgttgcaagccaaggcgatcgcgatcggtaagaggataccgcttggcgatcgcgccttcaaacaccgtgcggtagcgatcgactttggcgcgacgttgacgatagggttccagttcctcggtttcgatcgtcgtggcatcatccggcaacagcgtcagaccacgttgtaagtcgtccagataagaacgattgataaaggaaaaatcgccctcatcctcttctgccagcagcctgacttgtttgcgatattttagcgctgggtcatctttgggcgactttgccagcagaatcttgtaaccttccttcaccgggtagaactctggggtcatcgcgggtgcagcctccttcaccttgctgctggcgtaggcatgaagttcttccatcgcaataaacccatcatcgtcctggtcggctccgcccgtgcgaatgccttctaccaagtagtgagtgtaaaccgagaggtcaaagccctcttgcgccagggcgtactgcgttgagttggaggcggtgagaatggcggtgcctttgccgcccaaaaattgctctgggttgacgctgccgctatcttttgccttcacgcctttggcaaacgcaccgctgaagcaactgtcgaggatgatgaccttatactgcgatcggctttgctccagccaatcgcgtaccgatcgggcggcaacggcagtcgttggcactaaccgcccctgttctttacggctgaagcgactggcaaagtaaaactcgcccccatcatccaccacgccgtgaccagagaaatagagcaacaccagatcgtctttggcgcggttggcaaagagggtgtagatggcatcttccatcgcctgtcgggaaggattttgcagcacggtcacagcgtcagccgcaaactcacctatctctgggttggtcaacacctgctgcatggcggtcacgtcgttgacggctgatggcaacccgtctaaccctggtt

SEQ ID NO: 100 - DNA, 4000 bp, Escherichia coli
  misc_feature (256)..(256): n is a, c, g, or t
  misc_feature (811)..(811): n is a, c, g, or t
  misc_feature (1109)..(1109): n is a, c, g, or t
  misc_feature (1139)..(1139): n is a, c, g, or t
  misc_feature (1145)..(1145): n is a, c, g, or t
  misc_feature (1151)..(1151): n is a, c, g, or t
  misc_feature (1169)..(1169): n is a, c, g, or t
  misc_feature (1187)..(1187): n is a, c, g, or t
  misc_feature (1205)..(1205): n is a, c, g, or t
  misc_feature (1208)..(1208): n is a, c, g, or t
  misc_feature (1265)..(1265): n is a, c, g, or t
  misc_feature (1280)..(1280): n is a, c, g, or t
  misc_feature (1289)..(1289): n is a, c, g, or t
  misc_feature (1301)..(1301): n is a, c, g, or t
  misc_feature (1313)..(1313): n is a, c, g, or t
  misc_feature (1326)..(1326): n is a, c, g, or t
  misc_feature (1346)..(1346): n is a, c, g, or t
  misc_feature (1361)..(1361): n is a, c, g, or t
  misc_feature (1364)..(1364): n is a, c, g, or t
  misc_feature (1610)..(1610): n is a, c, g, or t
  misc_feature (1613)..(1613): n is a, c, g, or t
  misc_feature (1739)..(1739): n is a, c, g, or t
  misc_feature (1757)..(1757): n is a, c, g, or t
  misc_feature (1973)..(1973): n is a, c, g, or t
  misc_feature (1982)..(1982): n is a, c, g, or t
  misc_feature (1985)..(1985): n is a, c, g, or t
  misc_feature (1988)..(1988): n is a, c, g, or t
  misc_feature (1991)..(1991): n is a, c, g, or t
  misc_feature (2003)..(2003): n is a, c, g, or t
  misc_feature (2039)..(2039): n is a, c, g, or t
  misc_feature (2042)..(2042): n is a, c, g, or t
  misc_feature (2045)..(2045): n is a, c, g, or t
tatcaaagatattaatcgttcacgcgtcttaacagttggtacacttcctcttaaaaaagtatcttctaaaggtattacactatcaaatgatacatctttagaggatgcaatgaaggcgcttgtagaagctaaaaaggacagcgttacagttgtaaagggtgacgaaaagcttggaagcatttctatgtatgatatagttcatgcagcaactcgttcatcggaaacagctggagaagctgttacctacagataaaanaatctgaaacacagtcatgtaaggcatataaaaatttattaaatatatgccttacatacaaatatgaatatgtctgatgtaaactttagtatagaaaattcacttcgccccaatggcaatgaagttattatgggtgtagatgaggttggccgtgggccgtgggctggtccagtaactgcctgtgcagtgatacttgacccagacaatataccagtgggattaaatgactcaaagaaactaaccgcaaagcgcaggtttgtactttttgaggaaataatgaactcatcaatcgtttcttatgtacatgtagacgtagatgagattgatgaaattaatattttacaagcaacatttagggcaatggaacgttcaatatctaaacttccagtaccggatcatatattaatagacggtaataagttaccaccaaatcttccaagtcctgcgacagctattataaaaggtgacagtaagtctgcctctattgcggccgcatctattgtagcaaaagttattcgtgataagcttatggttgacctttctataaaatatccnggatatgggtgggaaaaaaatgctggatatggtacaaaaatacatcagttaggactgctaaataatggggtgaccccacaccatagacgttctttcaaacccatacacaacatgttgtattccgcttcacctcgtaagtaactgattcataaaaataaattgacgttagcctcagtttgaatcattttaaccctaacgacgcaaaaatgcgcattacgaggcagacatggtaaacagagcaaaaaaagaaggcagcattaagttgccgctaaataatattattgatggtgattgtgtngaggtaatgaattcattgccagaaaattcnattganctaatnttcgcagaccctccctanaatttacaattaaaaggngacttacatcgcccaganaantcaaaggtagatgccgttgatgatcattgggatcaattcgacagctttgcaatttangataaatttagccgngattggctnaaagcagcacgncgcgttttaaanccaaatggtgctntatgggtcattgggtcttancacaatatcttccgngtnggcacagctcttcaagatgcaggcttttggattttaaatgatgtcatttggcgtaaatcaaatccaatgcctaattttagaggtgttcgacttacaaacgctcacgaaacgatgatttgggcaggtaaaactgaaaaatccaaaccaacatttaattacgaagcgttaaaagcacttaatgatggggtacaaatgcgctcagattggcacttgccaatttgtaacggaaatgaacgcctcaaaaangangccggcgataaagctcatccaacgcaaaaacctgaatctctccttcatagggttattgttggctctacaaatgaaggtgacgtaatactcgatccattctttggatctggaacgaccggtgctgtngcaaagaaattagggcgnaacttcatcggcattgagcgtgaagaagaatatagaaaagttgcaaaaaagcgtatcaaagcaatcaaaaaatatgatgttgagagcttgaaggtatcaacatctaaacgtgcagaaccaagagttccatttggtcaagtcgttgaaagaggaatgttaaagccaggcgaccagctttattcattgaatggacgccatagtgctaaaattcacgcngatggaacnctngtngcncacgatcagcgnggttcaattcatcaagttggagcagctctagaaggngcnccnagctgtaatggctggacatattggtgttttaaaaaacgtgggcaagccattccaattgatatgttacgtaaaaaaattcgtgcagaaatgactccataaaagacttctacatctaatcattttacgaaacatagaagataactaccgtttagaactgctcgttctaaacattgccaacttaccccgcccttgtggcggggttttttatttatagaattattatttcagaaactttgatgcttctatccaaacttttcgcatcacagttggcaggtcatctgacttgaagttttcttttgttataaatttgccaactctaggtgtgcttttaacattaaatgcaatttttatagttagttctaaatggaagtgtgtaaaagtatggcgcacaggttcatttaaagtatgccaatctgcttctaacggtattaaatgatccgttggcttaatatcccaatcacttccaggccatcccaacatacctcccagcaaacctttttcggaacgtctctctagtaaaatagatttatcatttcttatggctacatatgcagtaccaacgcgtgttggtttttttagttttggggttttattaggtaaaccatctgcaatcccctttaaaagtccctcacaattgaaattccatggacaaatgctgcattttggttttcgaggcgtacatattgtagctcccaaatccatgactgcttgagcataatcaccacaacgattttctggagttaagccagaagccaatagccaaagagcttttttagaagccggcaacggttcctgaactgcataaatacgagacatgacgcgttcaatattaccatcaaggacgatagcttttttattaaatgctatgctcattattgcagcagctgtgtacggtccaatacccggtaatgataataactctttttcattgcatgggaactttccatcatattgatctttaataacccgagcacattttagtaaatttcttgctcgtgcataataacccaagccagcccaagcacccattacatcttcatccttagcattcgccatatcatgaactgtcggccataatgtaataaatttaacgaaatactctttaactgcagctactgtagtttgttgaagcatgacttcagacatccaaatataataaggattaggaatggtgcccattttgctgtttaaaggaggaatacgccatggcatctctcgagcatttgcatcataccaagatagtatctctactgccatattattttttttagtcaagacatatgccctttgcaatacattgtattttaggtttattattaaccactgatataaaccgatgtaaccactgaatataggaaatgaagcaaatggcatataagtcacgcggatttatacaaactggcggcttactgaaagcaaaaattcgagcagctactgaaactcggggctttgcagaaactagattacttacaaattggaaagatattgctgggccagcgacggcaagtatctgcaggcctgttaaagtaagttatggaaagcaaggctttggtgccacactcactcttttaacaacaggcgcgaatgcacctgttttacaaatgcaactgccaaaaatactttcaaaagtgaattcaatatatggttacaatgcaatcagtaaaattaaaataactcagacctctccaattgactttgaagatagttttgaaaatttcgaaggtagagaaaataaaaaagtcttatcagaaaaacagataattaacgttgaaacatctgtaaaaaatgtatctgatattaatctaaaggatgcgctgtcaagattgggcaaaaatataataatacgaaataataaggattaaattatgaatcgcagaaaatttacaggccttctttcaataggagcattgagtgcaagtgcaacacgaagttttgctgataatacggcaaaaaac

SEQ ID NO: 101 - DNA, 4000 bp, Escherichia coli
  misc_feature (1965)..(1965): n is a, c, g, or t
  misc_feature (1981)..(1981): n is a, c, g, or t
  misc_feature (1986)..(1987): n is a, c, g, or t
  misc_feature (1992)..(1992): n is a, c, g, or t
  misc_feature (1995)..(1996): n is a, c, g, or t
  misc_feature (2001)..(2002): n is a, c, g, or t
  misc_feature (2007)..(2008): n is a, c, g, or t
  misc_feature (2013)..(2013): n is a, c, g, or t
  misc_feature (2017)..(2017): n is a, c, g, or t
  misc_feature (2026)..(2026): n is a, c, g, or t
atgatccgcgacataatcgattcgcaggaaggtaatgtcgtattccgccatatccgtatcacaaaccgtgatttcatcgggaacggttcggaagtgctggaaatcctgcaactcggtatcgggggactggatgaaaacggtaatcaggtagagaagcccgtacttaccgggaactatctgctggatgaagtcatcgagaactcggatatagaagcgatccggaacggcttcgaaggtctgaccgtcagcaccataatcgacgcttatatcaagatcatcgactggtttaatgcggaagcgtatggcggagaaccctattatcccgaagtcacattggataatgtgggtgaaatcatggactattataatggtgaaacctatgaagaataccttcaacggtttgcggaagaaaatatggatattaacgatatagtaaacagcaaataacatgagtacaaaagaacagagcgcaaccctgctgcgtctcaataaacaggaacaggtaaaagccttgcaggcggtaggctttgccgacattacggaaaactcgcgtgccagcgagttccctaaccggataaagtgggctaccgggttgctggacatgcgggtggcatgtaaccggatttccgataattccaaatggtattttacccgtgaggagtggaactcgttgactcctgccaacaagttgaagtttatccgtcgtggtttgtgtatccgggcacattcgcagtcttttgtcattgcggcacaagagtgttatgcagctgacttgtcttccagcttctattggggcggtcttggtaaagcgattgacgggctttccgcaaagatgctgggcaaaatgtacacctgcttcaccgggaaagaagatacacgcctgatccttgatgccctgaaagggacaaattcgaacggtgtggaaggcgcacccgctgcggaagctgccgtagcctataaagccttcacactcgatggcgacggtctggaggatgatactgaatggttcttgccttcttccggacagatgatgatcatgtatcgataccgtgaccaaatcaatgaaatgctgcgtgcattttggagcagtgacagcatgttcctgacggacaaatactactggacgagcacgtactatgatacgacaaatgcatggacgtgcaatttgaataccgggcacatgaacgtacagaataaaaatacaagcctgttgcatgtaagggcaacggcagaagagtaatccattaaaacagtacatatttatgacagacaagaataatgaaagcgcattgcttttgcgcatgaataaagaagaacaggtatctgttttgcaggagatcggttttaccaacgtgaacgaaaatacgcctgccagtgacattgcaaaatatatcagatgggctggcgggctgcttgacctgtcctttgccacaatccggatcgaagacggtgtcaacgtgttctttactgctgaagaatggaattcccttagcgcaaataaccgttcaaaatacctgcgtgtaggtgtccgtatccgtgcggatcgtcgccagttcgtcatagcgaaaagcgactgcactgacgatataggcgggcgtactttcaaatggggggcatacggtacggacatccgtggcgttaagaattacgggaacggtaatcaagggctttatgaaacggcagacggaaagcaaaatactgatgctatcatagaagccactgcaggagtcaaggataattccggtgtcgtcggtgcaccagccgcagaagcagcaaagaactataaggcttgtacgcttgaactggacggacttgaagacaaaaccgagtggtatcttcccagcgaaggagaactcattaccatcgccaaatataagaccgaaatcaatgagttattatcctctgtatcaggtaatcaaaatataattacagccgactggtattggagcagcaccgaatacgacncctcgagcgcgtggtncgtgnncatgnacnncggcnncgtgnncacgnacancaagactancgcaggcagggttcgtcccgtttccgcaatagattctttatctctttaactctttatctcttagatagttacgtttaattagccccggtaggggctttttaagttttaaaattctgaaaaaatgagtgttaatagtttgacaatcattaactttgcggagcaaaagaaaaattttaaaaatatcaaaaattaacatgggaaaagcagaggacagaccagtctatcaattaatgtatcggttattaatgttgatacttgatgcaagagacaagtttccgaagaattacaggtacgaattcggtacggaacttatgatgtccgcccttcgttgttgcgagttgatccgttatgcaaattcaagccttccgcgtcgagtggaatacctgaacgaattccttgttaagtttgatacattgaaactcttattaagggtatgtcgagaccggaaactgatcaatattcagacgacagcagacatcattgagatgattacgtcgattgaaaagcaaattatagggtggcgtaatttcaccgcttcccaggaaaagacagcttccgtaaagccagagccataatcttcacggagtttatgggagagcaatctaatttatctattgggcattcccccggtgatgaaccgggaaagactaagacagtgaatgctgaatcctcgaacgcgtggtacgtgaacatgaacaacggcaacgtgaacacgaacaacaagactaacgcaggcagggttcgtcccgtttccgcaacagataaaccgatctatgacatacccttatcttccatcgtgcatgcatttgacgtctgttgcaagaataaacgcaatacagatgactgcatagagttttcgtttgaatatgacacggatttggttgccgtgtgggatgctatcagatacggtcgctacgaacctgattattcaaaatgcttcatacggaaaaagcccgttcttcgtgaaatttttgcttccgcttatgttgatcgtgtaatacaacattgggctgatctacgccttgatcctattttggaagagcgttttcaggcacagggaaatgtttcaaaaaattgccgtattggtgaaggagcactttcggctgttatctatctgaatgggatgatcatggaagtcagtgaaaattatacgaaagacgcatacattttcaagggtgatttcaaaagcttttttatgtcaatgtccaaatccctgttatgggaaatgatcgacctgtttatccgggataactataaaggcgacgatatagagtgtttattatatatattgcgcactgttatctttcaccagccacagtataaatgttataggaaatcaccgttacatttatgggatgagttgcctcatgataaaagtttgtttcatgctgatccggatcatggttttgcccccggcagtcttcatgcgcagaaattcgcaaattttatcggttcttgttttgattactatgtttccgaaatactgggaatcaagcattatgtgcgttttgtggatgatttcgcctttgtaatgcgtaataaagaagatattctaaatactgttcctttgcttgacagttacctgaaagagcagctgcttcttaaattacatcctaaaaaaatatatatacagcatcattctaagggagttttgtttgtaggggcattcattttgcccggtcgaatttatatttcaaaccgtgttgtcggtaatttatacgatgtaatcagcaaatataataaaatagcggaggaaggctttgcggaagcacacgcggacaaatttgttgccaccctgaattcctactatggattaatgaggcatttcaatacgtacaatctaagacggaaagtggcgaaacgtattaatcctgcatggtgggaatatttttatgttcagggacattgggaggtttttgtgttgaagaacgaatataattttaagaaacaattaaaaaaacaaataagaaaagg

SEQ ID NO: 102 - DNA, 4000 bp, Escherichia coli
  misc_feature (1986)..(1988): n is a, c, g, or t
aatctcttaatacttgcatgtaaacatcttgtgatttagttataaattttttttggagggtaagcgtaatagttccgatcatagctaaaagaagtataaatcctaaagcaacgaaaaggtaagcaaaagacgtaaaaaataattctcctaaataaagtgtgtttgatggtttaaaacaccaaatagaaaaatcaaaacagaaattaaatgaaagtaacgattcttgaactttagttaaagggatatcgtataaatttagtagcacgaaattaacattgaataatattaaagtttcaagtaaaaaaattagaccaaaaatgaatgctattaaaagatattgtttcgaaccttcttttaactcggataattttatattcagcattattaaaacgaataaaaaaagaaccgcaattgctccaacgtaaacaattaagaaaagaataggcaaaaattcaacgtttaatataaataacaaacaagataaattaaaaaaagttaatattaaaaaaagaacagaatagatagggtttttagaacttacgaccataaaagaacaaataagagctaaaccagaaaaaaagtgaaatataaaagagctaattgttaaaaacatcaaacgtataagttaaagaagcaagatttgaacttgcaattctaaaagaactaaatttacaatctagcgatttaaccaattcatccattctttaataggcaattaaaaggacttgaacctttatctgtaacgccacaaattactgttttaacccattaaactataaatgccttatttctttaaatttttaacgccgtaaatgcttttcgaagtcgctctaccaaaaactggagccaaatcaaatttaccgcgaaccgcaatgtttctaactccaattaaatctcgacttcttccgcatcgaattaagattgttgagtgttgttggaggttatgaccttgacctggaattttagctattaggctttgcttcgttttaactagtttaatcttacaaactcttctgtttgcagaatttggttttttaggagatatcgttaaaacttttaaacaaactgcgctttcttgaggaaaactgcttaaattattatatttcttttttgatcttttaataagttttattatacgattcatctatctaatttcgaaattggacttgaaccaataactttctaggtgtaagctagacattctgccattgaattattcgaatgtatttaaaattttattgtataagtttaaaccttgctatttaatcaaagtaaaaatctttcagaatcaactgattcaatagctattggcatagccccatgagcggaaccgcaaatttcgctgcactgaccgaaaaaaacaccatttcttaaaatatacaaacttgtttgattaagtcttccggggcaagcgtctaatttgactcctaacgaaggaacagctcaactatgtaaaacatcagctgcagttataagaactctaatgtgagtttttagaggtaatacaactctattatcaacctctaataatcttagtgttccgaattctagatcatcttctgctacaacgtaactatcaaaacggacagcacaatgctgagcctcaaaatcactatactcataacttcaaaaccattggttacctatacattttaaagttaaagcaggatcaacaatttcgtcgattgaataaagaagagcaaaagaaggaagagctactacaattaaaattaaagaaggaataactgttcaaattatttcaataattgttccgtgaacaacaaacctggaattcgaattgacgctttcggaagttttctgaaagtaatataaagttctagccataacaactagaacaaagaaaaaaataaaagtaatgaaaaacattaaatcatgatgaagattaataataccttccataacaggcgtagcagcatcttgaaaatataattgccaagacgtcgatgaatctaaaagaaaaaagtnnngcatcaaacaaaaaattttcaaaaataggatttgaacctatgactttttgattttcaatcaaacgctctaaccaactgagctacttcaacttttcagcaaggatttgaaccttgaatctttcgattaacagtcgaacgcttaaaccaattaagctattgaaatttttaccatgagctctttcgaactccacaaattaaacctaaactagcacgatttctaaagcttattcttgataaacgataacttttgaaaatagaatatcttttacctgttaaataacaggtgttttgattaataattagatttttaaagtcttttgttataattttttcttttaaaactttttttgaaaaccctgaatcaattaagagataaaatgataaacctaaaatttcattttttaaatacaaattaagctccttaaaatataattttttcatctttataaaactccattaaaacaccacaataaactaaaagtgattaaaacaaacgataacgaaatcggtaaaaaaaccttccaacatagacgcatcaactgatctatacgatacctaggaaacgaagcacgaactcaaataaaaaaaaataatataatagataacttaaaagctaaaataaaagaatctagaataaaaggttttgaaaaaatagatattcagcctccaataaatattattgttgtaagagaactcattaggatcatcgaactgtattcggctaaaaaaaataacgcaaaacccatacttgcgtattcaacattatatccgcttacaagttcgctttccgcttcgggtaaatcaaaaggagcacgattagtttcggctaaaatactaaccaaaaacataaaaaaaataggaaaaagaggaacaagaaaaaacaaaaattcttggaataaaattatactaaaaaaatttaaagaaccgacacaaacgagaacagtaaccaaaattaaaccaatagctacttcataactaaccatttgagcggcgcttcgtaaagagccgaaaaaagcgtatcgagaattgcttgatcaaccagaaaggattataccgtaaacgcccaaagaagaaacagcaaaaataaaaagtaaacttaaatcaacgtcaacataaaaaccagtaaaggaaagcggtattaacgctcagccgaataagcttaacaaaagagttaaaacaggggcaaaaacaaaactaaacgtatttgcgtttgttggaataacggtctctttaagaagaagttttaagccatcagctaaaggctgcaacaaacccaaaaaacctactacatttggaccttttcgttgctgcatcgaccccataacttttctttctgcgagcgtaagataagccacagagattaaaataggaacgataagaactaaaaaacatagtaaattttctaacaaaaacatcaaaaataaaagaattacaaaagttaaaggaatcgaacctttaatccttgaatttgaaattcaatattttaaccattaaactaaactttttgggatagtgtgagatttgaactcacgacgctttttgcgtttgaattttcaaaattcatgctttaaaccactcaaccaaccatctttttactttaagatcaaaaaaatttcaccgaaacttttgattaacgaaccttgagtcgaattagacttaaatattaatcctaagttacgagaattattatattttttcaaatttgctctaaaattaatagaggaaaataagcctaaattatttaaaggcttaacaattcgaatctctataaaaatcttactatttttatttaagaaatttaaaggaaattgttttataatgcaataacgtataaaaccttccttttttaacttttttaagaataaaaacgaaagaaatgaataatttataagaatttttttatttgtgttatttttgtaagaaagttttagtaacaattttcgtaggtgtttcattatttaaaaaatttttgcttatcgggagttgaacccaaatcaataacttcgtaaatt

SEQ ID NO: 103 - DNA, 4000 bp, Escherichia coli
  misc_feature (2973)..(2973): n is a, c, g, or t
  misc_feature (3012)..(3016): n is a, c, g, or t
  misc_feature (3022)..(3022): n is a, c, g, or t
  misc_feature (3028)..(3028): n is a, c, g, or t
  misc_feature (3030)..(3030): n is a, c, g, or t
  misc_feature (3039)..(3040): n is a, c, g, or t
  misc_feature (3042)..(3042): n is a, c, g, or t
  misc_feature (3044)..(3044): n is a, c, g, or t
  misc_feature (3046)..(3046): n is a, c, g, or t
  misc_feature (3054)..(3060): n is a, c, g, or t
  misc_feature (3062)..(3063): n is a, c, g, or t
  misc_feature (3066)..(3067): n is a, c, g, or t
  misc_feature (3071)..(3072): n is a, c, g, or t
  misc_feature (3076)..(3076): n is a, c, g, or t
  misc_feature (3078)..(3079): n is a, c, g, or t
  misc_feature (3084)..(3085): n is a, c, g, or t
  misc_feature (3091)..(3093): n is a, c, g, or t
  misc_feature (3096)..(3096): n is a, c, g, or t
  misc_feature (3100)..(3101): n is a, c, g, or t
  misc_feature (3103)..(3103): n is a, c, g, or t
  misc_feature (3108)..(3108): n is a, c, g, or t
  misc_feature (3113)..(3113): n is a, c, g, or t
  misc_feature (3116)..(3118): n is a, c, g, or t
  misc_feature (3120)..(3121): n is a, c, g, or t
  misc_feature (3123)..(3123): n is a, c, g, or t
  misc_feature (3125)..(3125): n is a, c, g, or t
  misc_feature (3127)..(3127): n is a, c, g, or t
  misc_feature (3129)..(3134): n is a, c, g, or t
  misc_feature (3137)..(3137): n is a, c, g, or t
  misc_feature (3139)..(3141): n is a, c, g, or t
  misc_feature (3146)..(3147): n is a, c, g, or t
  misc_feature (3149)..(3150): n is a, c, g, or t
  misc_feature (3152)..(3153): n is a, c, g, or t
  misc_feature (3157)..(3159): n is a, c, g, or t
  misc_feature (3161)..(3161): n is a, c, g, or t
  misc_feature (3163)..(3163): n is a, c, g, or t
  misc_feature (3167)..(3169): n is a, c, g, or t
  misc_feature (3171)..(3172): n is a, c, g, or t
  misc_feature (3176)..(3176): n is a, c, g, or t
  misc_feature (3178)..(3180): n is a, c, g, or t
  misc_feature (3185)..(3189): n is a, c, g, or t
  misc_feature (3191)..(3200): n is a, c, g, or t
  misc_feature (3202)..(3203): n is a, c, g, or t
  misc_feature (3205)..(3206): n is a, c, g, or t
  misc_feature (3208)..(3209): n is a, c, g, or t
  misc_feature (3213)..(3217): n is a, c, g, or t
  misc_feature (3220)..(3222): n is a, c, g, or t
  misc_feature (3224)..(3224): n is a, c, g, or t
  misc_feature (3226)..(3227): n is a, c, g, or t
  misc_feature (3229)..(3229): n is a, c, g, or t
  misc_feature (3233)..(3233): n is a, c, g, or t
  misc_feature (3235)..(3235): n is a, c, g, or t
  misc_feature (3238)..(3240): n is a, c, g, or t
  misc_feature (3243)..(3244): n is a, c, g, or t
  misc_feature (3246)..(3247): n is a, c, g, or t
  misc_feature (3249)..(3250): n is a, c, g, or t
  misc_feature (3252)..(3253): n is a, c, g, or t
  misc_feature (3255)..(3256): n is a, c, g, or t
  misc_feature (3261)..(3261): n is a, c, g, or t
  misc_feature (3266)..(3266): n is a, c, g, or t
  misc_feature (3268)..(3268): n is a, c, g, or t
  misc_feature (3271)..(3271): n is a, c, g, or t
  misc_feature (3274)..(3275): n is a, c, g, or t
  misc_feature (3277)..(3277): n is a, c, g, or t
  misc_feature (3280)..(3282): n is a, c, g, or t
  misc_feature (3286)..(3287): n is a, c, g, or t
  misc_feature (3289)..(3292): n is a, c, g, or t
  misc_feature (3294)..(3294): n is a, c, g, or t
  misc_feature (3296)..(3296): n is a, c, g, or t
  misc_feature (3298)..(3298): n is a, c, g, or t
  misc_feature (3302)..(3306): n is a, c, g, or t
  misc_feature (3308)..(3314): n is a, c, g, or t
  misc_feature (3318)..(3322): n is a, c, g, or t
  misc_feature (3327)..(3327): n is a, c, g, or t
  misc_feature (3329)..(3331): n is a, c, g, or t
  misc_feature (3333)..(3333): n is a, c, g, or t
  misc_feature (3335)..(3338): n is a, c, g, or t
  misc_feature (3340)..(3340): n is a, c, g, or t
  misc_feature (3342)..(3343): n is a, c, g, or t
  misc_feature (3347)..(3347): n is a, c, g, or t
  misc_feature (3350)..(3351): n is a, c, g, or t
  misc_feature (3353)..(3353): n is a, c, g, or t
  misc_feature (3355)..(3356): n is a, c, g, or t
  misc_feature (3361)..(3362): n is a, c, g, or t
  misc_feature (3364)..(3364): n is a, c, g, or t
  misc_feature (3366)..(3366): n is a, c, g, or t
  misc_feature (3368)..(3368): n is a, c, g, or t
  misc_feature (3373)..(3373): n is a, c, g, or t
  misc_feature (3375)..(3377): n is a, c, g, or t
  misc_feature (3379)..(3379): n is a, c, g, or t
  misc_feature (3382)..(3385): n is a, c, g, or t
  misc_feature (3387)..(3387): n is a, c, g, or t
  misc_feature (3390)..(3392): n is a, c, g, or t
  misc_feature (3396)..(3396): n is a, c, g, or t
  misc_feature (3400)..(3400): n is a, c, g, or t
  misc_feature (3402)..(3402): n is a, c, g, or t
  misc_feature (3406)..(3406): n is a, c, g, or t
  misc_feature (3408)..(3410): n is a, c, g, or t
  misc_feature (3413)..(3413): n is a, c, g, or t
  misc_feature (3416)..(3416): n is a, c, g, or t
  misc_feature (3419)..(3423): n is a, c, g, or t
  misc_feature (3425)..(3425): n is a, c, g, or t
  misc_feature (3428)..(3428): n is a, c, g, or t
  misc_feature (3430)..(3432): n is a, c, g, or t
  misc_feature (3435)..(3436): n is a, c, g, or t
  misc_feature (3438)..(3443): n is a, c, g, or t
  misc_feature (3445)..(3445): n is a, c, g, or t
  misc_feature (3449)..(3450): n is a, c, g, or t
  misc_feature (3452)..(3452): n is a, c, g, or t
  misc_feature (3455)..(3456): n is a, c, g, or t
  misc_feature (3458)..(3458): n is a, c, g, or t
  misc_feature (3461)..(3463): n is a, c, g, or t
  misc_feature (3466)..(3467): n is a, c, g, or t
  misc_feature (3469)..(3470): n is a, c, g, or t
  misc_feature (3472)..(3472): n is a, c, g, or t
  misc_feature (3474)..(3475): n is a, c, g, or t
  misc_feature (3477)..(3477): n is a, c, g, or t
  misc_feature (3480)..(3482): n is a, c, g, or t
  misc_feature (3485)..(3486): n is a, c, g, or t
  misc_feature (3490)..(3492): n is a, c, g, or t
  misc_feature (3494)..(3496): n is a, c, g, or t
  misc_feature (3499)..(3501): n is a, c, g, or t
  misc_feature (3503)..(3505): n is a, c, g, or t
  misc_feature (3508)..(3509): n is a, c, g, or t
  misc_feature (3511)..(3511): n is a, c, g, or t
  misc_feature (3514)..(3514): n is a, c, g, or t
  misc_feature (3516)..(3520): n is a, c, g, or t
  misc_feature (3522)..(3523): n is a, c, g, or t
  misc_feature (3529)..(3532): n is a, c, g, or t
  misc_feature (3534)..(3534): n is a, c, g, or t
  misc_feature (3536)..(3536): n is a, c, g, or t
  misc_feature (3540)..(3540): n is a, c, g, or t
  misc_feature (3542)..(3542): n is a, c, g, or t
  misc_feature (3545)..(3545): n is a, c, g, or t
  misc_feature (3547)..(3547): n is a, c, g, or t
  misc_feature (3549)..(3549): n is a, c, g, or t
  misc_feature (3553)..(3553): n is a, c, g, or t
  misc_feature (3591)..(3592): n is a, c, g, or t
  misc_feature (3595)..(3596): n is a, c, g, or t
  misc_feature (3599)..(3600): n is a, c, g, or t
  misc_feature (3603)..(3604): n is a, c, g, or t
  misc_feature (3607)..(3608): n is a, c, g, or t
  misc_feature (3611)..(3612): n is a, c, g, or t
  misc_feature (3615)..(3616): n is a, c, g, or t
  misc_feature (3619)..(3619): n is a, c, g, or t
  misc_feature (3623)..(3623): n is a, c, g, or t
  misc_feature (3627)..(3627): n is a, c, g, or t
  misc_feature (3631)..(3631): n is a, c, g, or t
  misc_feature (3633)..(3635): n is a, c, g, or t
  misc_feature (3637)..(3637): n is a, c, g, or t
  misc_feature (3639)..(3639): n is a, c, g, or t
  misc_feature (3641)..(3641): n is a, c, g, or t
  misc_feature (3643)..(3643): n is a, c, g, or t
  misc_feature (3645)..(3645): n is a, c, g, or t
  misc_feature (3647)..(3647): n is a, c, g, or t
  misc_feature (3649)..(3649): n is a, c, g, or t
  misc_feature (3651)..(3651): n is a, c, g, or t
  misc_feature (3654)..(3654): n is a, c, g, or t
  misc_feature (3657)..(3657): n is a, c, g, or t
  misc_feature (3659)..(3660): n is a, c, g, or t
  misc_feature (3662)..(3665): n is a, c, g, or t
  misc_feature (3668)..(3668): n is a, c, g, or t
  misc_feature (3671)..(3673): n is a, c, g, or t
  misc_feature (3677)..(3679): n is a, c, g, or t
  misc_feature (3683)..(3683): n is a, c, g, or t
  misc_feature (3685)..(3685): n is a, c, g, or t
  misc_feature (3689)..(3691): n is a, c, g, or t
  misc_feature (3694)..(3694): n is a, c, g, or t
  misc_feature (3696)..(3696): n is a, c, g, or t
  misc_feature (3698)..(3698): n is a, c, g, or t
  misc_feature (3700)..(3703): n is a, c, g, or t
  misc_feature (3705)..(3705): n is a, c, g, or t
  misc_feature (3707)..(3707): n is a, c, g, or t
  misc_feature (3709)..(3711): n is a, c, g, or t
  misc_feature (3713)..(3713): n is a, c, g, or t
  misc_feature (3715)..(3717): n is a, c, g, or t
  misc_feature (3720)..(3720): n is a, c, g, or t
  misc_feature (3722)..(3722): n is a, c, g, or t
  misc_feature (3730)..(3730): n is a, c, g, or t
  misc_feature (3732)..(3732): n is a, c, g, or t
  misc_feature (3734)..(3734): n is a, c, g, or t
  misc_feature (3736)..(3736): n is a, c, g, or t
  misc_feature (3738)..(3740): n is a, c, g, or t
  misc_feature (3744)..(3746): n is a, c, g, or t
  misc_feature (3750)..(3752): n is a, c, g, or t
  misc_feature (3756)..(3759): n is a, c, g, or t
  misc_feature (3766)..(3766): n is a, c, g, or t
  misc_feature (3770)..(3770): n is a, c, g, or t
  misc_feature (3772)..(3773): n is a, c, g, or t
  misc_feature (3775)..(3775): n is a, c, g, or t
  misc_feature (3778)..(3778): n is a, c, g, or t
  misc_feature (3780)..(3780): n is a, c, g, or t
  misc_feature (3786)..(3786): n is a, c, g, or t
  misc_feature (3788)..(3788): n is a, c, g, or t
  misc_feature (3794)..(3798): n is a, c, g, or t
  misc_feature (3800)..(3801): n is a, c, g, or t
  misc_feature (3805)..(3809): n is a, c, g, or t
  misc_feature (3811)..(3811): n is a, c, g, or t
  misc_feature (3813)..(3815): n is a, c, g, or t
  misc_feature (3819)..(3820): n is a, c, g, or t
  misc_feature (3823)..(3824): n is a, c, g, or t
  misc_feature (3826)..(3826): n is a, c, g, or t
  misc_feature (3828)..(3833): n is a, c, g, or t
  misc_feature (3838)..(3839): n is a, c, g, or t
  misc_feature (3841)..(3842): n is a, c, g, or t
  misc_feature (3844)..(3851): n is a, c, g, or t
  misc_feature (3853)..(3854): n is a, c, g, or t
  misc_feature (3856)..(3862): n is a, c, g, or t
  misc_feature (3864)..(3871): n is a, c, g, or t
  misc_feature (3873)..(3873): n is a, c, g, or t
  misc_feature (3875)..(3875): n is a, c, g, or t
  misc_feature (3878)..(3878): n is a, c, g, or t
  misc_feature (3880)..(3880): n is a, c, g, or t
  misc_feature (3883)..(3883): n is a, c, g, or t
  misc_feature (3887)..(3887): n is a, c, g, or t
  misc_feature (3890)..(3890): n is a, c, g, or t
  misc_feature (3899)..(3901): n is a, c, g, or t
  misc_feature (3903)..(3904): n is a, c, g, or t
  misc_feature (3906)..(3908): n is a, c, g, or t
  misc_feature (3910)..(3910): n is a, c, g, or t
  misc_feature (3912)..(3916): n is a, c, g, or t
  misc_feature (3919)..(3919): n is a, c, g, or t
  misc_feature (3921)..(3921): n is a, c, g, or t
  misc_feature (3923)..(3925): n is a, c, g, or t
  misc_feature (3927)..(3927): n is a, c, g, or t
  misc_feature (3929)..(3931): n is a, c, g, or t
  misc_feature (3935)..(3935): n is a, c, g, or t
  misc_feature (3938)..(3938): n is a, c, g, or t
  misc_feature (3941)..(3941): n is a, c, g, or t
  misc_feature (3943)..(3943): n is a, c, g, or t
  misc_feature (3945)..(3948): n is a, c, g, or t
  misc_feature (3950)..(3951): n is a, c, g, or t
  misc_feature (3953)..(3953): n is a, c, g, or t
  misc_feature (3955)..(3958): n is a, c, g, or t
  misc_feature (3960)..(3960): n is a, c, g, or t
  misc_feature (3962)..(3964): n is a, c, g, or t
  misc_feature (3969)..(3974): n is a, c, g, or t
  misc_feature (3977)..(3982): n is a, c, g, or t
  misc_feature (3985)..(3990): n is a, c, g, or t
  misc_feature (3992)..(3997): n is a, c, g, or t
  misc_feature (3999)..(4000): n is a, c, g, or t
tttgtcttttttattaattaaataaagtttatatttattatgaagaggaaaaaaatccacctttgaattaaaataatataatttatattttttcttaccaattattggtttaactttaccataggacaattgtaatactaatatatatataaagataatcaacagtaattgtaacataaataaattcgatatatttatatatatattttttttattaaaaatttttatttaatatatatattttcaatattaattattatttcatattgattatattctgacaaaatctttttaataagattacataataaaatattaatatatcttaattataaaaatttttaaaagtgtgatatttcaataacttttttttttaaaattttattcattattattcattattattcaattgtataatttttagaaattgttaaagaaaataaaaaaaataatttaattgttttagtatataataattagttttataaactaataaaaaaaaaagaaaagcagtttttttttttaatagattttaataaatatagttattcaaaatttagggatatgctttttttttcttttatttaaaaataatatataagtttatcagtttaattattcctttttaattataattataaatataattattattcaaacttaatgatactttttatatatatatatatagaaaaattatttaactgaattgatttaattattccgtttaagtttttataattataattattattttaatttataattataaagacatatttagaattataaaatataaagataaccaaataatatatattaataaaataattttaattataaaatatttgaatatttattataataatgatctaaaatatggtttatggttaagtcttataatataaaatgaatgattattattaatttgtattttgatattattaattttggattattaagtattaaaattgttatttcgaaaatacaatttcttttataattcatatatgttagtatgtacttattttataatattgaatatactattaatattattattatatatagtattataattatataatatcaaaatataatcattatttcaaagaatttcttttattcattattattacaatatattttaataaaattaaaaggtttagtaatactattactaataaatatttatattcaattaactttttagtagatatatatatttattattaaagttatttcaactataaaattttgaattttatagttgaaataacgatatgtaatatatttaaatattacatgtacttggatttcattttaaatattttttaaatattaaatttattattttggaaatatgatttcctctatttttataaaatatattattaaataattatttaatatatatgctattaatatctattaattatcaatatattatttcaaagaatttcttttaatcataattattactactatcataatatattaaaataaaattaaaaggtataataataataataataataataacaacaaaaacaatatttataataatgataaatatatgacaaaaattaataaattctgttaatttttttttataagatatattagctttaaattatatattaatagtattaatagtaatattaaatacatcataacatcaaagttatattttaataataaatgctaatatatcttgtgaattaatatattttaataatgtataaagtaatagatattataaggggtaaaaatcacatatgattttgtcttttatgtaagctttcccgtaatatgttccagttattaatattttattattcaataatgaaatatcataaaatatattgtataaaagaaaaagtttttttttattaataatttttaaaaaaattaaaatttctctaaattaaagttttttgaataatattattaataattgtttttttttttaaaaaaaaaaaaaaagatggttcttttttccaaaaaaagtttgaaattatagtaataataaaaataaactataatatattgtaatatataaaaatatatattatgatttaaatgtagattaaatttttaaacttttttattaatcatcagttttcttttttatatcatccatcaattttttataactaatttgtattttaaccttttttttcatctatagatggatattaaaatttaattaaattgtaataaaatttttaattagatggtgatggtttatttaaaaatatatatatatatataatattaataatattatatattttaattatttatttttcgtctttaaaaattttattaattaaaatagattgaaccattatatataatataatatattctactttatataatttaatttaaaaaattaaattaaatttattcttattcttattatttatttattcttatttttttaaaaaaaaactattaataaaatattcataatgaaaatttgaatagattttaagacaaacagattattaataatttgtcgaaagttttgctaaaataaatttataatagatgctaatataaaaagtatttcatattaaaaagaaaagattgtaaaaatttatatattaagcagtatttatttttaaatatttaaatatttgaaaacttttttttttttttttaattacattaattcattgtttttttttatagtaaagagaattatataatataatagaatttattaaattaaatacatatatattatttattaagatacacataatatatataatataataattatcaatttttcataaagatgtcacaaaaaaaagttaataataataatagtaataattgcattaataataataataataataagagtattaataataataataaatacttaaatatattgcggttaaattatatttattaaaaaacgcctccattttttttttttttttttttttttttttnatttttttttttttttttttttttttttttttttttttnnnnntttttntttttntnttttttttnntntntntttttatnnnnnnntnnttnnatanntttntnntttannatattnnnatnattnntntttanaattnatnnnanntntnanannnnnnttnannnttttnntnntnntcannntnanaatnnnannaatnannnaattnnnnntnnnnnnnnnntnntnntnntatnnnnnttnnntnanntntttntnaannnttnntnntnntnntnnatttntaatnanttnatnntnaannnattnntnnnntntnantttnnnnntnnnnnnntttnnnnnttatnannnantnnnntntnntttnttnntntnnatttnntntntnataantnnntntannnntnttnnntttnattntnattntnnnaanaantannnnntnaantnnnttnntnnnnnntntttnntnatnntnttnnnatnntnntntnntnaannntannattnnnannnttnnnannnttnntnttntnnnnntnnttattnnnntnanaaantnaanananaaanaaaaaaaaaaaaaaaaaaaaaaaaaaaaaaaaaaaaannaannaannaannaannaannaannaanaaanaaanaaanannnananananananananaantananntnnnnatnatnnnaatnnnaatnanaatnnnaanantnannnntntntnnntntnnnttnantttaaatntnantntnnntttnnntttnnntttnnnntttatanttananntnaanantaaaantnaaaatnnnnntnntttnnnnntntnnntttnnttnntntnnnnnnagtannannannnnnnnntnntnnnnnnngnnnnnnnntnanaananaanaatnatnattattatnnntnnannntnannnnnatntntnnntntnnntatntanatntnannnntnnanannnnanannnataannnnnnttnnnnnnaannnnnntnnnnnnann

SEQ ID NO: 104 - DNA, 4000 bp, Escherichia coli
  misc_feature (965)..(969): n is a, c, g, or t
  misc_feature (972)..(972): n is a, c, g, or t
  misc_feature (974)..(979): n is a, c, g, or t
  misc_feature (981)..(984): n is a, c, g, or t
  misc_feature (986)..(986): n is a, c, g, or t
  misc_feature (988)..(989): n is a, c, g, or t
  misc_feature (991)..(991): n is a, c, g, or t
  misc_feature (993)..(996): n is a, c, g, or t
  misc_feature (998)..(1007): n is a, c, g, or t
  misc_feature (1009)..(1016): n is a, c, g, or t
  misc_feature (1019)..(1020): n is a, c, g, or t
  misc_feature (1022)..(1028): n is a, c, g, or t
  misc_feature (1030)..(1035): n is a, c, g, or t
  misc_feature (1037)..(1042): n is a, c, g, or t
  misc_feature (1046)..(1047): n is a, c, g, or t
  misc_feature (1050)..(1057): n is a, c, g, or t
  misc_feature (1060)..(1066): n is a, c, g, or t
  misc_feature (1068)..(1069): n is a, c, g, or t
  misc_feature (1075)..(1076): n is a, c, g, or t
  misc_feature (1078)..(1080): n is a, c, g, or t
  misc_feature (1082)..(1082): n is a, c, g, or t
  misc_feature (1084)..(1087): n is a, c, g, or t
  misc_feature (1089)..(1100): n is a, c, g, or t
  misc_feature (1102)..(1119): n is a, c, g, or t
  misc_feature (1121)..(1124): n is a, c, g, or t
  misc_feature (1127)..(1127): n is a, c, g, or t
  misc_feature (1129)..(1131): n is a, c, g, or t
  misc_feature (1133)..(1133): n is a, c, g, or t
  misc_feature (1135)..(1135): n is a, c, g, or t
  misc_feature (1137)..(1140): n is a, c, g, or t
  misc_feature (1143)..(1144): n is a, c, g, or t
  misc_feature (1146)..(1152): n is a, c, g, or t
  misc_feature (1154)..(1161): n is a, c, g, or t
  misc_feature (1164)..(1171): n is a, c, g, or t
  misc_feature (1173)..(1176): n is a, c, g, or t
  misc_feature (1178)..(1178): n is a, c, g, or t
  misc_feature (1181)..(1184): n is a, c, g, or t
  misc_feature (1186)..(1187): n is a, c, g, or t
  misc_feature (1189)..(1191): n is a, c, g, or t
  misc_feature (1193)..(1197): n is a, c, g, or t
  misc_feature (1199)..(1200): n is a, c, g, or t
  misc_feature (1202)..(1202): n is a, c, g, or t
  misc_feature (1204)..(1204): n is a, c, g, or t
  misc_feature (1207)..(1213): n is a, c, g, or t
  misc_feature (1215)..(1215): n is a, c, g, or t
  misc_feature (1217)..(1220): n is a, c, g, or t
  misc_feature (1222)..(1226): n is a, c, g, or t
  misc_feature (1228)..(1228): n is a, c, g, or t
  misc_feature (1230)..(1234): n is a, c, g, or t
  misc_feature (1236)..(1237): n is a, c, g, or t
  misc_feature (1240)..(1241): n is a, c, g, or t
  misc_feature (1244)..(1250): n is a, c, g, or t
  misc_feature (1252)..(1254): n is a, c, g, or t
  misc_feature (1256)..(1259): n is a, c, g, or t
  misc_feature (1261)..(1276): n is a, c, g, or t
  misc_feature (1278)..(1280): n is a, c, g, or t
  misc_feature (1282)..(1285): n is a, c, g, or t
  misc_feature (1287)..(1294): n is a, c, g, or t
  misc_feature (1298)..(1298): n is a, c, g, or t
  misc_feature (1300)..(1304): n is a, c, g, or t
  misc_feature (1306)..(1307): n is a, c, g, or t
  misc_feature (1310)..(1311): n is a, c, g, or t
  misc_feature (1314)..(1315): n is a, c, g, or t
  misc_feature (1317)..(1320): n is a, c, g, or t
  misc_feature (1324)..(1328): n is a, c, g, or t
  misc_feature (1331)..(1331): n is a, c, g, or t
  misc_feature (1333)..(1334): n is a, c, g, or t
  misc_feature (1337)..(1338): n is a, c, g, or t
  misc_feature (1340)..(1340): n is a, c, g, or t
  misc_feature (1342)..(1342): n is a, c, g, or t
  misc_feature (1345)..(1346): n is a, c, g, or t
  misc_feature (1348)..(1348): n is a, c, g, or t
  misc_feature (1351)..(1351): n is a, c, g, or t
  misc_feature (1353)..(1353): n is a, c, g, or t
  misc_feature (1358)..(1359): n is a, c, g, or t
  misc_feature (1361)..(1361): n is a, c, g, or t
  misc_feature (1364)..(1364): n is a, c, g, or t
  misc_feature (1369)..(1371): n is a, c, g, or t
  misc_feature (1375)..(1375): n is a, c, g, or t
  misc_feature (1378)..(1378): n is a, c, g, or t
  misc_feature (1380)..(1380): n is a, c, g, or t
  misc_feature (1382)..(1382): n is a, c, g, or t
  misc_feature (1384)..(1386): n is a, c, g, or t
  misc_feature (1392)..(1394): n is a, c, g, or t
  misc_feature (1396)..(1396): n is a, c, g, or t
  misc_feature (1399)..(1399): n is a, c, g, or t
  misc_feature (1403)..(1405): n is a, c, g, or t
  misc_feature (1407)..(1407): n is a, c, g, or t
  misc_feature (1409)..(1409): n is a, c, g, or t
  misc_feature (1411)..(1415): n is a, c, g, or t
  misc_feature (1417)..(1417): n is a, c, g, or t
  misc_feature (1419)..(1419): n is a, c, g, or t
  misc_feature (1421)..(1423): n is a, c, g, or t
  misc_feature (1428)..(1428): n is a, c, g, or t
  misc_feature (1432)..(1436): n is a, c, g, or t
  misc_feature (1481)..(1481): n is a, c, g, or t
  misc_feature (1484)..(1484): n is a, c, g, or t
  misc_feature (1487)..(1488): n is a, c, g, or t
  misc_feature (1514)..(1517): n is a, c, g, or t
  misc_feature (1522)..(1523): n is a, c, g, or t
  misc_feature (1529)..(1529): n is a, c, g, or t
  misc_feature (1532)..(1533): n is a, c, g, or t
  misc_feature (1535)..(1535): n is a, c, g, or t
  misc_feature (1537)..(1538): n is a, c, g, or t
  misc_feature (1540)..(1542): n is a, c, g, or t
  misc_feature (1544)..(1544): n is a, c, g, or t
  misc_feature (1546)..(1547): n is a, c, g, or t
  misc_feature (1550)..(1553): n is a, c, g, or t
  misc_feature (1596)..(1596): n is a, c, g, or t
  misc_feature (1599)..(1599): n is a, c, g, or t
  misc_feature (1605)..(1605): n is a, c, g, or t
  misc_feature (1610)..(1610): n is a, c, g, or t
  misc_feature (1613)..(1613): n is a, c, g, or t
  misc_feature (1620)..(1620): n is a, c, g, or t
  misc_feature (1664)..(1665): n is a, c, g, or t
  misc_feature (1671)..(1672): n is a, c, g, or t
  misc_feature (1675)..(1675): n is a, c, g, or t
  misc_feature (1677)..(1677): n is a, c, g, or t
  misc_feature (1681)..(1681): n is a, c, g, or t
  misc_feature (1684)..(1684): n is a, c, g, or t
  misc_feature (1686)..(1686): n is a, c, g, or t
  misc_feature (1729)..(1730): n is a, c, g, or t
  misc_feature (1732)..(1732): n is a, c, g, or t
  misc_feature (1735)..(1737): n is a, c, g, or t
  misc_feature (1739)..(1740): n is a, c, g, or t
  misc_feature (1745)..(1746): n is a, c, g, or t
  misc_feature (1748)..(1748): n is a, c, g, or t
  misc_feature (1750)..(1753): n is a, c, g, or t
  misc_feature (1791)..(1793): n is a, c, g, or t
  misc_feature (1795)..(1795): n is a, c, g, or t
  misc_feature (1797)..(1802): n is a, c, g, or t
  misc_feature (1805)..(1805): n is a, c, g, or t
  misc_feature (1807)..(1809): n is a, c, g, or t
  misc_feature (1811)..(1812): n is a, c, g, or t
  misc_feature (1814)..(1817): n is a, c, g, or t
  misc_feature (1856)..(1862): n is a, c, g, or t
  misc_feature (1864)..(1865): n is a, c, g, or t
  misc_feature (1867)..(1867): n is a, c, g, or t
  misc_feature (1869)..(1871): n is a, c, g, or t
  misc_feature (1873)..(1885): n is a, c, g, or t
  misc_feature (1922)..(1923): n is a, c, g, or t
  misc_feature (1925)..(1926): n is a, c, g, or t
  misc_feature (1928)..(1929): n is a, c, g, or t
  misc_feature (1931)..(1935): n is a, c, g, or t
  misc_feature (1937)..(1939): n is a, c, g, or t
  misc_feature (1942)..(1944): n is a, c, g, or t
  misc_feature (1946)..(1947): n is a, c, g, or t
  misc_feature (1949)..(1949): n is a, c, g, or t
  misc_feature (1988)..(1989): n is a, c, g, or t
  misc_feature (1991)..(1993): n is a, c, g, or t
  misc_feature (1996)..(1999): n is a, c, g, or t
  misc_feature (2001)..(2003): n is a, c, g, or t
  misc_feature (2005)..(2005): n is a, c, g, or t
  misc_feature (2007)..(2016): n is a, c, g, or t
tggctacatgtcccttgccgctacactcacaacggataacgttgccaacaccgtgggtacattgatgcatggccccacttttatggccaatccactggcatgcgccgttgccaatgccagtatcgaattattattgagctcggcttggcaagacaacattgctcgtattgaaacaacgtttcatgctgaactggcatcgcttaagcaaaataataaagtcaaagatgttcgtattttaggcgccattgccgtggttgaattgcatgacgatattggggtagaatggacacaagagcgcttgattgagcttggtgtttggctaagaccttacggtaagctactctacaccatgccaccgtttacgattaaagagaatgaactgttaacaatcaccaatgcaatgaagatcatcgtggaagagacatgaaaactataatcctagcattaagtctgttgtcatttttttctcaagcagctaactatgcagaagttggtgttgaggtggaatctaaaagattgaatggaaatgcgtactacattccaggcatatctggctcagccactgaatatgagggttttatttctaatgctggttttattgtaacaactgaaggcgtggtggtatttgatggtttgggttcaccacctttggccaatgccatgctgtcagagattagaaaagttaccgataaaccaatcaagctcgtgattgtgagccattatcatgccgatcacatttatggtctgcaagtttttaaagcacaaggtgcgaaaatctgggcgcctaaaggcgtttgggattaccttgattctgaaactgcagaaaccttgctaaaatctcgacgtgacacattgtttccttgggtaaacgatgaaacctatctggttgaacctgaccggattattgataaagacacccaatttagtctgggcgagcataaatttttaatcagctattttggaannnnncantnnnnnngnnnnangnnantnnnnannnnnnnnnntnnnnnnnnttnnannnnnnncnnnnnntnnnnnnggcnnatnnnnnnnntgnnnnnnncnnatattnntnnntngnnnnannnnnnnnnnnntnnnnnnnnnnnnnnnnnngnnnnttntnnncnangnnnnggnngnnnnnnngnnnnnnnnaannnnnnnntnnnntngannnntnntnnncnnnnntnntnantannnnnnntngnnnnannnnntnannnnntnnatnngtnnnnnnngnnntnnnntnnnnnnnnnnnnnnnnannntnnnnannnnnnnncgtncnnnnngnntanncgnnannnngttnnnnncgnannttnnantnttnnangantnattgnntnatngtttnnntttntgnantngnnngtcatnnntntanatannncngnannnnntntnannnaattngtgnnnnntgtttaggcgatagtcggttacaatccagcttatgccactatatntanatnngagttgtgatttgcgtttaggcgatnnnnggttnnaatagnaannananntnnnanannaannnnatagttgtgatttgcgtttaggcgatagtcggttacaatatanatnacttgnatacnccnaaacaanagttgtgatttgcgtttaggcgatagtcggttacaatgaacgtnnaataannganangctngangntgttgtgatttgcgtttaggcgatagtcggttacaatttatannanaannntnnaatannantnnnngttgtgatttgcgtttaggcgatagtcggttacaattnnnanannnnnnatnannncnnannnntagttgtgatttgcgtttaggcgatagtcggttacaatnnnnnnntnnantnnnannnnnnnnnnnnngttgtgatttgcgtttaggcgatagtcggttacaatnnannanntnnnnntnnntcnnntnntnttgttgtgatttgcgtttaggcgatagtcggttacaatnnannnaannnnannnanannnnnnnnnnagttgtgatttgcgtttaggcgatagtcggttacaatatgctcgctacaaacgctgtaccataggcgcaactttcattttttctagtcagaaaaatgaaagttgcgccggtacggtttcgatgggtcggcgtttttttccgtaaaaaacctcgatacgtccaaattgcttatcggtaattttgataattcttacctcgccatcaggcggtaggtggagtttgattctacgcgcgtgtacttgggcgttttcttcactactggagtggcgcatatacactgagtattgcatcatcctaaaaccatcctcaagcaaaaacttgcgaaaatgtgtgtaatctttacgcatccatttatcatcggttggtaaatcaaacagtacaattacccacatggtttgtaagcctccaaacataagtaatcccaatgttcaaaagctttatattacgctcgtaatatggggtatgtcaatgttgagcattctttagtaaagttacgctttagatttgccattagataatgcattgataccatcattggcatttgctttttatcatagcgcacattgtggctaatcaggtttaaaaacggagttttactctcaatggtaatagcaatgttggggttggcttgatacagctcataagcaatactatccacccaagggcgtaacggttccatcaggtcatctgccaagcacagagcattgtattgattgtgatgaaacaagcctattgcagggtgcaaaccactagcgcaaatattacgcgccaccatagcacggatgattgaatagccataattaagtatggcgttaatgccatcggcattttgatcacgaataaaatccaccccaaataaagccttccaataatactgagccgccaagccctcacaattagtactgtcgcctgatttaacttcggtggctaatttatgtaatcgagtataaggcttgttaaattgtttaagcgtatcagcttgattgttaatcttttgaatgataacttgcttccacagtcttttgcgtataggttcagagatattaatttgttgtttgaggattttttggtgcagggtattgccctcagcaatcggcaaaatagtggaatagggcaggtgtttttcatcacaaaaaataatcgctacattatgcttttggcattcaataatcaacggctgggtgatgctaatagcgctatgttctaaaattaaagcgccaatatcctcaatcgggacttgtgccactaattcatgatcttgatcaattaataattgcttgtgtttaaggtgtaaataactcggattactaacctcaacaatgcgtttaatcatgttcgataaaatgaccgatagtgtttatatcgtgttttacgattttatatttatcaaagttatctttactgataccaatataaatttcctcatctttattttttagtgttgatgctatgccaagacgcaagacaaaacgttttgcgcccgtatctattttttgcactcgataaaatacgcgctcgccatctccttgttcgatactcacggtatcgttgatatgcagtgccatgacaaattcccaatcttgcccatagtcagttttaataatggcttgtttgggtatgttaatacccttagcgcggtgcgaggcgagcatggtggttacaaactcgcctttaactttacctgttttgctatttttgatgatttcaacgtggtgggtgttgccatacgacatgtatttaaaaattttgccagttttatcacgcacgccaaatttggtttgggcgagtttcttttcgttggttttggattgtaatacacgcacacgcttaatggggtttttaccaagtttgagtaaagctaaatgttcagcattaaaagcctctttagggtttggatagttttcaaaatgctctaaaactttagttttaacagcttcatcaacaatgcttagggcatttttaagagtgaactctgggcttaggg

SEQ ID NO: 105 - DNA, 4000 bp, Escherichia coli
aaaagatctggctttgtttgttcgtattgctaaaatagaacgtccgaaaaacatcgatgacattccgatctgggtgatgattcctgcttttgtaattagtgaacttaaagtcgcatttcaaatcggatttttattatatgtcccgtttctggtgattgacatggttgtagcgtcaatcctgatggcaatgggtatgatgatgatgccgccggtgatgatttcattaccttttaaactgatgctctttgtacttgttgacggctggcacttgattcttggttcaatggtcaaaagttttgtagatttctaactctctttaatcattttaattacgagaaatttatgacagaagcgcttgtagtctcaatcatgattgaagccatgcggatggctaccctgcttgcggcacctatgctgattggcgcacttgttgtgggtttactggtttcaattttccaagcggttactcagatccaggagcagacattggctatcattcctaaaatgggtgcaatgatggctgttttagcattccttttcccttggttcctctcacaggcaacgacctacatgtccggcattttcactaacatccctcgctatattggcggataaaagccaatagataaacctactcttagttcattgagcaagatccaaaaaattcatctcaagtaatttctggctagaccatcctcttccgatattggataatggtgttcagactgtggaacaattccaaaaccgcagaaataaaattaatactattcctaaactgcaataattaaataaaaataattaaaaaaaactatgagtaaatctcctgatcctgaattagaaaccgatgatgatcctcaagaggaagtaatagaaatagatggagacagtttagagacaatcactgaagaaaaagcactcgtcatcagtgaagatgtttttccggattcactgctcatcgtaccactctatgatcgtccgcttttcccaaaaatgctgctgccggttatcatttctgatgaaaaactggaaaaagtattagaggatgaattaaaaggacctttgaaatatgtcggtctggtttacagttatgaacctgatgggccgaatgtcgagactgaagcagaaaatgttccggacaacctggcaaatataggagcagttggcaggatagtacaggcatcaaagcatggtaatgatccgatgcatataatagtgcaggtcatggagcgctttgaaattcttgaaataattgccgaagatcctgtctacagagcaaaagttgaatatctacagggtacagacgatcaaaaatctgagtatgaattaaaagccttttccgtttctattatcaattttattaaagaattggttcagctgaatccattgttcaaggaagagttaggtctgttgatggggcgcattaacctcaaagatcctgcaacacttgctgactttgcggcatccatgacaactgcatccggaaaggagttgcaggaaatattggaaacaatgagcatcaaggaacgtattgaaaaagccttaaatttgctgaggcatgaactcgaagttgcaaaacttcaggtaaaaatatcccagcgtgtagaagatcggatgtctcaacagcagcgtgaattttttctgcgtgaacaactaaaggaaattaaaaaagagttaggtatcaccaaagaaggttcagaaagtgagaccgagaaatatgaagcacgcataaagaaactaaaacttactgaagagggcaaagagcgtattgaagaagaattggagaaaatgcgtttaatcgaaccttcatcgccagaatatcatgttactcgaacttatctggactggctgacaattttaccgtggggtatttacagtaaagatgtctttaatatccagcgtgcagcaagaattctaaatcgtgaccactatggtttaaaagatgtcaaagatcggatcctcgaactgatctctgtgggcatcataaacggagacctcgcaggatcaattgttttgctggttggtcctcctggaacaggaaaaacatctgtggggcagtcaattgccagagcaataggacgtaaattttaccgtttttctctaggcggtatgcgtgatgaagcggaaataaaagggcatcggcgtacatatattggggcactcccaggaaaatttataaatgcgatgaaaacctgtaaaacggcaaatccagtaatcatgctggatgaaatagacaaaattggcgcaagttttcaaggagaccctgcatctgcattgctggaagtattagaccctgaacagaacaaagatttccttgatcattatcttgatgtacgctttgatctttcaaaagtactttttatttgtactgcaaaccaaacagacacgatcccacctgccttgctcgaccggatggaagtcatccggctttcaggttatatcctggaagagaaactgcaaattgcacgtaaacatcttttaccaaaacaacttaaaatacatggactcaagaagtcacagttttctctgccgaaagttgttctacgtgaaataattgatggttatgccagagaagcaggtgtaagaagtctggaaaacaatcttaaaaaaataatgagaaaatctgcacgtaagattgtagaggaagaaattgaaaatgttaagattactaaagatgatctgcctgaaatgttgggacgcaagactttcgcagaagaaacacgttacaaaaaacctaaagttggagtcataactggtctcgcatatacaagtgtcggcggagcaactttgttcatagaagcatcttttgtggaagctaagaatccgggattcaagcagacaggccaacttggtgatgtgatgatagaatcaactgaaattgcttacacatatatccgttcaaaaggcagtagtgatgcaagaattaaaaaattctttgcagaaaactttgtccacatgcacgtaccggcaggagctactcctaaagatggaccttctgcgggtattacaatggcttgcgcacttcactcactggttgcaaatgaagcaattattcctaatattgccatgactggagagttaactcttactggtttggttatgcctattggtggagtaaaagaaaaaacaattgctgccagacgtaccggtatttctcaattaatttttcctgcagaaaatcaaaaagattttgaggatttggatgagataataactagaggcatcaaaccgcattttgtgaaaacatttgaagatgtactgcctatttgctttccaaatttaaaaggaacaagtaaaaagaaaccggcaaaaaaataaatcgacattacatgcaatccatttttaacaatcctgaaattatttcactgttgggtttgctgtttgtttcaggtgcatttgcgggtttgttagcaggtcttttcggcgtcggcggtggaatcattttagtgccggccttactctatgcctttgatgaactgggttattcagctgaagtcactgcacacatggcagttgggacatcactggcgattatcgtacccacctcaatcacctccgcctggtcccattacaaacgtggttcaggcaacattattttattccgcaaacttgcaattccggtgatgttcggcgcgctgcttggttcatggcttggtggtagtttgagtggagatacactcaaagcggttttcgccacgctgacaatgttgattgcactaaatttattacggaaaaaccatttcgtacttgctaaagaattacctgcagcttcaaagcagtggagtgcagcaggtctgatcggtctgctttcagcaataatgggaatcggcggaggtgtctttttcacttcttactttactgcttacagtttgcctatgctgagcgcagttggaacatcagcaagtttaggtttgatgatttcactaccaggagcaatcggttatattttcagcggttggtacaatccaaatcttcctcaattaagcttcggatattttaattt

SEQ ID NO: 106 - DNA, 4000 bp, Escherichia coli
  misc_feature (1)..(1): n is a, c, g, or t
  misc_feature (4)..(5): n is a, c, g, or t
  misc_feature (7)..(8): n is a, c, g, or t
  misc_feature (10)..(14): n is a, c, g, or t
  misc_feature (19)..(19): n is a, c, g, or t
  misc_feature (22)..(24): n is a, c, g, or t
  misc_feature (27)..(27): n is a, c, g, or t
  misc_feature (29)..(29): n is a, c, g, or t
  misc_feature (32)..(34): n is a, c, g, or t
  misc_feature (37)..(47): n is a, c, g, or t
  misc_feature (49)..(52): n is a, c, g, or t
  misc_feature (55)..(56): n is a, c, g, or t
  misc_feature (58)..(58): n is a, c, g, or t
  misc_feature (60)..(61): n is a, c, g, or t
  misc_feature (63)..(66): n is a, c, g, or t
  misc_feature (68)..(73): n is a, c, g, or t
  misc_feature (75)..(77): n is a, c, g, or t
  misc_feature (79)..(81): n is a, c, g, or t
  misc_feature (84)..(85): n is a, c, g, or t
  misc_feature (87)..(87): n is a, c, g, or t
  misc_feature (90)..(92): n is a, c, g, or t
  misc_feature (95)..(95): n is a, c, g, or t
  misc_feature (97)..(101): n is a, c, g, or t
  misc_feature (103)..(105): n is a, c, g, or t
  misc_feature (108)..(109): n is a, c, g, or t
  misc_feature (112)..(115): n is a, c, g, or t
  misc_feature (117)..(118): n is a, c, g, or t
  misc_feature (120)..(124): n is a, c, g, or t
  misc_feature (126)..(131): n is a, c, g, or t
  misc_feature (133)..(135): n is a, c, g, or t
  misc_feature (138)..(139): n is a, c, g, or t
  misc_feature (141)..(142): n is a, c, g, or t
  misc_feature (145)..(146): n is a, c, g, or t
  misc_feature (148)..(148): n is a, c, g, or t
  misc_feature (150)..(152): n is a, c, g, or t
  misc_feature (156)..(157): n is a, c, g, or t
  misc_feature (159)..(159): n is a, c, g, or t
  misc_feature (163)..(163): n is a, c, g, or t
  misc_feature (165)..(170): n is a, c, g, or t
  misc_feature (173)..(175): n is a, c, g, or t
  misc_feature (177)..(177): n is a, c, g, or t
  misc_feature (180)..(184): n is a, c, g, or t
  misc_feature (186)..(186): n is a, c, g, or t
  misc_feature (188)..(194): n is a, c, g, or t
  misc_feature (196)..(196): n is a, c, g, or t
  misc_feature (198)..(203): n is a, c, g, or t
  misc_feature (205)..(206): n is a, c, g, or t
  misc_feature (208)..(209): n is a, c, g, or t
  misc_feature (213)..(218): n is a, c, g, or t
  misc_feature (220)..(229): n is a, c, g, or t
  misc_feature (232)..(235): n is a, c, g, or t
  misc_feature (237)..(238): n is a, c, g, or t
  misc_feature (241)..(242): n is a, c, g, or t
  misc_feature (244)..(248): n is a, c, g, or t
  misc_feature (251)..(253): n is a, c, g, or t
  misc_feature (255)..(258): n is a, c, g, or t
  misc_feature (260)..(260): n is a, c, g, or t
  misc_feature (262)..(264): n is a, c, g, or t
  misc_feature (266)..(271): n is a, c, g, or t
  misc_feature (274)..(278): n is a, c, g, or t
  misc_feature (280)..(285): n is a, c, g, or t
  misc_feature (289)..(292): n is a, c, g, or t
  misc_feature (294)..(300): n is a, c, g, or t
  misc_feature (302)..(302): n is a, c, g, or t
  misc_feature (305)..(307): n is a, c, g, or t
  misc_feature (309)..(309): n is a, c, g, or t
  misc_feature (311)..(316): n is a, c, g, or t
  misc_feature (318)..(322): n is a, c, g, or t
  misc_feature (325)..(325): n is a, c, g, or t
  misc_feature (328)..(331): n is a, c, g, or t
  misc_feature (334)..(335): n is a, c, g, or t
  misc_feature (337)..(341): n is a, c, g, or t
  misc_feature (345)..(346): n is a, c, g, or t
  misc_feature (350)..(351): n is a, c, g, or t
  misc_feature (354)..(354): n is a, c, g, or t
  misc_feature (356)..(359): n is a, c, g, or t
  misc_feature (361)..(361): n is a, c, g, or t
  misc_feature (363)..(363): n is a, c, g, or t
  misc_feature (365)..(367): n is a, c, g, or t
  misc_feature (369)..(371): n is a, c, g, or t
  misc_feature (374)..(377): n is a, c, g, or t
  misc_feature (382)..(386): n is a, c, g, or t
  misc_feature (388)..(390): n is a, c, g, or t
  misc_feature (392)..(392): n is a, c, g, or t
  misc_feature (394)..(394): n is a, c, g, or t
  misc_feature (397)..(398): n is a, c, g, or t
  misc_feature (400)..(401): n is a, c, g, or t
  misc_feature (403)..(408): n is a, c, g, or t
  misc_feature (410)..(410): n is a, c, g, or t
  misc_feature (412)..(412): n is a, c, g, or t
  misc_feature (414)..(415): n is a, c, g, or t
  misc_feature (417)..(418): n is a, c, g, or t
  misc_feature (420)..(427): n is a, c, g, or t
  misc_feature (429)..(429): n is a, c, g, or t
  misc_feature (431)..(431): n is a, c, g, or t
  misc_feature (433)..(435): n is a, c, g, or t
  misc_feature (438)..(441): n is a, c, g, or t
  misc_feature (444)..(446): n is a, c, g, or t
  misc_feature (526)..(526): n is a, c, g, or t
  misc_feature (528)..(528): n is a, c, g, or t
  misc_feature (543)..(543): n is a, c, g, or t
  misc_feature (546)..(546): n is a, c, g, or t
  misc_feature (549)..(549): n is a, c, g, or t
  misc_feature (552)..(552): n is a, c, g, or t
  misc_feature (579)..(579): n is a, c, g, or t
  misc_feature (604)..(604): n is a, c, g, or t
  misc_feature (664)..(664): n is a, c, g, or t
  misc_feature (738)..(738): n is a, c, g, or t
  misc_feature (747)..(747): n is a, c, g, or t
  misc_feature (945)..(945): n is a, c, g, or t
  misc_feature (948)..(948): n is a, c, g, or t
  misc_feature (967)..(967): n is a, c, g, or t
  misc_feature (993)..(993): n is a, c, g, or t
  misc_feature (1035)..(1035): n is a, c, g, or t
  misc_feature (1044)..(1044): n is a, c, g, or t
  misc_feature (1071)..(1071): n is a, c, g, or t
  misc_feature (1101)..(1101): n is a, c, g, or t
  misc_feature (1122)..(1122): n is a, c, g, or t
  misc_feature (1143)..(1143): n is a, c, g, or t
  misc_feature (1341)..(1341): n is a, c, g, or t
  misc_feature (1350)..(1350): n is a, c, g, or t
  misc_feature (1353)..(1353): n is a, c, g, or t
  misc_feature (1399)..(1399): n is a, c, g, or t
  misc_feature (1456)..(1456): n is a, c, g, or t
  misc_feature (1765)..(1765): n is a, c, g, or t
  misc_feature (1973)..(1973): n is a, c, g, or t
  misc_feature (1975)..(1976): n is a, c, g, or t
  misc_feature (1978)..(1981): n is a, c, g, or t
  misc_feature (1984)..(1984): n is a, c, g, or t
  misc_feature (1986)..(1986): n is a, c, g, or t
  misc_feature (1989)..(1990): n is a, c, g, or t
  misc_feature (1996)..(1996): n is a, c, g, or t
  misc_feature (2049)..(2049): n is a, c, g, or t
  misc_feature (2055)..(2056): n is a, c, g, or t
  misc_feature (2060)..(2062): n is a, c, g, or t
  misc_feature (2066)..(2066): n is a, c, g, or t
  misc_feature (2070)..(2072): n is a, c, g, or t
  misc_feature (2074)..(2074): n is a, c, g, or t
  misc_feature (2126)..(2126): n is a, c, g, or t
  misc_feature (2132)..(2132): n is a, c, g, or t
  misc_feature (2134)..(2134): n is a, c, g, or t
  misc_feature (2138)..(2142): n is a, c, g, or t
  misc_feature (2145)..(2147): n is a, c, g, or t
  misc_feature (2153)..(2154): n is a, c, g, or t
  misc_feature (2202)..(2202): n is a, c, g, or t
  misc_feature (2211)..(2211): n is a, c, g, or t
  misc_feature (2213)..(2213): n is a, c, g, or t
  misc_feature (2216)..(2216): n is a, c, g, or t
  misc_feature (2220)..(2220): n is a, c, g, or t
  misc_feature (2227)..(2228): n is a, c, g, or t
  misc_feature (2278)..(2278): n is a, c, g, or t
  misc_feature (2281)..(2282): n is a, c, g, or t
  misc_feature (2291)..(2291): n is a, c, g, or t
  misc_feature (2294)..(2295): n is a, c, g, or t
  misc_feature (2301)..(2301): n is a, c, g, or t
  misc_feature (2304)..(2304): n is a, c, g, or t
  misc_feature (2355)..(2355): n is a, c, g, or t
  misc_feature (2357)..(2357): n is a, c, g, or t
  misc_feature (2362)..(2362): n is a, c, g, or t
  misc_feature (2372)..(2372): n is a, c, g, or t
  misc_feature (2377)..(2378): n is a, c, g, or t
  misc_feature (2381)..(2381): n is a, c, g, or t
nttnntnnannnnnaaaanggnnnaancnttnnnttnnnnnnnnnnnannnnaannangnnannnntnnnnnnannncnnnccnntnaannnagntnnnnnannnttnnaannnngnntnnnnncnnnnnnannnttnnannaannangnnnaaanntnaaantnnnnnnttnnncnaannnnntngnnnnnnntncnnnnnnannannaaannnnnncnnnnnnnnnnaannnnannaannannnnnttnnnannnngntnnntnnnnnnggnnnnnannnnnntttnnnncnnnnnnngnttnnnangnnnnnntnnnnnaanttnnnnttnnannnnnaaannaaannggnannnncntnannngnnnaannnntaaannnnntnnntngnaanntnnannnnnncngntnngnnannnnnnnnangntnnnaannnnaannnattgcctatgataaagaaaactctatgcttcagcaatccaatctacttaagtttgcgaaatgcacaattagttctgcatntncctgaagtagaaagnaanaanacnttgcctgaagctataaaaaaagaagcngagcgcaccatcccgatagaagatntcggggtggtaatcctcgacaataggcgtattaccataacttctggggtaatggaggctntacttgagaacaactgcgcagtcatcacttgcaatcaaaagagtatgccagtagggttacttctgccactatgnggtaacacnacacaaaacgaacgtttccgctctcagatagacgcctccttacctttacggaaacagctttggcaacagacaataaaacaaaagattcttaatcaagagtatgtgctacggacaaatacagataaggaaaccaattgtatgcgtgtatggtctaatgatgtacgtagtggagaccctgataaccttgaagcaagagcngcngcctattattggaaaaacntctttataaattatccaaactttgtnagagacagagaaggaacccctcctaataatctcttaaactanggctatgcnattcttcgtgccataatcgctcgagcnttagtaggaagtggattgctaccaaccttnggaatccatcatcataatagntataacgcctattgtcttgcngatgatattatggaaccctatcgcccttatgtcgatcaattagtgttagatatcattcaatgcaactcagaaatatctgatatcacacgagatttgaaaatgcaacttctcggtattccaatgttagatgtagtgataaatggcaaacgcagtcctttaatgattgctgcccaacaaactacagcctcgcttgcaagntgttttgcnggngaaaacaaacgcattagttacccagaaatgtaaaagtagtatgacnggctttgagcgcttcagtgagtaccgaattatgtggattcttgtattctttgatctnccaacggaaacaaagaaggagaaaaaagcctatagtgatttccggaaatcccttatcaaggatgggttcactatgttccagttttccatctatgtacgccattgcgcaagtatggaaaatgcagaggtacatataaaacgagttcgaaccatgttaccaaagttaggaaaagtcggaatactctgtataacagataaacaatttgcaaacattcaactctactatggcgaaaaagaacaaactcctaacgcacctggacaacaattagaacttttttgaactttataccctaacaattaaaaacaagcnttcaatatcctctcaaccaacttaaaacttatccttctcagcatagtcattaaagtaaaaaatcccattctaaacgaatgggatttcactttgttgtatcaaattattttcgaataacaaacttatatcttgttgttagccaataaattaaacaacatcagttgttttagataccacaaaggtacagattttcaagcaaatcacaacnanntnnnncangntcnntatctnacaccgttgttttagataccacaaaggtacagattttcaagcaaatcacaacngcgtgnngatnnntatnaacnnnantttcgttgttttagataccacaaaggtacagattttcaagcaaatcacaacngtgtancncctnnnnnaannnatcttnngttgttttagataccacaaaggtacagattttcaagcaaatcacaacntactagtgnantantaantcagttnnaagttgttttagataccacaaaggtacagattttcaagcaaatcacaacntanntcttagttnttnncatgtngtnctagttgttttagataccacaaaggtacagattttcaagcaaatcacaacnantcgtntatgtgttantgccnnctntgagttgttttagataccacaaaggtacagattttcaagcaaatcacaaccaaaatcgcatatacatttataatcaatctgttgttttagataccacaaaggtacagattttcaagcaaatcacaacaagaattgactggaacaaaggctacattaagttgttttagataccacaaaggtacagattttcaagcaaatcacaactgcaattatgtgcgccttcagaagcaacatgttgttttagataccacaaaggtacagattttcaagcaaatcacaacttatggtctaaatatccagatattgagtcgttgttttagataccacaaaggtacagattttcaagcaaatcacaacggttacaaggttgcctatctgctgcaatgtgttgttttagataccacaaaggtacagattttcaagcaaatcacaaccgttgctatcaaatgtaacgtcactaaattgttgttttagataccacaaaggtacagattttcaagcaaatcacaacacccaacatacgaggacgacggcaagggcggttgttttagataccacaaaggtacagattttcaagcaaatcacaacctatggaagaaatatcccgatattgagtcgttgttttagataccacaaaggtacagattttcaagcaaatcacaactaatcgctacttcaaggagcacactggaacgttgttttagataccacaaaggtacagattttcaagcaaatcacaacatctttttttgttttagttttctttttagagttgttttagataccacaaaggtacagattttcaagcaaatcacaaccatgacaccattactccatatcttttcagagttgttttagataccacaaaggtacagattttcaagcaaatcacaacgggtgagaggaagaataactctcacccgtagttgttttagataccacaaaggtacagattttcaagcaaatcacaaccgctgaaaccttccaaagaaagaacctcttgttgttttagataccacaaaggtacagattttcaagcaaatcacaactggtgctgtgttagatgccccagctcttgagttgttttagataccacaaaggtacagattttcaagcaaatcacaaccacatatggtgcggataccccgcaccatatgttgttttagataccacaaaggtacagattttcaagcaaatcacaactgatgtctccttcaacatcttgcgttccatgttgttttagataccacaaaggtacagattttcaagcaaatcacaacataatttgtattataataattattttattgttgttttagataccacaaaggtacagattttcaagcaaatcacaactgatataatcattactaccaatttcatctggttgttttagataccacaaaggtacagattttcaagcaaatcacaaccagtaagtcacaacgcaagaagaacataagttgttttagataccacaaaggtacagattttcaagcaaatcacaacagatattgttcatgttctcatcggtgtaggttgttttagataccacaaaggtacagattttcaagcaaatcacaacacacttttattaagttgctcaagtttataagttg

SEQ ID NO: 107 - DNA, 4000 bp, Escherichia coli
  misc_feature (1980)..(1980): n is a, c, g, or t
  misc_feature (1985)..(1986): n is a, c, g, or t
  misc_feature (1989)..(1989): n is a, c, g, or t
  misc_feature (1997)..(1998): n is a, c, g, or t
  misc_feature (2013)..(2013): n is a, c, g, or t
  misc_feature (2018)..(2019): n is a, c, g, or t
  misc_feature (2025)..(2025): n is a, c, g, or t
  misc_feature (2027)..(2028): n is a, c, g, or t
  misc_feature (2039)..(2040): n is a, c, g, or t
  misc_feature (2045)..(2046): n is a, c, g, or t
  misc_feature (2051)..(2052): n is a, c, g, or t
  misc_feature (2054)..(2054): n is a, c, g, or t
gcccgtttctcccgatagcaacaaggttggttggatgggtaactttcatggaatggcacaaaaaaccgttatccgtaatttactgagtaaatacggctatttgtccgtagaaatgcaaaatgccatcaccaatgactacgagggtgacgaaacttcacagcgtgaaatattgaccgacaattacgcaaacaaacaattgattgatgcggaagatgtgagctttgaaagcgtgtctgaacaccatacggaaagcgagcaacaaacggcaactattgaccccggatattgatagcgtatgaaactgatagtattaggttcgagtagttcgggtaattgctatatacttgataatggtacggaaagccttattatagaagctggaatccgtttccaagaagtcaagaaagcgttggatttcaatctgagaaaggttgtagggtgtgtggtaacgcacgcccacaacgaccacgccaaatatattaaggcgatggtagatagtggatttcacacgttggcattacgggaggtatggactgcaaagggcgtttgggattcccgttctttggtggttaaagagggcaaaggctataagatgggtaattttaaggtacttccttttcctgcttgccatgatgtgccatgtgtcggctatctgatagaccaccccgatatgggaaagatggtatttcttaccgatagctgtatgtgcgaatatcagttcaaggggcttaaccatgtgctgatagagtgcaattactctgataagaagctcatcgaggcgattacaaccgggcgcacgttgccctcacagcgtgaacgtctgcttacctcacacatggagcttactacgtgcaaggggtttttggaagcaaacgacttatcccatgtttcggaaatcgtgcttttacacctttccgagaataatagcgatgagccttatttcatatcggaagtggaaaggcatacggggaaagtggtttatgcggcaaagccgggtttaacgattgatttagacagaatataaggatatggctaaactccaagtagaaaagagaaacgggttatttgatttgaagcctctatacgaatggatgcgtaacgctttggatggtatctataggatagaggttaagaaagtcagaaagccacgttctttagaccaaaacgggtggttgttcgggtgtatttaccctatccttttagacgctcttttggaagctggttgggagttcgtttcagtagaacaagtgcatgagttttttaaggctcaaatgacggctgacaaagtggtaaataagcacacgggggagattatagagttcccgtgttctacagccactatggacacggtgacattctccacctattgcgaaaaactgagggagtacgccaaagagtttctgaatgtggatattcccgacccggataaatattggagaagccatgaaaagaatacctaacagcgtggtatctgagctgatacgcttagtgcccattttgatagcaaatattccacccggacaaagtacgagagtggataacgcaataagattaacaaaaaagattatcaacaaattaaaaacattgaaagatgagaacatttgaaattacagagaaagaagtagcggctgcatttcgtgaagcggaaagtggagaagcaaagaaaatattggcggctttgttctgcaaggaagaaatggtaaaacctacactggacgattacaagacaattcgcacgtatgaggatgcttgtaaggcacttggtgagcctatttttgaagaccctaataatttgcccaatcatatcatagcccttatgaagttggaaactattagccgggctttgtggggtagaaatttccaaccaaagccggatggggagggaagcaaagtgtattggtatccgtggtttgccttatggactaagaaagaggttgaggatatgaatcccgaacaaagaggtgcccttttgtctgcgantgcgnnttntggtgcgnntgcgggtttcggttntctgnntgcgantnntcgttcctcgnntgcgnntgcgnncnttgggttccgcttgtgccaagaaacggaagaaaaggctaagtattttgggcagcaattcattgaactttgggctgaatatttgaaattcaactttaccgtaggaaatcgtttgaaataaaagtgtgtttgtcaaacatattatcaactaaaaaataaagtgaaatgaaagacatcatgttagccgataccccggtggaacaaagggaacagattctacgtgatagctgcgaccaaattgtagaacgtagctacacacgcaaatttgacacgcaacagattaacgaaagacgtgctgaacttgcaaacgtagcaattcaaaaagctgatttggaagatgagttggctggaatcagagctgaatacaagtccaaaattaagcctttggatgagagaattggaaaggttcgtgatgagttgaaagccggaggcgattatgtaaaaggtgattgcttcaagtttgtagatgaagatgagggcatggttggattctacaccccggagggttatttgctggagcaacgtgccatgacgcaagaagaaagacaacgtaacgtattccgtgccattagaacggatagaacgggtacgaatgattgattattaacacattaaattttagtaaaatggaaaatcaagaaaaaggattaaccgtaaacatcggtgagtacaagggtgaaaaacctatcgaagtagtgtacagaattggtaatgctcctaaagcattggacgaattgcccattaagcaaccggaaagtatttctgtatcaggtgttatcagaactccgttggattggttggaaaagcgtattgacaccatcgaccaaaagcgtgcgaatgttaaagtaaaccgtgagaaaatgagtatcacgcttaccgtgaatgaggatgattattacaccaaaaacacctttgtaggtacggtggaattatcggaagtcttttcaaagttcggtatcaatgacggagaatgtggctggattccggctaaactggggcagttcctgcgtttgaatcgtggcgtattcatgcaaaaagaggattgtatgaagctcgtttcggtattaaagaacttcacggctaacgccaagactgaaattcagaaacagcgtgacccgtccggctctatggctgaggtgtaccgttcacaggtagaaagtaatttgcccaagagtttcacgattaacatcgccattttcaagggaactgcaaaaacgcctattgaagttgagttcgaccactatctttctaatggtgatgtgttgttgcaacttgtttcgcccggtgctaacgaactggcagaggactacagagataagtgtattgatgaggtgttggacggtattcgtgccattgccccggacattgctattcttgaaatctaaatactatatcgtgggggagcaatcccccacttataacagctcataatatggctaataaaaaaatcataccgcctatgcctttcgatgctaccgcttggttatccaacaatgcggctatgaggttgtcatttgcttgtaagggcttgtggctggatatgctttgctgtatgtgggtgagtatagagcgtggggttatgctgaaacctattggcggtgcgtacacggttgatgaattagaagccctctacggaagtggaacaaaggagctgatagaatcattgattaacgctgaattattgtctgtaaggaatgatggagctttgtacaacgctgatatggttaaaatggaatcaatacgggtaaaacggtctgaggctgggaaaaaaggtggtgtaactatgggtaaacggatattagccaaagttgatgcgcttgtggaaacgccaccgatagaaacgccacatacaccgtccccaacggctgaaacgcaacaaggggcgcaagcagacctattccccgatgatttgccggagaatccaccgccactgactgatgaacaacag

SEQ ID NO: 108 - DNA, 4000 bp, Escherichia coli
  misc_feature (2979)..(2979): n is a, c, g, or t
  misc_feature (2982)..(2982): n is a, c, g, or t
  misc_feature (2985)..(2985): n is a, c, g, or t
  misc_feature (3138)..(3138): n is a, c, g, or t
  misc_feature (3144)..(3144): n is a, c, g, or t
  misc_feature (3153)..(3153): n is a, c, g, or t
  misc_feature (3363)..(3363): n is a, c, g, or t
  misc_feature (3384)..(3384): n is a, c, g, or t
  misc_feature (3657)..(3657): n is a, c, g, or t
  misc_feature (3735)..(3735): n is a, c, g, or t
  misc_feature (3858)..(3858): n is a, c, g, or t
  misc_feature (3891)..(3891): n is a, c, g, or t
  misc_feature (3978)..(3978): n is a, c, g, or t
gtgttatgacggtcagaacttcttcgacaacgaccacccggtatatgaaaaagtcgatggcaccggccaatccaccactgtatccaatattttcaccggtaccgaagccgcttggtatttgctggatacatcacgcgccctgaaacctctgatttatcaggaacgcaagcctaagcagttcactgccatgaccgccgctaccgacgaaggcgtatttatgcgcaacgaataccgctacggcgtggacggccgttgtaatgttggtttgggcttctggcaaatggcggctaagtcgcaagaaaccctggatgccgaaggttttgaaaaggcttacaacgcaatggtcagcctgaaaggcgacggcggccgaccgctgggtatccgcccgaatgtgctgctggttcctccttctttggaaaacgccgccaaaaaattagtggaaggcgaccgcctggatagtggtgcgtacaacccgaacaaaggcaaatgcaaggtaatcgtatctccttggttgctgtaaccctttagataggcgggctctgcccgccgaaaggataagaaatggcaaaagtaaaaaacgaagatgaaaaaaccgagcaaacggttggcgcaactgtggatgtaaaccccgaagacgttaagttgcaggcgtttcttgaggctgaagtcgaaaaattgaacgccgagcttgaagcggcgcgtgtgcgtatcgccgaattggaagctcaattggaacaggccgcaagccctgccgttgaagcagtagcagcacaagaacgctatcaggcaggcggtgaagcggcggcagatgccgaagtggttgccatcaaatccaaacatggccatgcgttttggcgcagcgggtatcacgttcaaccgcattttacctttgtgaaacgtgccgatttcgagcccgaagcgtgggagcgcctgctggccgaaccgatggctgttgtttgtgaagccttgcctgtggagcaggattaatggcttacgcaacggttgccgatttggtggcgcgttataccgagccgacgattgcaggtctgaccgacctgacgcgcttgggaagcgtgaatgccgaaattgcgcaacaaggtttggatgatgcctccgccgaaatcgacggctatctggcatcgcgctatgaattgccgttgcctgcccctgtgcgcctgttgagcctttattgctgcgacattgccgtttaccgtttggcaacgggcaagcgccaactgacggaagatatggtgcaccgatatgaggcggcgattgcgtatctcaaattggtggcatcaggcaaggctggtttgggtgtggctgaaaatgccgaccccaagccgaccgtgcaaggtgatgcggtaatgtttgccgccaaggaaaaggtgttcggccgtgatagcgtctattgaacaagccatcaaacagcgtctttcagacggccttggccaaatggtcagcggtgtgcatacatacggtggcgaatttgacggcgaaggcttggctcaagtggtcaaccagttccccgccgtttgggtcatgtttgccggcattaccgacagcgagccccatgatacgcgccgaacacgctaccaagtcactggtcactttactgtcttggtcggcgaccgtgccagcggcagcgaggcggacagccgcttcggcggtttacaccgaaacgatgtcggcacttaccggctgatgcaggccgtgcgcctgttgctgatcaatcagactatgggtttgtgtataggccgtctaaagccgggcaaagcaaaaagcctgttttctaaacaaatggagttggacgcaatcagcgtatttgcgctggattttgaaacgcattggttcgaagacgcactgcgagacggcgattggccacggcctacggtttcagatgctcaacaggcgcaaatatatgccgacgtatccgaataccatggctgtacctatccagaacatcctgacttgaaaggcgcaaaccttgagctgcgtatcccgcccaaaaaaccaaaccaacccgccgatatggcggccaccgttaaaaccgaggtaaaacatgactgaaaccattaaagttcgtgccgccacaggtctgcaagtacctatggcaggaaagccacatgaatatattaccgaccaagaagcggtcgaagtgccgaatgccgcgtattacctgcgctgtattcactacggcgacttggttattgttgaggacaacccgaaaggcaacaaatcatgacttccgcaaacgtcagtttcgacaaaattcagaccagtacgcgtaagccgggcgtttacgtcgaatggaacaccaagcttgctgtacgcaacctgccaaccaacaagcaacgtgtactgctgattgcgcaacacagcaatcccaaggcgggcaagctgactgcgctggcaaatatctattctgcggccgatgtcgcagctgcgtatggtgccggctctcaggcgcatttgatggcattggccgctatcaaggcttacgcatatgcagatttgagcctgattaccgttgccgacaatgaagcaggcgttgcggcgaccggcaatatcacgattacgggcactgccgatacgcaaggcgttttacgcgtcaacatcggcaatgccgatacgctgaccgtcggtgtcgccgccaatgcaaccgccgcaaccgtagcctctgccgtcaaagccgccattgatgccgaaacatcattgccggtaacggcgacagcctctgaaggcttggtaacgctgacagctaaaaataaaggcacgcacggcaaccatatccgtattcgcacaggtaataccgccgaagggattaccgttgcagtcaaagcgatgagcggcggcgatgccgatgccgatatcggccctgcattgaatgcagtgattgccgaaggccataatttgattgcggtaggctgtaccgatgaggcgaacctcttgaagttgcgcacacatttggaaactgtcggngcnccngaagaaaaacgctgggcattgggtatttatggccaaaccggtgcattggcgcaaacaacgacacaggcaggccgtctgaacagcggttatctgtattcggcctggtatcgtaaaacgcctagcctgccatgtgagctggcagccgcgtttgcngccgtngtggccagngaggaagacccggctcgtccgctcaataccctgaagctcaacggcatcggtgtgtgcgacagtgcagacaagactatgcgtaccgaacaggaaaacgcgctctacaacggcgttactcctattgaaaccagcccagacggcacatccgcccaaatcgtccgcgctatttcgacttataccaaaactgccaacggcacggcagacgaaagnctgctcgatatgactaccgtncgcacattgatttatgtatcaggcgcgtgtgccgaccgtatcgcattgcgtttcccgcgcgacaaaatgaccgagcgcaccattgcccgtgtccgctccgaattgatcgacgtgttgatgaaatgcgaagaattggaaatcgtcgaagacgttgaaaacaatttggccaacctgattgtggaacgcgatgcacaaaacaccggcatgctcaactgccgcgtgccatccgatgtggttaacggcctgcaccaagtaggcatggttatcgacctntatctgtaaaaaggaaagaacatgagtacagaatatgtaggcagcgtaacgctgtatgtcggtgcgaccgaggtggangtcaccaagattgatgtgaaaaacatcacaggcaaaaaagaagttaaaaccatgaaccgcacacgccgcgtcaaaggctttacgcgcggtgtcggccagtatgatatttcttttaccgccgtngtgccgacagacggtacggttatcgattggganaaaatcgaagacgcaaaaatctcgctggttcctgatatcaatggtgcgcgcccaacctcctatcttggtttttgcgcgaaggaagcnggtgaaagctatacggtggaca

SEQ ID NO: 109 - DNA, 4000 bp, Escherichia coli
  misc_feature (1)..(16): n is a, c, g, or t
  misc_feature (18)..(53): n is a, c, g, or t
  misc_feature (55)..(57): n is a, c, g, or t
  misc_feature (59)..(61): n is a, c, g, or t
  misc_feature (63)..(117): n is a, c, g, or t
  misc_feature (119)..(119): n is a, c, g, or t
  misc_feature (121)..(146): n is a, c, g, or t
  misc_feature (148)..(157): n is a, c, g, or t
  misc_feature (159)..(194): n is a, c, g, or t
  misc_feature (196)..(207): n is a, c, g, or t
  misc_feature (209)..(214): n is a, c, g, or t
  misc_feature (216)..(287): n is a, c, g, or t
  misc_feature (289)..(374): n is a, c, g, or t
  misc_feature (376)..(458): n is a, c, g, or t
  misc_feature (460)..(463): n is a, c, g, or t
  misc_feature (465)..(504): n is a, c, g, or t
  misc_feature (506)..(548): n is a, c, g, or t
  misc_feature (550)..(574): n is a, c, g, or t
  misc_feature (576)..(576): n is a, c, g, or t
  misc_feature (578)..(616): n is a, c, g, or t
  misc_feature (618)..(640): n is a, c, g, or t
  misc_feature (642)..(663): n is a, c, g, or t
  misc_feature (665)..(670): n is a, c, g, or t
  misc_feature (672)..(698): n is a, c, g, or t
  misc_feature (700)..(769): n is a, c, g, or t
  misc_feature (774)..(778): n is a, c, g, or t
  misc_feature (780)..(784): n is a, c, g, or t
  misc_feature (786)..(788): n is a, c, g, or t
  misc_feature (790)..(791): n is a, c, g, or t
  misc_feature (794)..(798): n is a, c, g, or t
  misc_feature (801)..(805): n is a, c, g, or t
  misc_feature (809)..(811): n is a, c, g, or t
  misc_feature (813)..(814): n is a, c, g, or t
  misc_feature (1937)..(1938): n is a, c, g, or t
  misc_feature (1940)..(1940): n is a, c, g, or t
  misc_feature (1943)..(1944): n is a, c, g, or t
  misc_feature (1949)..(1950): n is a, c, g, or t
  misc_feature (1957)..(1957): n is a, c, g, or t
  misc_feature (1976)..(1977): n is a, c, g, or t
  misc_feature (1982)..(1983): n is a, c, g, or t
  misc_feature (1985)..(1985): n is a, c, g, or t
  misc_feature (1997)..(1998): n is a, c, g, or t
  misc_feature (2003)..(2004): n is a, c, g, or t
  misc_feature (2009)..(2010): n is a, c, g, or t
  misc_feature (3160)..(3160): n is a, c, g, or t
  misc_feature (3164)..(3165): n is a, c, g, or t
  misc_feature (3168)..(3168): n is a, c, g, or t
  misc_feature (3171)..(3171): n is a, c, g, or t
  misc_feature (3180)..(3180): n is a, c, g, or t
  misc_feature (3185)..(3185): n is a, c, g, or t
  misc_feature (3187)..(3187): n is a, c, g, or t
  misc_feature (3189)..(3190): n is a, c, g, or t
  misc_feature (3193)..(3193): n is a, c, g, or t
  misc_feature (3197)..(3197): n is a, c, g, or t
  misc_feature (3200)..(3200): n is a, c, g, or t
  misc_feature (3202)..(3203): n is a, c, g, or t
  misc_feature (3205)..(3205): n is a, c, g, or t
  misc_feature (3207)..(3208): n is a, c, g, or t
  misc_feature (3210)..(3211): n is a, c, g, or t
  misc_feature (3214)..(3214): n is a, c, g, or t
  misc_feature (3216)..(3220): n is a, c, g, or t
  misc_feature (3223)..(3224): n is a, c, g, or t
  misc_feature (3226)..(3226): n is a, c, g, or t
  misc_feature (3228)..(3230): n is a, c, g, or t
  misc_feature (3234)..(3234): n is a, c, g, or t
  misc_feature (3238)..(3238): n is a, c, g, or t
  misc_feature (3242)..(3242): n is a, c, g, or t
  misc_feature (3244)..(3244): n is a, c, g, or t
  misc_feature (3250)..(3252): n is a, c, g, or t
  misc_feature (3256)..(3257): n is a, c, g, or t
  misc_feature (3261)..(3262): n is a, c, g, or t
  misc_feature (3264)..(3264): n is a, c, g, or t
  misc_feature (3267)..(3267): n is a, c, g, or t
  misc_feature (3273)..(3277): n is a, c, g, or t
  misc_feature (3279)..(3280): n is a, c, g, or t
  misc_feature (3282)..(3282): n is a, c, g, or t
  misc_feature (3284)..(3284): n is a, c, g, or t
  misc_feature (3288)..(3289): n is a, c, g, or t
  misc_feature (3299)..(3302): n is a, c, g, or t
  misc_feature (3310)..(3312): n is a, c, g, or t
  misc_feature (3317)..(3317): n is a, c, g, or t
  misc_feature (3320)..(3321): n is a, c, g, or t
  misc_feature (3323)..(3326): n is a, c, g, or t
  misc_feature (3330)..(3331): n is a, c, g, or t
  misc_feature (3333)..(3334): n is a, c, g, or t
  misc_feature (3338)..(3339): n is a, c, g, or t
  misc_feature (3341)..(3341): n is a, c, g, or t
  misc_feature (3343)..(3343): n is a, c, g, or t
  misc_feature (3348)..(3350): n is a, c, g, or t
  misc_feature (3352)..(3352): n is a, c, g, or t
  misc_feature (3355)..(3355): n is a, c, g, or t
  misc_feature (3366)..(3366): n is a, c, g, or t
  misc_feature (3370)..(3370): n is a, c, g, or t
  misc_feature (3373)..(3373): n is a, c, g, or t
  misc_feature (3375)..(3379): n is a, c, g, or t
  misc_feature (3382)..(3382): n is a, c, g, or t
  misc_feature (3384)..(3384): n is a, c, g, or t
  misc_feature (3388)..(3390): n is a, c, g, or t
  misc_feature (3392)..(3395): n is a, c, g, or t
  misc_feature (3402)..(3403): n is a, c, g, or t
  misc_feature (3407)..(3407): n is a, c, g, or t
  misc_feature (3414)..(3415): n is a, c, g, or t
  misc_feature (3420)..(3420): n is a, c, g, or t
  misc_feature (3422)..(3422): n is a, c, g, or t
  misc_feature (3424)..(3426): n is a, c, g, or t
  misc_feature (3428)..(3429): n is a, c, g, or t
  misc_feature (3431)..(3439): n is a, c, g, or t
  misc_feature (3441)..(3444): n is a, c, g, or t
  misc_feature (3446)..(3446): n is a, c, g, or t
  misc_feature (3452)..(3452): n is a, c, g, or t
  misc_feature (3459)..(3459): n is a, c, g, or t
  misc_feature (3461)..(3461): n is a, c, g, or t
  misc_feature (3466)..(3466): n is a, c, g, or t
  misc_feature (3470)..(3470): n is a, c, g, or t
  misc_feature (3472)..(3472): n is a, c, g, or t
  misc_feature (3482)..(3482): n is a, c, g, or t
  misc_feature (3485)..(3485): n is a, c, g, or t
  misc_feature (3488)..(3488): n is a, c, g, or t
  misc_feature (3496)..(3496): n is a, c, g, or t
  misc_feature (3499)..(3499): n is a, c, g, or t
  misc_feature (3506)..(3508): n is a, c, g, or t
  misc_feature (3515)..(3515): n is a, c, g, or t
  misc_feature (3518)..(3519): n is a, c, g, or t
  misc_feature (3525)..(3525): n is a, c, g, or t
  misc_feature (3530)..(3530): n is a, c, g, or t
  misc_feature (3541)..(3542): n is a, c, g, or t
  misc_feature (3547)..(3547): n is a, c, g, or t
  misc_feature (3553)..(3553): n is a, c, g, or t
  misc_feature (3555)..(3556): n is a, c, g, or t
  misc_feature (3563)..(3564): n is a, c, g, or t
  misc_feature (3571)..(3571): n is a, c, g, or t
  misc_feature (3574)..(3574): n is a, c, g, or t
  misc_feature (3580)..(3582): n is a, c, g, or t
  misc_feature (3591)..(3592): n is a, c, g, or t
  misc_feature (3595)..(3595): n is a, c, g, or t
  misc_feature (3605)..(3605): n is a, c, g, or t
  misc_feature (3607)..(3607): n is a, c, g, or t
  misc_feature (3612)..(3612): n is a, c, g, or t
  misc_feature (3616)..(3616): n is a, c, g, or t
  misc_feature (3618)..(3618): n is a, c, g, or t
  misc_feature (3624)..(3625): n is a, c, g, or t
  misc_feature (3627)..(3627): n is a, c, g, or t
  misc_feature (3633)..(3633): n is a, c, g, or t
  misc_feature (3637)..(3638): n is a, c, g, or t
  misc_feature (3640)..(3640): n is a, c, g, or t
  misc_feature (3642)..(3642): n is a, c, g, or t
  misc_feature (3644)..(3645): n is a, c, g, or t
  misc_feature (3650)..(3650): n is a, c, g, or t
  misc_feature (3653)..(3653): n is a, c, g, or t
  misc_feature (3657)..(3657): n is a, c, g, or t
  misc_feature (3660)..(3660): n is a, c, g, or t
  misc_feature (3669)..(3669): n is a, c, g, or t
  misc_feature (3674)..(3674): n is a, c, g, or t
  misc_feature (3676)..(3676): n is a, c, g, or t
  misc_feature (3678)..(3678): n is a, c, g, or t
  misc_feature (3681)..(3681): n is a, c, g, or t
  misc_feature (3683)..(3683): n is a, c, g, or t
  misc_feature (3689)..(3692): n is a, c, g, or t
  misc_feature (3695)..(3699): n is a, c, g, or t
  misc_feature (3704)..(3704): n is a, c, g, or t
  misc_feature (3708)..(3710): n is a, c, g, or t
  misc_feature (3717)..(3718): n is a, c, g, or t
  misc_feature (3725)..(3725): n is a, c, g, or t
  misc_feature (3730)..(3732): n is a, c, g, or t
  misc_feature (3735)..(3735): n is a, c, g, or t
  misc_feature (3737)..(3737): n is a, c, g, or t
  misc_feature (3742)..(3742): n is a, c, g, or t
  misc_feature (3745)..(3745): n is a, c, g, or t
  misc_feature (3750)..(3750): n is a, c, g, or t
  misc_feature (3752)..(3753): n is a, c, g, or t
  misc_feature (3756)..(3756): n is a, c, g, or t
  misc_feature (3758)..(3758): n is a, c, g, or t
  misc_feature (3762)..(3762): n is a, c, g, or t
  misc_feature (3765)..(3765): n is a, c, g, or t
  misc_feature (3767)..(3768): n is a, c, g, or t
  misc_feature (3773)..(3774): n is a, c, g, or t
  misc_feature (3778)..(3778): n is a, c, g, or t
  misc_feature (3781)..(3781): n is a, c, g, or t
  misc_feature (3784)..(3785): n is a, c, g, or t
  misc_feature (3790)..(3790): n is a, c, g, or t
  misc_feature (3793)..(3793): n is a, c, g, or t
  misc_feature (3796)..(3796): n is a, c, g, or t
  misc_feature (3798)..(3798): n is a, c, g, or t
  misc_feature (3802)..(3802): n is a, c, g, or t
  misc_feature (3805)..(3805): n is a, c, g, or t
  misc_feature (3811)..(3811): n is a, c, g, or t
  misc_feature (3813)..(3813): n is a, c, g, or t
  misc_feature (3820)..(3822): n is a, c, g, or t
  misc_feature (3824)..(3826): n is a, c, g, or t
  misc_feature (3828)..(3828): n is a, c, g, or t
  misc_feature (3830)..(3830): n is a, c, g, or t
  misc_feature (3834)..(3834): n is a, c, g, or t
  misc_feature (3837)..(3838): n is a, c, g, or t
  misc_feature (3841)..(3841): n is a, c, g, or t
  misc_feature (3843)..(3843): n is a, c, g, or t
  misc_feature (3855)..(3855): n is a, c, g, or t
  misc_feature (3857)..(3857): n is a, c, g, or t
  misc_feature (3860)..(3862): n is a, c, g, or t
  misc_feature (3866)..(3866): n is a, c, g, or t
  misc_feature (3873)..(3873): n is a, c, g, or t
  misc_feature (3877)..(3877): n is a, c, g, or t
  misc_feature (3879)..(3879): n is a, c, g, or t
  misc_feature (3883)..(3883): n is a, c, g, or t
  misc_feature (3886)..(3887): n is a, c, g, or t
  misc_feature (3890)..(3894): n is a, c, g, or t
  misc_feature (3897)..(3897): n is a, c, g, or t
  misc_feature (3900)..(3900): n is a, c, g, or t
  misc_feature (3902)..(3902): n is a, c, g, or t
  misc_feature (3906)..(3906): n is a, c, g, or t
  misc_feature (3911)..(3913): n is a, c, g, or t
  misc_feature (3921)..(3921): n is a, c, g, or t
  misc_feature (3923)..(3924): n is a, c, g, or t
  misc_feature (3928)..(3929): n is a, c, g, or t
  misc_feature (3931)..(3931): n is a, c, g, or t
  misc_feature (3933)..(3933): n is a, c, g, or t
  misc_feature (3936)..(3937): n is a, c, g, or t
  misc_feature (3940)..(3940): n is a, c, g, or t
  misc_feature (3942)..(3942): n is a, c, g, or t
  misc_feature (3945)..(3946): n is a, c, g, or t
  misc_feature (3948)..(3948): n is a, c, g, or t
  misc_feature (3954)..(3954): n is a, c, g, or t
  misc_feature (3956)..(3958): n is a, c, g, or t
  misc_feature (3960)..(3960): n is a, c, g, or t
  misc_feature (3962)..(3962): n is a, c, g, or t
  misc_feature (3964)..(3965): n is a, c, g, or t
  misc_feature (3968)..(3968): n is a, c, g, or t
  misc_feature (3971)..(3971): n is a, c, g, or t
  misc_feature (3999)..(3999): n is a, c, g, or t
nnnnnnnnnnnnnnnnannnnnnnnnnnnnnnnnnnnnnnnnnnnnnnnnnnntnnntnnntnnnnnnnnnnnnnnnnnnnnnnnnnnnnnnnnnnnnnnnnnnnnnnnnnnnnnnntntnnnnnnnnnnnnnnnnnnnnnnnnnntnnnnnnnnnnannnnnnnnnnnnnnnnnnnnnnnnnnnnnnnnnnnnannnnnnnnnnnntnnnnnnannnnnnnnnnnnnnnnnnnnnnnnnnnnnnnnnnnnnnnnnnnnnnnnnnnnnnnnnnnnnnnnnnnnnnnntnnnnnnnnnnnnnnnnnnnnnnnnnnnnnnnnnnnnnnnnnnnnnnnnnnnnnnnnnnnnnnnnnnnnnnnnnnnnnnnnnnnnnntnnnnnnnnnnnnnnnnnnnnnnnnnnnnnnnnnnnnnnnnnnnnnnnnnnnnnnnnnnnnnnnnnnnnnnnnnnnnnnnnnnntnnnnannnnnnnnnnnnnnnnnnnnnnnnnnnnnnnnnnnnnnnntnnnnnnnnnnnnnnnnnnnnnnnnnnnnnnnnnnnnnnnnnnntnnnnnnnnnnnnnnnnnnnnnnnnnantnnnnnnnnnnnnnnnnnnnnnnnnnnnnnnnnnnnnnnntnnnnnnnnnnnnnnnnnnnnnnnannnnnnnnnnnnnnnnnnnnnnannnnnnannnnnnnnnnnnnnnnnnnnnnnnnnntnnnnnnnnnnnnnnnnnnnnnnnnnnnnnnnnnnnnnnnnnnnnnnnnnnnnnnnnnnnnnnnnnnnnnnaaaannnnnannnnntnnntnnttnnnnnttnnnnntttnnntnngtgattcaagtaacgtttattaatcgcttgattattaattgcttgtataattgtatagcctacaatatgcctacatttcttatctattacaggttatttcttacttaataagacttgtattagacgttccttctcctcaattatcctttctaaatcagctatttttgcatccttatcaagttcatttgattttattccaggtatgggaatattatcaaagaatacacctacaggaacttccagaacctttgctattgcctcaatggtttttgtattcgttgttccattcctgacaatagcctgtatgctactatcttcttttcctatacgtgatgcaagttctcgtatagtgattttctttaactcacataattctcttattaacaagaaattagccatattatatctttgttataacttttattaacgtaattcttattcacttgtggtgaaaataattatacctttgctatgtaaagttaataataatgagtatatttatcacaaaggtatgacgaaaaaaaaattaaaaaggaatgatgacggcgagaaactaagaatgtaccttttgaatttgccggtaaaagaatcttctgaaatgtcccttaaattggcagaagcatgtaaagtgccattacatacctttcgtaattggcggggtagtcgttgtcgtattcccgaacttgccaaggataagatcgaggaagtaacaggcgtaaaaatcttccatagtgaaaaccaataaataaaagaaaaatgaaatcaaagaaattagaaatcgaaattccggaaggtaaaacggccgtctggagaaatggcatcttaactcttattgatgaaccggagaaagacgtaaaagaacgtattaagacgtttgaggacgcctgccgtgaaattggcattgatgcggaagcatggagccgggataaaatatccctcggtcttgaacctgacgttctggctttcctgaaactccgtatcattgtcaaggctttaaatgaaggctgggaacctcaatttatagaggatgaataccgttattatccttggtttattctttatacaggggaagaatacaataagttggacgaggaagaaaagtctcgtgtggtgtatcggtcgnncnacnncgcgnncgcgttnggcggtgtttcgtatgcgnncgcgnntnacgattcatcgnncacgnntgcgnncatcggcgttcggcttgccttcaaaacgtcagaactggcagcgtattgcggtcgacaattccttgatatttgggcggactttgtttttcttccggaaaagaaaagtgaataaataaccggggcggcttttgccgctccatataataaccgccggagtgtggagataaccccgaagggcgaaagcgggtgttattggtagttcgatgctatcctccggcacagctataaacaacaatgagcaaaatttacatagtaactaaaagggaatctggaaaatacgaagaagacggcgtttggttttctatccttgccgcatttgatacgagaaataaagcagaagaatatttaaagaaatatgtaaaaacggctcctaaagaagcttactacactttctatcgaatagaatctgttccgttgtttctttcttctcataaagtgaaaataaacagaccgaaacatacgacctatcctattggtgaattggtaaaattaaaaataagtggtgaaaaataattcaaatcaagaacagaaatgagcaaaaaaatctccataaaagtaactgaagcacaaccgcttccttgcccttattgcaatggtttttacggttatcagtatagtgatctgtttagaatgagttacacgagtgtgcataattctgacggtacatattccggtggggaatattccgacggagtttccttaaacaagagtaaaacagcttattgtgtgaattgtggtaccaaactaccttttaccctaatacgtgaaggtgaggaacaagtcgaataattaaaaataaatcagaaatgaaatcaacaattaccacccccgatgaattaaccacgctacgaatagaaggcagtagtggaacctataaaatattcagtagcttccgccccatggaatcccctgcgttcgtggatgcggtggaccggaaatataatctggcggagattaagaatctttccggcggaaaaggttatttcctggtacacttgaacagagagcagcaggaaactatacaggaggatttaagcgctatcctttgcgatagtgtgccatgtcttctgtaaactaagacgatcttaacgaaatgccatgaaagaagacagacgcctaagaaacctacgttatcagatgcggaagaaangttnncanttngatacaaanaaccngntnnccnttangcntnnanannannaangnnnnnttnncnannnaagnagantaancnaattcnnntttnnaatnnantanaacatnnnnnannantnaaanntaaaaatttnnnntacatcgnnnacgcnatnntnnnngttnncnntatnngncngattnnntntgncatttattatncggntanannnnnttntntttnnntnnnnttattcnntttnctgtatnnacctngnannnanntnnnnnnnnnannnnangaaganaacgaanantaagnaacnangtaactttanaangangataaagncanaagacannnacaaagnaannaacaangggcnggatataattnnacatnattatncnnaagcccnngattgtntcngaaccnnncgccatttnnaangccggccgtnanaggangacncntcggcnngnatcaanttanncngnanngaagnttnccancangtttataangtaangnanttngncgatannnnaannnnncaaancccnnncgatatnngcatgtntgagnnnggncnccggnttnacgangnnatncntaanctngnntccanntacnacntanncgatnaantcnancgtnacntaaacnanccggatnnncnnnangntccngcnnccnangatcagaaagangntannnaaantttcgancttncngatnatnncannnnngancantnacgnatacnnngcccccgngnnaccnngnanaannccnangcnntncactgntnnncngncnnatncanagggtatgtaaaaaatcgcgaggtaacnt

SEQ ID NO: 110 - DNA, 4000 bp, Escherichia coli
  misc_feature (590)..(590): n is a, c, g, or t
  misc_feature (3081)..(3082): n is a, c, g, or t
taagtgcctgattagcaagacttgcgacacccacatcaaataaggacaaatcaatatgctgcccctgccctgttttgttgcgatgttcaacagccgccagaatagcaacgcttgcattaaggcctgttagaatatctatcagggcaacaccggctttcactggcataccgccagcatctttgggctcacccgtaacagacatcagcccgctcatgccctgtatcatgaaatcatatccagcgcgcgaggcatcagggccatcctggccaaaaccagtgaccgaacaatagataagatggggatagtctttgctcaggcttgcgtaatcaaggccatattttgctagaccacctaccttgaaattttcaattagaatatcggcttcaccggcaagctgatgaatcaggcgcgcgccctcttcagaggtaaaatcaagagcgatagattttttatttctgtttacattagcgaaataggcagaaatgcccggcacatcgccatctggctcctgcacaaaaggaggcccccaactgcgggtttcatcccctgagccggggcgctcaatcttccaaatttcagcgcccatatcnccaagcgtctgggtggcccatgggccagccagaacacggctcatatcgagcactttcagatgggacagtgccccttgcgcaacactcatccggacagcgccccctaattagcctgtaaaggcctgaagacctgtctgtgcccggccaagaataagcgcatgcacatcatgagttccttcataggtgttcacagtttccaaattcaccatatgacgcatcacatgataatcttcagaaataccgttaccgccatgcatatcacgcgaaaggcgtgcaatatgcagcgctttgccgcagctgttacgcttcatcattgagataagttcgggcgcgcatcttcccgcttccatcatccgtgagacgtgcaagacagattgcagagcaagggtaatttctgtctgcatatcagctagttttagctggataagctggtttgctgctaacggacggttaaactgcttgcgctcaagcgtataggtgcgcgcggcatgccagcatgcttctgctgcgcccaatgcaccccagctaatgccaaagcgtgctttgttaagacagctgaacggacctttcaagccttcgacatgtggcagtaatgcatcctcagacacatcgacattatccatgctaatcgatccggtcatagaggcccgcaatgaaagctttcctttgatagggtcagccgataagcctttcatgcccttttccagaatgaagcctttaattttaccgtcatgtgcatctgactttgcccagatgataaacacatccgctatcggggcatttgaaatccacattttcgagccagaaatccggtacccatctgaggtcttctcagcacgtgtccgcatcgcacctgggtcagagcctgcatctgcttcggttaggccaaaacaaccaataaactcacctgttgccaagcgtggcaggaatttttgtttctgctcttcagtaccaaagctttcgataggatgcatgaccagcgatgactgaacagacagcatcgagcgatagcctgaatcaacccgttcaatttcacgcgcaacaagaccataggctgtgctattggcgccaacgccgccatattctggtgacactgttaccccgagcaagccaatttctcccatctcggtaaagatagctgggtctgtcttttcttcgcgatatgcttcgacaatccgtggctgcaatttatcagttgcataggcgcgcgctgtatcacgaatgagacgctcatcttcagagagctgatgctcaatttctaacgggtcatcccaggtaaaaacgggcttagaagaagatgtcgttgtattaaggctatccataataaaaaagagctcctgttgagaaagcgagtggatgtcggctattaccgaagaaaaaggcacttaatgaataaagcataatctataccgcccacattaacatacaagctagtaggcgaaaataggctagtttttttacctgttggttttttaccggctggttttttcctgttccagagagcgtgttctttgccacagatagaggccagagccaacaataagcgcgcttccgctgagggttgccgcggacggtacttcattaaacagcaacaagccccagatcatcgcaaacacaagggtgagataattaaccggcgcaaggtctgttgccgatactttgttgagggccagaataaggctgtaatgaccaatactcccgaacaacgacattgatagcatcaataagatggttatcccgctatcgggcatcacccacacaaaaggcagaataaggctactagcaatcgcgccgcaccctgctgtgtagaacaaggttgtacgggcatcttcgcttggccccagaaagcgggtgagaatagaatagctcgcatacaggcttgccgcgcataatggcagaagactggctaatgaaaaacttgatgattggggctgaataattatcattgcgccaacaaacccaacaagcaggcagacaattcgcctcatcccgattgtctcgcccagaaacagaacagctagtatcgttatcaccagtggcgccacctgaaagatggctgtcgcaagaccctgatcaagataaaacaaactcgtaaagaaacagatagttgctgaaaaaagagctgcagaccttgcgagctgaaggccaagataacgggtatgcataacccgttttaagtgcggcgcaaacacaatcagcaagagcaaaaactgtccggcatagcgggcccagacaacctgcaagacaggctgtgtctgggttagaattttggcaacagtatccatcgctggaaaacacatgactgtcaccaacataagcagaaagccaatttgatgctgacttaatgaggataaaagacgcgaaaccatagccggaaattaccccctacacacaaccgcgttacagtagggttcttttcattattctcctacttctttttgtctgcgtttaatcaccctctggtcttacgcctctcatgtgatatattagnngtaggtagcgcatcgttgaacggtttgtgaggggtagcgtcactattctgcaaaccgagcaacgtaaggtctaaaactcttcactttttggcagggtcattcgatgtccaagacaaaaaaaacacctgcagacatagccagcgccaaacgggcatcctggcagaaaaaggcgtctgaggagctgcgtggtgcgccgctagaaagtctgacaaaaacaactgcagaaggcatcgatattgcgccgctttataccagcgaagatgcagagggcttaccgcatatgggctcccttcccggcgaggctccttttttgcggggtccgcgggcaagcatgtatacacaccggccttggaccatccgtcaatatgctggtttttcaacggccgaagaaaccaataactttttcaggtccgccctaaatgccggccagaagggcctgtctgttgcgttcgatcttgcgacacatcgtggctatgattctgatcatgaacgggtacgcggcgatgttggcaaagccggcgttgcaatagatacagtcgaagatatgaaacgtctatttgacggcatccctctggatagcatgtctgtttccatgacaatgaacggtgctgttctgcctgtattagcaagctttattgttgctgccgaagagcagggtgtgcctgctgaaaagatatctggcaccatccagaatgacattctcaaagaatttatggtgcgaaacacctatatttatccgcccagcccttcaatgcggattgttgctgatattatcgagcatacggcgagcaatatgccgaaattcaattccatctcgatttctggctatcatatgcaggaagcaggggcaaaccttgtacaagaactcgcttttacaattgctgatgggcttgaatatgtaaaagtagcgactgacag

SEQ ID NO: 111 - DNA, 4000 bp, Escherichia coli
  misc_feature (54)..(54): n is a, c, g, or t
  misc_feature (56)..(56): n is a, c, g, or t
  misc_feature (80)..(80): n is a, c, g, or t
  misc_feature (159)..(159): n is a, c, g, or t
  misc_feature (218)..(218): n is a, c, g, or t
  misc_feature (232)..(234): n is a, c, g, or t
  misc_feature (236)..(236): n is a, c, g, or t
  misc_feature (240)..(240): n is a, c, g, or t
  misc_feature (242)..(243): n is a, c, g, or t
  misc_feature (245)..(245): n is a, c, g, or t
  misc_feature (379)..(379): n is a, c, g, or t
  misc_feature (437)..(437): n is a, c, g, or t
  misc_feature (464)..(464): n is a, c, g, or t
  misc_feature (493)..(493): n is a, c, g, or t
  misc_feature (704)..(704): n is a, c, g, or t
  misc_feature (725)..(725): n is a, c, g, or t
  misc_feature (776)..(776): n is a, c, g, or t
  misc_feature (884)..(884): n is a, c, g, or t
  misc_feature (890)..(890): n is a, c, g, or t
  misc_feature (896)..(896): n is a, c, g, or t
  misc_feature (964)..(964): n is a, c, g, or t
  misc_feature (975)..(975): n is a, c, g, or t
  misc_feature (987)..(987): n is a, c, g, or t
  misc_feature (1520)..(1520): n is a, c, g, or t
  misc_feature (1525)..(1526): n is a, c, g, or t
  misc_feature (1582)..(1582): n is a, c, g, or t
  misc_feature (1986)..(1986): n is a, c, g, or t
  misc_feature (1992)..(1992): n is a, c, g, or t
  misc_feature (2001)..(2001): n is a, c, g, or t
  misc_feature (2003)..(2004): n is a, c, g, or t
  misc_feature (2007)..(2007): n is a, c, g, or t
  misc_feature (2009)..(2009): n is a, c, g, or t
  misc_feature (2027)..(2028): n is a, c, g, or t
  misc_feature (2033)..(2033): n is a, c, g, or t
  misc_feature (2323)..(2323): n is a, c, g, or t
  misc_feature (2373)..(2373): n is a, c, g, or t
  misc_feature (2404)..(2404): n is a, c, g, or t
  misc_feature (2529)..(2529): n is a, c, g, or t
  misc_feature (2591)..(2591): n is a, c, g, or t
  misc_feature (2630)..(2630): n is a, c, g, or t
  misc_feature (2656)..(2657): n is a, c, g, or t
  misc_feature (2672)..(2672): n is a, c, g, or t
  misc_feature (2681)..(2681): n is a, c, g, or t
  misc_feature (2695)..(2695): n is a, c, g, or t
  misc_feature (2703)..(2703): n is a, c, g, or t
  misc_feature (2705)..(2708): n is a, c, g, or t
  misc_feature (2710)..(2710): n is a, c, g, or t
  misc_feature (2712)..(2712): n is a, c, g, or t
  misc_feature (2714)..(2719): n is a, c, g, or t
  misc_feature (2721)..(2721): n is a, c, g, or t
  misc_feature (2723)..(2727): n is a, c, g, or t
  misc_feature (2729)..(2734): n is a, c, g, or t
  misc_feature (2736)..(2736): n is a, c, g, or t
  misc_feature (2738)..(2739): n is a, c, g, or t
  misc_feature (2741)..(2741): n is a, c, g, or t
  misc_feature (2744)..(2744): n is a, c, g, or t
  misc_feature (2746)..(2746): n is a, c, g, or t
  misc_feature (2748)..(2750): n is a, c, g, or t
  misc_feature (2752)..(2755): n is a, c, g, or t
  misc_feature (2758)..(2758): n is a, c, g, or t
  misc_feature (2762)..(2762): n is a, c, g, or t
  misc_feature (2765)..(2768): n is a, c, g, or t
  misc_feature (2770)..(2775): n is a, c, g, or t
  misc_feature (2777)..(2777): n is a, c, g, or t
  misc_feature (2779)..(2779): n is a, c, g, or t
  misc_feature (2785)..(2786): n is a, c, g, or t
  misc_feature (2789)..(2790): n is a, c, g, or t
  misc_feature (2792)..(2792): n is a, c, g, or t
  misc_feature (2795)..(2796): n is a, c, g, or t
  misc_feature (2798)..(2799): n is a, c, g, or t
  misc_feature (2802)..(2802): n is a, c, g, or t
  misc_feature (2804)..(2804): n is a, c, g, or t
  misc_feature (2806)..(2806): n is a, c, g, or t
  misc_feature (2811)..(2813): n is a, c, g, or t
  misc_feature (2815)..(2815): n is a, c, g, or t
  misc_feature (2817)..(2818): n is a, c, g, or t
  misc_feature (2820)..(2825): n is a, c, g, or t
  misc_feature (2827)..(2827): n is a, c, g, or t
  misc_feature (2829)..(2829): n is a, c, g, or t
  misc_feature (2831)..(2831): n is a, c, g, or t
  misc_feature (2835)..(2841): n is a, c, g, or t
  misc_feature (2845)..(2845): n is a, c, g, or t
  misc_feature (2847)..(2848): n is a, c, g, or t
  misc_feature (2850)..(2851): n is a, c, g, or t
  misc_feature (2855)..(2858): n is a, c, g, or t
  misc_feature (2861)..(2861): n is a, c, g, or t
  misc_feature (2863)..(2863): n is a, c, g, or t
  misc_feature (2866)..(2869): n is a, c, g, or t
  misc_feature (2872)..(2872): n is a, c, g, or t
  misc_feature (2874)..(2876): n is a, c, g, or t
  misc_feature (2878)..(2880): n is a, c, g, or t
  misc_feature (2883)..(2884): n is a, c, g, or t
  misc_feature (2886)..(2887): n is a, c, g, or t
  misc_feature (2891)..(2891): n is a, c, g, or t
  misc_feature (2893)..(2896): n is a, c, g, or t
  misc_feature (2898)..(2898): n is a, c, g, or t
  misc_feature (2903)..(2904): n is a, c, g, or t
  misc_feature (2906)..(2907): n is a, c, g, or t
  misc_feature (2910)..(2910): n is a, c, g, or t
  misc_feature (2915)..(2917): n is a, c, g, or t
  misc_feature (2919)..(2919): n is a, c, g, or t
  misc_feature (2921)..(2922): n is a, c, g, or t
  misc_feature (2925)..(2925): n is a, c, g, or t
  misc_feature (2929)..(2931): n is a, c, g, or t
  misc_feature (2933)..(2934): n is a, c, g, or t
  misc_feature (2936)..(2937): n is a, c, g, or t
  misc_feature (2939)..(2944): n is a, c, g, or t
  misc_feature (2947)..(2951): n is a, c, g, or t
  misc_feature (2956)..(2958): n is a, c, g, or t
  misc_feature (2960)..(2961): n is a, c, g, or t
  misc_feature (2964)..(2964): n is a, c, g, or t
  misc_feature (2966)..(2968): n is a, c, g, or t
  misc_feature (2971)..(2972): n is a, c, g, or t
  misc_feature (2974)..(2974): n is a, c, g, or t
  misc_feature (2978)..(2978): n is a, c, g, or t
  misc_feature (2980)..(2981): n is a, c, g, or t
  misc_feature (2984)..(2985): n is a, c, g, or t
  misc_feature (2989)..(2989): n is a, c, g, or t
  misc_feature (2991)..(2991): n is a, c, g, or t
  misc_feature (2994)..(2994): n is a, c, g, or t
  misc_feature (2996)..(3006): n is a, c, g, or t
  misc_feature (3009)..(3011): n is a, c, g, or t
  misc_feature (3013)..(3014): n is a, c, g, or t
  misc_feature (3016)..(3018): n is a, c, g, or t
  misc_feature (3020)..(3025): n is a, c, g, or t
  misc_feature (3027)..(3027): n is a, c, g, or t
  misc_feature (3029)..(3033): n is a, c, g, or t
  misc_feature (3036)..(3038): n is a, c, g, or t
  misc_feature (3041)..(3042): n is a, c, g, or t
  misc_feature (3044)..(3046): n is a, c, g, or t
  misc_feature (3048)..(3048): n is a, c, g, or t
  misc_feature (3051)..(3051): n is a, c, g, or t
  misc_feature (3053)..(3053): n is a, c, g, or t
  misc_feature (3055)..(3059): n is a, c, g, or t
  misc_feature (3062)..(3065): n is a, c, g, or t
  misc_feature (3067)..(3069): n is a, c, g, or t
  misc_feature (3071)..(3073): n is a, c, g, or t
  misc_feature (3076)..(3078): n is a, c, g, or t
  misc_feature (3080)..(3088): n is a, c, g, or t
  misc_feature (3092)..(3093): n is a, c, g, or t
  misc_feature (3095)..(3098): n is a, c, g, or t
  misc_feature (3100)..(3100): n is a, c, g, or t
  misc_feature (3103)..(3105): n is a, c, g, or t
  misc_feature (3110)..(3111): n is a, c, g, or t
  misc_feature (3113)..(3113): n is a, c, g, or t
  misc_feature (3117)..(3118): n is a, c, g, or t
  misc_feature (3120)..(3120): n is a, c, g, or t
  misc_feature (3122)..(3122): n is a, c, g, or t
  misc_feature (3126)..(3127): n is a, c, g, or t
  misc_feature (3129)..(3129): n is a, c, g, or t
  misc_feature (3131)..(3131): n is a, c, g, or t
  misc_feature (3133)..(3134): n is a, c, g, or t
  misc_feature (3136)..(3137): n is a, c, g, or t
  misc_feature (3142)..(3143): n is a, c, g, or t
  misc_feature (3146)..(3149): n is a, c, g, or t
  misc_feature (3151)..(3151): n is a, c, g, or t
  misc_feature (3155)..(3156): n is a, c, g, or t
  misc_feature (3159)..(3159): n is a, c, g, or t
  misc_feature (3162)..(3163): n is a, c, g, or t
  misc_feature (3167)..(3168): n is a, c, g, or t
  misc_feature (3172)..(3173): n is a, c, g, or t
  misc_feature (3176)..(3178): n is a, c, g, or t
  misc_feature (3180)..(3181): n is a, c, g, or t
  misc_feature (3185)..(3185): n is a, c, g, or t
  misc_feature (3189)..(3190): n is a, c, g, or t
  misc_feature (3193)..(3197): n is a, c, g, or t
  misc_feature (3200)..(3201): n is a, c, g, or t
  misc_feature (3204)..(3208): n is a, c, g, or t
  misc_feature (3210)..(3210): n is a, c, g, or t
  misc_feature (3212)..(3212): n is a, c, g, or t
  misc_feature (3215)..(3218): n is a, c, g, or t
  misc_feature (3220)..(3224): n is a, c, g, or t
  misc_feature (3226)..(3227): n is a, c, g, or t
  misc_feature (3229)..(3230): n is a, c, g, or t
  misc_feature (3232)..(3232): n is a, c, g, or t
  misc_feature (3235)..(3236): n is a, c, g, or t
  misc_feature (3238)..(3238): n is a, c, g, or t
  misc_feature (3242)..(3244): n is a, c, g, or t
  misc_feature (3246)..(3246): n is a, c, g, or t
  misc_feature (3248)..(3248): n is a, c, g, or t
  misc_feature (3250)..(3254): n is a, c, g, or t
  misc_feature (3256)..(3256): n is a, c, g, or t
  misc_feature (3258)..(3261): n is a, c, g, or t
  misc_feature (3263)..(3263): n is a, c, g, or t
  misc_feature (3265)..(3267): n is a, c, g, or t
  misc_feature (3269)..(3269): n is a, c, g, or t
  misc_feature (3271)..(3275): n is a, c, g, or t
  misc_feature (3278)..(3279): n is a, c, g, or t
  misc_feature (3281)..(3283): n is a, c, g, or t
  misc_feature (3286)..(3286): n is a, c, g, or t
  misc_feature (3290)..(3290): n is a, c, g, or t
  misc_feature (3294)..(3295): n is a, c, g, or t
  misc_feature (3302)..(3305): n is a, c, g, or t
  misc_feature (3309)..(3312): n is a, c, g, or t
  misc_feature (3317)..(3317): n is a, c, g, or t
  misc_feature (3320)..(3324): n is a, c, g, or t
  misc_feature (3326)..(3327): n is a, c, g, or t
  misc_feature (3329)..(3330): n is a, c, g, or t
  misc_feature (3332)..(3332): n is a, c, g, or t
  misc_feature (3336)..(3337): n is a, c, g, or t
  misc_feature (3339)..(3339): n is a, c, g, or t
  misc_feature (3341)..(3342): n is a, c, g, or t
  misc_feature (3344)..(3344): n is a, c, g, or t
  misc_feature (3346)..(3347): n is a, c, g, or t
  misc_feature (3349)..(3349): n is a, c, g, or t
  misc_feature (3352)..(3353): n is a, c, g, or t
  misc_feature (3358)..(3359): n is a, c, g, or t
  misc_feature (3362)..(3362): n is a, c, g, or t
  misc_feature (3365)..(3365): n is a, c, g, or t
  misc_feature (3367)..(3368): n is a, c, g, or t
  misc_feature (3370)..(3374): n is a, c, g, or t
  misc_feature (3377)..(3377): n is a, c, g, or t
  misc_feature (3379)..(3379): n is a, c, g, or t
  misc_feature (3384)..(3385): n is a, c, g, or t
  misc_feature (3388)..(3388): n is a, c, g, or t
  misc_feature (3390)..(3390): n is a, c, g, or t
  misc_feature (3397)..(3398): n is a, c, g, or t
  misc_feature (3401)..(3408): n is a, c, g, or t
  misc_feature (3411)..(3411): n is a, c, g, or t
  misc_feature (3413)..(3413): n is a, c, g, or t
  misc_feature (3418)..(3418): n is a, c, g, or t
  misc_feature (3423)..(3425): n is a, c, g, or t
  misc_feature (3430)..(3430): n is a, c, g, or t
  misc_feature (3434)..(3437): n is a, c, g, or t
  misc_feature (3447)..(3453): n is a, c, g, or t
  misc_feature (3456)..(3456): n is a, c, g, or t
  misc_feature (3458)..(3460): n is a, c, g, or t
  misc_feature (3463)..(3463): n is a, c, g, or t
  misc_feature (3466)..(3466): n is a, c, g, or t
  misc_feature (3468)..(3469): n is a, c, g, or t
  misc_feature (3471)..(3473): n is a, c, g, or t
  misc_feature (3478)..(3479): n is a, c, g, or t
  misc_feature (3481)..(3483): n is a, c, g, or t
  misc_feature (3485)..(3486): n is a, c, g, or t
  misc_feature (3492)..(3492): n is a, c, g, or t
  misc_feature (3494)..(3494): n is a, c, g, or t
  misc_feature (3496)..(3496): n is a, c, g, or t
  misc_feature (3498)..(3498): n is a, c, g, or t
  misc_feature (3500)..(3501): n is a, c, g, or t
  misc_feature (3503)..(3505): n is a, c, g, or t
  misc_feature (3508)..(3510): n is a, c, g, or t
  misc_feature (3512)..(3514): n is a, c, g, or t
  misc_feature (3518)..(3520): n is a, c, g, or t
  misc_feature (3522)..(3522): n is a, c, g, or t
  misc_feature (3526)..(3532): n is a, c, g, or t
  misc_feature (3534)..(3535): n is a, c, g, or t
  misc_feature (3539)..(3539): n is a, c, g, or t
  misc_feature (3542)..(3544): n is a, c, g, or t
  misc_feature (3546)..(3549): n is a, c, g, or t
  misc_feature (3552)..(3557): n is a, c, g, or t
  misc_feature (3559)..(3559): n is a, c, g, or t
  misc_feature (3564)..(3564): n is a, c, g, or t
  misc_feature (3566)..(3566): n is a, c, g, or t
  misc_feature (3569)..(3569): n is a, c, g, or t
  misc_feature (3572)..(3573): n is a, c, g, or t
  misc_feature (3575)..(3578): n is a, c, g, or t
  misc_feature (3580)..(3582): n is a, c, g, or t
  misc_feature (3584)..(3585): n is a, c, g, or t
  misc_feature (3587)..(3588): n is a, c, g, or t
  misc_feature (3590)..(3591): n is a, c, g, or t
  misc_feature (3604)..(3604): n is a, c, g, or t
  misc_feature (3606)..(3607): n is a, c, g, or t
  misc_feature (3612)..(3613): n is a, c, g, or t
  misc_feature (3615)..(3615): n is a, c, g, or t
  misc_feature (3618)..(3618): n is a, c, g, or t
  misc_feature (3620)..(3620): n is a, c, g, or t
  misc_feature (3625)..(3625): n is a, c, g, or t
  misc_feature (3628)..(3628): n is a, c, g, or t
  misc_feature (3631)..(3631): n is a, c, g, or t
  misc_feature (3636)..(3636): n is a, c, g, or t
  misc_feature (3638)..(3641): n is a, c, g, or t
  misc_feature (3644)..(3646): n is a, c, g, or t
  misc_feature (3648)..(3651): n is a, c, g, or t
  misc_feature (3657)..(3662): n is a, c, g, or t
  misc_feature (3665)..(3666): n is a, c, g, or t
  misc_feature (3669)..(3670): n is a, c, g, or t
  misc_feature (3673)..(3675): n is a, c, g, or t
  misc_feature (3683)..(3684): n is a, c, g, or t
  misc_feature (3688)..(3688): n is a, c, g, or t
  misc_feature (3691)..(3692): n is a, c, g, or t
  misc_feature (3694)..(3695): n is a, c, g, or t
  misc_feature (3701)..(3702): n is a, c, g, or t
  misc_feature (3707)..(3707): n is a, c, g, or t
  misc_feature (3710)..(3711): n is a, c, g, or t
  misc_feature (3713)..(3714): n is a, c, g, or t
  misc_feature (3716)..(3716): n is a, c, g, or t
gcctccaggtggtaggctgtctgcgacgatacgcggatggtgattttctttcgntnctcgctcatgcctcgcctccgccngtaggccggaggtagccattttcaacggccatggcccggattttgcggatggtggcgtcgctgacccgcaggccggtgncgctcctggtagccaggctgtcaataaagccgttgatgactttctcaagctcatcctgngagatgacgatagnnngnttgngnncntccagctcatccaggtaggcacagagctgagcgtcggtcatcttccgcacccggattgcccggtcgtgctgctcctgttcaaagccggtcctccggcagcttcgcttcttcaatagttctccctccagttattntccgtctacccgtaccatgccctccgggtactcctgaatgagagggccgccccacagntctttcagactgtttttcataaagacngggaccccggcagactgagcaacttccgngatggcctctacccattcccgcttcggctgctttcgcttgcttcccggcccggtcatggctccgatgatgacccaaagaggctcgcccaaccgccggaaaccggcgcagtcatccgcgctgaacggctccagcagcggctcaatgctcaagaacgtgttgacgcaggaagctccaaagtattccgtttcggggctggtgatcgtggtcccntaccagaagttccgctccatnggaagcttcccggcgtggcccatgtcaagatacctctgcgggttcttggtnaggaacaggtaagtatgctgcggcgctcgcttgcaggcggcgaagacatcctcaatccagatgtccggcacccactccccgaacaggtctcccatgctggagacgaanatccgngcaggngtcttccgcttctcaggatagtccatggtgtaggcgtgataggtgggggcaaagcccttggggtacgnggtagagcgcncaggctccccgntttcgtcgcagagcttggtaggctgctccacgtagtagcacccggtccccttgggtagtacctccagtggctcaatgatgggccgctcgcaggggtgcgggccaaacctggacaccatgcgccgggcgtagcagtattcgcacccgtgcttgcaccccgttacggggttccatgtgtggctgcaccactcaatgtcggttttgtgaatattcataggtcagtctccctcgcgcttgggggcggtggcccccatgtcaaataagctgcattggttctccatcatcttccggtcggcctcttcctgctttatcttccgcaggcagcagggaccgtacccatcccgcaagccctgggaggatgtcagcagacctccacaccgcttgcaccggcgggccgggatggtgaacacttcatcgtgcataggctacactccaaacgcgattagaatagacagggccagcaggcccgcagatgtaacctttgcgccgttgctccggtcattcatggtcttgcccccaaaggtgtagcaaaanccagnnaatgtaatcaggatgaagagggtccacgtaaacagcagcatcgtcattcacccagnagctcgcaaaggtgctccagcttggcaatctccatgtcggtgttgtcaccgaagatgacgtggagctggttcagcatgatttccacatcggccctctcttcggagatcgccgccaggatttccgcctcatcgccctgctcatggtccttgaagcgcagatacttgagtagggccttttgcagctcgctcatctcttccaccgccatgaggatttgagcgctctccccgaactgctccacggcctgctcatagagggccatttccgcttgctccggggtctcatccactccaggctgcggaccgtcggcgggccggatttctgccgctctcttcttgtcctcggcgtcaaggatagatgccaagatgtcagatttcagagttaaagccgggcgcacacccctgcngccgtngtacgcgtngnngtngntgaggctcccgtccgagnncacgnagcgcacgaaagaggtcccggaactcttcggggtcccgtccggcgtgatgagccagcgccaatgctccggcgcggggtgcagatcgcgggtctgccggtactcatcggcggtgagcatcgttaccttgtccagacagtttccgtagtcccggaggccgtcatcggcggtcaggtcgcggtaggtggggacaatggcgtctttcaggccggggcattcagcgatgaggttatccaggaactcgccgttgagccgcttccgcaggctcgccttgttccagtcgttgcagtcnttctcatcaaagggggcctggaagacgtcttcggtggcctcgcagaagtngagatcggagcagcccggcgtcggcgccggngtggtccgcagcacaatccagtccagaccggccacgtggaacacgtctccgtacttgaaagtcctcttttgctcttgcatggtaaattcctcctgatttttatttccccggcttctggccgtggnttatctgtggtggcttgacctgtccgcaccgggtcgggtggttcaagcaggggttcttgcanttcttatcccggtagccgcaatcggcgcagcagatgttnccgtgccgccggtcgcagttgaagannttgcatcggcgtggngctgtcttnctcatggggcctcncctccttngnnnntncncnnnnnncncnnnnngnnnnnngncnngnttngngnnncnnnntcncccngtnnnntnnnnnngntnaaaccnngcnnangtnnanngcncngncacgnnntntnnannnnnncnancncgtnnnnnnntctncnnanncatnnnnccngnggnnnnttncnnngnnngcnntnngccntnnnntntgccnntnncancagtnnnangnnatngcannncnngnntnnnnnngtnnnnntttcnnncnncgncnnnccnncnaaantnnatnncgcngnccncnnnnnnnnnnncgnnngnncnnngnnnnnntncnnnnnggnnnatnnannncngcncntnnnnntcnnnntnnncnnngcnnngnnnnnnnnntgcnntnnnncnggnnngcgcnncngcgnngncntctnnangntnnanngcccnntcnnnncncacnncgncgnnccannaaanncgnnnannctgncggnnggnnnnnagnnctnnnnncncngtnnnngnnnnncnntnntnctnnanccgnnncngnannnnntngnnnncncnnngncnnnnnagnncnnngcnggcntccnngcccgcnnnntggnnnntcgcncannnnngnntnncnaccnntncnncngnncnacnnggatnnggngananngnnnnnacngncgatnnggngngggtagnngtnnnnnnnnccntnaggancggannntccgncgcnnnngcaggctcannnnnnnccncnnntcnggncnncnnnggcgnnannngnncgctcncnancncnngnnngcnnngnnngccnnnancaannnnnnncnnccgntcnnncnnnngtnnnnnncnctccntncanagnntnnnncnnngnntnngnnggcttcctctacngnnttaanncnacngnccctnagnttncgcangnnnntcnnnannnncccccnnnnnngcnnccnncgnnnccggcccnnttcnaanncnnagcccnncagcnccnngnntncctccgggaatgacatggaccactctccatcctcattctgagactggaccatgatctgaaagaacgtccgcttctcatcgtatggcccaggggtcttgcctgggaagaactctgcccacaggtgggcggtggtctccgcaagctccacccccagggcctccgtgtagccgaaatagcttgtcgggtcctctttgaactctgccaggaagtctccctccaggtcatccgggggcggctgccagccctccatctcttccactgagcggagatggtaggtgctgggc

SEQ ID NO: 112 - DNA, 4000 bp, Escherichia coli
  misc_feature (897)..(897): n is a, c, g, or t
  misc_feature (1957)..(1958): n is a, c, g, or t
  misc_feature (1966)..(1967): n is a, c, g, or t
  misc_feature (1972)..(1973): n is a, c, g, or t
  misc_feature (1975)..(1976): n is a, c, g, or t
  misc_feature (1978)..(1978): n is a, c, g, or t
  misc_feature (1985)..(1985): n is a, c, g, or t
  misc_feature (1987)..(1987): n is a, c, g, or t
  misc_feature (1990)..(1990): n is a, c, g, or t
  misc_feature (1994)..(1994): n is a, c, g, or t
  misc_feature (1996)..(1997): n is a, c, g, or t
  misc_feature (1999)..(2000): n is a, c, g, or t
  misc_feature (2008)..(2009): n is a, c, g, or t
  misc_feature (2015)..(2015): n is a, c, g, or t
  misc_feature (2019)..(2019): n is a, c, g, or t
  misc_feature (3405)..(3405): n is a, c, g, or t
  misc_feature (3459)..(3459): n is a, c, g, or t
ttcgatggaatcattcaggacggaatattgcagcatgtcggaactgcaatggttgtaaaagaatcggaagcaatgattatcaacgttggtgtcggacgagcctggttcaatcacacttggacgctgaatgacgctctgttaccgttagtagttccacagtccgagattctgctgaaccgatatgatgcagttgtgcttgaagtggattcgagagaggccgtcagagcaaatgacatcaaaatcattaaaggaaccccagcatcgaatccaacgaaacctacgatggtgaagacaaatgatcgctggcaatatccgctggcgtatatttatgtcggcgccggagttacttctattcgacaggcaaacatcacgaactgcgttggaacttcagagtgtccattcgtaacggctccattggacaaggtcgaaatcgatgatttgattgctcaatggcaggaccagtggaaagagttctacgaaaagcagactactgatatggaagaaacaaataagttttggaaagagcagtggtctacctggtttctggcacagactgaggagattcagtctgcatatttgacatgggaagctcagtggaacctttggtactcggagcatacagcagatatggaagccacaagtacctattggaaagaaaaatgggaggcgtggttcaacgaatacacaagcatcaatactgcggaaatggctgactggaaacagaagtcagaaacagaatttcgagaatggtttgatcagttacaggcactgttagatggcaatacggcggcaagccttgctaagaagctgctggaattgcaggagcaggtagatattcttaaccagttcagttccaaccttgaaaacgaatacacggtatatcagaagctttatganaatggataccgtacttacggagacgtgctcgattcttcggacgcacccattactgacagcaatttggatacggtcattggacgtacatattccagtgatcttctccgtgacagcaatggcgatgttatcgaaggtcgggctatttttgtcatcaaataaaggaggattcattaaatgaaaatcacagactacgaaaaggtccaggcgttagcagcaagtaatattttcctgcttgacggacctaacgggacaaagaccattgcggcagatgctttagcaaaggcgttaatcggtcttttaagttccaaagattttatcggaggagtaaatctttccgaactcacccagatcaacgagctggtatccggtaacaaattactcgtcgggactacggacggaaacaaggctattgcagctgaagacgcactctttgctatgcttgatggctttgctccggtggagcttcgccgggtactcttcagaggcaagaatcttggtacagcgctgaccgcagtacagaaagctgctattaaggacggttcctttaaaggaatgttccttggcgactattggagtatcggaggtcgtatttggcgtatcgttgatatggattactggtacaactgcggtgatactgcatttaccagccatcatctcgttatcatgccggatgaggcgctttacaatgcgcagatgaatactaccaatgttacgaccggtggatatgtgggctctgcgatgtacaagagtaacttggcaaacgccaaaacaatcgtaaatgcggctttccaggggtctgttcttactcacagagaatacctgtgcaatgcggttgcaaatggaagaccgtcaggtggagcatggttcgattccagcattgagctcccgaacgaacctatgatgtatggccatcctcatttcagtccaacttctgatggttcaacagttccgagtatctacacaatcagcaagactcagctggcgctgttcatggtatgtccgagattcatcgtaaacagatcttacaaccagtggttaagagacgtcgtttcttcggctnnctttgccnntgtgnncnncnatggcantncgnactncnncnncgcttcgnnctcttntggngttcgtccggtcttcccggttggttaattaaaatcgcggggccttgtgccccgtttatatttttgaaaggagcttctaatcatggaagagaaaatctataaaattattctcggtgatggaactgagatttccaatcttaagctgaacggaaacaatttcatttctacagaaaaaatcgaggaatctgtatttgcagataactgctctccggttactatcagcgacggaacaaccgagactgttcatccgaacatggagctggttcagatcgttgagcaggttcctggcgaatactggtttgtccttagagatatttctgaggaggagtttgccagaaccaaaatgcagtctgacatcgcctacattgcgatgatgtccaatgtagagctttaagaaggaggatcaccatggaacatagcaagaattacagtaaagtaaagctttggtacagcatgaaaatgtggaatgagaccagagttcgtaatgcggtgaagatgggctggatcaccaaagaggagttcgctgagatcaccggtaaagattacgaatgagcgttctgttaggcgacagaaaagagtcaaaattcgaagcgattacgtactcgatcgagttgcatgatatgctgatactccttatgcagaggggatttggtgttaaggatgtggacggctttgttcggaagaagtatgcgtatggagaaatttcggaagaaaactttgctaagtacagggaactgatgcggagtttcaaatcgaaagtaaaccagtgtgcttccctgataacgagcaatgttagagcggcaaacaccatttacccacggacaatgcacgagtacgagaccaggagagattaccagaatgcggccattgtaaattgcgagcagctcatcaacgagttgcagcgggttgttgaaatattcgatgtagatctgaatgtgtacaaccggtatgttaaagctatcgaccgagaaatcggattgataaaaaggtggcgtcaaagagacatggcgattaagtcgcggttagaaaaagggtaacatctaaaaaattgcgtcgtttcttcggctaactttgccaatgtgaacaacaatggcaatacgaactacaacaacgcttcgaactctaatggagttcgtccggattcttcgattaaccaacgaagaaggagatgctatccgttccgcaaggataaataataaagcctaatacaatttactacggtaagtattgttataacggtgaataggttatgaactacgaggagattgtctgtgacgccaataacttgtatagggcttataaggtctctgtgaaaagcagcaagtggaaagaatcgacgcaaaaattcatgatgaatttcctgcggtatatatttgaaatccaagangatctaataaatcggacacttcaaaatggaccgacacaggaattcgagctgcangaaagaggccgaataagacctattacaagcattcaaatccgcgatcgcattgtccgacattctctgtgcgatgaggttttacttccagaagttagaaaacatatcatttatgataactgcgcatctatcaaggggcgcggaatttcacaacagagaaaacgattcgaaatccatctccacaaatactaccaattatacggaaatgacggttatattctattcggtgacttttcaaagttctatgacaatattatccatgagattgctaaacgagaattgttgaagctgttcaatgacgatgagtttattgactggcttttaacgttgatatttaaaggtttccagatcgatgtttcgtatatgtctgacgaggaatacgagacctgtatgatcgatactttcaataaactggagtatcggaatattccaaaagagaagctcactggcgaaaagtggatggagaagtccgtcaatattggggatcaactttcacaagtcattggaatttattatccatatccgattgacaattacgtcaagt

SEQ ID NO: 113 - DNA, 4000 bp, Escherichia coli
  misc_feature (118)..(118): n is a, c, g, or t
  misc_feature (223)..(223): n is a, c, g, or t
  misc_feature (226)..(226): n is a, c, g, or t
  misc_feature (541)..(541): n is a, c, g, or t
  misc_feature (1991)..(1991): n is a, c, g, or t
  misc_feature (2123)..(2125): n is a, c, g, or t
  misc_feature (2127)..(2128): n is a, c, g, or t
  misc_feature (2130)..(2130): n is a, c, g, or t
  misc_feature (2132)..(2133): n is a, c, g, or t
  misc_feature (2135)..(2135): n is a, c, g, or t
  misc_feature (2137)..(2137): n is a, c, g, or t
  misc_feature (2141)..(2142): n is a, c, g, or t
  misc_feature (2144)..(2144): n is a, c, g, or t
  misc_feature (2148)..(2150): n is a, c, g, or t
  misc_feature (2153)..(2155): n is a, c, g, or t
  misc_feature (2157)..(2157): n is a, c, g, or t
  misc_feature (2160)..(2165): n is a, c, g, or t
  misc_feature (2167)..(2168): n is a, c, g, or t
  misc_feature (2170)..(2176): n is a, c, g, or t
  misc_feature (2182)..(2187): n is a, c, g, or t
  misc_feature (2189)..(2189): n is a, c, g, or t
  misc_feature (2193)..(2198): n is a, c, g, or t
  misc_feature (2200)..(2203): n is a, c, g, or t
  misc_feature (2205)..(2205): n is a, c, g, or t
  misc_feature (2207)..(2215): n is a, c, g, or t
  misc_feature (2218)..(2229): n is a, c, g, or t
  misc_feature (2232)..(2233): n is a, c, g, or t
  misc_feature (2235)..(2237): n is a, c, g, or t
  misc_feature (2240)..(2242): n is a, c, g, or t
  misc_feature (2244)..(2245): n is a, c, g, or t
  misc_feature (2247)..(2249): n is a, c, g, or t
  misc_feature (2251)..(2256): n is a, c, g, or t
  misc_feature (2258)..(2260): n is a, c, g, or t
  misc_feature (2262)..(2265): n is a, c, g, or t
  misc_feature (2267)..(2277): n is a, c, g, or t
  misc_feature (2279)..(2280): n is a, c, g, or t
  misc_feature (2284)..(2285): n is a, c, g, or t
  misc_feature (2287)..(2290): n is a, c, g, or t
  misc_feature (2294)..(2294): n is a, c, g, or t
  misc_feature (2296)..(2299): n is a, c, g, or t
  misc_feature (2301)..(2303): n is a, c, g, or t
  misc_feature (2308)..(2311): n is a, c, g, or t
  misc_feature (2313)..(2313): n is a, c, g, or t
  misc_feature (2316)..(2323): n is a, c, g, or t
  misc_feature (2325)..(2325): n is a, c, g, or t
  misc_feature (2328)..(2330): n is a, c, g, or t
  misc_feature (2332)..(2338): n is a, c, g, or t
  misc_feature (2340)..(2341): n is a, c, g, or t
  misc_feature (2343)..(2344): n is a, c, g, or t
  misc_feature (2347)..(2350): n is a, c, g, or t
  misc_feature (2352)..(2355): n is a, c, g, or t
  misc_feature (2358)..(2376): n is a, c, g, or t
  misc_feature (2378)..(2378): n is a, c, g, or t
  misc_feature (2381)..(2382): n is a, c, g, or t
  misc_feature (2384)..(2386): n is a, c, g, or t
  misc_feature (2388)..(2391): n is a, c, g, or t
  misc_feature (2394)..(2394): n is a, c, g, or t
  misc_feature (2398)..(2399): n is a, c, g, or t
  misc_feature (2401)..(2403): n is a, c, g, or t
  misc_feature (2405)..(2405): n is a, c, g, or t
  misc_feature (2408)..(2410): n is a, c, g, or t
  misc_feature (2414)..(2416): n is a, c, g, or t
  misc_feature (2419)..(2419): n is a, c, g, or t
  misc_feature (2421)..(2421): n is a, c, g, or t
  misc_feature (2423)..(2426): n is a, c, g, or t
  misc_feature (2429)..(2431): n is a, c, g, or t
  misc_feature (2434)..(2435): n is a, c, g, or t
  misc_feature (2437)..(2439): n is a, c, g, or t
  misc_feature (2441)..(2442): n is a, c, g, or t
  misc_feature (2446)..(2446): n is a, c, g, or t
  misc_feature (2448)..(2449): n is a, c, g, or t
  misc_feature (2451)..(2452): n is a, c, g, or t
  misc_feature (2454)..(2461): n is a, c, g, or t
  misc_feature (2463)..(2467): n is a, c, g, or t
  misc_feature (2469)..(2469): n is a, c, g, or t
  misc_feature (2471)..(2471): n is a, c, g, or t
  misc_feature (2473)..(2476): n is a, c, g, or t
  misc_feature (2478)..(2490): n is a, c, g, or t
  misc_feature (2492)..(2492): n is a, c, g, or t
  misc_feature (2494)..(2502): n is a, c, g, or t
  misc_feature (2504)..(2504): n is a, c, g, or t
  misc_feature (2506)..(2510): n is a, c, g, or t
  misc_feature (2512)..(2516): n is a, c, g, or t
  misc_feature (2519)..(2520): n is a, c, g, or t
  misc_feature (2522)..(2522): n is a, c, g, or t
  misc_feature (2526)..(2527): n is a, c, g, or t
  misc_feature (2529)..(2532): n is a, c, g, or t
  misc_feature (2535)..(2538): n is a, c, g, or t
  misc_feature (2540)..(2541): n is a, c, g, or t
  misc_feature (2543)..(2543): n is a, c, g, or t
  misc_feature (2546)..(2547): n is a, c, g, or t
  misc_feature (2549)..(2552): n is a, c, g, or t
  misc_feature (2554)..(2562): n is a, c, g, or t
  misc_feature (2564)..(2564): n is a, c, g, or t
  misc_feature (2566)..(2568): n is a, c, g, or t
  misc_feature (2570)..(2573): n is a, c, g, or t
  misc_feature (2575)..(2576): n is a, c, g, or t
  misc_feature (2580)..(2580): n is a, c, g, or t
  misc_feature (2582)..(2582): n is a, c, g, or t
  misc_feature (2584)..(2588): n is a, c, g, or t
  misc_feature (2590)..(2593): n is a, c, g, or t
  misc_feature (2595)..(2601): n is a, c, g, or t
  misc_feature (2603)..(2604): n is a, c, g, or t
  misc_feature (2606)..(2614): n is a, c, g, or t
  misc_feature (2616)..(2616): n is a, c, g, or t
  misc_feature (2618)..(2618): n is a, c, g, or t
  misc_feature (2621)..(2627): n is a, c, g, or t
  misc_feature (2630)..(2630): n is a, c, g, or t
  misc_feature (2632)..(2633): n is a, c, g, or t
  misc_feature (2635)..(2637): n is a, c, g, or t
  misc_feature (2639)..(2639): n is a, c, g, or t
  misc_feature (2641)..(2645): n is a, c, g, or t
  misc_feature (2647)..(2655): n is a, c, g, or t
  misc_feature (2657)..(2659): n is a, c, g, or t
  misc_feature (2662)..(2666): n is a, c, g, or t
  misc_feature (2668)..(2668): n is a, c, g, or t
  misc_feature (2670)..(2684): n is a, c, g, or t
  misc_feature (2686)..(2690): n is a, c, g, or t
  misc_feature (2692)..(2696): n is a, c, g, or t
  misc_feature (2698)..(2698): n is a, c, g, or t
  misc_feature (2700)..(2704): n is a, c, g, or t
  misc_feature (2707)..(2707): n is a, c, g, or t
  misc_feature (2709)..(2714): n is a, c, g, or t
  misc_feature (2718)..(2722): n is a, c, g, or t
  misc_feature (2724)..(2725): n is a, c, g, or t
  misc_feature (2727)..(2727): n is a, c, g, or t
  misc_feature (2729)..(2736): n is a, c, g, or t
  misc_feature (2738)..(2740): n is a, c, g, or t
  misc_feature (2742)..(2742): n is a, c, g, or t
  misc_feature (2744)..(2744): n is a, c, g, or t
  misc_feature (2746)..(2747): n is a, c, g, or t
  misc_feature (2749)..(2751): n is a, c, g, or t
  misc_feature (2753)..(2755): n is a, c, g, or t
  misc_feature (2758)..(2759): n is a, c, g, or t
  misc_feature (2762)..(2762): n is a, c, g, or t
  misc_feature (2765)..(2766): n is a, c, g, or t
  misc_feature (2768)..(2768): n is a, c, g, or t
  misc_feature (2770)..(2771): n is a, c, g, or t
  misc_feature (2773)..(2774): n is a, c, g, or t
  misc_feature (2776)..(2777): n is a, c, g, or t
  misc_feature (2779)..(2781): n is a, c, g, or t
  misc_feature (2784)..(2789): n is a, c, g, or t
  misc_feature (2791)..(2795): n is a, c, g, or t
  misc_feature (2797)..(2797): n is a, c, g, or t
  misc_feature (2799)..(2801): n is a, c, g, or t
  misc_feature (2803)..(2805): n is a, c, g, or t
  misc_feature (2807)..(2807): n is a, c, g, or t
  misc_feature (2809)..(2810): n is a, c, g, or t
  misc_feature (2812)..(2817): n is a, c, g, or t
  misc_feature (2819)..(2819): n is a, c, g, or t
  misc_feature (2821)..(2822): n is a, c, g, or t
  misc_feature (2824)..(2826): n is a, c, g, or t
  misc_feature (2828)..(2828): n is a, c, g, or t
  misc_feature (2830)..(2837): n is a, c, g, or t
  misc_feature (2840)..(2841): n is a, c, g, or t
  misc_feature (2843)..(2844): n is a, c, g, or t
  misc_feature (2846)..(2847): n is a, c, g, or t
  misc_feature (2849)..(2855): n is a, c, g, or t
  misc_feature (2858)..(2859): n is a, c, g, or t
  misc_feature (2861)..(2861): n is a, c, g, or t
  misc_feature (2863)..(2865): n is a, c, g, or t
  misc_feature (2867)..(2869): n is a, c, g, or t
  misc_feature (2872)..(2879): n is a, c, g, or t
  misc_feature (2881)..(2882): n is a, c, g, or t
  misc_feature (2884)..(2886): n is a, c, g, or t
  misc_feature (2888)..(2888): n is a, c, g, or t
  misc_feature (2892)..(2899): n is a, c, g, or t
  misc_feature (2901)..(2901): n is a, c, g, or t
  misc_feature (2903)..(2903): n is a, c, g, or t
  misc_feature (2905)..(2907): n is a, c, g, or t
  misc_feature (2909)..(2910): n is a, c, g, or t
  misc_feature (2912)..(2913): n is a, c, g, or t
  misc_feature (2915)..(2916): n is a, c, g, or t
  misc_feature (2918)..(2919): n is a, c, g, or t
  misc_feature (2921)..(2923): n is a, c, g, or t
  misc_feature (2926)..(2926): n is a, c, g, or t
  misc_feature (2928)..(2929): n is a, c, g, or t
  misc_feature (2933)..(2935): n is a, c, g, or t
  misc_feature (2937)..(2937): n is a, c, g, or t
  misc_feature (2939)..(2940): n is a, c, g, or t
  misc_feature (2942)..(2942): n is a, c, g, or t
  misc_feature (2944)..(2944): n is a, c, g, or t
  misc_feature (2946)..(2951): n is a, c, g, or t
  misc_feature (2953)..(2962): n is a, c, g, or t
  misc_feature (2965)..(2971): n is a, c, g, or t
  misc_feature (2973)..(2973): n is a, c, g, or t
  misc_feature (2975)..(2975): n is a, c, g, or t
  misc_feature (2977)..(2982): n is a, c, g, or t
  misc_feature (2984)..(2992): n is a, c, g, or t
  misc_feature (2994)..(2997): n is a, c, g, or t
  misc_feature (3000)..(3004): n is a, c, g, or t
  misc_feature (3006)..(3009): n is a, c, g, or t
  misc_feature (3011)..(3018): n is a, c, g, or t
  misc_feature (3020)..(3023): n is a, c, g, or t
  misc_feature (3025)..(3031): n is a, c, g, or t
  misc_feature (3033)..(3039): n is a, c, g, or t
  misc_feature (3041)..(3041): n is a, c, g, or t
  misc_feature (3043)..(3048): n is a, c, g, or t
  misc_feature (3050)..(3052): n is a, c, g, or t
  misc_feature (3054)..(3055): n is a, c, g, or t
  misc_feature (3057)..(3068): n is a, c, g, or t
  misc_feature (3070)..(3070): n is a, c, g, or t
  misc_feature (3072)..(3074): n is a, c, g, or t
  misc_feature (3077)..(3078): n is a, c, g, or t
  misc_feature (3080)..(3084): n is a, c, g, or t
  misc_feature (3086)..(3086): n is a, c, g, or t
  misc_feature (3088)..(3088): n is a, c, g, or t
  misc_feature (3090)..(3090): n is a, c, g, or t
  misc_feature (3093)..(3094): n is a, c, g, or t
  misc_feature (3096)..(3096): n is a, c, g, or t
  misc_feature (3098)..(3101): n is a, c, g, or t
  misc_feature (3103)..(3104): n is a, c, g, or t
  misc_feature (3107)..(3109): n is a, c, g, or t
  misc_feature (3111)..(3120): n is a, c, g, or t
  misc_feature (3122)..(3126): n is a, c, g, or t
  misc_feature (3128)..(3128): n is a, c, g, or t
  misc_feature (3130)..(3132): n is a, c, g, or t
  misc_feature (3134)..(3134): n is a, c, g, or t
  misc_feature (3137)..(3139): n is a, c, g, or t
  misc_feature (3141)..(3144): n is a, c, g, or t
  misc_feature (3147)..(3148): n is a, c, g, or t
  misc_feature (3152)..(3155): n is a, c, g, or t
  misc_feature (3157)..(3157): n is a, c, g, or t
  misc_feature (3159)..(3159): n is a, c, g, or t
  misc_feature (3161)..(3161): n is a, c, g, or t
  misc_feature (3164)..(3164): n is a, c, g, or t
  misc_feature (3166)..(3167): n is a, c, g, or t
  misc_feature (3170)..(3173): n is a, c, g, or t
  misc_feature (3175)..(3177): n is a, c, g, or t
  misc_feature (3179)..(3184): n is a, c, g, or t
  misc_feature (3186)..(3187): n is a, c, g, or t
  misc_feature (3189)..(3195): n is a, c, g, or t
  misc_feature (3197)..(3197): n is a, c, g, or t
  misc_feature (3199)..(3200): n is a, c, g, or t
  misc_feature (3202)..(3203): n is a, c, g, or t
  misc_feature (3207)..(3210): n is a, c, g, or t
  misc_feature (3212)..(3212): n is a, c, g, or t
  misc_feature (3214)..(3214): n is a, c, g, or t
  misc_feature (3217)..(3217): n is a, c, g, or t
  misc_feature (3220)..(3221): n is a, c, g, or t
  misc_feature (3224)..(3234): n is a, c, g, or t
  misc_feature (3236)..(3239): n is a, c, g, or t
  misc_feature (3241)..(3247): n is a, c, g, or t
  misc_feature (3249)..(3254): n is a, c, g, or t
  misc_feature (3256)..(3258): n is a, c, g, or t
  misc_feature (3260)..(3263): n is a, c, g, or t
  misc_feature (3266)..(3270): n is a, c, g, or t
  misc_feature (3272)..(3273): n is a, c, g, or t
  misc_feature (3275)..(3276): n is a, c, g, or t
  misc_feature (3279)..(3286): n is a, c, g, or t
  misc_feature (3288)..(3289): n is a, c, g, or t
  misc_feature (3291)..(3292): n is a, c, g, or t
  misc_feature (3294)..(3298): n is a, c, g, or t
  misc_feature (3301)..(3302): n is a, c, g, or t
  misc_feature (3304)..(3305): n is a, c, g, or t
  misc_feature (3308)..(3309): n is a, c, g, or t
  misc_feature (3311)..(3311): n is a, c, g, or t
  misc_feature (3314)..(3314): n is a, c, g, or t
  misc_feature (3317)..(3321): n is a, c, g, or t
  misc_feature (3323)..(3324): n is a, c, g, or t
  misc_feature (3326)..(3330): n is a, c, g, or t
  misc_feature (3332)..(3333): n is a, c, g, or t
  misc_feature (3335)..(3337): n is a, c, g, or t
  misc_feature (3339)..(3339): n is a, c, g, or t
  misc_feature (3341)..(3341): n is a, c, g, or t
  misc_feature (3343)..(3343): n is a, c, g, or t
  misc_feature (3345)..(3350): n is a, c, g, or t
  misc_feature (3352)..(3356): n is a, c, g, or t
  misc_feature (3358)..(3359): n is a, c, g, or t
  misc_feature (3361)..(3363): n is a, c, g, or t
  misc_feature (3365)..(3365): n is a, c, g, or t
  misc_feature (3367)..(3370): n is a, c, g, or t
  misc_feature (3372)..(3377): n is a, c, g, or t
  misc_feature (3379)..(3380): n is a, c, g, or t
  misc_feature (3382)..(3382): n is a, c, g, or t
  misc_feature (3384)..(3386): n is a, c, g, or t
  misc_feature (3388)..(3392): n is a, c, g, or t
  misc_feature (3394)..(3397): n is a, c, g, or t
  misc_feature (3399)..(3400): n is a, c, g, or t
  misc_feature (3402)..(3407): n is a, c, g, or t
  misc_feature (3409)..(3413): n is a, c, g, or t
  misc_feature (3415)..(3415): n is a, c, g, or t
  misc_feature (3417)..(3420): n is a, c, g, or t
  misc_feature (3422)..(3426): n is a, c, g, or t
  misc_feature (3428)..(3428): n is a, c, g, or t
  misc_feature (3430)..(3433): n is a, c, g, or t
  misc_feature (3435)..(3438): n is a, c, g, or t
  misc_feature (3440)..(3441): n is a, c, g, or t
  misc_feature (3444)..(3447): n is a, c, g, or t
  misc_feature (3449)..(3451): n is a, c, g, or t
  misc_feature (3454)..(3457): n is a, c, g, or t
  misc_feature (3459)..(3459): n is a, c, g, or t
  misc_feature (3461)..(3464): n is a, c, g, or t
  misc_feature (3466)..(3466): n is a, c, g, or t
  misc_feature (3468)..(3469): n is a, c, g, or t
  misc_feature (3471)..(3473): n is a, c, g, or t
  misc_feature (3475)..(3475): n is a, c, g, or t
  misc_feature (3477)..(3486): n is a, c, g, or t
  misc_feature (3488)..(3488): n is a, c, g, or t
  misc_feature (3490)..(3490): n is a, c, g, or t
  misc_feature (3492)..(3492): n is a, c, g, or t
  misc_feature (3495)..(3500): n is a, c, g, or t
  misc_feature (3503)..(3507): n is a, c, g, or t
  misc_feature (3509)..(3512): n is a, c, g, or t
  misc_feature (3514)..(3517): n is a, c, g, or t
  misc_feature (3519)..(3524): n is a, c, g, or t
  misc_feature (3527)..(3528): n is a, c, g, or t
  misc_feature (3531)..(3532): n is a, c, g, or t
  misc_feature (3534)..(3534): n is a, c, g, or t
  misc_feature (3536)..(3538): n is a, c, g, or t
  misc_feature (3541)..(3544): n is a, c, g, or t
  misc_feature (3546)..(3547): n is a, c, g, or t
  misc_feature (3553)..(3557): n is a, c, g, or t
  misc_feature (3559)..(3563): n is a, c, g, or t
  misc_feature (3566)..(3566): n is a, c, g, or t
  misc_feature (3568)..(3568): n is a, c, g, or t
  misc_feature (3571)..(3571): n is a, c, g, or t
  misc_feature (3573)..(3575): n is a, c, g, or t
  misc_feature (3577)..(3577): n is a, c, g, or t
  misc_feature (3579)..(3583): n is a, c, g, or t
  misc_feature (3585)..(3590): n is a, c, g, or t
  misc_feature (3592)..(3592): n is a, c, g, or t
  misc_feature (3594)..(3595): n is a, c, g, or t
  misc_feature (3597)..(3597): n is a, c, g, or t
  misc_feature (3599)..(3599): n is a, c, g, or t
  misc_feature (3602)..(3603): n is a, c, g, or t
  misc_feature (3605)..(3606): n is a, c, g, or t
  misc_feature (3611)..(3614): n is a, c, g, or t
  misc_feature (3616)..(3616): n is a, c, g, or t
  misc_feature (3618)..(3619): n is a, c, g, or t
  misc_feature (3621)..(3621): n is a, c, g, or t
  misc_feature (3623)..(3624): n is a, c, g, or t
  misc_feature (3626)..(3630): n is a, c, g, or t
  misc_feature (3633)..(3638): n is a, c, g, or t
  misc_feature (3642)..(3642): n is a, c, g, or t
  misc_feature (3644)..(3645): n is a, c, g, or t
  misc_feature (3647)..(3647): n is a, c, g, or t
  misc_feature (3649)..(3652): n is a, c, g, or t
  misc_feature (3654)..(3661): n is a, c, g, or t
  misc_feature (3663)..(3665): n is a, c, g, or t
  misc_feature (3667)..(3668): n is a, c, g, or t
  misc_feature (3670)..(3670): n is a, c, g, or t
  misc_feature (3672)..(3676): n is a, c, g, or t
  misc_feature (3678)..(3678): n is a, c, g, or t
  misc_feature (3680)..(3680): n is a, c, g, or t
  misc_feature (3682)..(3682): n is a, c, g, or t
  misc_feature (3684)..(3684): n is a, c, g, or t
  misc_feature (3687)..(3687): n is a, c, g, or t
  misc_feature (3689)..(3689): n is a, c, g, or t
  misc_feature (3693)..(3694): n is a, c, g, or t
  misc_feature (3696)..(3698): n is a, c, g, or t
  misc_feature (3700)..(3701): n is a, c, g, or t
  misc_feature (3707)..(3708): n is a, c, g, or t
  misc_feature (3710)..(3719): n is a, c, g, or t
  misc_feature (3723)..(3725): n is a, c, g, or t
  misc_feature (3728)..(3729): n is a, c, g, or t
  misc_feature (3731)..(3731): n is a, c, g, or t
  misc_feature (3733)..(3741): n is a, c, g, or t
  misc_feature (3743)..(3744): n is a, c, g, or t
  misc_feature (3746)..(3746): n is a, c, g, or t
  misc_feature (3748)..(3753): n is a, c, g, or t
  misc_feature (3755)..(3757): n is a, c, g, or t
  misc_feature (3759)..(3763): n is a, c, g, or t
  misc_feature (3765)..(3767): n is a, c, g, or t
  misc_feature (3769)..(3769): n is a, c, g, or t
  misc_feature (3771)..(3771): n is a, c, g, or t
  misc_feature (3773)..(3778): n is a, c, g, or t
  misc_feature (3780)..(3781): n is a, c, g, or t
  misc_feature (3783)..(3783): n is a, c, g, or t
  misc_feature (3785)..(3785): n is a, c, g, or t
  misc_feature (3787)..(3787): n is a, c, g, or t
  misc_feature (3790)..(3790): n is a, c, g, or t
  misc_feature (3792)..(3793): n is a, c, g, or t
  misc_feature (3795)..(3795): n is a, c, g, or t
  misc_feature (3797)..(3797): n is a, c, g, or t
  misc_feature (3799)..(3799): n is a, c, g, or t
  misc_feature (3801)..(3802): n is a, c, g, or t
  misc_feature (3804)..(3810): n is a, c, g, or t
  misc_feature (3812)..(3814): n is a, c, g, or t
  misc_feature (3816)..(3819): n is a, c, g, or t
  misc_feature (3821)..(3823): n is a, c, g, or t
  misc_feature (3825)..(3825): n is a, c, g, or t
  misc_feature (3827)..(3832): n is a, c, g, or t
  misc_feature (3834)..(3835): n is a, c, g, or t
  misc_feature (3837)..(3840): n is a, c, g, or t
  misc_feature (3842)..(3844): n is a, c, g, or t
  misc_feature (3846)..(3846): n is a, c, g, or t
  misc_feature (3848)..(3852): n is a, c, g, or t
  misc_feature (3856)..(3859): n is a, c, g, or t
  misc_feature (3862)..(3862): n is a, c, g, or t
  misc_feature (3864)..(3869): n is a, c, g, or t
  misc_feature (3873)..(3874): n is a, c, g, or t
  misc_feature (3878)..(3879): n is a, c, g, or t
  misc_feature (3881)..(3882): n is a, c, g, or t
  misc_feature (3885)..(3892): n is a, c, g, or t
  misc_feature (3894)..(3894): n is a, c, g, or t
  misc_feature (3896)..(3898): n is a, c, g, or t
  misc_feature (3900)..(3906): n is a, c, g, or t
  misc_feature (3908)..(3909): n is a, c, g, or t
  misc_feature (3912)..(3912): n is a, c, g, or t
  misc_feature (3914)..(3918): n is a, c, g, or t
  misc_feature (3921)..(3925): n is a, c, g, or t
  misc_feature (3928)..(3928): n is a, c, g, or t
  misc_feature (3930)..(3931): n is a, c, g, or t
  misc_feature (3933)..(3934): n is a, c, g, or t
  misc_feature (3936)..(3939): n is a, c, g, or t
  misc_feature (3941)..(3943): n is a, c, g, or t
  misc_feature (3945)..(3946): n is a, c, g, or t
  misc_feature (3948)..(3951): n is a, c, g, or t
  misc_feature (3953)..(3955): n is a, c, g, or t
  misc_feature (3957)..(3964): n is a, c, g, or t
  misc_feature (3966)..(3969): n is a, c, g, or t
  misc_feature (3971)..(3973): n is a, c, g, or t
  misc_feature (3975)..(3976): n is a, c, g, or t
  misc_feature (3978)..(3982): n is a, c, g, or t
  misc_feature (3984)..(3985): n is a, c, g, or t
  misc_feature (3987)..(3990): n is a, c, g, or t
  misc_feature (3992)..(3994): n is a, c, g, or t
  misc_feature (3997)..(4000): n is a, c, g, or t
cgaccaaccggcttggcaggaactcactagcctggaagatgtgaaaggctttgtagagaaggtgggctatccggtactggtgcgtccgtcttacgtactctccggtgctgcgatgaangtatgctacgatgaagaagaactggaaaacttcttgaagatggctgctgaggtatctaaggaatatccggtggtggtatcccagttcttgcagaacaccaagganatngagttcgacgctgttgcccaaaacggtgaagtggtggaatacgccatctccgagcacgtagagtttgccggtgtacactccggtgacgctacgctggtattcccggcacagaagatttactttgcaacggcacgccgcatcaagaaaatcagccgccagattgcgaaggaactcaatatttccggtcctttcaatatccagttcctggcacgcaacaacgaggtgaaggttatcgagtgtaacctccgtgcatcgcgcagcttcccgttcgtatccaaggtgctgaagcgtaacttcatcgagactgctacccgnatcatgctggacgctccctatacacaaccggacaagtcggcattcgacatcgaccgtatcggtgtgaaggcaagccagttctccttctcccgtctgcacaaggcagacccggtattgggtgtggacatgtcgtctacgggcgaggtaggctgtattggcgacgacttctccgaagcattgctgaatgccatgattgctaccggattcagaatcccccgtcccgagaagggcgtgatgttctcctccggagccatgaagtccaaggtggatttgctggatgccagccgcatgctctttgccaaaggctataagatttatgctacggcaggtacagccgctttcctcaacgcccatggcgtgacgacggaagccgtttactggccggatgaacgcccggatgcggaaaacaacgtgatgacgatgattgccgaccatgccttcgacctgattgtcaacattccgaagaaccatacgaaacgcgagctgaccaatggctacaagattcgtcgcggtgccatcgaccacaacattccgttgattaccaatgcccgcctggcaagtgcctttatcgaggcattctgcgaaatgaagctggaagatatccagattaagagctggcaggagtacaaataaattgtttgctctataaacgattgcaggagcggaaagccgaaaggttttccgctcttttggtatactgcgtttatttccgtatttttgttcggggctgagtctctgtatgaatcaaaagaagaaataatatgaatgaagtggaaaaaatgcgtagctcccagttggcggatatgtccgttccggagatacaggtgaagttcgagcatgccaagcgcttgctggcaaaaatgcgtgtgatgagtacttacgatgaggattaccggagtttgctggaggaactggtgccaggtattcccgctacttccatcatctgcccgcccttccattgcgaccacggggatgggatccggctgggtgagcatgtctttgtcaatgccaattgcactttcctggacgggggatatatcacgattggtgcccatacgttggtcggtccatgcgtacagatatacactccccatcatccgatggattatatcgagcgtcgtacggaaaaggaatatgcctatccggtgacgataggagaggattgctggattggcggcggtgccattctgtgtccaggcgtcaccatcggcgaccgttgtatcatcggtgcgggtagtgtggtgacgaaagatattccatccgatagcatagccgttggtaatccggcaaaggtcatccggaaaaatgaggcaaaaaagtgaacgtactaaatgcttgagaaacagagcgtgtcgctaaatgactaaaaaaatatcgaaaaatattatgcaaaagttttggtaatgtcaaaataagctgtacctttgcatcgcttttgaaacggaagtgnacgggcgtttagctcagctggttcagagcatctgccttacaagcagagggtcggcggttcgaatccgtcaacgcccactggaaattttcattcgaaggtggtcttgcaagtgattgtaaggccatttttttnnncnntnanntncntttnntnaaannnttnnncnttnnnnnntnntnnnnnnnaaaaannnnnnantttnnnnnncnnnnantnnnnnnnnnaannnnnnnnnnnnaanntnnnttnnntnncnnnannnnnncnnntnnnngnnnnnnnnnnngnnaaanngnnnntttngnnnncnnnttttnnnnanttnnnnnnnntnaannncnnnnnnnanntnnaannnnannnnttnnnnnnnnnnnnnnnnnnncnttnncnnnannnnaangggnngnnnanggnnntttnnnaancntnnnnaannnttnncnnnanntttncnnanncnnnnnnnnannnnntnangnnnntnnnnnnnnnnnnnancnnnnnnnnnangnnnnngnnnnnttnntnaaannannnnttnnnnanntnggnngnnnngnnnnnnnnnangnnntnnnncnntttngncnnnnntnnnnannnnnnnannannnnnnnnntncnttnnnnnnnaangnngnnntngnnnnngnnnnnnnnncnnnaannnnngnannnnnnnnnnnnnnncnnnnntnnnnngnannnnnggncnnnnnncccnnnnntnncnannnnnnnngnnnancngnntnnncnnnccnnttnggnnangnngnnanngnnnttnnnnnncnnnnngnannncnnntngnnannnnnnangnntnnncngnnnnnnnnaanntnngnngnnnnnnnggnnantnnnannnccnnnnnnnngnntnnncngaannnnnnnngnangnnntnngnnannanntnnnttncnnaaannntngnntngnannnnnngnnnnnnnnnnccnnnnnnncnantnnnnnnannnnnnnnncnnnnttnnnnncnnnnannnnnnnnannnngnnnnnnntnnnnnnnancnnnnnntnnngnnannnnnnnnnnnngnannnttnnannnnnanantnaanncngnnnngnnggnnncnnnnnnnnnncnnnnnangnnnanccnnntnnnnttnnaaannnngnangnaancnnggnnnngnnnannnnnntnntnnnnnnntngnngnnaaannnncngnttnccnnttnnnnnnnnnnntnnnngnnnnnnncnnnnnncnnnannnnggnnnnncnntnnggnnnnnnnntnntnncnnnnnaanntnnttnnanggnttnnnnnanntnnnnntnnannnancngncnnnnnncnnnnncnngnnnantnnnngnnnnnngnngncnnngnnnnncnnnncnntnnnnnncnnnnngncnnnncnnnnncntnnnnannnntnnaannnntnnnccnnnncnannnngncnntnnngnannnnnnnnnnangnanttnnnnnnggnnnnnannnnannnnannnnnnaannaannantnnnggnnnntnncccccnnnnntnnnnnggnanttnannnancnnnnnannnnnncngnngnanttnnannttttnnnncngnnantnntnnnnnaannnnnnaaantnnangnnnnannnnnnnnannnanngncnnnnngncnangnttnantttnntnnnannaaaaannannnnnnnnnnaaannnaanntngnnnnnnnnntnntncnnnnnngnnnannnnngnnncngncnnnnnngnnancnanttnannangnangnngnnnnnnncnnncnnnntnnnancnnnnnnanngnnnncnnncntnnnnncccnnnnttnannnnnnaaanngggnncnnccnnnnnnnncntnnnannnnnnncnnccntnnnnnccnnnnnttnanncnngnnnngnnnanngnnnncnnncnnnnnnnncnnnntnnnannannnnnanngnnnncnnnccnnnn

SEQ ID NO: 114 - DNA, 4000 bp, Escherichia coli
  misc_feature (1984)..(1985): n is a, c, g, or t
  misc_feature (1987)..(1988): n is a, c, g, or t
  misc_feature (1992)..(1992): n is a, c, g, or t
  misc_feature (1994)..(1994): n is a, c, g, or t
gcacattggcaaagaattttagccgtatatctatttatttgttttcagactgcaggaatagcagaaatgcgaatggggcaggattatttaaaggctgtaattgttagtattatccttaccccttttggtctatttttctttaaaaaggaatccttaaaatgatgcgaacgttcaagctaatcattatttatattttatgtccagtcgttctttttgggcaaagaacagggttagaaattatggaacaggttaaaaataatcccttaccatcgtcttctattacccatattgaattaacgattgtgacgaaaaaaggaaaacgagaaaagaagaaaatccgagagtttattcgttatcaaaaaaattacgaatcgggtaaatatgaacgaaaaactttggtgcgttttacgaagcccttgtttgttaaaggaacaggcttattaaattggactcaaaaaaatggcgtccaagaacaatggatttttctacccaaattaaaaacagcaaaaaaaattacgtctaaagatagaacaaaatctttcatgggttcagattttatttatgaagatttagaatcacgttctctaaatgaggatacttttactgaatttggtatcgaagttattttcaataccccgtgttatgttatcgaagcgaaaccgaaagaagaaagtgcttatcagtggcaaaaaatttgggttgaaacaagcacttggcaaattaaaaaagtggagtattacaatgaaaaaaataaaatcataaaaacattatcaattcctaagcataaaatcgtaaatggattttatatcccagaaaaaatgaccatgatatctattaaggggaatcaaacaagtatggtgattaacaaagccactatggacgcaggactgcaaaatgatatattttctaagaaatttttaattcgaatcaaataaaccattgacttataaaggagctgttttgtaatatcggaaacgatatatacgaaaaacgtttccattgaccgactcacagacacaacaagaagcatatatactcgaacaaagctttgaagctttgacgcgggatggtgttcgttcattcacagtggattctctgtctcagaatttgggaatgagtaaaaaaacgatttataaatttttcccatcaaaagaagatttagttgataaaagtgtaggatattttcacggattaattgaaaaaaaattaaaacggcttattgaaactgaaccgaatcccgctatccaatttgtgaaagtaatggaatttatcatggggcatatttccaatgtatctattgagagattagcggatttaaaaaaccgttttccgagagtatgggaaaaaatggaaacatttagattagcaagaagagatgatttttttcatgttttatcaaatgcgcaaaaacagggatatgtgagagatgatgtagatattaatattattgctactttatatatgaatattattaattctacgtttcaacccgagttttttctaaaaaataatttggcaccaacggatgcgattcacaattttttaaaaatgatttctggcggtctttttacgccttccggaaatcaatatgtcaataaactatttaataaggaagatttataaatggggcatccaattagagaatgggtcattcaaaaaaccctaaagcatccaaaaagaacgattattatcagtatcctgataacaattttcatggcatcgggcatcaggttttttattgttgacgatgatatgatgaaactattgccaaaagatatgccatctcgtattgcttgggataatgtcatggaagaatttggtaatacagatatgatttatgtggcgtttggtgaaaagggtaagccggggatcaatcaaaaatcattagcaacattatgggatttcacaaaagccatggaggctttgcctgaagtggaaaaagtaacttcaatcacttcaattgaccggttggagagtgaagatnntnntatngnagtcggcgaccttcagaattcacgagaattaacgattgaagaagtggctgaaatcaatcaatacttaaataaaaataaaaatgttaaaaaacaattaatcagccaaagtgatgtttatcttaatgttgttatccagccttctgctcattcaaagtttgatgttctaagtcataaagtgagagatgtgggggatgatattttaagcaagtatgaaacccattatggcggtgctgcctacataacaggtatcgttccaagtctcattcgagatgatgttgctatgttgatgcaatcaggtatgttgattatggtattgattttattggtcaacttaagaagtccagtggctgtaggaatggttatgcttactattgttttgtccctaggatttatgcttgggtttatgggatgggttttaaaattgacaggttcggaaaagtttttattcaccatgatgaatacatctatgcccatcattttattgacaatagccaattcagatggtgttcatatgatggcgaagtttttcaaagaattaagaaatagaagaaatattaaagaatcggtcacagtggcaatggattcattattggtccctatctttttaactagcatcacaacagcggcggcattcttggcacttatttttgcaccgattgagcaaatggtgggatatggtatttcaatatctgccggcattttatgggcgtggattttatcttcaacaatgcttcccgctttgatttcattaaggaaatgggatctaaactctaaagcggttactcaagcaagtatttttgaaaatggtattgatcgactcgcaaagcaagtaacaaagcatccaaaatatatattaacgacaggactccttcttgtctccattggaggcatgggcgtgacgatggtagaagtcgatgtaaattttatgacttttttcaaaaaggggacggaaattcgtgacagtatggacttcttagaagatgaaatgttaggcaccatggatgtgcgtgttcgcgtagaaggcgatttaaaagagccagaacatttacaagcgattgttgacctgcaaacatacatggaggaagatgagaaagtcgggatgagtttttctattgcgaacattgtgcaacaaatgcataaatccattatggatgatgatccgaattttgaaactattccggattcaagagggaaggtaaataatctgttcactatgtattcgttttcaggagatccaaacgcttttgagtccatggtcgattatgattatgaagtgggactcgttacagcattaagtaaaatgatggggacacaagaaattattgtttttgtggataaaattgaaaactacgtgatggatcattttcccgaaggattgtctgctatgattactgggatggccgtagtatatagagatctcgtttttctcattataaaatcatctctcattagtattattgtatccatttttgtaattggagccatagcaagtctgtttttcggaaaatttcattggggaatattagcgattattcccttatctgcagccgtgattctaaattttggttttatggggctgtttgatgtaaagcttagtcatattacggctatattagcctcaatcattattggtgtgggtgtggattttgctattcattatattgctcaatttagacggtattcacgcgatccaaataaggttgacaatttgagccaggaagtcatcgacgatgtgggataccctattattcttgatgcagcttcaaatatgggatttggcgcattattgttttctacttttgtccctattcaatatataggtggtcttatggtttttgccatgatttcaacatcgcttgggactttgactgttttggctgcgctcactgaattattaaaaaaacgaattgttgaacaataggaggttcaaatgaaaaaaatcattttatggataagtctctttggaattggcatggcacaaacaggtatagaaattgcccaaatgg

SEQ ID NO: 115 - DNA, 4000 bp, Escherichia coli
  misc_feature (45)..(45): n is a, c, g, or t
  misc_feature (574)..(574): n is a, c, g, or t
  misc_feature (587)..(588): n is a, c, g, or t
  misc_feature (639)..(639): n is a, c, g, or t
  misc_feature (642)..(642): n is a, c, g, or t
  misc_feature (645)..(645): n is a, c, g, or t
  misc_feature (647)..(648): n is a, c, g, or t
  misc_feature (651)..(651): n is a, c, g, or t
  misc_feature (653)..(653): n is a, c, g, or t
  misc_feature (657)..(658): n is a, c, g, or t
  misc_feature (661)..(661): n is a, c, g, or t
  misc_feature (826)..(826): n is a, c, g, or t
  misc_feature (1984)..(1985): n is a, c, g, or t
  misc_feature (1987)..(1987): n is a, c, g, or t
  misc_feature (1990)..(1990): n is a, c, g, or t
  misc_feature (1993)..(1993): n is a, c, g, or t
  misc_feature (2003)..(2003): n is a, c, g, or t
  misc_feature (2018)..(2018): n is a, c, g, or t
  misc_feature (2023)..(2024): n is a, c, g, or t
  misc_feature (2029)..(2030): n is a, c, g, or t
  misc_feature (2032)..(2033): n is a, c, g, or t
  misc_feature (2044)..(2044): n is a, c, g, or t
  misc_feature (2047)..(2047): n is a, c, g, or t
  misc_feature (2050)..(2051): n is a, c, g, or t
  misc_feature (2056)..(2057): n is a, c, g, or t
aacaaaggacacgctttaaccgaaactacttggtggaaatgtatngctcgtggaacaaccgccacagcagcagctaaaaaggctgaggacgctgctaaactggctaatgaaaaagctacagcagccgatagcgcagcaggtaaggcagtagaggctaccaacaatgccaacgcaaaagctaatgaagctcacgaaaaggcagaagaagccaatactgctaaagataatgcaaatgaagctactggcgatgcaagggtagttatcgcaaggctggaggaactggaagaatcgctaatctcaaaatacaagctgatccctacttccatgaagctaaactacccgaaaaaagttacttacaggaatacccagcctttcaaagttgaggtagaattacttcccgtagatactggtaggaatgtattgtttctcggtgatgatcgggcggtgtctatcactcctgatggcgtatttatgattaacggtgtagggatgagtaaaattcacgttatcccaacggaaaatacgggtatttatcaaactatacagattgaagtacaggagccaggaataaggnttacttctggtannggtatgcgtttatccggctctggtggtatcatattaacttagtaaattttnttnttnannttntnaacnntanaaaatatggcacttacagcagaagaggaagctaaagtaaaaaagattattacagcttacgacaatggcaaaagattaaatgaattaccagtagcagacagcagtaaccctttcgacctcacaactgaggtattggataaaagcggagaaagcaaacaagctggtntggctgctatgctaccttatgcagaggatcaatgtagttatggcgtagaattagatgtaacagtatcttcttcggttcttacccgtactggcaatatgacactgcataaaacattgccaattcaaagcaagatgaaagggtgtttgctatcagatgaaggcaaggttattgaatacctaaaccctaccaactggaaagcgcataaaagggatggttccaatggtatggttatggtggaaatccctgctcactggagaagattttataccaatggaaacaaaagaggtgtacgaatcagtgaatacccgatacctggttatcatttcgtaaagaaatgctatatctcggcttatgaggcaacaatccaacgtagcactggtaaactggcttctgtagtaaatacttcggctgattacagaggtggtaataaccaagcagattgggatgctttgcctaaatcccaattaggcaagccagctacatctacgagtagaacaaactttcgtgctgctgctcgtaaaaggggagctggtacgcaatggaactgcatggactataacgcttatatcactttggcatggctctattacatagagtatggaaaccttaactgccagttggctttcaatgcccagaaagatagcaacgggtatgctcagggtggtttgggtaatggtgtaactacatgggatggtacaaagtggaacaattttagtggttattatcctattattccttgcggtacgagtgatgaattgggaaatgcttctggtgaagtagcttacactttagagaaagcagaaggagaaaacagcaaagtatttaccgtacctcgctatcgtggtattgaaaatcccttcgggcacgtctggaagtggacggatggagtaaatatagaagtgaaaaccaattcagacggaggaacttctaaagtgtatgtttgcgatgatccttctaaatacaacgatagtaactacacaggctatacgcttagaggattggctgcacgtgcagaaggttatgcaaaagaaatgattttcggtgaatttggcgatttgattgcttctgtagtcggaggtggatctactacctattggtgtgattacttctataccaatataggatctaacgctcttaggggtgtccttttcggcggtnntncgnatnatggcgatcntgcgggcttcggttntgcgnntacgnntnncgccccctcgnatncgnntgcgnntgtcggctctcggctttgttttattcctgaatcgtgaagcgagccaggtttagactgcaaaacttaaatgattaataaacaaataaatataggttggttgctggtgggtgtccttttcagcggtaatacgaataatggcgatcatgcaggcttcggttatgcgaatacgaataacaccccctcgaatacgaatgcgaatgtcagctctcagctatgatttttcaaaattaactcaacatacgaagcaacgaccttacctattggtagaagataacataactcataaaggtgctggtagggaaaccgaaggctctgagtacgaaaaacaaagaatatgaagagattaagtaatttatacgagcaaattatttcacttgacaacttgcgcctggctgatgaaaaagccagaaaaggcaagttgcgttcttatggtgtcaaacgacacgataggaatagggaagcaaacatactggctcttcacgaatctttgaaaaacaagacttttgtaaattctaaatatgaggtatttataatcagagatcccaaagaacggcttatttaccgtttgccttattatcctgatagaatcttgcaccatgccattatgaatattctggagcctatatgggtgtccttatttacagaagatacctattcttgcattaaggatcgtggtattcataaagcagcagataaagtaaagaaggctttgaaagaagatccagaacacactacttactgcttgaaaatggatatagtgaagttctatccaagtatagaccatgatattttgaaaacaatattacggaagaaaatcaaagataaagatctgctttggttgcttgacgtgattatagacagtgccgatggcgtacccatagggaactatctaagtcagtattttgctaatatttatctggcttacttcgatcactggataaaggaggttaagaaggtaagatattactttaggtatgcagatgatattgtgattttaggcgatgatcctaaacagcttcacaaactccgtatagagattgaagaatatctgcatgacaatttaaagctatcacttcgtaaagtggatcctaaaactggaaaaaagaaatggaagtttcaagtattcaaaattgatagccatagaggtattgattttgtcgggtatgtcttttaccatacccatacccttattcggaagggaatcaaaaagaacctatgtaggaaggcagccaagctgaataagaaaaagcacatttccgatatggaatacaagcaagttatttgcagttggtttggctgggctaaatatagtaattctaagcatctattaaaaacaataattaaaaagcaagtatatgatacactacgattttaagccttctaagttagaggctaacgggaatggttcttacacataccgttgggatattcaggaagttcaagtagaaaaccattttggagaagctggagataatgggcaagctacaaaatggacttgtaacgaagttgttgtttggggaatggttacaaatgataagctaaaaaaggcagttattacccatttgtgggattcggataaagaagccaagattatcaatgactataacgctgcccagctcggtattcttactgaaaaatcagctaccaatgattacaaggaatatttgcaaaagagaaaagctatcaaagaaatgatagataacgattgtaaggaacttaatattatattgtgatgaaaaagtttagtgagttaggtgtaaccgtacaagatgaacgtaaaatgttcaactgtagccaggtttctatttcggatgtgctgaactgtgagatcattgtagaagatttcattccagatgtaaagacttcgcacggtgaaggaagataccttgtgaaatttaaacatagcaatggtgcggatggtaagtttttcacaaacgcagctt

SEQ ID NO: 116 - DNA, 4000 bp, Escherichia coli
  misc_feature (46)..(46): n is a, c, g, or t
  misc_feature (238)..(238): n is a, c, g, or t
  misc_feature (259)..(259): n is a, c, g, or t
  misc_feature (910)..(910): n is a, c, g, or t
  misc_feature (1621)..(1621): n is a, c, g, or t
  misc_feature (1934)..(1934): n is a, c, g, or t
  misc_feature (1947)..(1947): n is a, c, g, or t
  misc_feature (1952)..(1953): n is a, c, g, or t
  misc_feature (1955)..(1955): n is a, c, g, or t
  misc_feature (1979)..(1979): n is a, c, g, or t
  misc_feature (1985)..(1985): n is a, c, g, or t
  misc_feature (1991)..(1992): n is a, c, g, or t
  misc_feature (1994)..(1994): n is a, c, g, or t
  misc_feature (2006)..(2007): n is a, c, g, or t
  misc_feature (2012)..(2013): n is a, c, g, or t
  misc_feature (2018)..(2019): n is a, c, g, or t
  misc_feature (2021)..(2021): n is a, c, g, or t
  misc_feature (2965)..(2965): n is a, c, g, or t
  misc_feature (2986)..(2986): n is a, c, g, or t
  misc_feature (3296)..(3296): n is a, c, g, or t
  misc_feature (3492)..(3492): n is a, c, g, or t
  misc_feature (3577)..(3577): n is a, c, g, or t
  misc_feature (3726)..(3726): n is a, c, g, or t
tgtattaccagaatatttggaaggcaacagaactggctcatacacnccagaacagtggcttgacgaagtaaaggacaaaaattcggacgagattatccaggagggaactccaatggatgccgaacacttcaatcacatggagcagggcattcataacaactcacttatgttggctcttttgttagagaatgtaaagcatactcagcaaagcgtagagtctgttgatggtgaggaactngaagttacattgaccaacacnaaggatttctattttaataattctgttaagactgtggcgcttgcaaatatgcgtagcacattggattatagggttatcacagaagtacaaggcaatcctgtaaatgttggcgatgtggttgtctatgataagcaggtgaatggttttaagattgcttttacaggcagtgctaaaagtgtgactgttcgctgctttgtacagggaggaggtacggtgtagtggcaaatatcattattcatagtgacgaaagaaaagctgaaacaaacagaactcttcgtgattatggtatcaatccggaacatgcaaccaaagcacaaagagatatggctgattgcgtagcccagaagacaggcgaagcctgcagagaattaaggaggtatgacagatgaaagtcgtagaggtaaatgttggaaagaaaattgagtacagtgtatcgaaaaataagattacatttgctgatgaactgatgctcaattgcgaaaagttggagagagataatgatgaatgtgttgacatttgcattgcaaagaatgggatgattacttctggccagcttggtgaaaagtatgcagcacaaattgagattccagcaaggcagtatgttgaaaaggaagttcctaatccagattatgatcctgatgtagaaaacancagcgaaacaattatggaaagaacccctgttccattcaatatggcaaatgttacgctcaaattatatgcaatcgaataaggaggactattatgggaaattatgatcagatggcagctgcggtaagcgagctgtcaggcggaaaaaatgtggtattactggatgacatcggaatgccatcaatttatgtaagaattccaaaaggaaaaaattcagagcttgtaagcggtcttagcgataatgttcattatgcgtttaatgtggacagtgtcgagaaggccgctttttattattccaagtatcagaatattattgtaaatgaaagggcatattctcttggacacagagatcctgcaaattccataaattgggatgctgcaagaaaggcttgcgaaaataaaggagcgggcttccaccttgcaacaatggcagagtgggcttatattgctctctggtgccgcaagaatggcactatgccacatggaaacaataattacggaaaagattcggcttatacacatgaacacggcgaggaatcttcaaaggatagcggaaaaactggaagatgtttcacaggttctggacctgtaacatggaaccataaccatcacggagatggcatttgcgacttaaacggaaatgtatgggagtggaatgcaggcatgcgtcttgttgatggagaaatccagatcattccatacaataatgcagcnatgggtagcaaatgtgatatgtcggcatcctctactctctggaaagcaattaaggcggatggctcgcttgtagaacctggaacagctggaacattaaagtgggattgggtatctggcaaaattcagcttacttctggtgcgattacatataagactgatagcggtgtcggagggcagtataaagatatgacacttgcaagcgggcttactgctccagaaattgcaaagatgttattgctctacccagacgaaccaaacggagattacgcaggtgattatcattggttcaaccctgttggcgagcgtttgccgntttgcgggggcanctggnncnatggtgccaacgctggtgtcttcngcttgnacctcnncnatccccgctccnntgcgnnctggnncntcggtttccgctccgcttttgttgatctgtaatctgttgcactgtaatctgactgaggctgcgatagcagcctcttattttattttttaccttgcaataacgaaatacgatataaaataacaaataaatccgaagcagaactatgtgtggtagaatggaaaaaaatatggtatagagggactttatggaggaattaaagatattacaaaagaccttcgatatgatgaactatgcttatcctgcattggcacaatatccaaagggcgagaaattcgcccttgttgtggatataaagaggtgcatggatgttatgttggagaggattatcgaggccaacaaaaagtattataagaaaactacactacaggaattagatgtagaagtggaaaagttaaaggcatatgtccgattgtcatataacttaggttttttacctccgaaaaaatatgaacaatggtccggtctggtagttgaaattggcagaatggtaggaggctggataaagagtgtaagcaagtagggtacggaatactgcgtttgccgatttgcgggggcaactggaacaatggtgccaacgctggtgtcttcaacttgaacctcaacaatccccgctccaatgcgaactggaacatcggtttccgctccgctctgccttcaagtcagatgctgcagacctaatgggtgtgcagtcagtacagaggtgtaaaggattccgtctcctttgctctcgcaaaaaaatgtaatgggcatgaatgccggtagtagtataagcgaatcccgcaatgctctgaaaggagataatatgtccattaaaaatgtgtatgctcaaatcgtatcttttgataatttgctacaggctgagaaagatgcccgagcaggaaaaagatatgaaaatgagcagcttgcattctgggggaacctggaagacaatatacattcgatanccgaaaaacttaaatgccatnattatccgccagacatataccatcatttttatgtgtatgagccaaaattgcgaaaagtaatattttctgattacacaacaaaggtaattcaaagggcagcatacaatgtactcaatcctatagtttgtaaagggatgattagtgatacctattcctgcatagaagatagaggacaacttaaatctatgcagagattagcagggtgggttgattttgtagagaaaagcggtgaacgttggtactatctgaaaatggatgtggagaaattcttctatcgaatggatcatgaggtgcttatgagcataatccngaaaaagataggggacaaggaagcggttagattccttgaacattatgtgtgccatgcttccagagcatttggacttccgcttggagtaaagtcaccactggaaatatcggataaagaaatgctgtgggatgtagggattgccataggtggcggattgtcacacatgtatggcaatatgtatttaaaccctatggancaaatggcaaagagaaaagagggcatacagtattatattcgttatatggatgatgtgattattctatcgacggacaaggagctgntacacaggtacaagaatatgttttctgattttttaggcgatgttctgaaacttcgattaaataataaaacagcaattcgacctgtctcacatggcatggagtttgttggttatactattcgcccttttgatgttcgattgagaaaaagnacaagccttagaatgaaaaggcatttgaaaacaatacaggagctttatcgtgattatgagatagaccttgatagagcccgctccactcttatgagttataaggccttgatggaccattgcgactgcagggctttggaaaagaaaatatttgaggattttgttcttacgcacaatccgaaggaggctgatacagacaatggatgaagacaatatgttggaactgctcgaactttatatggatatggttgaaaaacaggatgaaatcatataccgc

SEQ ID NO: 117 - DNA, 4000 bp, Escherichia coli
  misc_feature (1984)..(1985): n is a, c, g, or t
  misc_feature (1990)..(1991): n is a, c, g, or t
  misc_feature (1993)..(1993): n is a, c, g, or t
  misc_feature (2002)..(2003): n is a, c, g, or t
  misc_feature (2018)..(2018): n is a, c, g, or t
  misc_feature (2023)..(2023): n is a, c, g, or t
  misc_feature (2029)..(2030): n is a, c, g, or t
  misc_feature (2032)..(2032): n is a, c, g, or t
  misc_feature (2044)..(2044): n is a, c, g, or t
  misc_feature (2047)..(2047): n is a, c, g, or t
  misc_feature (2050)..(2051): n is a, c, g, or t
  misc_feature (2056)..(2056): n is a, c, g, or t
  misc_feature (2059)..(2059): n is a, c, g, or t
  misc_feature (2515)..(2515): n is a, c, g, or t
cctgctgtcgaaatacggctatctctccgtcgagatgcagaacgcgatggctcacgatgtcgaggatgaggccatgtcgaaccgcaacgacacgctcgataatgccgcagcgcagacggtcgatctctcggcaacggaatacgaggaggtcgatacggaaacgggggaagtcaaggaaaccggatcggagcaggccgcacccgctcctgcacctgaatactgatctgacggcacgagagtatgatcttgaaatgtttggggagttcatcacggggcaactgctacatcctcgaagcggccgatgaaactttgatcgtcgaggcgggaataccgatgcgcgacatcaaaaagggtctcggctggcagctcggcaaggtggtaggatgcctcgtatctcaccgacacgaagatcatgcaaggtcgttgaacgactttctcacctgcggcatccgcgtactggctctcgccgatgtattcgacgccgccaatccgagaaatcgcgtattctgcaagataatcgaaccgatgcacggctacaaagtgggaggcttcaaggtcttcgtactgccggtcgtccacgatgtgccgtgcgtcgggttcgtcatcgagcatcaggagatgggacgcctgcttttcatcaccgatacgatgatgctggaataccggctgccgaacctgaatcacatcatgatcgaggcgaactactccgatgcaatcttgcagcgcaatatcgacagtgggcggatgcctcccgccatgcggggacggctgctgggttcgcacatggaattgcagacgacgaaagagattttgcggacgaccgacctatcggcggcaaatgaggtgattttactgcatctctccgacggcaacagcaatgccaaaggattcgccgaagaagttcggcaaatcgccggaaaaccggcatatatcgcccgtgcaggattggaggtcaatctcgataaaatgccctactgatatgcgacccgtgccgaacgatatagtttcaacgctgatccgctacctgccgcagatactcgaaaacgtgcagatagacagcggaaatacgcggctcatcaatgccgtaagactgacaaaaaggattattccacgattaaagaaaattgagaatgaaaaaaataccaaaccctaacggaaacaaattcgtcttgccaaagggatatactgacctcggatggcaactcgattttaatgcttccgaactaaaaaaatgtagggaagccgggcatatccggcggaagttcgataattccaaatacctgtatcggtgtaacgatgtggtatatatctgcgatcaatgcaagaatgtacaccatgtcgatatgagtgattaaaaaatcgaatgcaatgctgatagtaaagcaggacaagacccgcaaggaggaagagggacagatattcgtcgaactcacgatttaccgtgatgtcaggaatatcgcagactgcaaccgcctcggatattggtgcgacaaagcgcatctgtcgcacttcatcatggaatgcgcgaaatgttttacgcaagacgaattaaaaaacatactgaaaatgaacggaaacaatatttacatcgagaaaaacaacctgctcgatgcctacaagaaaggcaatgccgataacaagaagatgctcgaaaatctcttcggcaaggagatgttccgcccgaaaaacatcatggagcgcatcaagacctttgatgacgcattcaaggaactcggcgagcaccatccgctcgtaaaagaataccacaaacggcatctgttcctcgaagacgattcggatattagctccgatctcgtagcctacctcaaactccgcatcattaccgccgctctcaacgagggttggacaccgcagttcaccgaggacgaataccgctacttcccgtggttttggctctacaccaaggaggagatcgccaagatggacaaggaggagcgcaagaaagttgtcctgttcggcggtnntgcgnntnacggctcgnntgccggttttgcgtntgcgnattcgnntnacgcgccctcgnatncgnntgcgnatntcgggtctcgcctttgcttcaaatcgtccgcgctggcgaaatacgcaggtgaacaattcgctgaaatctactttgctttcgtggggaaatagatgatgggaggatggataaaaatatatcaaaccattcgggagcattggatatggaatgatccgcgaaaattgaagtggtggatcgacctgctgatgctcgccgaatggagagatagcaaacgccttgttggatcagacctcgtaaccatcaaacgggggcaattgatcgcatccgtccactatctccgcgagcggtgggcatacaaagatgacaacggggtgcagcgcaagccgtccgagcataccatcctcaaatttctatctctcctcgaagcagatcagatgataagccgcgcgaaacaccctgccacccgtgcaacgatgattacgatagttaattacgatgattaccagcagaatagcncagcaggatgcaacgagggcagcaacgacccctgcaacgacgggtgcaacgatccctgcacagaagataagaataataagaatataaaagacaatagagaggggaaaagtggaaaaagcgaaaaacgcttttccccgccctctatcgaggaggttgattcttatatcagggaaaaggggtacacggtggatgccgagcgattcgtgaacttctacgagagcaagggatggtatgtcggcaaaaacaagatgaaaaactggcgtgcggcggtggcaacatggcaaaaagaagacaacaaacgaaatgggatcaatcaacaaagatcatgtgataaacgtcgagggactgaggcgacagctactcgcccggaagactacgaggggaaattttaagtggtcggtgagcttgaagcaggcagcggacattctgctggcagcatatcaggcggaagtcgaataccgccaccgcaggttcatcgaggacaaggcgaccaaaaccaacatcgaacggctggccgcattcctgatccgcgacgatgccaagttcggggtaatgctctgcggcgtacccggcaatggtaaaacaactctcctgtatgcctttcagtcggcggtgaattggctcaacgacatagggcatttcgagggcaaacgggccggtattcggatcgtcgatgcaaaggaggtagttatgctcgcaaaggatttcgaggcattccgtaacctacgcaatatgccgatgatcgccattgaggacatggggcgcgaaccgatagaggttctcgactatgggaacatcctcaatccggttgtcgatatgctcgaatatcgctacaacatgcagctcttcacgttcatcacgaccaatctcacgaaatcgcaaatccgcgagaagtacggcaaccgcatcgcagaccgattcaacgagatgctcgaagtcatcattttcaagaatgagacctatcgggacaaatgaaattaaggcgatttgccgcgagtttcaggtaacggcgataagatggtcggataatccgaaataatgcggcatatcgcagaaaacagagcaaagacacaaaattcaacgcaatggggacagaagtaaaattaaaacgggaggcaatcgagcgacgcatcgccgaattggagggcaagatgcccgacatccaagcctccaaagagggagccgaagcgcgggcaacgatccgcaggctgaaagcgcggctcaaaacctatccgcaagagccgaaaaagcggatttacaaagtcaaggcccgattcattttcgacggcgttttcgagattcgcgcccacactcgcaaagaggccgtgcagatggcaaaaatcggatgcgggatgaacatcggagaaatccacacctgctacgggactgacgtagattgggaatttgattgcaaaccggataaaatcgtgaaataaccgataccatgacacaagacgaatttgacgcactacgattttgcgcagg

SEQ ID NO: 118 - DNA, 4000 bp, Escherichia coli
  misc_feature (750)..(750): n is a, c, g, or t
  misc_feature (753)..(753): n is a, c, g, or t
  misc_feature (755)..(755): n is a, c, g, or t
  misc_feature (757)..(758): n is a, c, g, or t
  misc_feature (760)..(761): n is a, c, g, or t
  misc_feature (763)..(763): n is a, c, g, or t
  misc_feature (765)..(767): n is a, c, g, or t
  misc_feature (769)..(770): n is a, c, g, or t
  misc_feature (774)..(774): n is a, c, g, or t
  misc_feature (776)..(777): n is a, c, g, or t
  misc_feature (780)..(780): n is a, c, g, or t
  misc_feature (785)..(787): n is a, c, g, or t
  misc_feature (789)..(789): n is a, c, g, or t
  misc_feature (792)..(792): n is a, c, g, or t
  misc_feature (794)..(794): n is a, c, g, or t
  misc_feature (798)..(800): n is a, c, g, or t
  misc_feature (802)..(805): n is a, c, g, or t
  misc_feature (808)..(812): n is a, c, g, or t
  misc_feature (1085)..(1086): n is a, c, g, or t
  misc_feature (1089)..(1089): n is a, c, g, or t
  misc_feature (1092)..(1092): n is a, c, g, or t
  misc_feature (1096)..(1096): n is a, c, g, or t
  misc_feature (1110)..(1110): n is a, c, g, or t
  misc_feature (1145)..(1145): n is a, c, g, or t
  misc_feature (1149)..(1149): n is a, c, g, or t
  misc_feature (1169)..(1169): n is a, c, g, or t
  misc_feature (1175)..(1175): n is a, c, g, or t
  misc_feature (1179)..(1182): n is a, c, g, or t
  misc_feature (1185)..(1185): n is a, c, g, or t
  misc_feature (1206)..(1206): n is a, c, g, or t
  misc_feature (1212)..(1212): n is a, c, g, or t
  misc_feature (1221)..(1221): n is a, c, g, or t
  misc_feature (1251)..(1251): n is a, c, g, or t
  misc_feature (1254)..(1254): n is a, c, g, or t
  misc_feature (1281)..(1281): n is a, c, g, or t
  misc_feature (1283)..(1283): n is a, c, g, or t
  misc_feature (1290)..(1290): n is a, c, g, or t
  misc_feature (1295)..(1295): n is a, c, g, or t
  misc_feature (1298)..(1299): n is a, c, g, or t
  misc_feature (1302)..(1302): n is a, c, g, or t
  misc_feature (1304)..(1306): n is a, c, g, or t
  misc_feature (1311)..(1311): n is a, c, g, or t
  misc_feature (1317)..(1317): n is a, c, g, or t
  misc_feature (1323)..(1323): n is a, c, g, or t
  misc_feature (1555)..(1555): n is a, c, g, or t
  misc_feature (1624)..(1624): n is a, c, g, or t
  misc_feature (1758)..(1758): n is a, c, g, or t
  misc_feature (1773)..(1774): n is a, c, g, or t
  misc_feature (1798)..(1798): n is a, c, g, or t
  misc_feature (1811)..(1811): n is a, c, g, or t
  misc_feature (1830)..(1830): n is a, c, g, or t
  misc_feature (1955)..(1955): n is a, c, g, or t
  misc_feature (1957)..(1958): n is a, c, g, or t
  misc_feature (1960)..(1961): n is a, c, g, or t
  misc_feature (1963)..(1964): n is a, c, g, or t
  misc_feature (1969)..(1970): n is a, c, g, or t
  misc_feature (1978)..(1979): n is a, c, g, or t
  misc_feature (1984)..(1985): n is a, c, g, or t
  misc_feature (1987)..(1988): n is a, c, g, or t
  misc_feature (1994)..(1994): n is a, c, g, or t
  misc_feature (2008)..(2009): n is a, c, g, or t
  misc_feature (2012)..(2012): n is a, c, g, or t
  misc_feature (2020)..(2021): n is a, c, g, or t
  misc_feature (2023)..(2024): n is a, c, g, or t
  misc_feature (2030)..(2030): n is a, c, g, or t
  misc_feature (2041)..(2042): n is a, c, g, or t
ccgcgtttcacacggttagacccgcttgctgatttctaccccagatggatcgtgataacaaagtgctgtgcgcatagccgatgaatcccatcctgctgcgtgtgctttggtacaagacctctgcgcatattttcccttgtatatatgcatgttcggttttttctatccctttcaggcagcgtttcaggttttcacggcgtatccgcaatagcttgggaaagatacgataacctaagtagggaatgccgtgagtaactctattgatttgcaaagatttgggtttgatgcgcagctcaagttgctgctgcacatagtgctctatttgcttgagagcctccttcaactcttgtgagtcatctgaaaacaggataaaatcatccatatagcgtacatacgctcgaaacccaagagtctgctttacaaagtgatccaactgattcagatagatattggcgaagaattgcgaagtcaagtttcccaccggcagtcccttgttctcttccattcccatgctcactgtctggttgctcagtattatccggcagagtgacatcaccgcagggtctttgatcttgcggtttatcaatttgagcagtatctcgtgattgacactggtaaaaaacttctcgatatccagcttcaaataccatttatagcggcaggcatacttttgggcagcactcactgctagatgcaagcccttttcctttctggtggcataggaatccttgataaaagctgcttcaaaanacngntnnannanannnannaaancnngangcacnnncntancncgannngnnnnaannnnnataatgcgctctttgggttctctgatggtgaaatatttgtaaggttgtggatgataacgctgctcaatcagttctgcttgcaactccaacagatacttctcgcagtgatacatccattctgtggtttcacttttgctctttttatgcttacaagcctttttgtaggccagatagagattggaccagcttgtaaggctatcatagagatatccaatgcgtttaggcacttttgagccagcctcccaccattttgccgctttccagcagttcccnnctnatntatncatactggctttcnctgaggtgccgcatcttgaatgccatctggatcanggcncgcagaacatccagtttcangttgancttnnnnagnggttcccgttttgcctggctntagatngcctgtacnatcagttccagaatctccaggcagatgttntcnatcttctgagccagcgaatagcgcagntncttgggnaatcnctnngtncnnnccatnatccanggcacngtgtccagccatttcacatagaggggataattattcttctggctcaagtgctgcttcttgcaatagcttgattatctgctcaccgtatttatccgctttgcctttcatccccttgatcgctgcgaaatctgccttagcttgaggttgtcgcttgattatctcatagatctgggaattatacattatgatgtaagccgggatgccttcgttggcagccaactcattgcgccantcccgcagtcggttgtattgctccagttccctttcactcagtttggccatgtcgggcttttcatttccngctttacgggagtggtattctataaagaaagaatagtagatctcgccacccgtgtttataaattccttctcgatccgcacgatgttttgctctgcacaaaacttattgaattcatcatcttcaaagcgtccggnatcccggtcgaaacnnactaggattaatttgaacatcatnctcccttaaaaanatccggcgggcaggggganaaatccccctgcacccccaccttgtcgtaagctcataaccttattccttagccctgaaattttcaaaaggcaaaaagaacaaaaaacaaaaatcaaggggaaaccctgacacagcggaagcctananngnngnngctgnnggtcgcanngttgnngnnccgatnggaaacggtgcagnngtnggcattgnngnnccagcnaccgccgcgtnncacacggtaagacccgctatttgctcccgtaggattattctgtgaaccactgggatagctaccataaatgtcccacacccattcccatacgtttccactcatatcaaaagtgccaagctcattggcggctttggtacctacggtgtgtgtggttgaaccggagtttgatgtataccacgccacatcaccaatgctattactgccgctataggtgtaaccctggctctggttaccacccttggccgcaaacatccattccatctcagtcggcaggcggtagccattggcagtccagttacagtttacattggtatgattggtattgctggaattccatcccgcaggccagttatcaggattcgtgccgtaggtgctatagctgtagcagggagttaatccttcctgcaggctgcggcgattactgtattcaatggcgttgaaccaagaaacataatagacaggataattgctgcctaccccatatccagaagctggattaactcccatcaccgcctgatattctgcctgggtgatctcgtatttatccatgtaaaatgaggacagagtcacatcagaggtgccgttgttaaatgtgccaccctctaccagaataaagtcatccacagcaacaggattgggattgtctctggcgattactttggctttgtaatctgtgcctactgccattccgtcaccggcaggatgccagatgatttgtttgccgttaccaacggtgacgctattacctatatcaccggatacggctgtgggaggaatgtcattgtagctgacgccattatcggcagaaattagcagggttacggcacagtctgtatcagcagcaaggtcataggaaatagttacttgaccggcagaaggggtggctaccacattgcttaccacgggtgcggcggcaatggcatatcctgccaatgcgatcaggctcagggtgattaatagttgtttcatcttgtcctcccttacttcatcagcactattttttgagttgagctgtgtttaccggcggtcatgaccacatgatatactccactcgagagcgtgtttccatgtgtatccttcccttcgaactgcacagaataaatccctgctgtgttatgtgaccggctaatagtttgcactatctgaccacgggtattgtagatgctgagagtcacagcttccggggtcttgatctgatagctgatcgtggtgctgggattgaagggattggggtagattgccctcagtccggtttccaagggtattccgggaatgtcaggattgccaccatccagattgaccagaatggaggcgggaccatggaagcttccgtggccatccatctccatgctgtaaagccaatagtaatactgcccgctttgatagatttcactatcgaggaaagaatagctttgctggctggaagtattggtgggttggatcagaccggatacaatactggcagaacttaaattagcggctgtgcagcgatatacgtagtagccttgcaggttggtctcggattgggtaacccaattcaactgcacatagttattggctgtaagggtagccgaaaaggaagacatctccacggggagagtttcttcggtaatgccaaaagtgttggattcaccgaatccggtgagagcaaaaatgctgcctgcgcataaaagcagaaaggcagccacaagtagtttgtgtctcatgtttttctccttgttttttggagttattttgttcggacgcagtccaggtgatatcattggtatcacctatataccagctttttcgacgttggggctgagagaagaacctgcctgatcgacggtgtcattcactacgggtgcggatgtgccatagctggacagagccagcagcccggtagcgaaggcaaacaggatgccaatcagcagtgttgttttcattagttactccatttcgcagttttttgttatgcg

SEQ ID NO: 119 - DNA, 4000 bp, Escherichia coli
  misc_feature (490)..(490): n is a, c, g, or t
  misc_feature (498)..(498): n is a, c, g, or t
  misc_feature (1017)..(1017): n is a, c, g, or t
  misc_feature (2667)..(2667): n is a, c, g, or t
  misc_feature (2925)..(2925): n is a, c, g, or t
tgttgtataacctgaaccacctgaaattaagaatatgtctgtaatatcaccaacaccggtatttctttcttgtacaattttatcaccggcataactatctccttcggaggttgcttcttctaaaacaatatggtcttcttcttcaacattggcgccaagagctctaaccatctgatagacggaatccctatcagcgatagttgtttcatctacaccctctctattaataccaacaccctctctaccaaagtcatctcttaaagtaaagttgtatgttgaactatctgaagcagttacagttacaacttcaccttttttaaatggtgttgtaccaacatatgtaatgtataaaactgtttcattaaaatctgttttcttatcataaaccttaccagagattgtttctgtagtacgctgtaatgttgtaccatcaatattatatcttactgttgccgttgcacctgaagtttgacctgtaagtaacagaacngcatttgntgtactgtcatcggcatcattaatagaacctctaatatttccaaatgattgtccacccgttacagaaccaggttttacagatataactggacctgataagtattttgttaatgggtctgttgatgttgaattttctggaaataatgtattaccactttcaagtcctaattcagcagaaaacccaccgtttacaactgatacaaatgcttgagcacctgcacctgaagtattgccagcattaaaagttaaattatctcctatttcaaagtcaaaaccaccatcatcaataatagtttctgtgattgcaccaccacctaattcgccaacttggaaagaagcaccttgtccaccaccagttaatctaattgtagcattactatcatacaatgcaccatcgttgttaattatttttgtaccaggaataccagtgattgtagattttatgaatacatcattaatatcggattctgtacctcgtattacttcaccaatttgaaaagtgcctgttactgtttctgnatcaacaataaattctgttacattatttgcaccaaaactaaatctaaaaacattttctacaacagcagttgcacttgatgtttcaccagtaattgttctaccaataagttttgatgtatcaccgataacatcaataccacgaataatctttcttgtaccccattgaccatctgatactcttaaaatattttctctaggatataatgtttctgatttttcaccaaatagtaaattaaagaaaattctatgtccttcagccgtaccttttaattgatacagtgctttaatgtttttaataagttttcttttatcaacacctgtagccaaattttctggcattgtgtgtaagaattcatttctaaactgagataagaacctatcaattactctgtcaggatccttatactctactaagttagaaatgttttcaattggatttggtttgtaacctttaataatagctcttgcatttgaagaactaccattgattgtttcaccagtaataaatttattttgtgatgtaacaaaaagtctagtattatctaaatcttcggccacaataactgctgtcgcacctgaagtggcacctgttattgtttctgagttttgaaatttaccaaatgctgtatcttctgtaagaactttgtcaccagcatctaactgtgttcttgtagaacctaatctaccagcatctaatattaataagttttcttggttggtttcagtttctaatagaataccatcagtggtttctatttgttcaacttgtaactctgcactttctaataattgataatatgtttttaaaaatgttgcaaacttagggtgttgctcaactacgaattcaggtagttgtgcatttataagggtagaaatcttgtcattaaattttgccatttatcactctaataacttgttgttggtgtataacctacacctgcatcatttgaaccacctgtgaaaccatctgcttcaactgtgaaacctgaattcgtaacatctatttctacaactgaatttctaactggaacaatatcatttgaatttggtacagtagttaattctataactgtagaagcggccgctctaatattagatattgatgaaatatttaatgagttaattgttatttggcctgttgtgtaattaatagtaccttgtgtttcgtttgcatatgttttaacaccaccagcatcaaagtaatatcttcttacaacacctgaaccattatcatctaaaaacatttcatttgtatttcctgaaactttgaaacctgaagaagataaaataccaccacttgttgacatatgacctgtatgtggattatataatgcatttctaaaataaatgtcgtatcttgctgatgtatttaattgtggtgtaaatgattttctcattttaacagaagtaatatttgatacaatactattatcaacaccatcaataataccaattaattttgaatatctaaacacaccatcaaatctttgtagtgtatttgtattataatttgtaactgctgtgataatttctgtctttaatgtttctgctgttttagaagtaacttttgtatcgtatctagcatttgatgtaagtattacactagtagtttctgcatcaacaacttctggtctaactgaagctacattntattgttttaattgtgttgctatatcttttttagtttgtgttgttagtgtagaaccagatgccggtttaattgcaatttttacaacaccatataccggtatctcatcatcttctccaccccacgcactaactgacaatgcgtttggatacatttgtttaacaaaagtttcatagtcagaagaagtcactgctctgttttgagctgcataggataatggtgcattaaatttaatactttcatctgcttctgcctctgcnccgccttgtgaaactgagtttactgtgattgttacatctgtaaatccaccaatattacctgaaagagtaaatgaacttgcgccattggattctgttgtattagtaacaatatattccatgattacaatattaccgtcttgtaattttgcacctgttataccgtcaccaaaataaatttcatatctaccatcttggccttcttgtaaaaaatatgctttagatgtactagttacatttgaatagttactagaaaatgagtaagtcgatactgttgcatctgaagttgaattttgtacagttacttttaatgtagatgtatcagctctgttacttggtattataaacttttggtcggggtcatttacatcaactgtatatttaaatgtaactaaagtaccctcatataaagtacaatttgaaaatttataaacaccatttacaggcgtgattgtaatgtctgcgttgtttacatattgataagatgtttcatcaactgtagttgtaaacaccgtacctttgttcattgtgatagaagtacctgaagcattattaatttgtacatcaacatcagctttaggtgctcttggtgaagttggtgtataaccaaccatctttgcaagtgacacaatgttattacgaatatctgcactatctaagtaaacttcatttgttgacatgttcgccaaaaaggaaagataatgtgtattgtatgataacgcatctaatagaatagaaaggcctgagccttcaaagttgtaatcttggaattctgtttgactttgtaaaaatgtttttaaatttgacttaatttggtcaaagtctaaatcagatacatttaatttatgttttgccattctatcttaacctctgtaaaaatgccgttactgtaactggatccataacaccttgtatataaaaatagatatcacatactaatctgttgccatcttggtcttcatcaattctaatactttcaagtgatgctctaggttcataatttgctatgacttcttctatttttctttgtagaaaaactctagtcaatggtgtaaagttttcaaataacaaatctctc

SEQ ID NO: 120 - DNA, 4000 bp, Escherichia coli
  misc_feature (1991)..(1991): n is a, c, g, or t
actgttggtattattagctcctggaacataaagcccttcaccagcctgactgccaattgcagttgctgctgcacggtttactcctggaggacgataaccatcagaccatgacgcatatactaataagtcatcagtcggagtccatgatccagtgaatttaagaaggacgtcatcacgatttaacggggtcaaatcattataaacgttatcatatgcacgaccgccagtaagactaggtctaatgtcatttgatggatcattatcatccacaaacaatggacggttaccatatctccaagctccaatgcccgtgaaattatattctaaatcataataacgcgcaccagcctcaagattaaactcatctgttacatcccagctaactgaaccataaagtgccatttgtttttcagatctatcattgtcatttctaaactgagtagcatcatttatctcaaatgtgttcaatgtttcctgaggaaaatcagaacgagtagtcacatcaataggtgcaaaacctagatctgctggagctgaatagttaaatcgaccaacgtgctcaattttgaagtcttcatagtaaccaccaactgtaaagttaactggcccatcaaaatctgaaaccacacggaattcttgggtaaaccttgaatttttgttggtaatatgagcactattagaaggatcaccgcattcaatcacttccggatctccgccaattgttgggtcaagtccatatactgtagaagcattgctacctacaccattataatatgaaccaacaagatactcgcaagcatatcctggaataaaaccaccaatgttggtataaccagtgtaatcaatttttgcttcaacatcacgatctaaataggcaccagtataaactaaatctaactgacccatgcgaccattaacagtccaagctgtttgattaaacgcatcattattggagtcttcagcaaatcgggaaacattcaaatcaccctttgttggatcatagtcccaaacaccagtagtgtctaaagtttgacgcgaatgctgcaacaaaacgtcccagtcatcattaatattatacttcgctccaattctcattccggtataagtagcatcattgaagtcatcttcaatcagtgctgcattatttgctgtaacaaagttaaccggaacagttactcctccagccggaacaactgttccgttaacaaatacagtaccttctggataagttacactactagctggaaatgctggatttatagcattactagcagtaaatgttccagccacgttgtcgatatatccaccttttctatcagtgtaaaatacaccacgtaaagctaacttatcttcaataacaggaacattaagtaccgcctctaaagcagtgctatcttctccaccttttgtaaatgcataactagcagatgcacttgctgaatattcattcattactggcttattagtaataagacgcacggtacccgccattgagctagcgccatataaagtaccttgtggtcctggaagaacctctatgcgctccatatcagcaatgtatacatctaaatttcgtccaccttgagtaacaggctgctcatctaagtataatgcaacgttaggggcagaaccttgtgattcagcaactgtaatattgatagcgtcaattgcagcaccgcgaatgtataattcgttctgtcctggtcctctgccacctgcgtttacacttgggagatatttaacataatcttcaaaactatcgatattttgctcttcgagttgttcggcgttaaaagcctgaacagcaatcgcaatatcttgcatgctttgtgacttcttagtcgcagtaactattacttcatcatcgagttgtgcaaatgcaggagacgacatccctatagccgcaatagctcctatcgcagtacaacttagtagatttagttttttcattttattccccttcagtgagatatagtttgattcattgatcntactttaagaaaagtttcactaacatcaataataatttagtatttggtttactaatgttacaatcttatttgctaagtgtgacataaacacaacaaaaagagtaaaattctatgtaaataggattataatcttataaatatcagtattttataaagattaaataaactttatttattgatcaacagagatctaactaacgctatagacataaatgccattacaattgaaaaaggtaatgctccaatgatcataacagatttcaacgcctccataccaccacttgccaacaaagcgcctgtagttgctgtcaaaattaacccccaaacaacaatatgcttaacatgttttttctctgaattaccagcagatgtaatagtgttaattattaatatagctgaatcagcagaagtaaccaaatatgttagaagcagtattacaattaaaagagacattaaagcagaaaaagttggcgacaatattaaatttattgtttcatataattgtgcagatatatcagcattaactattgctccttttgcaacacccaaaagctctaaattaattgcagttcctccaacaagagcaaaccaggtaagcgccattaaagttggaactaacatcgctccaagtatgtattcccttacagttcttcctctagaaacccgagctaaaaacaaacctacaaatggagcaaaaccaatccaccaagcccaataaaaaacagaccaagcagattgccaagaagctaatgctttctcagtttcatctccatttgggctccaaacagaaagtgacattgaaggaagggcaattaaataatccattatcgtagtaaaaaatgatttaaatgcaaagaatgtagcgccaaaaaaaacaaaaaaagataacaacaaaattgaaaaaatcatatttatatttgacagccactttataccttttttcactcctgaaactgcagacagtgttgatgccagcattataataattaaagcaattagttgagcatttaaggttggcttaccatttgaatcacttatccattcggccccagatatattgaatataccggcagcaaactgtgatactccaaaaccgatagtaacacccacacctgatattgtggctatgatagccactacatcaactacatgaccaaaagttccatttagacgattgccaaaaattggaaataatccagaacgtattgttaaaggcaaacccttattataagcaaaataacccaatgataggcctacaattccgtagcatgcccaaggcgtaagcgcataatgaaacgcagcccatttatatgcatatctaacattttctaccgattgactttcaactaatccttttattacatcaggattgttggcaaaatggaatattggttctgcggtcgaataagtcatcattccaacaccaataccagcgccaaacatcatggaaaaccaagaaaaattagaaaactcaggcttttcatcaatatcacccaatctaacagttcctgatttaggtagtattgctaggcccaaacaaactagaacaaaaaagaaagttatatacatgtaccacgcactaaaaatatgcacggtatctgtttggattactgatagaatttcattggcattttgtggttttagcacaacccaagttgtgaataaaattaacgcaatcattgcaccaaatgtaatcaccttattgaatccagaatagtatccatccttggatactttaatttccaataattttgagtttatcattaatacatatccatttataaataattagcagtaaattctacttagtaatatttatttggctagccttcatccagcaggcatgaaaaccaactgggattgcgtgtggcatggttactcttgccactggccctaaagatatattttgggcatcaaaaatttgaagctcttgaatttgtattttatcattccacataaaacatataaggtaaccatggtcttccaataattgattatccgctggcgca

SEQ ID NO: 121 - DNA, 4000 bp, Escherichia coli
  misc_feature (108)..(108): n is a, c, g, or t
  misc_feature (1873)..(1873): n is a, c, g, or t
  misc_feature (1970)..(1971): n is a, c, g, or t
  misc_feature (1976)..(1977): n is a, c, g, or t
  misc_feature (1985)..(1986): n is a, c, g, or t
  misc_feature (1988)..(1989): n is a, c, g, or t
  misc_feature (1991)..(1991): n is a, c, g, or t
  misc_feature (1995)..(1995): n is a, c, g, or t
  misc_feature (2000)..(2001): n is a, c, g, or t
  misc_feature (2006)..(2007): n is a, c, g, or t
  misc_feature (2010)..(2010): n is a, c, g, or t
  misc_feature (2013)..(2013): n is a, c, g, or t
  misc_feature (2018)..(2019): n is a, c, g, or t
  misc_feature (2027)..(2028): n is a, c, g, or t
  misc_feature (2117)..(2117): n is a, c, g, or t
  misc_feature (2250)..(2250): n is a, c, g, or t
  misc_feature (2498)..(2498): n is a, c, g, or t
  misc_feature (2939)..(2939): n is a, c, g, or t
  misc_feature (3139)..(3139): n is a, c, g, or t
  misc_feature (3433)..(3433): n is a, c, g, or t
  misc_feature (3542)..(3542): n is a, c, g, or t
  misc_feature (3620)..(3620): n is a, c, g, or t
  misc_feature (3636)..(3636): n is a, c, g, or t
  misc_feature (3653)..(3653): n is a, c, g, or t
  misc_feature (3669)..(3669): n is a, c, g, or t
  misc_feature (3676)..(3676): n is a, c, g, or t
  misc_feature (3690)..(3690): n is a, c, g, or t
  misc_feature (3706)..(3707): n is a, c, g, or t
  misc_feature (3725)..(3725): n is a, c, g, or t
  misc_feature (3741)..(3741): n is a, c, g, or t
  misc_feature (3800)..(3801): n is a, c, g, or t
  misc_feature (3814)..(3814): n is a, c, g, or t
  misc_feature (3882)..(3882): n is a, c, g, or t
  misc_feature (3957)..(3957): n is a, c, g, or t
  misc_feature (3996)..(3996): n is a, c, g, or t
tcaataccgttggtaactatatcagaaattgcctttttaattgccggcacaagaacatccatcacaatatacgatttcacattgttgacatcctcagaaatgaatacntccgcaaacttctgcatttctgacttcttcttaggcttcaccgttccggaaattactttctctacatgtttttctggaatagattcttttcgttcctcctttgacctatgggaatttggcttatattcctccattaagttatctcctttccactcactagactaatttttccaggtaatataatctttgtacccggaagtcgattgtttttctttttaaattgatatgtaagattcgatcgtgctttcttttcagaaaccgctcgtgtagaagcagtccaacgattggcaacacagttatcgaactccatcaccggtccatcatataaatataaattcataaaaatcacctccggataaaagaaaaaagggaaagtaccttgttacagatactctccctcgtgttgaaacacagttttctctttagatttcttcggattcctctttctcactctcgatgttcggttcatctgaatcttcccactcagcatcgataatctgctgttccttctgagctttgattttggcaatcatcggtttacccacatacttgtagattacaacacctgcaagtacagctaaaccaacaccggccgcaaccttaaaccctttaccagaactcgatttaacgatttcctcagtagttgtctccataacctcttcattgttcatgatctcattagtttccataaatattctcctttcattttttgaaaatgtgtgattcttcttccattaaagccattgtttttttcgcgcggttatctcaaattacgaaagtcgtatctcggtgcaattgtgtaatcgatcaccagacaaggtgttccatcactggctaattgtgaactgaaggataagtcgatatatccgtcatcaatattccaaccaagttcatcccccagcttaatattatccaaaccaatttcatagtaaaaatcattcagggatatatacatttcatccctcatctgtcgattcagctcacattcagctttcttaattttctcgatatctcccttgaaatacctcccagacaccgcatcatagcaaagtgtatttcctttttctgtaatgattacttctcgtgtaaccaccggatttttctcaactttgtcttttgcaatagcatcctttacagcttcgtttttcttctctccaaacatctctattactttttcctgatagtctttgagagccgattccgataaggtgtaggctgttgcgagtgctgcgtttcgacgaacgtttaccgaactagcgccgattaaacatgcaatggaaagtgtccccgtaagtgctgccggaacataacacatccatgttgtttttatcaaatctacggcctcgagctgattaacaccgatttcctcttttctttcttcgataagaataagagcctttggtgttgcacgaaccgccataacagttgtcgtaatcatgccggcaataccaatgcctgtaagaatttctggactatgttttttaatcgatgttttaagcaataaaaagctttttgataattcttttttcattatcttcctcctccgagaatcgtttttgatagctccattaccatctgaaacgcctcgtctttcgtaaatccggcctgaatataactatccatcacttttttcgtttcacgagccgcctgttccatagcctctttctcttccagatttttgatttcctgtttgagaagcttgatctcgttctctttttcaaaaacctcctcctgtaaggattcttttgttacctcttttgagttncttcccccacagtaatttctataagaaaccttgctttcacggggcacagggcccctggattcctgcttaaccaaccagaattccggacgaaccccannagagnncgaagcgnngnngnagtncgtanngccanngtngtncacannagcgaaannagccgaagaaacttcttcttttgttgcatttctcagccagccccatgatgaatcatttttaaaataagcaaccctgttctttcgttccntcatcaacggaagctgctcgtcagtatcgggttctaaattgttattatcccattcgtcttcatgccccacaatctgtccaacagtaggaagcgtaagaccataaatcttatcacgcagttcctccgggaatgncataagcagaaccgtatccatccactttttcagttcagacttttcaaagccgcctttgtttgtatttttgctattcatcggacgacgagtaatatactcatcaaatataaacatgattccttcatccgtaaccttgtgagcagttgcgctaaactcgccaatctctgctaatggaataattacctgatctcctacctgaatgttagctgtttcaatttcctgttttcttaataccttcatgatgtttntcctttcgaaaatataaaatttgtggttataaaataagaccaagaagtgcctcagccgtattttctgcaacttgaaatataagattatttgcctgatttcccgacatatgaagaaaaaattccatttttaaaataaatccttctatcacaaagtcggcttcggtcaatggatgatccataatagttaaaagaatctcatcaactgcccatctttcatatgagcgttccataatggcttgtttagaccaatttgacctcggttcgaataaatattcgtttgcatagcttataattttttgaatcgcttcatcgttcatatgcacctactccaaactaaaaagaaagagcccttgttaggactcctcttcgttttcgctatctcgtttggcaagtgcctcatttactttctcttcgattctctcatccattttcttttcgttnacccaatcggtaaggatattcactccaaacccaattacggtaaccgcaataccaatagttttgataatttttccattcgtcataaagcattagcctcctttcataatacggtttgtaatttttgcgaatcactcaaatttactcaatgccatcgtatcaatgatgatacattccagcccatcttccaaagtcgttttatnattatcaaaatccaaccagtaacaatccatttcttcaatcatataacatatatcccaaccaattacatcacctccgtccacctcatccagaccaagaaaggacaaatattcattcaacggacaaacccctcttactgaaagattacgatttacatggtattgagcatttaatacagcagccatcgttgttctaaaatatttctttgaagcaagatcgtagaaaagtaacctctcgctatcggaatccatatccatgttgtaaacctgatatccccagtcatatgtcgataccancgcgtctttcgccatttccgcatggattttatcatccgcatcctccccataaactgtcttggctgcctttcgatattgcttataagattcgttaagcatggcataggcnctcatcaaagatgcttgtttcttttgatttaatgcgtttgccccaaagatacatgcgatggttgaaactcccagtagnacagaaggaatataantcggtccagccgctcgnataatttctaatttgnttaaatnttcccctttctctnactccgcttctttcannatttttattgcctttggngttgctcgaacagccntaatagttgttgtaacaactccaacggaagccactacagttaatatggtcggcgaaganngatacaattgccncccaactctttttgagattttaactttttgcatgatattctcctttcgttttgtcttactccatagcntgtagtaaatcttgaatactttctccgatcagttttgcagtcatgaaaatggaactattctttttgttcatagangcaaacatttccatctttttcgcaaatgtacaagccatntctc

SEQ ID NO: 122 - DNA, 4000 bp, Escherichia coli; identical to SEQ ID NO: 1
  misc_feature (189)..(190): n is a, c, g, or t
  misc_feature (1175)..(1175): n is a, c, g, or t
  misc_feature (2014)..(2014): n is a, c, g, or t
  misc_feature (2742)..(2742): n is a, c, g, or t
  misc_feature (3182)..(3182): n is a, c, g, or t
  misc_feature (3739)..(3739): n is a, c, g, or t
  misc_feature (3844)..(3844): n is a, c, g, or t

SEQ ID NO: 123 - DNA, 4000 bp, Escherichia coli
  misc_feature (1)..(148): n is a, c, g, or t
  misc_feature (150)..(290): n is a, c, g, or t
  misc_feature (292)..(1800): n is a, c, g, or t
  misc_feature (1808)..(1809): n is a, c, g, or t
  misc_feature (1877)..(1877): n is a, c, g, or t
  misc_feature (1990)..(1990): n is a, c, g, or t
  misc_feature (2887)..(2887): n is a, c, g, or t
  misc_feature (3147)..(3147): n is a, c, g, or t
  misc_feature (3708)..(4000): n is a, c, g, or t
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttttttgnngtgtgccttgcggcgcacgtttctaaagggtgaaagtccctaatccgccctagtagtgggaaggatanagccgaagacaagggtgtccatcgtgaggtggaatctgaaggaagtcggatggcaaatctccggtctgacgaatagaaatcacatcaggctatggctaaggataaggttgctncacaaactgaagtccaataactactcggaattagctatggtaaatgtggcagataggtggggagaaagaaacgtgtggtaccgagggaggtcttgccagtggtggaaacagagtaagaagccatagtaacaacgaatggcaagaagtcagcaaaagtcatagtaccattacggttgcaaacataatgggaaggactgaactttaggaggtgttagtaaatgaatgtaaccaatgatggagttaaggacagacaacttcatatagaggactatctgcaaatggtatctgcggaacagaaagagtatgcagaagtgtccgaccatcagaggattactgaaagaaacgacaccatcacagattttcagacggacaaactgatggaagagattttatcaaacgataaccttaacaaagcgtacaaaaaggtaaaatcgaataaaggagcaggcggagtggatgggatgaacgtagatgaacttctagcgtttctcagaaacaacggaaagcgacttaaacagcagttgatggaagggaaatataaacccaatcctgtccgaagggtggaaataccgaaagaaacaaagggtgagtttagaaaactgggagtgccaacggttgttgacagagtttttcagcaggcaatcgcacaggtgctaactcctatttacgagaaacagttttcagaagacagctacggatttcgtccaaacagaagggcacacgatgcactaaagaggtgtcagacaaacgtaaatgatggatatgtatatgtggtagatatggatttagagaagttctttgacacagtatgccaaagtaagcttattgaagtactatcacgaaccatcagagacggaagggttatatctcttattcacaagtatctcaatgcaggantgataagcagaggagtatttgaaaggaccgaggtaggagtaccgcaaggtggtccacttagcccgttgcttagcaacataatgctaaatgagctagataaggaattggtgcgaagaggacacagatacgtcagatatgcagatgactgtatgatattttgtagaagcagaaagagtgcagagagaaccttacgcaatatcacgccatatatagaaggtaaactgtttcttaaagtaaacaaggagaaaacctgcgtggancatatcagcaaggtcaaatacctagggtacagcttttataggtacaagggggaatgcagactgaggatacacccaaagtcagtagctaagatgaaagacagaataagggaactgacaaaaagaagtaacggatggagtaattcatacagggcaatgaaacttacgctttatatacgtggatttgtcaattactttgggcttgcagatataaagagtatccttcttagaactgacgaatggctgagacataaaataaggacaatctactggaaacaatggaagaaagtaaagactaaattcaaagaactaaagaagttaggtgtagatgaagagaaagcgtggatatgcgcaaatatgcgaaatggaaactggtattgtggtggatacttcgtattacagactgcatttaacaataagaaactccgtgaactcggctatccgacattcacagagtactatatgaaaatatgtgaaaactaaagaaccgccgtgtaccgaacggtacgcacggtggtgtgggaggtcggtagataaaataattatctacctcctacccgattnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 124 - DNA, 4000 bp, Escherichia coli
  misc_feature (1976)..(1976): n is a, c, g, or t
  misc_feature (1979)..(1980): n is a, c, g, or t
  misc_feature (1982)..(1982): n is a, c, g, or t
  misc_feature (1988)..(1988): n is a, c, g, or t
  misc_feature (1994)..(1994): n is a, c, g, or t
  misc_feature (2015)..(2015): n is a, c, g, or t
  misc_feature (2024)..(2024): n is a, c, g, or t
  misc_feature (2036)..(2036): n is a, c, g, or t
  misc_feature (2043)..(2043): n is a, c, g, or t
  misc_feature (2049)..(2049): n is a, c, g, or t
caagctggaagaacttgaggcccgcggtacgcaggtgcagagcgtggtgctagccaagggttctcccgtgacgctgctccaccttcccggtacactgaccagcctccgtctggaatatctgggcagactgaccaccggcgggctgacattggaaagctacagcaaggtgaagaccttcatctttgacagttgtccaggtattgactgggaaaccctgctgggccgttgcacgggtgtggaacgtatcagagtaaccggtattgaccgcgaggatgacggtacgtggctggataagtttgtcgggatgggcggtgtggattccgatggcaacactacggacacgtgcgccttggtgggtacggtacagctcacgcgctacattgatgacgatacgtacagcgctctgaaggcgcacttcccggaactgaatatccggcagccggaatacacgatgatcgagttcgacgacgaggtatcggatgacgcgaacgtgagcaaccttgacaacggtaccggctacaagtatgacaacgcgtatgaggtgagcggtcatatttccgccatcctgaagcagcgtcaccgtgtacttgctaaagtgactaaaaaagcgacgacgcggggtgtgaacatggcgaacgttgataccacggtgaacaacctggacggtgagatgacctactacccgctggacgacacggacagcaacaagtacgccgacggcacggctgccagactggacggcactgaaggtgactggatgatgtacgagcccttcttctggagcaagggtatcaatgattacctgaacggcaagcattactcctgttacagcagtaacggttcggataacatgccttccgttccggatgctgacgtccttacgcttgacgacattaagggcacgagtggcggttatctttccggtcgtaagatcatgagcggaaaggatacgctttcgaacagctacagtactgacagtacgtattcggtatgcaaggtgaacgtggacggttacaagcgtgtgcgtttcccgagcgttcccggtacaagccttgtcggaagcattttcacagacgattccggcacggtcatcagttcaatcgtcgtccctaccttgagcaacaagttcgaggccggtatgtacctgattgccgatgttccggagggtgccactgctcttcacttctccattctgaacacggcagagttcgataaggttgtcctttctaacagtgacaggatcgaggatatggaacccgaatgggtgcctaatgacgagcacttgtgtgccgttgtgggcagcagtgttgtcggttccaaacttcgcgcctgcattaccggcgggagcactacggcgagcatgacctgggctgatttccactattacagtgtccagcgcggtatgcagcagattgatgcccttatgcactcgcgcatcgcgaatcttttctacgcgaagtacggtcgtcgtgacagccaggaacaatgcggcgcgggctctcacacgaacaaccgtactacgggtggtactgccagccgcggtatgacggacacgatcggctacgaggaagcctcctcaatcaaccctaatgtgacgaacagcctgatagaaaactccgtccaccagtatgcgtggtaccgtgagaaggatgactacggcggggccacggttacgcaggtgaataatatttgctgccttggctacgaggacatctatggtcataaatatgacatgatggacggcgtggatcttcctaatgacacgggcaattccgggaagtggcgcatctggatgcctgacggcagtacccgcctggttaagggttccgtgagctccggtatctggattaccgccgtggcgcatggcaaatatatggacgtgattccggtgggttccgtttcgggttcctcctcgacaaattactgcgacatctactacatatccactgcctccagccgtgtggtctatcgtggcnacnncnacgcgnacccgnatggcggtgtttcgatgtcgnatgcgagcnacgattcctcgnatacgancacgancatcggttctcgtctggccttccgcggccggctcgttaaggcgtcgagcgccgtggcgtttaaagcgataagcgaggttgcatgatcggccgcgtaaagcgtcaaagcgggagcgaagcgacaaaacatccggtgttccccgagcaggggaacgccgttcattacgggcgtcagcccgtcgaaaaatatttttttgacgtcaggttttgtatctgtttgttaaataataatttgaaaatagtacttttgcatttgaaaggtggcgcctccccataggccgtgtggtctatcgtggcaacaacaacgcgaacccgaatggcggtgtttcgatgtcgaatgcgaacaacgattcctcgaatacgaacacgaacatcggttctcgtctgaacaacaatcgaaaggaaattttaatcggcgtacaacaccggggacttgtccccaccgtggtgccgaggggggcaagccgcagtaacagcggtccgtaagggccggaaaactgaaaaataaagtgtcgggtagggtttggtaggccggaaacggttcgaagaagccgggcccgggggattgaaggccccgtattaaaagcaataaacagtaatttatgcgcagggttgggtatatcatcgaggagatcgtggagccttccaacatggaggcttccttccggcaggtccttcgcggcagcaagcgtaaacgcagccgccaggggtgctatctgctcgcgcataagcccgaggtgttggaggagctggtcgcgcagatcgcatccggtactttccgcgtgaaggactaccgtgaacgcgagatcatcgagggcggcaagctacgccgcattcaggtgatcccgatgaaggaccgcatcgccgtgcatgccatcatggcggtggtggaccgccatctgcggaaacgtttcatccgtaccacctccgccagtatcaagagacgggggatgcacgacctcctggcgtatgtccgccgtgacatggccgaagaccctgatggtacacgttactgttacaagtttgacatcaccaaattctacgagagcgtgaagcaggattttgtgatgtattgcgtcagccgggtgttcaaggacgcaaagctcgtgaccatgctggagagctttatccgcctgatgcctgaaggtctgagtatcggcctgcgcagctcgcaggggctgggcaatttgcttttgtctgtgtatctggaccattatctgaaggacaggtatgccgtgcgtcatttctaccgctattgtgatgacggcgtcgtactgggtaaaacgaaagcggaactgtggaagattcgtgatgccgtccacgggcgcatggagtgtgccggtctcctggtgaaggggaacgagcgcgtgttcccgccgggcgagggcatcgactttctggggtatgtgactttcggtgcggaccatgtccgccttcgcaagcgcatcaagcagaagttcgcccgaaaaatgcacgaggtaaaatcgagaaggaggaggcgtgagctgatagcgtcgttctacgggatggccaagcacgccgactgtcatacgttgtttaaaaaattaacaggcaaagacatgagatcatttaaagacttgaacgtttcctacaagccggaggacggcaagaaacgttttcccggggtggtggtaagcatccgggagctggtgaacttaccgattgtggtgaaggacttcgagacgggcatcaagaccgaacagggcgaggaccgctgtatcgtggccattgagatgaacggtgaaccgaaaaagttctttaccaacagcgaggagatgaagaacatcctcttgcaagtgaaggatatgcccgacggcttcccgttcgagaccaccatcaagacggaaaccttcggcaagggtcgaactaaatacatatttacatgaaacgggtagaaggaacatccgggataaaactgatcgagtgcgtga

SEQ ID NO: 125 - DNA, 4000 bp, Escherichia coli
  misc_feature (193)..(193): n is a, c, g, or t
  misc_feature (199)..(199): n is a, c, g, or t
  misc_feature (397)..(397): n is a, c, g, or t
  misc_feature (460)..(460): n is a, c, g, or t
  misc_feature (1303)..(1303): n is a, c, g, or t
  misc_feature (1474)..(1474): n is a, c, g, or t
  misc_feature (1677)..(1677): n is a, c, g, or t
  misc_feature (1990)..(1990): n is a, c, g, or t
  misc_feature (2143)..(2143): n is a, c, g, or t
  misc_feature (2157)..(2157): n is a, c, g, or t
  misc_feature (2361)..(2361): n is a, c, g, or t
  misc_feature (2658)..(2659): n is a, c, g, or t
  misc_feature (2773)..(2773): n is a, c, g, or t
  misc_feature (2776)..(2776): n is a, c, g, or t
  misc_feature (3324)..(3324): n is a, c, g, or t
  misc_feature (3462)..(3462): n is a, c, g, or t
  misc_feature (3654)..(3654): n is a, c, g, or t
  misc_feature (3879)..(3879): n is a, c, g, or t
  misc_feature (3900)..(3900): n is a, c, g, or t
  misc_feature (3924)..(3924): n is a, c, g, or t
  misc_feature (3930)..(3930): n is a, c, g, or t
  misc_feature (3963)..(3963): n is a, c, g, or t
  misc_feature (3993)..(3993): n is a, c, g, or t
tgacggtgaacctatgatgatcaagggtgatactcagatacaggcatacgatcatgttgtcgtattctgcttggatacggctatgcgtaagctggaggactactttaactagttgatagttatgttgaacgtacgttttatagtgaagatgctaggggtgatgttcatccttgagactttttttatgctggcngctacngtcgtagccttcctttatcgggggagtgatgtatatccgcttcttatttcaagcggaatcttattcgggaccggttttttgttctactctatgggctttaaggcgaatgaacactcggccggccggcgggaaggaatgttgatcgtgacattgacttggattttattctctttatttggaatgttaccattctatatnggaggatatatagataatgtgaccgatgcctttttcgagaccatgtccggatttacgactacnggctctactattttaacgaatatagaggcgttgcctaaaggtatcttattctggcggagtcttacacagtggcagggaggtatcggtatggtcgtattcaccgtggctttgatgcctattttcggaggtggtgcctcgcagatgtttgatgccgaaacgcccggtataacccatgaacgttttcgtcctcgtattacgcaagtcgctaaacgcctgtggggggtgtatgtttttctgacactttttttagtcggccttttatgggctggtccgatgaatttgtatgatgcggtaaatcatgcgttcacggctatatctactggtggatattcaaccaaaaacgcaagtatcgcttattggaattcctcttatatagagtatgtaataactattttcatgtttatcggagctaccaatatgacattggtttatttctgttttaatggaaatgtgaagaaattgattaaagatgaggagtttcgctggtttttcttttttgttttaagcgctattatcgttgtcatggtgtggatcttgtaccttggattcgcctcggatgtagagaatgcgttccgtaaggcggctttccaagtggtgaccttggtttctacctgtggattcgctacggatgactatattccttggggaccgtttttctggtttatcgcattgatcttgatgtttatttgtggatgcgccggatctacttgcggtggcttgaagatgggacgcttcgttattttaacgaagaatctctccaatgaatttaagaaacagacacatccccatgcggtgattccagtacgaatgaacgggcatgtcgtatctggtgatatcgtacancgtgtgttagcttttgtgttcgcttatattacgttaatcgtggtgagctgtttggctttatctttggatgggatgggattttcggaggcgattggtgccgctgtttctgctataagtaacgtagggcccggcttgggaacgcttggtccggtaagtaattttgcggatgtncccacggtgtcgaaatggtttctgtcttttttgatgttaacagggcgtctggagatatttacggtattaacgatattagtccccggtttttggaaacagtaaaattattgaaaatgaaaagtatacaggtcattgctagtctgctgtgtggtattctgtattgtgggatttctttaaatgcccagaatgtattgaaagcaacnggttggatgccagagcacacatttacttccggaatagaaggtccggctgtagatagcgaaggaaatttatatgccgtaaattataagaaagaagggacgatcggtattgtacgcccagatggtagccatggctgttttctcgttttgccggaaggatctaccgggaatagtatccgcttcgggaaagacggaaatatgtacgtggcggattatacagggcataatatcttaaaagtggatatgaaatctaagaagatcagcgtattcgctcatgagccaaagatgaatcaaccaaacgatattgtatttgccnccaatggaaatatctatgcgagtgacccggattggccgaatcaaaaaggccaactttggttgattaccccggatgcgaaagtctccttattggagacgaatatgggaacgactaatggcatcgctgtgagtgaggatggtaaacgcttgtacnttaatgaatctgcncaattaaaagtctgggtatatgatatatgcccggatggtactttaaggaataaacgtctatttcatacttttgaggggtacggtatggatggtatgaagtgtgacgagaaaggaaatctttatatttgccgttatgataagggtactatagctttgttaaatccgcaaggagatttagttgaagagattcaattgacaggaaancagccgtctaacttaacatttggaggacctgatcatcgtcaatgttatgtgacattgcaggatcggggttgttttgaaacctttaaggttccttatccgggaaaagaatggtaacccgatatacgtttttgattaattttgcgttataataggtacggaatattaaaaagatatatagatgatagaatatataaagggtgaaatcgtggaacttacacctacacgtatgattttggagtgtggtggtataggctacgagctgaatatatccttgaatacatatagtgcgtttgggannaagactaccggaaaaatatatatatatgaggtaatccgggaagatgctcatttactatttggctttgccgagaaaatcgaaagggagttgttccttttgcttacttccgtttcnggngtgggaccgaataccgcacgcatgatcctttcttctctaccgccatccgaattggttcaagtgatcggttcgaagaatgaggccgcattgactgccgtgaaagggattggtttgaagacggcccagcgtatcttggtagatttgaaaaataaggtgaaacctatggagagtatggccggaaacttgccggaggcatcagtctctaatggagcggtaaccgaggaggccgtagccgcattggttatgttgggtttccagaaagcggcttcgcaaaaagcggtatccgctattttgaaaggctcgcccactttagctgtggaacaagtaattaaaactgcgcttagaatgctttgataattgacaattgaggattaacgattaacaattgacaattaaatgagaaaatgagaaaacgaatactgaaatattccatatggatcgttgtattattgtttggtgtcggcttgtattcgctgaatgctgattaccttgcgtatacatcatctttgccggaattggagttgctggaagctccggaggatacgatncctccccgttatccggtagctaaaactacaccggaggaatatcaagatatcgtgaaacaatcacctgccgatttgcgtgatccggagaatgtcaagactacgattgagtatgatttaaagacgaatacgtatattgtncgtacgaaattaggcgatatggagattggtacgccgatgagtttaaccccagcggaataccaagattattctatgcaacaatcacttcgttcctatttccgccaaaagaacgaggaagaattccaaaaagctacgaataaacagtttaacttaaccgatatgcagtttaatatcggtgcggcggaacgtatnttcggccccggtggagtacgtgtaagaacacaaggttcggccgagatcacgatgggattgaagacgaataagaataatgatccttctcttccggagcgttcccgtaaacgtactttcttcaattttgacgagagtgtgcagttgaatgtacaagcctcggtgggtagcaaggtgaatttcggaatgaattacaataccgagacctcttttgatttcgattccaanaaattgaagttggcgtatacnggcgaggaggatgagattatcaantcgttngaagccggtaacgtgagcatgaataccagcaantccttgattaatggaggtgcggctttattnggtatga

SEQ ID NO: 126 - DNA, 4000 bp, Escherichia coli
  misc_feature (162)..(162): n is a, c, g, or t
  misc_feature (1988)..(1988): n is a, c, g, or t
  misc_feature (1993)..(1994): n is a, c, g, or t
  misc_feature (2000)..(2000): n is a, c, g, or t
  misc_feature (2012)..(2012): n is a, c, g, or t
  misc_feature (2015)..(2015): n is a, c, g, or t
  misc_feature (2021)..(2021): n is a, c, g, or t
  misc_feature (2026)..(2026): n is a, c, g, or t
  misc_feature (2051)..(2051): n is a, c, g, or t
  misc_feature (2053)..(2054): n is a, c, g, or t
  misc_feature (2059)..(2059): n is a, c, g, or t
aatatcttcattcaaggattcggtttcctcaaagtccattacctcgttcataagtccatcggtatattataggtttcacaatcggcatccaccatttcacggatagccaaacggtctttcaaaaagttctcatagggggatttcgcactttcggcaagcaancccagcatggcagactgatattcgtttaccagcttactttctgtcttagccgggtatcttgcagtaagcaacgtgctgaaaatattatcagccgtttttggatattccaccctcacgctgtcatattggaacatcgtgcctgtggcacgttccgcatcagtcgtaatctcaatgccaccctctttgtctgcaataaccttaacctctttgatgttatggttataaaggaacgttccctgcccgttattaagagaatctatcacctccggcttagtcttagccagcagccctgtagtcaaaacatttgcttccatcgttcaaacaattattaaaaatgaatttactgtgttcctccgagcatctgattatccagccatattcagatgggaagaagtgtttaatatccgtttcatctttgatttcgtatttattgatggtgcggtggaatttcttataaaaccttttcagaataccgcttcttagcaatatgccgtaatggttttgtttgaatcccacataatcaatgctacgagcatcaaccgggaatatctgccaattgcttttaatctctactttcaattcgccacccaagtaaagccccatcatgtcgagtacgaaatgcagtgcctctttgtcagcgcatagtatcaccatatcatccatatagcgatagtagtagattttcaccccaaaacgcttcatcactatcttagccagttcttctttaacccaatggtcgaaatatgctaaatagagattagccaaatattgacttgtgaaattgcctattggcagccccttgtctttaccgttactatctattatcttatccaacagccttaacagttgttcatccgctatagtgtagcggattatccttttcaatgctgcgtggtctatgttatcatagaacttcttgatgtcaatcttcaaacagaaccttgtaccttttctgtctatgattaaagccgtatgcacatcctccatacatttatgaataccacgccctttgatacaagcgtatgtattcgcaatgaagaagttagtccagtaacgccccaacacattgataatgcaatggtgtactatcctgtccgggaagaacggggcaatcataatcaccctttctttcggctcatatataaccttaatccgatattcaccgggggtataagtttcattgcgcaagtcccagtacaagctatccaaattctccaaaatgttctcattgaacttggatatttcggtacgctctcctttgccttgctgtgccttatattgcgcccgtatgaggttggagcattcatatatcaggtgataaacattcttaattttcttagcttgggaaatgaatatctttcctgtatcaccgacatataaaccgcaatcctcaaaatccgagtattgataaaagcaggtatcagccgtataacataacccgtattcagtctttactacacccatttgtgccgttgttctaaaacagagctttcaattacttacttgcaccgtcctaatccatattattttaccaactatcagacgtgccgatagtctctgtgaggtaagggcgtggcagcaacagttataagttgaaaccacggtaaaagcggaacccaatgttcgcattcgcattcgaggaacgattattcgcattcagataaccgaaacccgcagtcgcaccattattcgcattagcagacaaaagggcaccagccgccacaaccctgtaatgtttttatttttttcaatccaacgccattttcgttgctccgttcaccgagttttgcagtccgtcaaaaacggcacaagcggaacccaatgtncgcanncgcatncgaggaacgatnatncgcatncaganaaccgaaacccgcagtcgcaccatnanncgcangagcagacaaaagggcaccataccagcctacagcagaccacgtactaccacctgtgggagtccaatagtaatcgcaatagcctttattacttgaacctcctactttttcggcaaaggaataacctttagtggaatgagccatagaaagcacatagccctcagttcgtggaagctccgtaatggcttcatatccgataggtacggtagtagcactatctgaatgagaggtgaattttgtcgggtcttcgcatacataggcaatagatacatccgctttatgccaaattagtacatcatcagcaagcatccacaagtattcataaggagtttccaaaccacggtaagaggttacttgtaccaccttatcgccaccagtccatcccttgatagtgtaggacaccttacccgtgttgtttcccagcgttgcagtaacaccgcaagggacaaacggtttgtaacctccccatgtattccactccgtaccattaacaaccggaccactccctaagcctccttgatggaatccgtcagcagtcagcgtttcggtgtaagcatcttggcagtgcaatgaggcatattccacacgttgcaaccaagcaatttcattgtacaccctgtacgccccgtggtgtgttccgttcttgcaaagaggacgaacaccagcctttgaaatggaagtacgaggcatacccaacatggagttgtaagtaccatccttagcggcatcaccagcacccgaaccacctctgaattgtgcggcattcgctttgagtataacaaatccgtctgaatcccttgcaatttcatcgccattccaagtgagccaacatcccgaaacggctacagagttggtaatatccaccgttgcataccacgggcttaccgtctttcgttccatcttgataaagccgggcaacggatattcggaataggcacgaatccatttcgtcccctctatttccaacttgaagtaatattccggcttttcaagcattacattaccgtccgtgctgtcaatcacagccgttgcacccgaatcctttttacggctgtcattttggttaaggtaatacttaaccgagccgtcagggttttccacaaagcgtttcagcttcgcttgaatgggtaatgtacggtgtaaatccaaattacccacacgctttagtttgtagtcctgtgagttgaaatcaccttgcaccccataccattggtcgtaaggatattgcggtttcgtgtttccgcttcccaataataatcccatagctataagttatttaatagtttcaccagcaccccaatacacatcatataccgaaaggtcgataccgtttggggatattacggttatcgctccgggcgtccaatccccgataggtacggggaacatactaaattccttatcacaaatgagcttgcatttaagcagcgtacttgtttccatcgtaacctctttaggtcgtacaaagacggtaaacggaacaccacccaaagcaaaaccattggaaaggtctgtaaccttacctttggaaagaatccgtaggctgtacatcgttgtttccataattcactgagtaaatcaagtttatttaactgcaaatataatcataaatgtgttcaacaaacacatttatgattataattaaagtatatcatcagataatgaggtataacgtgcttcaagttcattgattttatctcttagcaactgcctttcattatgcaatgcctttatctcatacggcattgcataccccattagggcggcttcgtagcatttgattatcttataatcgctacttgccaacacctcctttgagcgttcaatctcatgtgccaccttttgaaagtcggggacttctatgtatctgaatgaaatcctgtccccggcatcgtatggcacaatgcgcacaacatagccctccttatctgtgttttgtttac

SEQ ID NO: 127 - DNA, 4000 bp, Escherichia coli
  misc_feature (27)..(27): n is a, c, g, or t
  misc_feature (36)..(36): n is a, c, g, or t
  misc_feature (56)..(56): n is a, c, g, or t
  misc_feature (487)..(487): n is a, c, g, or t
  misc_feature (565)..(565): n is a, c, g, or t
  misc_feature (814)..(814): n is a, c, g, or t
  misc_feature (848)..(848): n is a, c, g, or t
  misc_feature (1985)..(1985): n is a, c, g, or t
  misc_feature (3082)..(3082): n is a, c, g, or t
  misc_feature (3418)..(3418): n is a, c, g, or t
  misc_feature (3569)..(3569): n is a, c, g, or t
  misc_feature (3571)..(3571): n is a, c, g, or t
ttgtcagcaattgcttttactggaacngctacaccnggagagtaagcaagtgctangtctctctttgtcgtcattggttttgaggaattaatctcaatttttccaggtttatttaaactatgaaattctagagcttctttatcagtgtaatggtctattttagtttttttcatttttggtaattaggtatacaattgaagcgaatttaagactaatatgatttatgaatcttctcaagtcaacaggtacgtttagtttttttacgataattagtagattattaggttatttaagagatattttaatagcaatttttcttggaacaggattgctagctgatgcattttttgttgcatttagaattccaaatacttttagaagattattctctgaaggaacatttaatgctgcgtttgtcccaagctattcctctttattaaataataaaaaaaaatcacaagcttttgctaatagtatttttaacttnttaattttaggattgttttttttagtacttcttattgaaattttaatgccagtattcgtctttctaatagcacctggntttgagggcgatcttaagaaaatggaaatagccgtaactctaacaagaattacatttccttttcttttatttattagtttagcatcttttttttctgctattttaaactcacataataaatttgctgtagcatcagctgcaccaattattttaaacatacttttaattagtgttttatttttgggtaaaattttagatgatcaattggtgtattatttatcttatgctgtgacaatctcaggtattttncagcttatttttttatatttttatgtaaaaaaanatttttcacctatagtaaatttttcaatcaagattgataaaaaagtaaaaaatttctttaaaaaattattaccaagtattttttcatctggtgttacccaaataaatattttagttggaacaattattgcctcatttcaaactagtgcagtttcttatctttattatgcagatagagtttatcaaataaatttagcaattgctggaattgcaattggtacagttattttgccccaattatctaagtatgttcaaaatcaaaataaagataaaatgaatttaattcaaaataaagctttagaattaagtttgtttttaagtatccctgctgcaattgcattgttaattgcttcagaagaaattatatcgtcattatttggttatggatcttttgatgaattaagtgttaaaaattcagcaaaggctctattttattttgctattggcttacccgcattttcattgataaaagttttttctgctttttttttcgcaagacacaatacaagattacctttttatatttctctaatctcagttttattaaatatatttataagtgttattttttttaaggaaataggatttattattttacctatagcaactacaatatcatcttggtttaatgcaatttgtttatttgtttttttaaaaaaagataatttgtttaaatttaatttagttttcattgatagatttatcaaaattatagtagcctctattctaatgggtattttttttaattttttgattaatttttttaatgaacaattaatgtattccgaaaattttaaagcaatatatttaatctcaacagtaattgttggatttacattctatatttttatagcactcttaatcaaagcttttaaaaaaagtgatattaatctaaactattaacatgagtaaaaaaattttttcaggtgttcagcctacaggcaatcttcatttgggaaactatcttggcgctataaaaaattttgtagagcttcaaaatgacaagggaaatcattgcattttttgtgttgtagatcttcatgcaatcacagttaagcaagatcctaaggaattaaaaaataatataagagagacagctgctacatttattgcaagcggtatcaatccagataacaanattatctttaaccaatcaatggtgtcagcacattcagaagctgcttggattttaagttgtgtttcaaggattggctggcttaatagaatgactcaatttaaagaaaaagctggaaaagataaagaaaaagctagtattggtctttattcatatcctgttttgatggctgctgatattttgctttatgatgcaacacatgtgccagtaggagacgaccaaaaacagcacctagaactttgcagagatattgcgcaaaaatttaataatgattttaatgcacctgagtttttaaaagtgccagagccattgatacaaaaacaattttctagaataatgagtttaaaagatggattaaaaaaaatgagcaaatcagatccttcagatcttagtagaattaatcttactgacagtaaagatgaaatagttaataagattaaaaaagcaaaaactgacccattgccattaccaaaaaatattgatgagttggttgagcgacctgaagcagaaaatttattaggtatttactctagcttgaaaaatcaaagtttacaaaattcaatagatgaattttcaggaaaaaatttttctgaatttaagatagaactatcagatgttttagttgaaaaaattgaacctatttcaaaaaaaataaaagaattactaaatgatgaaaaatatttagatacaattctgttagaggggtctaaaaaagcagatatagttgcatctaaaaaaattaaggaaataaaagaattagttggtttttaaacaaatatattaattagtttaaatttcataatttatcactatatatataataatgtttatccaaaccgaagctacaccaaatccaaattctttaaagtttcttcctggtaaaagggtatccaataatggatcttttgaagttactaaaaaagaagagactgataacgagttagttcgaaacttgctatctgttaacggcgtgacagctatttttttaggtgcagattttttgtcaattaataagaaagaagaaataagttgggatgatattaaacatatagcaatttctttgattaatgatttctactctacgggcaaagagtttgtcnttgcgaatgaattattcggaggggaaaaagaaaaacatagtgaaatagaaaaacaaattataagtattttagagtctaaaattagaccagctgttgctaaagatggtggagatattaaatttaaagaatttaaagatggtgttgtcaaagtagaactacaaggtagttgctctggatgcccaagctcaacaatgacacttaagcaaggagtgcaaaatcttttgtgccattatctccctgaggtaaaagaggtggtagctatatagttatgagaaataaagaattttcactgttagagataaaaagatttttaaaaaaaaagggacttataataanaaagaatatctacaaaaaaaaatctattaccttaaataccctatcaaaaacttttttatctagtttaattataatctcttttttctttgttttgccacttgccattgatcttacaaataaaaaaatattattttctaaaaactatgagaananttccaaaaataatttgaataaactactagaaaaccaagatccaaaactagatgatggcttagataaaaaatctttatttgaagacattttcacatttgatcaacagccaagagataaagatagtgtgagattaagtgcatctacaattgaagagttatttaaatcaacaaattataatttagaagatgtaagaaaaaataaattagtaaaaccgatttctttaacattattaccggcagagattactaaaatagaaaatgctaaaaaaagaaaagagttatttatccaaattattttaccattagtcattgaagaaaataataatattaaatctgaccgtaataaactttttactattctaaataaaagtaaaaatactaaagcagaacaaaattggctgaactcaaaatttaaacaatatggagttgt

SEQ ID NO: 128 - DNA, 4000 bp, Escherichia coli
  misc_feature (92)..(92): n is a, c, g, or t
  misc_feature (1153)..(1153): n is a, c, g, or t
  misc_feature (1182)..(1182): n is a, c, g, or t
  misc_feature (1187)..(1188): n is a, c, g, or t
  misc_feature (1190)..(1190): n is a, c, g, or t
  misc_feature (1930)..(1930): n is a, c, g, or t
  misc_feature (1948)..(1949): n is a, c, g, or t
  misc_feature (1957)..(1957): n is a, c, g, or t
  misc_feature (1963)..(1963): n is a, c, g, or t
  misc_feature (1982)..(1982): n is a, c, g, or t
  misc_feature (1984)..(1984): n is a, c, g, or t
  misc_feature (1987)..(1987): n is a, c, g, or t
  misc_feature (1999)..(1999): n is a, c, g, or t
  misc_feature (2005)..(2005): n is a, c, g, or t
cgcttgaccgagtaggccgcacggctgaaagcaatgcaccaccaacaaaggaaggtgtttcccttccctgctatccacggcggggataaatncaagattgctgataccgaagcattgcccgcgggcatggcagaggttacgcacggcaaggagttttttaaccatgaacgactttgaaaaagtctggaattttgaaagcctctaccgcgcctatatgaaggcgcggcggggcaaacgctggaagggagcggcggcgaagtttgaagttaatttgctggaagctcttaaccttttaagcgaacagttgaaaagcaaaacgtacaggctttcgccatacaacacgttcaaggtgtacgaaccaaaagaacgcgttgttatgtcgaacagctacaaagacaaggtagtgcaacatgcactttgcgacaacgttttgcaaccgcgcgtcgcgccgtcgttcatcaaagacaactacgcgtcgcaagtgggaaaaggaacgcatttcgggcttgatcggctggaagagttcatgcgccgcttctaccgcaaacacggcgttgacggctgggtgttgaagtgcgacatacgcaaatacttctattccatccagcacgacaccttaaagggcttgatccggaaatatattgacgatcccgaatgcctttggttgctggacatgataattgacagcaccgaaggcaacgtaggaattccgatcggcaatcagtcttcgcagattttcgccctgctttacctttccccgctggatcatttcatcaaggaaaaattgggcgtgaagttctacggtcgatatatggacgatttttatttgatccacgaagaccgcgaatatttgcgccattgctggaaggagattgaagagcatgtaaacaaaatcgggcttgcgctgaacgagaaaacgaacatatacccgttgaagaacggaattgattttttgggctttcacacgtacatttcggaaacgggcgcggtgatccgcaaggtgcgccggaaatcgaagaacaacgtgcgccgcaagttgaagaaaatgcggggcttgttggaggcgggacggatcacgccggaaacggtggaacagtcatataaaagctggcgcggccacgcgtcgaagggaaattgccatcaccttatccgnaacatggatcaatattacaatcaactatncgggnngnccgccgccgttgcgcagaagcgcggcggcggttctgcttcacaaaaggaggaacgcagataatggctaaatctttaagcacgctggccgttggcgcaacgtttgaagttcccgtaaaagcggcgtatcaatcgcttttgggcgcaaccgtcgttttcaaaatggccgacaagaaccattcgggttatccgtctaattcggtgacgctcatttgtgacaaaatcccgattgtgcttgctttcgacgcgaaagagccgagcaacagcaacgcagatcggaaaaactacggcaacaaccgctattcctatgcgaacgtgcttcaatggctgaacagcaacgccacggcggggaattggtacagcgcgaagcatagcgcggatcaatccccttcttccgcgtcttacgtgtcaaacaatccgtattcaagcaaggcgggtttccttgcaatgcttgatgataatttcgttgcggcattgctgaatacaacggtgacggtggcaaaaaacaccgtcacggacggcgggagctatgaaaccgtcaccgcaaaaatgcaccttccttctactacggaagtagggcttgcgaacgaaaacagcattgcagaaggcgcgaagctggcgttgttcagcgacaacacaagccgacttgcttaccctacggcgcaatgcgtgtcgaacagcgactatacaaacagcagtttcaacgcttcggcggcgtggtattactggcttcgcacgccgnattccggctattcgtacnncgtgcgcnatgtcnattcttcgggcgcgttgancnacnacaacgcgtacnacggcnataggggcgtgcgcccgctttgtaatctatcatcttctatcttggtatctgacaccacgaatgcaaacggcaactacgaatttcaatggaacgaagccccgtccacgccgtccggaatttccgtgccgtccagttgttacagcacgcagaatattttggtgtcgtggggagcttccaccgatccggacggcgacgaaatcacttacgttctggaacggtcgtacaacaacggaagctatgcgcaagtggcggcaaccgcggggcggtcgtttacggaagtggtgtccacaagctggaatacggttcgttaccgcgtaaaggcgcgtgacagcttcggcaatgaaagcgcgtatattacttccagcgaagcggcggtgatccacaatcagccgcccgccatttccggacagaacgccgatcttggcacgaagcgcgaaggcttttcccatgcgtacaccgtgaccgatccggacggcgacgcggtgacggtggttgaagcggtggatggaaagaccttgcggagctacacgcctacgcttggacagtcaaataatttgacgctggcaggaaacgacttcaccgccctttcaaacgaggcgcacacgatcaccattacggcgacggacagcgcgggcaattcggcggttcgcacgctgacttttacaaaggcaatcagcggttttgtaatctaccttgaaacgccgcttgaagcggaggcgcagccgaagcgggcgaacattgttgtaacgcgcggcattcccgcgggcggcacgttcaaggttgaggcgacgaacaatccgtttgatcctacgcccgtttgggaggattgcacgaacgcggttgtgcagggcgtggcgcacgtcttcgagaacacggaaaacgccgcggtgcaattcggcttgaacgcccgcgtgacggtggagcgcggcgacgctatttccgaatgctgggtgtcttcgattgggggtaattttgaatgagcgtaacacataggccggacagaccggacaaaacggaagagctgacaaaggaagttgagagcgtaaaggcggcgggcgaaagcaccgccgctttgctttccctttccttcaaagcgcagatcgtacaggatcgcgcggcgggaacgaacgcaatttctgatgaaatgatccttgcttcaacggcggtcgttgaatacgacgacttcaaggacaaccacgcctataacaccgtgggcgaaatcatcaaatcggacgggctgtattttgagatcgtcgcgccgcacacgtccaacgccgccgcttatccggtagcaacaacgttcgcgtattaccgccttgtggagctgacgcacacggggacgcttgatgatccgatcccatatccggaaaccgcgggcgtgctggtaaacgtgaagaacgggttgtattacagctataaaggcgcggtttatctggcgaagctggatatgccgaattgcgtatacccgcccgacacggcgggtatgtggcaatgggaacaagtgtaaaggcggtgaaagcatggaacagattttaacggcaatttccgtcgttagtacaatttgcgcaatcgtcttcggctacgccgcattttcccgcaaccgaacaaaggacaccgaagacgaagtgaagcgggacacaacggttttgtctgaaatcggctatatcaaaagcggcgttgatgatattaaggcagaacagcgcgaacagcgaaagacaaataccgaatttgtgtcgcggctgacggcggttgaagcgtccgcgaagcaggcgcacaagcgtattgacacgctggaaggacacacaacgcgggaataacgaagggagcgaaagacaatggcagttatgaaagcaagcgaattcgtgaagaagctgaaagatgttgcgcagaattacaaaacactttatgtcatggggtgcttcggcgcgccgctgaacggatcgaacgtcacaaggtattgcacgaaccatagctacaacaaggacgcaacgcgaa

SEQ ID NO: 129 - DNA, 4000 bp, Escherichia coli
  misc_feature (1992)..(1992): n is a, c, g, or t
  misc_feature (2121)..(2121): n is a, c, g, or t
  misc_feature (2758)..(2758): n is a, c, g, or t
  misc_feature (2788)..(2788): n is a, c, g, or t
  misc_feature (2797)..(2797): n is a, c, g, or t
  misc_feature (2800)..(2800): n is a, c, g, or t
  misc_feature (2806)..(2806): n is a, c, g, or t
  misc_feature (2808)..(2808): n is a, c, g, or t
  misc_feature (2812)..(2812): n is a, c, g, or t
  misc_feature (2817)..(2817): n is a, c, g, or t
  misc_feature (2820)..(2820): n is a, c, g, or t
  misc_feature (2822)..(2823): n is a, c, g, or t
  misc_feature (2827)..(2827): n is a, c, g, or t
  misc_feature (2829)..(2829): n is a, c, g, or t
  misc_feature (2831)..(2831): n is a, c, g, or t
  misc_feature (2844)..(2844): n is a, c, g, or t
  misc_feature (2848)..(2848): n is a, c, g, or t
  misc_feature (2850)..(2851): n is a, c, g, or t
  misc_feature (2853)..(2854): n is a, c, g, or t
  misc_feature (2856)..(2857): n is a, c, g, or t
  misc_feature (2859)..(2860): n is a, c, g, or t
  misc_feature (2862)..(2862): n is a, c, g, or t
  misc_feature (2865)..(2865): n is a, c, g, or t
  misc_feature (2867)..(2867): n is a, c, g, or t
  misc_feature (2869)..(2874): n is a, c, g, or t
  misc_feature (2876)..(2877): n is a, c, g, or t
  misc_feature (2879)..(2879): n is a, c, g, or t
  misc_feature (2883)..(2884): n is a, c, g, or t
  misc_feature (2887)..(2891): n is a, c, g, or t
  misc_feature (2893)..(2896): n is a, c, g, or t
  misc_feature (2900)..(2900): n is a, c, g, or t
  misc_feature (2903)..(2904): n is a, c, g, or t
  misc_feature (2907)..(2909): n is a, c, g, or t
  misc_feature (2913)..(2915): n is a, c, g, or t
  misc_feature (2917)..(2920): n is a, c, g, or t
  misc_feature (2922)..(2923): n is a, c, g, or t
  misc_feature (2925)..(2926): n is a, c, g, or t
  misc_feature (2928)..(2928): n is a, c, g, or t
  misc_feature (2931)..(2931): n is a, c, g, or t
  misc_feature (2933)..(2943): n is a, c, g, or t
  misc_feature (2945)..(2953): n is a, c, g, or t
  misc_feature (2955)..(2962): n is a, c, g, or t
  misc_feature (2965)..(2967): n is a, c, g, or t
  misc_feature (2969)..(2974): n is a, c, g, or t
  misc_feature (2976)..(2976): n is a, c, g, or t
  misc_feature (2978)..(3004): n is a, c, g, or t
  misc_feature (3006)..(3024): n is a, c, g, or t
  misc_feature (3026)..(3043): n is a, c, g, or t
  misc_feature (3045)..(3048): n is a, c, g, or t
  misc_feature (3050)..(3058): n is a, c, g, or t
  misc_feature (3060)..(3062): n is a, c, g, or t
  misc_feature (3064)..(3071): n is a, c, g, or t
  misc_feature (3073)..(3073): n is a, c, g, or t
  misc_feature (3075)..(3075): n is a, c, g, or t
  misc_feature (3077)..(3089): n is a, c, g, or t
  misc_feature (3091)..(3091): n is a, c, g, or t
  misc_feature (3094)..(3096): n is a, c, g, or t
  misc_feature (3098)..(3103): n is a, c, g, or t
  misc_feature (3105)..(3106): n is a, c, g, or t
  misc_feature (3108)..(3108): n is a, c, g, or t
  misc_feature (3112)..(3120): n is a, c, g, or t
  misc_feature (3123)..(3127): n is a, c, g, or t
  misc_feature (3130)..(3141): n is a, c, g, or t
  misc_feature (3144)..(3147): n is a, c, g, or t
  misc_feature (3149)..(3150): n is a, c, g, or t
  misc_feature (3154)..(3156): n is a, c, g, or t
  misc_feature (3158)..(3160): n is a, c, g, or t
  misc_feature (3162)..(3162): n is a, c, g, or t
  misc_feature (3164)..(3164): n is a, c, g, or t
  misc_feature (3166)..(3166): n is a, c, g, or t
  misc_feature (3168)..(3169): n is a, c, g, or t
  misc_feature (3171)..(3174): n is a, c, g, or t
  misc_feature (3176)..(3178): n is a, c, g, or t
  misc_feature (3181)..(3184): n is a, c, g, or t
  misc_feature (3186)..(3192): n is a, c, g, or t
  misc_feature (3194)..(3195): n is a, c, g, or t
  misc_feature (3197)..(3197): n is a, c, g, or t
  misc_feature (3199)..(3200): n is a, c, g, or t
  misc_feature (3206)..(3206): n is a, c, g, or t
  misc_feature (3208)..(3208): n is a, c, g, or t
  misc_feature (3210)..(3212): n is a, c, g, or t
  misc_feature (3217)..(3217): n is a, c, g, or t
  misc_feature (3225)..(3228): n is a, c, g, or t
  misc_feature (3230)..(3233): n is a, c, g, or t
  misc_feature (3239)..(3239): n is a, c, g, or t
  misc_feature (3242)..(3243): n is a, c, g, or t
  misc_feature (3248)..(3248): n is a, c, g, or t
  misc_feature (3251)..(3251): n is a, c, g, or t
  misc_feature (3257)..(3261): n is a, c, g, or t
  misc_feature (3263)..(3263): n is a, c, g, or t
  misc_feature (3275)..(3275): n is a, c, g, or t
  misc_feature (3277)..(3279): n is a, c, g, or t
  misc_feature (3281)..(3282): n is a, c, g, or t
  misc_feature (3286)..(3286): n is a, c, g, or t
  misc_feature (3288)..(3288): n is a, c, g, or t
  misc_feature (3290)..(3291): n is a, c, g, or t
  misc_feature (3294)..(3294): n is a, c, g, or t
  misc_feature (3297)..(3299): n is a, c, g, or t
  misc_feature (3302)..(3303): n is a, c, g, or t
  misc_feature (3311)..(3312): n is a, c, g, or t
  misc_feature (3317)..(3317): n is a, c, g, or t
  misc_feature (3326)..(3326): n is a, c, g, or t
  misc_feature (3330)..(3330): n is a, c, g, or t
  misc_feature (3333)..(3333): n is a, c, g, or t
  misc_feature (3335)..(3337): n is a, c, g, or t
  misc_feature (3339)..(3339): n is a, c, g, or t
  misc_feature (3341)..(3341): n is a, c, g, or t
  misc_feature (3344)..(3350): n is a, c, g, or t
  misc_feature (3352)..(3359): n is a, c, g, or t
  misc_feature (3361)..(3361): n is a, c, g, or t
  misc_feature (3363)..(3365): n is a, c, g, or t
  misc_feature (3367)..(3373): n is a, c, g, or t
  misc_feature (3375)..(3376): n is a, c, g, or t
  misc_feature (3378)..(3382): n is a, c, g, or t
  misc_feature (3384)..(3385): n is a, c, g, or t
  misc_feature (3387)..(3387): n is a, c, g, or t
  misc_feature (3390)..(3390): n is a, c, g, or t
  misc_feature (3392)..(3396): n is a, c, g, or t
  misc_feature (3398)..(3399): n is a, c, g, or t
  misc_feature (3401)..(3402): n is a, c, g, or t
  misc_feature (3404)..(3408): n is a, c, g, or t
  misc_feature (3411)..(3413): n is a, c, g, or t
  misc_feature (3416)..(3420): n is a, c, g, or t
  misc_feature (3423)..(3424): n is a, c, g, or t
  misc_feature (3426)..(3433): n is a, c, g, or t
  misc_feature (3435)..(3438): n is a, c, g, or t
  misc_feature (3440)..(3443): n is a, c, g, or t
  misc_feature (3445)..(3445): n is a, c, g, or t
  misc_feature (3449)..(3449): n is a, c, g, or t
  misc_feature (3451)..(3454): n is a, c, g, or t
  misc_feature (3456)..(3467): n is a, c, g, or t
  misc_feature (3469)..(3469): n is a, c, g, or t
  misc_feature (3472)..(3478): n is a, c, g, or t
  misc_feature (3480)..(3484): n is a, c, g, or t
  misc_feature (3486)..(3488): n is a, c, g, or t
  misc_feature (3490)..(3490): n is a, c, g, or t
  misc_feature (3492)..(3496): n is a, c, g, or t
  misc_feature (3498)..(3499): n is a, c, g, or t
  misc_feature (3501)..(3503): n is a, c, g, or t
  misc_feature (3505)..(3506): n is a, c, g, or t
  misc_feature (3508)..(3514): n is a, c, g, or t
  misc_feature (3516)..(3523): n is a, c, g, or t
  misc_feature (3525)..(3525): n is a, c, g, or t
  misc_feature (3527)..(3527): n is a, c, g, or t
  misc_feature (3529)..(3532): n is a, c, g, or t
  misc_feature (3534)..(3546): n is a, c, g, or t
  misc_feature (3549)..(3549): n is a, c, g, or t
  misc_feature (3552)..(3556): n is a, c, g, or t
  misc_feature (3560)..(3560): n is a, c, g, or t
  misc_feature (3564)..(3565): n is a, c, g, or t
  misc_feature (3567)..(3568): n is a, c, g, or t
  misc_feature (3571)..(3575): n is a, c, g, or t
  misc_feature (3577)..(3577): n is a, c, g, or t
  misc_feature (3579)..(3579): n is a, c, g, or t
  misc_feature (3582)..(3584): n is a, c, g, or t
  misc_feature (3586)..(3589): n is a, c, g, or t
  misc_feature (3591)..(3599): n is a, c, g, or t
  misc_feature (3601)..(3602): n is a, c, g, or t
  misc_feature (3604)..(3608): n is a, c, g, or t
  misc_feature (3610)..(3615): n is a, c, g, or t
  misc_feature (3618)..(3623): n is a, c, g, or t
  misc_feature (3625)..(3625): n is a, c, g, or t
  misc_feature (3627)..(3633): n is a, c, g, or t
  misc_feature (3637)..(3638): n is a, c, g, or t
  misc_feature (3640)..(3643): n is a, c, g, or t
  misc_feature (3645)..(3648): n is a, c, g, or t
  misc_feature (3650)..(3658): n is a, c, g, or t
  misc_feature (3660)..(3660): n is a, c, g, or t
  misc_feature (3663)..(3664): n is a, c, g, or t
  misc_feature (3666)..(3666): n is a, c, g, or t
gcaccgagatgctgttgtggtggcccgccacgtcgagttccagaaacggaaagctgacggcggcgatcatcaaaataaacgcagagatcgcgaggcttaaaactgttgcgagggccgttggccgttctgtggcgatcaccccgccacagcgtttacaatgggcgcgcacattctcgggcaacaccgacgcacggtgcagcgtatcgcaatgcggacaagccacaagctgagacaacgggggcaaatcgcttggcagcacgacatcctcagggttcaatccgttcgcagtgaacgtttgggcatgcatagccctaagaagtcgaagttgctacggcaaatttgggttttaactccgcggttgaccatccagcgtcaggtcgcaaggcagcgcgaaatcaatgaccgcctgcgcgttaggaatgtcattgccttccgcacgccgggttgccaccagacggctatggttgagcgatagccagcgctgaataagccgcgcacgcagttcgggcagcgggacatccagccgcgccgtaatatcccaaagaggcgcaagatcacgccatccctcggcgtcaaacatcagataattaccttcaacaatcaccacaggcagatcggcagacacatgcattgcgcctgcaatcgacagatcgcgggggcggtcaaagaggggcacatatacatcaactccgctctttattgccttgataagacgtgtgaatccaccaacgtcaaatgtctctggcgcacctttgcgtgccatcaaattgaggtcttcaaggatcgcattatcgaggtggaacccatccattggaacaacaatacaagggcacttttgtaaagaaatccgccgcgcgacctctttggctaaggttgactttccactgcccggagcgccggcgattgcaacgatgagcctgccgccctccgcccgcttttcatggatgagagatgcaagcgcatcaacgtgatctgttaaactggacaatttttgcgccctttcacggccttttttgaaactataatcgcaaatgaaaaatcggcaattcaattcaaaacaaagtccaaaaacggtctccattgttgctctggcaatcggggctcgctcaacataggttactccacattcttgaaggggctgcagaatgacgggatttggctggctgttacggctttggcggttgctttatgcgacgtggctcttgtcgggtcgcaagcaaaccagcttgatcgcggcaggcgttgccttctttgggatgtttgccgtctttccagctatcgctgcggtcatcgcactctttgggcttgtggctgatcctgcggttgtgggcacgcagttggagttgttgcaaaacataatccctgaggacgcctattcgcttttctccagccagatcaatcgattgctgcgcgcgcagacccatacgttgggttgggcgacatttgtgtctattgtcttggcgttgtggtcgtcgcgggcaggggtggcggctttgatgggcgggcttgatgccattgcaggcggcatgccgcgtaacgggatttggcacgcggtcgtggcgttttggctgacgatatgtctggtctcgctggcgattgtcgctctctttgcggtagttgtaacgccgatcattttggcgttcctgccgatcgctgcatcaacagcgtggatgttagaggcattgcgctggcttatcgcgctgacctcactcttgctcgcgcttggcttgttgtaccgctttggccctgcgcgtggtgaggggcgcatccgctggtttacagtcggagctgtcgcagtggtcattttgtgggtcgcagcgtcggttggcctctcttattacctcacaaatttcggcgcctacaatgaagtctacggatccatcggcgcggtaattggcttgatgctctggctctatgtcagcgcctatctggtattgctcggggcagcgctcaacgaacaggttcacagaaataccgctggaaaatcaagcncttaaataacgtgactctcctgcaacaaccctagaaaaatcgtgattgtggcggcaatgcggcgcttaaatgacgtttgaaagggcattttcccactagaatttgagcaaatccccagatagtgtggtntcaattaaagtaagcacacgtccatgatggcggtgcaatgaggcggagttagtattatatcagcgattgagttcgttgtcagcgatggcgcgggcgcagttacacgtgggtcgattgcaggagcaagcggcgacaattctattatagtcggtgcgggtcaggatatctcgctgaacctcgatagaaataacattctttcctatgtgcgtcagggtcaggccttgcaggttactttggttgatggccggatggtcacaatcgaagggttctttagtcctgagggcgcgattgagaacgacttgatgatctctgcaaatggctcgctttccaaggttgatttgaccgcgggtgagggaaacctcctttacgcgcaatatgtagacgcggactcctttggtaagtggagccccgacgatgatctctacttcgtgcgtggctcggaggttatggttgccggcgtagaggctgctgacgcagaagcgggtatgttgttcacgccacttctgggtggtcttggtggtttgggtggtcttggcgcggggcggcagcggctgttgctgcggcggctatcgttgccggttctggtaaaggcgacggtgacccaaccgatccagttgacccaaccgatcctgttganccaaccgatcctactgacccaaccgatccnactgacccnacngatccngntganccagntgntnntgcnancnctggtggcgttgngagngnngnngnngnngnaantngnnnnnntnntnaagnnggnnnnnannnngaangtnntgnnncaannngnnnnanngnnanaancnnnnnnnnnnntnnnnnnnnngnnnnnnnngtnnntnnnnnngntnnnnnnnnnnnnnnnnnnnnnnnnnnnannnnnnnnnnnnnnnnnnngnnnnnnnnnnnnnnnnnnannnnannnnnnnnnannncnnnnnnnnangncnnnnnnnnnnnnnangcnnnannnnnngnnanggtnnnnnnnnncgnnnnngtnnnnnnnnnnnntcnnnncnntgannncnnncncntngnngnnnncnnngannnngnnnnnnncnncngnngtacangnannngatangctggtgnnnntnnnnttgagngtnncgacngtnacgacnnnnngnctggtgagtctngnnnanntggncngnntgntcnnnctnntgggcagnncgcgnacggcttgnacgnttntnnngntnatnnnnnnncnnnnnnnnancnnngnnnnnnngnntnnnnntnngncgntnnnnntnncnncnnnnncannngcnnnnngcnngnnnnnnnngnnnntnnnngngacngnnnngnnnnnnnnnnnnancannnnnnngnnnnncnnngntnnnnntnncnnnannannnnnnncnnnnnnnntnanannnngnnnnnnnnnnnnnacngtnnnnncaancgcnnanngcnnnnngncngcnnnannnngnnnnnnnnngnngnnnnnannnnnnctnnnnnngncnnnnnnngcgnntnnnncnnnngnnnnnnnnnanacnncnatggcgaatggtccgcaacatttagcgcatctgaggtgccaacaggtacgcttgatgtgcctgtgactgcgatttccactgatgcagtgggcaacactgcaacggcatctggcacggtccacattgatacagagctcagcactgcgatcgacacctctggtgtagaagcggacggcattgtgaacgctgtagagcatgctgatggcgtcacactgaatggtactgctgatgcgggcgctcaggtcactgttacatttggcacaggcacgcgcgttgtgacggctacggcgaatggcacatggtcggctgattgggcgacgtccgaagtgccaac

SEQ ID NO: 130 - DNA, 4000 bp, Escherichia coli
  misc_feature (1)..(4): n is a, c, g, or t
  misc_feature (6)..(12): n is a, c, g, or t
  misc_feature (14)..(15): n is a, c, g, or t
  misc_feature (17)..(20): n is a, c, g, or t
  misc_feature (22)..(27): n is a, c, g, or t
  misc_feature (29)..(31): n is a, c, g, or t
  misc_feature (33)..(37): n is a, c, g, or t
  misc_feature (39)..(39): n is a, c, g, or t
  misc_feature (41)..(51): n is a, c, g, or t
  misc_feature (53)..(56): n is a, c, g, or t
  misc_feature (61)..(61): n is a, c, g, or t
  misc_feature (63)..(87): n is a, c, g, or t
  misc_feature (89)..(89): n is a, c, g, or t
  misc_feature (91)..(94): n is a, c, g, or t
  misc_feature (96)..(103): n is a, c, g, or t
  misc_feature (105)..(108): n is a, c, g, or t
  misc_feature (111)..(111): n is a, c, g, or t
  misc_feature (113)..(114): n is a, c, g, or t
  misc_feature (116)..(124): n is a, c, g, or t
  misc_feature (126)..(144): n is a, c, g, or t
  misc_feature (146)..(147): n is a, c, g, or t
  misc_feature (149)..(153): n is a, c, g, or t
  misc_feature (155)..(164): n is a, c, g, or t
  misc_feature (166)..(170): n is a, c, g, or t
  misc_feature (172)..(174): n is a, c, g, or t
  misc_feature (176)..(177): n is a, c, g, or t
  misc_feature (179)..(198): n is a, c, g, or t
  misc_feature (200)..(208): n is a, c, g, or t
  misc_feature (210)..(216): n is a, c, g, or t
  misc_feature (218)..(230): n is a, c, g, or t
  misc_feature (233)..(233): n is a, c, g, or t
  misc_feature (235)..(236): n is a, c, g, or t
  misc_feature (239)..(244): n is a, c, g, or t
  misc_feature (246)..(248): n is a, c, g, or t
  misc_feature (250)..(253): n is a, c, g, or t
  misc_feature (257)..(268): n is a, c, g, or t
  misc_feature (270)..(274): n is a, c, g, or t
  misc_feature (276)..(282): n is a, c, g, or t
  misc_feature (284)..(288): n is a, c, g, or t
  misc_feature (290)..(294): n is a, c, g, or t
  misc_feature (296)..(302): n is a, c, g, or t
  misc_feature (304)..(320): n is a, c, g, or t
  misc_feature (322)..(324): n is a, c, g, or t
  misc_feature (326)..(334): n is a, c, g, or t
  misc_feature (336)..(337): n is a, c, g, or t
  misc_feature (339)..(342): n is a, c, g, or t
  misc_feature (345)..(347): n is a, c, g, or t
  misc_feature (349)..(354): n is a, c, g, or t
  misc_feature (356)..(356): n is a, c, g, or t
  misc_feature (361)..(364): n is a, c, g, or t
  misc_feature (366)..(368): n is a, c, g, or t
  misc_feature (370)..(373): n is a, c, g, or t
  misc_feature (375)..(377): n is a, c, g, or t
  misc_feature (379)..(388): n is a, c, g, or t
  misc_feature (391)..(394): n is a, c, g, or t
  misc_feature (396)..(396): n is a, c, g, or t
  misc_feature (398)..(398): n is a, c, g, or t
  misc_feature (401)..(403): n is a, c, g, or t
  misc_feature (405)..(408): n is a, c, g, or t
  misc_feature (410)..(411): n is a, c, g, or t
  misc_feature (413)..(413): n is a, c, g, or t
  misc_feature (415)..(418): n is a, c, g, or t
  misc_feature (421)..(447): n is a, c, g, or t
  misc_feature (449)..(450): n is a, c, g, or t
  misc_feature (452)..(457): n is a, c, g, or t
  misc_feature (459)..(462): n is a, c, g, or t
  misc_feature (464)..(464): n is a, c, g, or t
  misc_feature (466)..(472): n is a, c, g, or t
  misc_feature (475)..(478): n is a, c, g, or t
  misc_feature (480)..(481): n is a, c, g, or t
  misc_feature (484)..(499): n is a, c, g, or t
  misc_feature (501)..(504): n is a, c, g, or t
  misc_feature (508)..(508): n is a, c, g, or t
  misc_feature (510)..(511): n is a, c, g, or t
  misc_feature (514)..(534): n is a, c, g, or t
  misc_feature (536)..(537): n is a, c, g, or t
  misc_feature (539)..(539): n is a, c, g, or t
  misc_feature (541)..(543): n is a, c, g, or t
  misc_feature (546)..(546): n is a, c, g, or t
  misc_feature (549)..(558): n is a, c, g, or t
  misc_feature (561)..(567): n is a, c, g, or t
  misc_feature (570)..(572): n is a, c, g, or t
  misc_feature (574)..(575): n is a, c, g, or t
  misc_feature (578)..(582): n is a, c, g, or t
  misc_feature (585)..(614): n is a, c, g, or t
  misc_feature (616)..(619): n is a, c, g, or t
  misc_feature (622)..(626): n is a, c, g, or t
  misc_feature (628)..(637): n is a, c, g, or t
  misc_feature (639)..(649): n is a, c, g, or t
  misc_feature (651)..(651): n is a, c, g, or t
  misc_feature (656)..(656): n is a, c, g, or t
  misc_feature (661)..(665): n is a, c, g, or t
  misc_feature (668)..(668): n is a, c, g, or t
  misc_feature (670)..(673): n is a, c, g, or t
  misc_feature (676)..(677): n is a, c, g, or t
  misc_feature (703)..(703): n is a, c, g, or t
  misc_feature (710)..(711): n is a, c, g, or t
  misc_feature (718)..(719): n is a, c, g, or t
  misc_feature (721)..(721): n is a, c, g, or t
  misc_feature (724)..(725): n is a, c, g, or t
  misc_feature (727)..(728): n is a, c, g, or t
  misc_feature (730)..(730): n is a, c, g, or t
  misc_feature (732)..(734): n is a, c, g, or t
  misc_feature (736)..(736): n is a, c, g, or t
  misc_feature (738)..(738): n is a, c, g, or t
  misc_feature (741)..(743): n is a, c, g, or t
  misc_feature (746)..(750): n is a, c, g, or t
  misc_feature (752)..(755): n is a, c, g, or t
  misc_feature (757)..(758): n is a, c, g, or t
  misc_feature (761)..(762): n is a, c, g, or t
  misc_feature (764)..(766): n is a, c, g, or t
  misc_feature (768)..(781): n is a, c, g, or t
  misc_feature (784)..(799): n is a, c, g, or t
  misc_feature (801)..(805): n is a, c, g, or t
  misc_feature (807)..(809): n is a, c, g, or t
  misc_feature (812)..(813): n is a, c, g, or t
  misc_feature (816)..(816): n is a, c, g, or t
  misc_feature (830)..(837): n is a, c, g, or t
  misc_feature (839)..(839): n is a, c, g, or t
  misc_feature (842)..(846): n is a, c, g, or t
  misc_feature (848)..(851): n is a, c, g, or t
  misc_feature (853)..(855): n is a, c, g, or t
  misc_feature (858)..(858): n is a, c, g, or t
  misc_feature (860)..(865): n is a, c, g, or t
  misc_feature (868)..(868): n is a, c, g, or t
  misc_feature (871)..(875): n is a, c, g, or t
  misc_feature (877)..(878): n is a, c, g, or t
  misc_feature (880)..(881): n is a, c, g, or t
  misc_feature (1533)..(1540): n is a, c, g, or t
  misc_feature (1544)..(1545): n is a, c, g, or t
  misc_feature (1985)..(1985): n is a, c, g, or t
  misc_feature (1989)..(1989): n is a, c, g, or t
nnnnannnnnnnannannnntnnnnnntnnnannnnnantnnnnnnnnnnntnnnntttanannnnnnnnnnnnnnnnnnnnnnnnntnannnntnnnnnnnnannnnaantnntnnnnnnnnntnnnnnnnnnnnnnnnnnnntnntnnnnntnnnnnnnnnntnnnnntnnntnnannnnnnnnnnnnnnnnnnnntnnnnnnnnnannnnnnnannnnnnnnnnnnntancnnttnnnnnnannnannnnaaannnnnnnnnnnntnnnnntnnnnnnnannnnnannnnntnnnnnnntnnnnnnnnnnnnnnnnnannntnnnnnnnnntnnannnnaannnannnnnntnatttnnnntnnnannnntnnnannnnnnnnnnttnnnntnantannntnnnntnnantnnnnttnnnnnnnnnnnnnnnnnnnnnnnnnnnanntnnnnnntnnnnanannnnnnnttnnnntnnttnnnnnnnnnnnnnnnntnnnntttntnnttnnnnnnnnnnnnnnnnnnnnntnntntnnnatnttnnnnnnnnnnaannnnnnnttnnnannttnnnnnttnnnnnnnnnnnnnnnnnnnnnnnnnnnnnntnnnnttnnnnntnnnnnnnnnntnnnnnnnnnnnanttttnttttnnnnnttntnnnnttnntttttttttttttttttttttttttnttttttnnttttttnnanttnntnnantnnntntnttnnnacnnnnnannnntnnttnnannntnnnnnnnnnnnnnnttnnnnnnnnnnnnnnnntnnnnntnnnttnnatntttttttttttttnnnnnnnnanaannnnntnnnntnnnatnannnnnntanatnnnnntnntnnttttttttttttttttttttttttttttttttttttaatatcgcctcctcgatctacatctgttataaattataaattcctcttttccattgtatataattttatattctttggtatactataaatatttaaatatattcattaccatatgccagtctgagattgttggattttcagcacttcttgacactttattaactgtaaaggcaatatctgaacttgaacttctggctaaagtaaattagggaccttaatgtactttaataaattatttttattaaatggttcattattttcatttttgctatctccgctacctagtgtctttgttttcttaacattattaactctaaatcttactagtatattttctatgtaactaatttaagaaatggattgtcaaattcaacattaataaattaagttaaataattatcaataaattttaaataaaaaaattttgttttaaaatatatatatttattttatttaaaaaaaaatattataattttcgattatttaatttttataaataaaaaaaattttttattaatatattgtattatattatttgtattacattaatactaaatatatatactttattctatatttaatagtacaaatgagctttcaatataaattcaatttnnnnnnnntttnnaaaaaaaaaaaaaattatatacaatctggttgtatctatatttatattttaaataattataaaattaataataatgttttttaaaaaaaaataatttattttacttaatttacatctattaatgtaaaaaggaactaatactcacaaatccattactacgagaactatccctcatatattcacaataaatagaatattggattatttctataaattactactcagatacactttgctcttggtactaaaatttatgttaatattgcttcacctgtaaaaattcttccatttttttagatttttagatattcatcatctgtataaataaagatttaattctaataaatataattgttgttgataaatagaagatattgttgtagaaatgaatataaataaaatggaattataattaaactaatgtttttttttattatttnaganattttaaaaaaaaaaaaaaaaaaaggcttttataaaaatacattaacaaataatagtataatgtttatggaaaatattttttataattattaataatacagtatctaaatttttaatttcattttttttgtataaaattatttattttaaataaaagaatatattaatttaaaaatttaataatattaaatataattatgaaattgtaatttttttctaaaaaaaaatatatatatatatattttaaattaatttttgataatattttattaattattataataaaattttaaaatctcttatttaaaataggtattaggattagtttttaactttttaatttttattaaaattaatcaaatagttaatatattaattatgtatatacaatattacatgaaatcaatactccatgattttaagtaaattaaaaaaaattttttgaactgttaaatgagaaattttaaaacaaagatttttaaatagaatttctagtacaatatgatagtaatttaaattattttaaaattattaataattaataattagtaaatattaaattgtgtagtaaatataaagttatatagttttttttaacaattaagttattaattattattaattattaattatttttagaatattataattagtatgtaatttttttttttttttagaattatatcattactactggtttaaaaataataaattagaattattatcattactattatttgaatataaaaagataagaagcgtttattatattgaagagtcaaaccgagttagaaaaaaatatttttatattttgataaatttcaaagaatcaagtatatcttcagagctatagtccataagctctaatgggttattagttgaactatcacagttaagagaagtggatatttcagagtcactataaatatccattacttcttgaaagcgtgggtaggggcattgttgactttagcaatgtggagatgattgaatttgtgtcctcaaaggtgggttctgtttcttttaagagttcagaaattacttttgaactcttgagacttaagtggaccaccagggttagtagatttattagtagtaagggccttagataggccgattatattaccctgttttaatgcaagggtaaagggcagaaaacctgctaaggatcgaaaggaagagatggttacttcaatggtcgagccgggagaatactatgaaatttattacaacgagtttaaattatagatgtaatacaacaaaaaacataaagaaaaacattttttttaaatttaagtttcaatttatttaaatcataaaataatatatatgtcaaaatctttgtttgctaacattctcctctcaaacttaattttttctgttttgtcaaaaattatgtttgtgaattttatcatttttggtccgataatatttttagttagagtgttgacaaacatatatttgagtgctattattttattttttaagttatctttattaaaagagaattttatattaatatggttgagttttgaatttaattcacagtttactattgttgtcatgcttgataaactgtctgtaaaaatagttatttgctttttaatgtttaataatttaattataatacttcttatccaaagtacctttttcacacattctgaagagctgatatatttagcttcctgagtctaagttgtcatagtagttttttttttttttatttagaattccaacatattgaattttttcccataagaattatttgtcctgaagttgactttttatcttttaatatctcctcttaggtcgagattgtaaaagcaatggtttcgcctattccgttgtaaattattttattgtttttagtagagtgtaagtatttgaatatatttgttacccttttccaatcagtgatggtgggttcttgtcttattaaaacttgagaagtttctttaggattgttaatgtatttacctttgtctgtagtattattgaagcaataatttgt

SEQ ID NO: 131 - DNA, 4000 bp, Escherichia coli
  misc_feature (1986)..(1986): n is a, c, g, or t
aacgagcccatgttcgcctttttcccataaaacactttgtgatcgttcaaaagcgccgcgatgccgtgatcgtcggttcgtcccggatgcaacgctcgtcgactccgctccaccacctccgccttgtctgtctccttactcacgctcgaaggatcgtttaagtcctccttgagcgcgttcgcatcggagagaagctgcttcggcacgctttgcttccctcgcgtctccttcaccagcgctggatgcttcaacagcgtcccgtttggcaccgtcagctttagcctcaccggcggcgtcgctcgcacgtccaacgaccaccctccgtcttcctgcccgtgtaaaaccccatcgtccagcaacaaattcccccactgcaacagcgacatcgcgtccgtcgcgcccggtggcaactgcacgcacgcctccacgagcgctcgtcccgtgacgctctcgctcacctcgatcgcgacgtccgcgcactgcggcgtctccgcgaacaactcattcgagcgtccccgcgtgcgcgacagccactcgaccgtgagatatatcgttcccgtctcgctggctctcgagtcgtcgtcgttcgcgctcttatcgccgtcgtcgcgcgcgcgcttgcgcgacttggctttcgattgcccagccggattcgcgtcgtcgttttgacgcgcgcgcgcgcgcgcgctcagcgcggcgaacatcgagccgcgcgagggcgacggtttcgccgctcgcgccgcgggcgctcgcgatcgcgcgacgctcgccgcgcgcgggtgtgcgacttccagagggctgattactacaatcttcgggacgcgcggagagattgggaaagcgaatatctatgtatgtgacgacgcgccgtcgattcgatcgaacgccaacgcgctcggtgatgctcgcgcgtcgcgatgacgcgcgcaccgagcgaacgcgcgcgatggaaccgacgacgcgacggggcgcgctcgagactcgttcgggcggcgcttacaacccggaacgaccccagacgaccaaggcgagggagaaggaaaacgtcgccatgatggcggcccacgccacttgcacgatgaacggttcaccctcagccacttggccgaccgcctcgacgacggcggcggacgccggcgccgcggacacgatttgcgcggcgacgctcgccgcggcggcgctcagcgcaacctacgcattcaaacgcgacgtcgcgctctcgtcagtctctcgcgcacaccgcgcgcgccacggcgcatcccacgccccgttcccatcgatcccaaacctcggcgcgaccgcgatcgaggcccctcgcctcgcgtcgcgccgccgcgccgttccttatccaccgccgcgccgcgtccccccccgcccgcgcccgacgcccgcgcgcccgacgccgcgcgccgccgaatccaacgcgcgcgcgtttcctccacccatcgatcgcgcgcggtcgtcctcgtcgccctcgcgcgcgtccccccgtcgacgcctcgtcccgcgcgcgccgatcgcgacccgatcgagggctcgcgtcgcgccttcatcgccccccccgatcgcgtccgtcccgcgcccgccctctcgagcgcccgcgtccgcgcgatcaaaatcctccccatcgcgcgcgcgcgcttcgagccctccatcgacgtcgcgcgcgcctccgcgcgtccgcgcgcgcgccgccccccgatcgcgtcgtcgcgtcgcggtcgcgcgcgtcgtcctcgtcgcggtcgcaccttttgttccgtctcgacgcgcttcgcgctcggcgcggccgcgcaccgaacggtgcgttggttcttcgtcgcgcgcgcgctcgaggcgcgcgcggtgacggtcgggcgtgcggtcgcggcgtgcatcggggcgtcgtgtgcggcgcgcgcgcgtcgatcggatcgggcgccgatgcgcgcgcgcgcgccatctttttatgcgacattcttcccgccttttattcaatttaagganatacgacgccaccccggatcggacgacgcgtgacgcgttcgaagatctagggctttttgtacgtacagtacgatatacatagtcgtactcgcgcccttgaattcgggatcgatcgcgcgaggggaacgaacggcgattcgcgcgccgacgcgcgagaccgcgacgcgcgacggcggcgacgacggcgcgcgcgaccgacgcgtcgcgtcgcgacgggattcgcgcgcgatcgcgtcgattcgtcgcgacgggatcggcgcgacgcgcgcgatggcgcgcgaggacggcgcgttgacgccgcgggatacgaatcgcatcgcgcgcgacggcgacgtcgagttcgcgtgggagcacgcgaaggagaacgtgcagccggcgcgacggggacgggatgggtgcgcgctgcgggacgcgctgcgggcgacgacgcgaggcggggatcgagaggcggaggcgcgggaggcgacgagggcgaagatgtgggcggcggcgacgagggcgcggggcgcggacgacgacgcgttgggggcgtggtgcgggttgatcaagtggacggagcagacgtacgcgacgggaaacggacgggagagagagcttttgccggtgctggagcgatgcacgcgagagctgcaggaggtggaggcgtataaggaggacgcgcggtatttgcgagtgtggatcaagtacgcggattgttgcgccgagccgggggatattttcaagtttttgaaggcgaacgcgatcgggcagcgacaggcgctgtattacgaggcgtatggggcgtttttagaggttcgtcaagcgtacggggcggcgaatgagcagtacgagcgcgggattgagatgcgcgcagagccgctcgagcgcctgcgcgcgtcgtacgccgcgtttcagcatcgaatggttcgtcgaacgcagaagcgcatcgagagcggcgagatcgacgagaacgaaggagaagagatcgttcgtaactttggagacacgctcaaggcgcgatcacgaagcggagggggagtgagctctcgtagaggcgagtcgacgacgggcgcgcgccaggcgcgcggcggcttatcaggaccgacgcgcggcgcgactcaatctacaccacaagctcagacttcgaacgcgcaaggaaacgttggcggtttagacgtttacgatgacgccgaaaacggtgcgcccactcccggagaggcgacgacgacggggcgatggaaaaacttgggcgggtacaaggatgtgcgcaaggaaaacaccgcgcaggcgacgacgtgggccggtcaacgagcgacgcaaagcaaacgaaaagtgacggtgcccagcgatgagattgcggtttttgaagacactgagtgcttgaaggcgagcgacgtgaaggcagccacggcagcaacggagcgcgacgttggttcgttgcgacagcgcgttgacggtgaggtcgatttgagtcgaaatccaatgctgtaccactctggtggccagcctccgctagcgcctggcgagcgaccgaagagcaagtatcgtggattcaaacctgcgcacctacgatcggaggatggcgaggagttgtgctacgaggaaattcgagcagcagcgtgggtgcgcgccaacggtccgacgcacaagccacgtacgaccgccgaggcgctcgtcgaactagaaccgacgatggagatggatatggacgtcgatatggatggaaacgtcactgaaataagtggtgatcttccacagctcgccacgcaggcgacgcgagatcacgcgacatcactcgtgaagcccgcgaaggcggcaaaggacgatgaaatcgtctccaagcgaacgtacgtggctccaccgccacccgttggatctcgcactgggtcgtgcgcgagtgagccatcagaagctggatcggtgatttctcgcgaaaagtcgccgcaggcaaagaggccggcgttggtgaacaaggtacgcgctggcgcccgatggacggcggacgaggagggcacgcgttcggcgaaccacgatc

SEQ ID NO: 132 - DNA, 4000 bp, Escherichia coli
  misc_feature (248)..(248): n is a, c, g, or t
  misc_feature (349)..(349): n is a, c, g, or t
  misc_feature (564)..(564): n is a, c, g, or t
  misc_feature (568)..(568): n is a, c, g, or t
  misc_feature (570)..(570): n is a, c, g, or t
  misc_feature (573)..(574): n is a, c, g, or t
  misc_feature (576)..(577): n is a, c, g, or t
  misc_feature (579)..(580): n is a, c, g, or t
  misc_feature (583)..(583): n is a, c, g, or t
  misc_feature (586)..(589): n is a, c, g, or t
  misc_feature (591)..(591): n is a, c, g, or t
  misc_feature (594)..(597): n is a, c, g, or t
  misc_feature (599)..(599): n is a, c, g, or t
  misc_feature (601)..(606): n is a, c, g, or t
  misc_feature (609)..(609): n is a, c, g, or t
  misc_feature (611)..(615): n is a, c, g, or t
  misc_feature (617)..(630): n is a, c, g, or t
  misc_feature (632)..(634): n is a, c, g, or t
  misc_feature (637)..(640): n is a, c, g, or t
  misc_feature (642)..(646): n is a, c, g, or t
  misc_feature (651)..(655): n is a, c, g, or t
  misc_feature (657)..(657): n is a, c, g, or t
  misc_feature (660)..(662): n is a, c, g, or t
  misc_feature (664)..(664): n is a, c, g, or t
  misc_feature (666)..(666): n is a, c, g, or t
  misc_feature (668)..(668): n is a, c, g, or t
  misc_feature (670)..(673): n is a, c, g, or t
  misc_feature (676)..(678): n is a, c, g, or t
  misc_feature (680)..(681): n is a, c, g, or t
  misc_feature (683)..(683): n is a, c, g, or t
  misc_feature (687)..(688): n is a, c, g, or t
  misc_feature (691)..(695): n is a, c, g, or t
  misc_feature (697)..(697): n is a, c, g, or t
  misc_feature (699)..(699): n is a, c, g, or t
  misc_feature (701)..(701): n is a, c, g, or t
  misc_feature (703)..(705): n is a, c, g, or t
  misc_feature (707)..(709): n is a, c, g, or t
  misc_feature (711)..(712): n is a, c, g, or t
  misc_feature (714)..(714): n is a, c, g, or t
  misc_feature (716)..(719): n is a, c, g, or t
  misc_feature (721)..(722): n is a, c, g, or t
  misc_feature (724)..(730): n is a, c, g, or t
  misc_feature (733)..(736): n is a, c, g, or t
  misc_feature (738)..(738): n is a, c, g, or t
  misc_feature (740)..(740): n is a, c, g, or t
  misc_feature (742)..(744): n is a, c, g, or t
  misc_feature (747)..(747): n is a, c, g, or t
  misc_feature (749)..(750): n is a, c, g, or t
  misc_feature (752)..(755): n is a, c, g, or t
  misc_feature (757)..(758): n is a, c, g, or t
  misc_feature (760)..(765): n is a, c, g, or t
  misc_feature (767)..(768): n is a, c, g, or t
  misc_feature (770)..(776): n is a, c, g, or t
  misc_feature (778)..(778): n is a, c, g, or t
  misc_feature (780)..(782): n is a, c, g, or t
  misc_feature (784)..(784): n is a, c, g, or t
  misc_feature (786)..(787): n is a, c, g, or t
  misc_feature (789)..(792): n is a, c, g, or t
  misc_feature (794)..(794): n is a, c, g, or t
  misc_feature (796)..(796): n is a, c, g, or t
  misc_feature (798)..(798): n is a, c, g, or t
  misc_feature (800)..(800): n is a, c, g, or t
  misc_feature (802)..(804): n is a, c, g, or t
  misc_feature (806)..(806): n is a, c, g, or t
  misc_feature (809)..(809): n is a, c, g, or t
  misc_feature (811)..(811): n is a, c, g, or t
  misc_feature (813)..(818): n is a, c, g, or t
  misc_feature (820)..(826): n is a, c, g, or t
  misc_feature (829)..(829): n is a, c, g, or t
  misc_feature (831)..(831): n is a, c, g, or t
  misc_feature (834)..(834): n is a, c, g, or t
  misc_feature (837)..(839): n is a, c, g, or t
  misc_feature (841)..(842): n is a, c, g, or t
  misc_feature (844)..(858): n is a, c, g, or t
  misc_feature (860)..(862): n is a, c, g, or t
  misc_feature (864)..(865): n is a, c, g, or t
  misc_feature (867)..(867): n is a, c, g, or t
  misc_feature (869)..(871): n is a, c, g, or t
  misc_feature (873)..(873): n is a, c, g, or t
  misc_feature (875)..(878): n is a, c, g, or t
  misc_feature (880)..(880): n is a, c, g, or t
  misc_feature (882)..(883): n is a, c, g, or t
  misc_feature (885)..(890): n is a, c, g, or t
  misc_feature (892)..(899): n is a, c, g, or t
  misc_feature (901)..(902): n is a, c, g, or t
  misc_feature (904)..(908): n is a, c, g, or t
  misc_feature (910)..(912): n is a, c, g, or t
  misc_feature (914)..(915): n is a, c, g, or t
  misc_feature (917)..(925): n is a, c, g, or t
  misc_feature (927)..(930): n is a, c, g, or t
  misc_feature (934)..(935): n is a, c, g, or t
  misc_feature (937)..(939): n is a, c, g, or t
  misc_feature (941)..(946): n is a, c, g, or t
  misc_feature (948)..(952): n is a, c, g, or t
  misc_feature (954)..(954): n is a, c, g, or t
  misc_feature (956)..(956): n is a, c, g, or t
  misc_feature (958)..(962): n is a, c, g, or t
  misc_feature (965)..(967): n is a, c, g, or t
  misc_feature (969)..(972): n is a, c, g, or t
  misc_feature (974)..(974): n is a, c, g, or t
  misc_feature (976)..(976): n is a, c, g, or t
  misc_feature (980)..(980): n is a, c, g, or t
  misc_feature (982)..(984): n is a, c, g, or t
  misc_feature (987)..(987): n is a, c, g, or t
  misc_feature (989)..(995): n is a, c, g, or t
  misc_feature (999)..(1008): n is a, c, g, or t
  misc_feature (1010)..(1011): n is a, c, g, or t
  misc_feature (1014)..(1017): n is a, c, g, or t
  misc_feature (1020)..(1023): n is a, c, g, or t
  misc_feature (1025)..(1030): n is a, c, g, or t
  misc_feature (1032)..(1049): n is a, c, g, or t
  misc_feature (1051)..(1054): n is a, c, g, or t
  misc_feature (1056)..(1058): n is a, c, g, or t
  misc_feature (1060)..(1063): n is a, c, g, or t
  misc_feature (1065)..(1065): n is a, c, g, or t
  misc_feature (1067)..(1078): n is a, c, g, or t
  misc_feature (1080)..(1080): n is a, c, g, or t
  misc_feature (1082)..(1092): n is a, c, g, or t
  misc_feature (1094)..(1097): n is a, c, g, or t
  misc_feature (1099)..(1101): n is a, c, g, or t
  misc_feature (1103)..(1105): n is a, c, g, or t
  misc_feature (1108)..(1109): n is a, c, g, or t
  misc_feature (1111)..(1115): n is a, c, g, or t
  misc_feature (1119)..(1119): n is a, c, g, or t
  misc_feature (1121)..(1126): n is a, c, g, or t
  misc_feature (1129)..(1131): n is a, c, g, or t
  misc_feature (1133)..(1135): n is a, c, g, or t
  misc_feature (1137)..(1146): n is a, c, g, or t
  misc_feature (1148)..(1150): n is a, c, g, or t
  misc_feature (1153)..(1160): n is a, c, g, or t
  misc_feature (1162)..(1168): n is a, c, g, or t
  misc_feature (1170)..(1177): n is a, c, g, or t
  misc_feature (1179)..(1183): n is a, c, g, or t
  misc_feature (1185)..(1185): n is a, c, g, or t
  misc_feature (1187)..(1188): n is a, c, g, or t
  misc_feature (1190)..(1191): n is a, c, g, or t
  misc_feature (1193)..(1194): n is a, c, g, or t
  misc_feature (1196)..(1198): n is a, c, g, or t
  misc_feature (1202)..(1207): n is a, c, g, or t
  misc_feature (1211)..(1218): n is a, c, g, or t
  misc_feature (1221)..(1221): n is a, c, g, or t
  misc_feature (1223)..(1226): n is a, c, g, or t
  misc_feature (1228)..(1232): n is a, c, g, or t
  misc_feature (1234)..(1236): n is a, c, g, or t
  misc_feature (1238)..(1239): n is a, c, g, or t
  misc_feature (1241)..(1244): n is a, c, g, or t
  misc_feature (1246)..(1247): n is a, c, g, or t
  misc_feature (1251)..(1255): n is a, c, g, or t
  misc_feature (1257)..(1259): n is a, c, g, or t
  misc_feature (1262)..(1262): n is a, c, g, or t
  misc_feature (1264)..(1265): n is a, c, g, or t
  misc_feature (1269)..(1270): n is a, c, g, or t
  misc_feature (1272)..(1272): n is a, c, g, or t
  misc_feature (1274)..(1274): n is a, c, g, or t
  misc_feature (1276)..(1278): n is a, c, g, or t
  misc_feature (1280)..(1280): n is a, c, g, or t
  misc_feature (1282)..(1283): n is a, c, g, or t
  misc_feature (1285)..(1288): n is a, c, g, or t
  misc_feature (1290)..(1291): n is a, c, g, or t
  misc_feature (1293)..(1300): n is a, c, g, or t
  misc_feature (1302)..(1302): n is a, c, g, or t
  misc_feature (1304)..(1307): n is a, c, g, or t
  misc_feature (1309)..(1313): n is a, c, g, or t
  misc_feature (1315)..(1315): n is a, c, g, or t
  misc_feature (1317)..(1321): n is a, c, g, or t
  misc_feature (1323)..(1325): n is a, c, g, or t
  misc_feature (1327)..(1327): n is a, c, g, or t
  misc_feature (1330)..(1332): n is a, c, g, or t
  misc_feature (1334)..(1335): n is a, c, g, or t
  misc_feature (1337)..(1337): n is a, c, g, or t
  misc_feature (1340)..(1341): n is a, c, g, or t
  misc_feature (1343)..(1347): n is a, c, g, or t
  misc_feature (1350)..(1352): n is a, c, g, or t
  misc_feature (1355)..(1356): n is a, c, g, or t
  misc_feature (1359)..(1359): n is a, c, g, or t
  misc_feature (1365)..(1371): n is a, c, g, or t
  misc_feature (1374)..(1380): n is a, c, g, or t
  misc_feature (1382)..(1388): n is a, c, g, or t
  misc_feature (1390)..(1390): n is a, c, g, or t
  misc_feature (1392)..(1394): n is a, c, g, or t
  misc_feature (1396)..(1400): n is a, c, g, or t
  misc_feature (1404)..(1408): n is a, c, g, or t
  misc_feature (1410)..(1413): n is a, c, g, or t
  misc_feature (1415)..(1424): n is a, c, g, or t
  misc_feature (1428)..(1428): n is a, c, g, or t
  misc_feature (1430)..(1431): n is a, c, g, or t
  misc_feature (1433)..(1434): n is a, c, g, or t
  misc_feature (1436)..(1436): n is a, c, g, or t
  misc_feature (1439)..(1441): n is a, c, g, or t
  misc_feature (1443)..(1445): n is a, c, g, or t
  misc_feature (1447)..(1449): n is a, c, g, or t
  misc_feature (1454)..(1454): n is a, c, g, or t
  misc_feature (1456)..(1461): n is a, c, g, or t
  misc_feature (1463)..(1463): n is a, c, g, or t
  misc_feature (1466)..(1467): n is a, c, g, or t
  misc_feature (1469)..(1472): n is a, c, g, or t
  misc_feature (1475)..(1477): n is a, c, g, or t
  misc_feature (1479)..(1481): n is a, c, g, or t
  misc_feature (1485)..(1489): n is a, c, g, or t
  misc_feature (1491)..(1491): n is a, c, g, or t
  misc_feature (1493)..(1498): n is a, c, g, or t
  misc_feature (1500)..(1500): n is a, c, g, or t
  misc_feature (1502)..(1504): n is a, c, g, or t
  misc_feature (1506)..(1507): n is a, c, g, or t
  misc_feature (1509)..(1511): n is a, c, g, or t
  misc_feature (1513)..(1515): n is a, c, g, or t
  misc_feature (1517)..(1528): n is a, c, g, or t
  misc_feature (1530)..(1531): n is a, c, g, or t
  misc_feature (1533)..(1540): n is a, c, g, or t
  misc_feature (1542)..(1542): n is a, c, g, or t
  misc_feature (1544)..(1544): n is a, c, g, or t
  misc_feature (1546)..(1548): n is a, c, g, or t
  misc_feature (1550)..(1554): n is a, c, g, or t
  misc_feature (1556)..(1558): n is a, c, g, or t
  misc_feature (1561)..(1568): n is a, c, g, or t
  misc_feature (1570)..(1570): n is a, c, g, or t
  misc_feature (1572)..(1575): n is a, c, g, or t
  misc_feature (1577)..(1582): n is a, c, g, or t
  misc_feature (1584)..(1584): n is a, c, g, or t
  misc_feature (1586)..(1586): n is a, c, g, or t
  misc_feature (1590)..(1590): n is a, c, g, or t
  misc_feature (1592)..(1593): n is a, c, g, or t
  misc_feature (1595)..(1597): n is a, c, g, or t
  misc_feature (1601)..(1606): n is a, c, g, or t
  misc_feature (1608)..(1614): n is a, c, g, or t
  misc_feature (1616)..(1616): n is a, c, g, or t
  misc_feature (1618)..(1619): n is a, c, g, or t
  misc_feature (1621)..(1622): n is a, c, g, or t
  misc_feature (1624)..(1625): n is a, c, g, or t
  misc_feature (1627)..(1628): n is a, c, g, or t
  misc_feature (1976)..(1976): n is a, c, g, or t
  misc_feature (1997)..(1997): n is a, c, g, or t
  misc_feature (2337)..(2337): n is a, c, g, or t
  misc_feature (2340)..(2341): n is a, c, g, or t
  misc_feature (2343)..(2348): n is a, c, g, or t
  misc_feature (2350)..(2351): n is a, c, g, or t
  misc_feature (2355)..(2358): n is a, c, g, or t
  misc_feature (2360)..(2363): n is a, c, g, or t
  misc_feature (2366)..(2367): n is a, c, g, or t
  misc_feature (2369)..(2373): n is a, c, g, or t
  misc_feature (2376)..(2376): n is a, c, g, or t
  misc_feature (2378)..(2378): n is a, c, g, or t
  misc_feature (2380)..(2384): n is a, c, g, or t
  misc_feature (2386)..(2386): n is a, c, g, or t
  misc_feature (2389)..(2390): n is a, c, g, or t
  misc_feature (2392)..(2393): n is a, c, g, or t
  misc_feature (2395)..(2395): n is a, c, g, or t
  misc_feature (2397)..(2399): n is a, c, g, or t
  misc_feature (2401)..(2417): n is a, c, g, or t
  misc_feature (2419)..(2419): n is a, c, g, or t
  misc_feature (2421)..(2425): n is a, c, g, or t
  misc_feature (2427)..(2429): n is a, c, g, or t
  misc_feature (2431)..(2434): n is a, c, g, or t
  misc_feature (2436)..(2437): n is a, c, g, or t
  misc_feature (2439)..(2446): n is a, c, g, or t
  misc_feature (2448)..(2448): n is a, c, g, or t
  misc_feature (2450)..(2458): n is a, c, g, or t
  misc_feature (2460)..(2464): n is a, c, g, or t
  misc_feature (2466)..(2474): n is a, c, g, or t
  misc_feature (2476)..(2481): n is a, c, g, or t
  misc_feature (2483)..(2490): n is a, c, g, or t
  misc_feature (2492)..(2494): n is a, c, g, or t
  misc_feature (2496)..(2497): n is a, c, g, or t
  misc_feature (2499)..(2508): n is a, c, g, or t
  misc_feature (2510)..(2524): n is a, c, g, or t
  misc_feature (2527)..(2531): n is a, c, g, or t
  misc_feature (2534)..(2541): n is a, c, g, or t
  misc_feature (2544)..(2544): n is a, c, g, or t
  misc_feature (2546)..(2555): n is a, c, g, or t
  misc_feature (2558)..(2560): n is a, c, g, or t
  misc_feature (2562)..(2610): n is a, c, g, or t
  misc_feature (2612)..(2628): n is a, c, g, or t
  misc_feature (2630)..(2646): n is a, c, g, or t
  misc_feature (2648)..(2675): n is a, c, g, or t
  misc_feature (2677)..(2678): n is a, c, g, or t
  misc_feature (2680)..(2680): n is a, c, g, or t
  misc_feature (2682)..(2684): n is a, c, g, or t
  misc_feature (2686)..(2687): n is a, c, g, or t
  misc_feature (2689)..(2690): n is a, c, g, or t
  misc_feature (2697)..(2697): n is a, c, g, or t
  misc_feature (2699)..(2708): n is a, c, g, or t
  misc_feature (2710)..(2717): n is a, c, g, or t
  misc_feature (2719)..(2721): n is a, c, g, or t
  misc_feature (2723)..(2723): n is a, c, g, or t
  misc_feature (2725)..(2726): n is a, c, g, or t
  misc_feature (2729)..(2732): n is a, c, g, or t
  misc_feature (2734)..(2737): n is a, c, g, or t
  misc_feature (2739)..(2741): n is a, c, g, or t
  misc_feature (2746)..(2748): n is a, c, g, or t
  misc_feature (2750)..(2750): n is a, c, g, or t
  misc_feature (2754)..(2754): n is a, c, g, or t
  misc_feature (2757)..(2758): n is a, c, g, or t
  misc_feature (2760)..(2761): n is a, c, g, or t
  misc_feature (2765)..(2766): n is a, c, g, or t
  misc_feature (2769)..(2769): n is a, c, g, or t
  misc_feature (2771)..(2771): n is a, c, g, or t
  misc_feature (2776)..(2776): n is a, c, g, or t
  misc_feature (2781)..(2782): n is a, c, g, or t
  misc_feature (2784)..(2784): n is a, c, g, or t
  misc_feature (2786)..(2786): n is a, c, g, or t
  misc_feature (2790)..(2792): n is a, c, g, or t
  misc_feature (2799)..(2799): n is a, c, g, or t
  misc_feature (2802)..(2802): n is a, c, g, or t
  misc_feature (2806)..(2806): n is a, c, g, or t
  misc_feature (2811)..(2811): n is a, c, g, or t
  misc_feature (2813)..(2814): n is a, c, g, or t
  misc_feature (2816)..(2816): n is a, c, g, or t
  misc_feature (2823)..(2823): n is a, c, g, or t
  misc_feature (2826)..(2826): n is a, c, g, or t
  misc_feature (2832)..(2833): n is a, c, g, or t
  misc_feature (2837)..(2837): n is a, c, g, or t
  misc_feature (2840)..(2840): n is a, c, g, or t
  misc_feature (2842)..(2842): n is a, c, g, or t
  misc_feature (2845)..(2845): n is a, c, g, or t
  misc_feature (2847)..(2847): n is a, c, g, or t
  misc_feature (2852)..(2852): n is a, c, g, or t
  misc_feature (2856)..(2859): n is a, c, g, or t
  misc_feature (2861)..(2865): n is a, c, g, or t
  misc_feature (2870)..(2870): n is a, c, g, or t
  misc_feature (2874)..(2874): n is a, c, g, or t
  misc_feature (2876)..(2878): n is a, c, g, or t
  misc_feature (2882)..(2882): n is a, c, g, or t
  misc_feature (2884)..(2885): n is a, c, g, or t
  misc_feature (2892)..(2894): n is a, c, g, or t
  misc_feature (2900)..(2900): n is a, c, g, or t
  misc_feature (2903)..(2903): n is a, c, g, or t
  misc_feature (2905)..(2905): n is a, c, g, or t
  misc_feature (2912)..(2912): n is a, c, g, or t
  misc_feature (2915)..(2915): n is a, c, g, or t
  misc_feature (2920)..(2920): n is a, c, g, or t
  misc_feature (2923)..(2923): n is a, c, g, or t
  misc_feature (2926)..(2941): n is a, c, g, or t
  misc_feature (2945)..(2945): n is a, c, g, or t
  misc_feature (2949)..(2965): n is a, c, g, or t
  misc_feature (2967)..(2969): n is a, c, g, or t
  misc_feature (2972)..(2974): n is a, c, g, or t
  misc_feature (2976)..(2981): n is a, c, g, or t
  misc_feature (2983)..(2990): n is a, c, g, or t
  misc_feature (2992)..(2994): n is a, c, g, or t
  misc_feature (2996)..(2997): n is a, c, g, or t
  misc_feature (2999)..(3003): n is a, c, g, or t
  misc_feature (3005)..(3005): n is a, c, g, or t
  misc_feature (3007)..(3008): n is a, c, g, or t
  misc_feature (3010)..(3012): n is a, c, g, or t
  misc_feature (3014)..(3025): n is a, c, g, or t
  misc_feature (3027)..(3029): n is a, c, g, or t
  misc_feature (3031)..(3031): n is a, c, g, or t
  misc_feature (3033)..(3033): n is a, c, g, or t
  misc_feature (3038)..(3039): n is a, c, g, or t
  misc_feature (3041)..(3046): n is a, c, g, or t
  misc_feature (3048)..(3051): n is a, c, g, or t
  misc_feature (3053)..(3054): n is a, c, g, or t
  misc_feature (3056)..(3059): n is a, c, g, or t
  misc_feature (3061)..(3061): n is a, c, g, or t
  misc_feature (3063)..(3064): n is a, c, g, or t
  misc_feature (3066)..(3068): n is a, c, g, or t
  misc_feature (3072)..(3078): n is a, c, g, or t
  misc_feature (3080)..(3085): n is a, c, g, or t
  misc_feature (3087)..(3088): n is a, c, g, or t
  misc_feature (3090)..(3092): n is a, c, g, or t
  misc_feature (3095)..(3100): n is a, c, g, or t
  misc_feature (3103)..(3103): n is a, c, g, or t
  misc_feature (3105)..(3110): n is a, c, g, or t
  misc_feature (3112)..(3113): n is a, c, g, or t
  misc_feature (3115)..(3115): n is a, c, g, or t
  misc_feature (3118)..(3120): n is a, c, g, or t
  misc_feature (3124)..(3124): n is a, c, g, or t
  misc_feature (3126)..(3127): n is a, c, g, or t
  misc_feature (3129)..(3129): n is a, c, g, or t
  misc_feature (3131)..(3133): n is a, c, g, or t
  misc_feature (3137)..(3138): n is a, c, g, or t
  misc_feature (3140)..(3140): n is a, c, g, or t
  misc_feature (3142)..(3149): n is a, c, g, or t
  misc_feature (3151)..(3151): n is a, c, g, or t
  misc_feature (3153)..(3157): n is a, c, g, or t
  misc_feature (3159)..(3160): n is a, c, g, or t
  misc_feature (3163)..(3164): n is a, c, g, or t
  misc_feature (3166)..(3166): n is a, c, g, or t
  misc_feature (3168)..(3169): n is a, c, g, or t
  misc_feature (3171)..(3172): n is a, c, g, or t
  misc_feature (3176)..(3177): n is a, c, g, or t
  misc_feature (3181)..(3182): n is a, c, g, or t
  misc_feature (3184)..(3198): n is a, c, g, or t
  misc_feature (3200)..(3208): n is a, c, g, or t
  misc_feature (3211)..(3219): n is a, c, g, or t
  misc_feature (3222)..(3223): n is a, c, g, or t
  misc_feature (3225)..(3228): n is a, c, g, or t
  misc_feature (3230)..(3235): n is a, c, g, or t
  misc_feature (3237)..(3240): n is a, c, g, or t
  misc_feature (3243)..(3249): n is a, c, g, or t
  misc_feature (3252)..(3253): n is a, c, g, or t
  misc_feature (3255)..(3259): n is a, c, g, or t
  misc_feature (3261)..(3262): n is a, c, g, or t
  misc_feature (3264)..(3266): n is a, c, g, or t
  misc_feature (3268)..(3277): n is a, c, g, or t
  misc_feature (3279)..(3279): n is a, c, g, or t
  misc_feature (3281)..(3281): n is a, c, g, or t
  misc_feature (3283)..(3285): n is a, c, g, or t
  misc_feature (3287)..(3289): n is a, c, g, or t
  misc_feature (3291)..(3294): n is a, c, g, or t
  misc_feature (3296)..(3301): n is a, c, g, or t
  misc_feature (3303)..(3305): n is a, c, g, or t
  misc_feature (3308)..(3309): n is a, c, g, or t
  misc_feature (3311)..(3311): n is a, c, g, or t
  misc_feature (3313)..(3315): n is a, c, g, or t
  misc_feature (3317)..(3317): n is a, c, g, or t
  misc_feature (3319)..(3320): n is a, c, g, or t
  misc_feature (3322)..(3323): n is a, c, g, or t
  misc_feature (3325)..(3328): n is a, c, g, or t
  misc_feature (3330)..(3340): n is a, c, g, or t
  misc_feature (3342)..(3344): n is a, c, g, or t
  misc_feature (3346)..(3351): n is a, c, g, or t
  misc_feature (3353)..(3354): n is a, c, g, or t
  misc_feature (3356)..(3357): n is a, c, g, or t
  misc_feature (3359)..(3361): n is a, c, g, or t
  misc_feature (3363)..(3363): n is a, c, g, or t
  misc_feature (3365)..(3371): n is a, c, g, or t
  misc_feature (3373)..(3375): n is a, c, g, or t
  misc_feature (3377)..(3386): n is a, c, g, or t
  misc_feature (3388)..(3389): n is a, c, g, or t
  misc_feature (3392)..(3392): n is a, c, g, or t
  misc_feature (3394)..(3394): n is a, c, g, or t
  misc_feature (3396)..(3400): n is a, c, g, or t
  misc_feature (3402)..(3402): n is a, c, g, or t
  misc_feature (3404)..(3408): n is a, c, g, or t
  misc_feature (3411)..(3419): n is a, c, g, or t
  misc_feature (3421)..(3425): n is a, c, g, or t
  misc_feature (3427)..(3442): n is a, c, g, or t
  misc_feature (3444)..(3445): n is a, c, g, or t
  misc_feature (3448)..(3448): n is a, c, g, or t
  misc_feature (3450)..(3450): n is a, c, g, or t
  misc_feature (3452)..(3452): n is a, c, g, or t
  misc_feature (3454)..(3459): n is a, c, g, or t
  misc_feature (3461)..(3463): n is a, c, g, or t
  misc_feature (3465)..(3468): n is a, c, g, or t
  misc_feature (3471)..(3472): n is a, c, g, or t
  misc_feature (3475)..(3477): n is a, c, g, or t
  misc_feature (3480)..(3480): n is a, c, g, or t
  misc_feature (3483)..(3486): n is a, c, g, or t
  misc_feature (3488)..(3498): n is a, c, g, or t
  misc_feature (3501)..(3504): n is a, c, g, or t
  misc_feature (3506)..(3508): n is a, c, g, or t
  misc_feature (3512)..(3512): n is a, c, g, or t
  misc_feature (3514)..(3516): n is a, c, g, or t
  misc_feature (3518)..(3519): n is a, c, g, or t
  misc_feature (3521)..(3541): n is a, c, g, or t
  misc_feature (3543)..(3543): n is a, c, g, or t
  misc_feature (3545)..(3548): n is a, c, g, or t
  misc_feature (3550)..(3555): n is a, c, g, or t
  misc_feature (3557)..(3561): n is a, c, g, or t
  misc_feature (3563)..(3600): n is a, c, g, or t
  misc_feature (3602)..(3620): n is a, c, g, or t
  misc_feature (3622)..(3627): n is a, c, g, or t
  misc_feature (3630)..(3640): n is a, c, g, or t
  misc_feature (3643)..(3643): n is a, c, g, or t
  misc_feature (3645)..(3649): n is a, c, g, or t
  misc_feature (3651)..(3651): n is a, c, g, or t
  misc_feature (3653)..(3665): n is a, c, g, or t
  misc_feature (3667)..(3670): n is a, c, g, or t
  misc_feature (3672)..(3673): n is a, c, g, or t
  misc_feature (3675)..(3675): n is a, c, g, or t
  misc_feature (3677)..(3681): n is a, c, g, or t
  misc_feature (3683)..(3684): n is a, c, g, or t
  misc_feature (3686)..(3689): n is a, c, g, or t
  misc_feature (3691)..(3694): n is a, c, g, or t
  misc_feature (3696)..(3702): n is a, c, g, or t
  misc_feature (3704)..(3707): n is a, c, g, or t
  misc_feature (3709)..(3713): n is a, c, g, or t
  misc_feature (3715)..(3716): n is a, c, g, or t
  misc_feature (3718)..(3726): n is a, c, g, or t
  misc_feature (3728)..(3734): n is a, c, g, or t
  misc_feature (3736)..(3738): n is a, c, g, or t
  misc_feature (3740)..(3741): n is a, c, g, or t
  misc_feature (3743)..(3745): n is a, c, g, or t
  misc_feature (3747)..(3747): n is a, c, g, or t
  misc_feature (3749)..(3749): n is a, c, g, or t
  misc_feature (3752)..(3771): n is a, c, g, or t
  misc_feature (3773)..(3778): n is a, c, g, or t
  misc_feature (3780)..(3780): n is a, c, g, or t
  misc_feature (3782)..(3783): n is a, c, g, or t
  misc_feature (3785)..(3785): n is a, c, g, or t
  misc_feature (3787)..(3793): n is a, c, g, or t
  misc_feature (3795)..(3796): n is a, c, g, or t
  misc_feature (3798)..(3799): n is a, c, g, or t
  misc_feature (3801)..(3801): n is a, c, g, or t
  misc_feature (3804)..(3804): n is a, c, g, or t
  misc_feature (3806)..(3806): n is a, c, g, or t
  misc_feature (3808)..(3815): n is a, c, g, or t
  misc_feature (3817)..(3817): n is a, c, g, or t
  misc_feature (3822)..(3822): n is a, c, g, or t
  misc_feature (3824)..(3825): n is a, c, g, or t
  misc_feature (3827)..(3830): n is a, c, g, or t
  misc_feature (3833)..(3838): n is a, c, g, or t
  misc_feature (3840)..(3840): n is a, c, g, or t
  misc_feature (3842)..(3848): n is a, c, g, or t
  misc_feature (3850)..(3859): n is a, c, g, or t
  misc_feature (3861)..(3862): n is a, c, g, or t
  misc_feature (3864)..(3864): n is a, c, g, or t
  misc_feature (3866)..(3867): n is a, c, g, or t
  misc_feature (3869)..(3874): n is a, c, g, or t
  misc_feature (3876)..(3877): n is a, c, g, or t
  misc_feature (3881)..(3881): n is a, c, g, or t
  misc_feature (3883)..(3888): n is a, c, g, or t
  misc_feature (3891)..(3895): n is a, c, g, or t
  misc_feature (3897)..(3897): n is a, c, g, or t
  misc_feature (3899)..(3900): n is a, c, g, or t
  misc_feature (3902)..(3903): n is a, c, g, or t
  misc_feature (3905)..(3906): n is a, c, g, or t
  misc_feature (3908)..(3908): n is a, c, g, or t
  misc_feature (3910)..(3921): n is a, c, g, or t
  misc_feature (3923)..(3928): n is a, c, g, or t
  misc_feature (3930)..(3930): n is a, c, g, or t
  misc_feature (3932)..(3932): n is a, c, g, or t
  misc_feature (3934)..(3940): n is a, c, g, or t
  misc_feature (3942)..(3946): n is a, c, g, or t
  misc_feature (3948)..(3956): n is a, c, g, or t
  misc_feature (3958)..(3959): n is a, c, g, or t
  misc_feature (3963)..(3963): n is a, c, g, or t
  misc_feature (3965)..(3969): n is a, c, g, or t
  misc_feature (3971)..(3974): n is a, c, g, or t
  misc_feature (3976)..(3978): n is a, c, g, or t
  misc_feature (3981)..(3983): n is a, c, g, or t
  misc_feature (3985)..(3987): n is a, c, g, or t
  misc_feature (3989)..(3991): n is a, c, g, or t
  misc_feature (3993)..(3994): n is a, c, g, or t
  misc_feature (3996)..(3997): n is a, c, g, or t
  misc_feature (3999)..(4000): n is a, c, g, or t
tggcagcgaagcggcccttggacgtaagtccttggtgcacgtcggagcggtctaggccaggagcaaggcgacggacgcgtgggccgtgtagtgggtgtgcggtttgtgccatggggcggccttggattgtatggaccttcgggccccagccttacaaacgcctttatgtgtatgggccaagcatttgctaccgtgaacacgtatagtcctaggtgactgggaatacggtcccttatgccccgtcttgnaacacggaccaaggagtctaacaactgcgcgagtgtgaaggggtaagaaacccacgacatgcgtagggaaaccgataaggtatcaaggcgagcctacgggnaagtctgcagtaccggcccactgacgatagaggccccggcctttgtcatcgatggagcaggagcgctaattgttaggacccgaaagatggcgaactatgcgtggtcggatcgaagccgggagaaatcccggtggaggatcgtagtaggtactgacgtgcaaatcgttcacgagaagtgcgtataggggcgaaagactaatcgagccatctagtanctgntnccnncnnannttnccnnnngnaannnngnannnnnnaangnnnnntnnnnnnnnnnnnnnannnttnnnngnnnnnggggnnnnngnccnnngncnantnnnnaannncnnangggnnaannnnngncngntnnntnnntnnancnnnncnnannnnnnnaannnntncnannnggncnntnnnngnnannnnnnanngnnnnnnngnannnancnnannnngnantnangnnncnaantngnnnnnnannnnnnnaancnaanggnnntnntnnnnnnnnnnnnnnngnnngnngncnnngnannnngnanncnnnnnngnnnnnnnnannannnnncnnncnnannnnnnnnncnnnnaaanngnnngnnnnnnannnnncnancnnnnnttnnncnnnngnancccngnnnttngnnnnnnngggnnnnnnnnnngnnggnnnnggnnnngnnnnnnannnnnnnnnnnnnnnnnngnnnngnnncnnnngncnnnnnnnnnnnntngnnnnnnnnnnnannnntnnngnnnaanncnnnnnaaangnnnnnnccnnnannncnnnnnnnnnnannnttnnnnnnnnannnnnnncnnnnnnnngnnnnncngnncnnanncnnngggnnnnnncccnnnnnnnnaangnnnngnnnnntnnntnnannnnanntttnnnnngnnnaangnnaaanngntnannntncnntnnnnanntnnnnnnnngnannnngnnnnntngnnnnngnnnanccnnngnncnggnntnnnnnggnnnggnnttncccccnnnnnnnaannnnnnngnnnnnnngnannnannnnnaaannnnnannnngnnnnnnnnnngggncnnanngnccnnntnnngnnnggggnannnnnntnggnngnnnnaannntnnngggnnnnncngnnnnnncnannncnnannngnnnannnnnnnnnnnnanncnnnnnnnngntngnnngnnnnngnnnttnnnnnnnntncnnnntnnnnnntngncccntnnannngggnnnnnntnnnnnnntngnngnnanngnnttaaacccataggccttcatcgaagtactcgcttaaccgtacgataatccgcaacaggtctctaaggtgacaagcctctggtctgaccgtgcgaacgtgagtaagggaattcggcaaaatggacccgaaacttcgggataagggttggctctaggggatgggcggttggcgcaagctggcctaaaacatccagcctagaactgaagcgaacaaggggaatccgacggtttaattaaaacacagcgaagcgtagactggaaaatcggtgtagacggttcgtgatttctgcccagtgctctgaatgttaaagcggagagattcgaccaagcgcgggtaaacggcgggagnaactatgactctcttaaggtngccaaatgcctcgtcatctaattagtgacgtgcatgaatggatgaacgagattcccactgtccctattcacatacgggcgaacccactgccaagggaacgggcttggaatacatgtaggggaaagaagaccctgttgagtttcactctagtctggcgatgtgctatgatttgtgaggtatagaataaatgggagccgaggggcaacccggagcgacagtgtaataccattacttgcaatattgtagcactcattgggtaaaatctcgtcatagggtgcacagcttatgctgggcttaaacgcagacccttgcggtccgggccctttgattcaagcgcacnacnnannnnnngnnaggnnnnannnnagnntnnnnngananannnnngnaanngnnanannngnnnnnnnnnnnnnnnnnanannnnntnnnannnnanngnnnnnnnncncnnnnnnnnnannnnngnnnnnnnnncnnnnnngnnnnnnnngnnnannannnnnnnnnncnnnnnnnnnnnnnnnggnnnnngcnnnnnnnngcngnnnnnnnnnnccnnngnnnnnnnnnnnnnnnnnnnnnnnnnnnnnnnnnnnnnnnnnnnnnnnnncnnnnnnnnnnnnnnnnngnnnnnnnnnnnnnnnnncnnnnnnnnnnnnnnnnnnnnnnnnnnnncnncntnnncnngnncaagganannnnnnnnnnannnnnnnncnnntncnnggnnnngnnnncnnngttcnnnangaancgnncnntganngtntnactgnagcanncngngacnnngcggacnagncacntaaananntnagggatntgnagtcgnngcanctncnttntntctcngtcnnnngnnnnnaagancagncnnnagangnngtttccnnnagaagncangncaaggtngangcccngcngtnnnnnnnnnnnnnnnnattnactnnnnnnnnnnnnnnnnncnnngannngnnnnnnannnnnnnnannnanncnnnnnangnnannncnnnnnnnnnnnngnnnancngcaanntnnnnnngnnnnanntnnnngncnntnnnacannnnnnntnnnnnngnngnnntcnnnnnnaantnnnnnncnngnaannnagcngnncncnnnattnncnannnnnnnngngnnnnncnngtnngntnngnnggtnncaanntnnnnnnnnnnnnnnntnnnnnnnnngannnnnnnnnaanngnnnnannnnnngnnnnggnnnnnnntgnnannnnncnncnnncnnnnnnnnnngntngnnnannnannnntnnnnnnannntcnncnannncnannanngnnnngnnnnnnnnnnnannncnnnnnntnnanncnnngnannnnnnnannntnnnnnnnnnncnngtncngnnnnncncnnnnncgnnnnnnnnncnnnnnannnnnnnnnnnnnnnnanngangnanannnnnnannngnnnntgnncannncanagnnnntnnnnnnnnnnncannnnannnggtnannncnntnnnnnnnnnnnnnnnnnnnnncntnnnnannnnnnannnnnannnnnnnnnnnnnnnnnnnnnnnnnnnnnnnnnnnnnngnnnnnnnnnnnnnnnnnnnannnnnnaannnnnnnnnnnggnannnnngnannnnnnnnnnnnnannnncnngnannnnnanncnnnnannnntnnnnnnntnnnntnnnnncnngnnnnnnnnntnnnnnnntnnncnncnnntnanatnnnnnnnnnnnnnnnnnnnnannnnnntncnntnannnnnnncnnanncncancncnnnnnnnngnacaantnnannnnttnnnnnncnannnnnnngnnnnnnnnnnanngnannannnnnntnncttntnnnnnnagnnnnntncnngnntnncnannnnnnnnnnnncnnnnnngncnannnnnnnannnnnannnnnnnnnannagcnannnnnannnnannnagnnnannnannncnncnncnn

SEQ ID NO: 133 - DNA, 4000 bp, Escherichia coli
  misc_feature (87)..(87): n is a, c, g, or t
  misc_feature (96)..(96): n is a, c, g, or t
  misc_feature (99)..(99): n is a, c, g, or t
  misc_feature (117)..(117): n is a, c, g, or t
  misc_feature (171)..(171): n is a, c, g, or t
  misc_feature (210)..(210): n is a, c, g, or t
  misc_feature (237)..(237): n is a, c, g, or t
  misc_feature (291)..(291): n is a, c, g, or t
  misc_feature (537)..(537): n is a, c, g, or t
  misc_feature (561)..(561): n is a, c, g, or t
  misc_feature (684)..(684): n is a, c, g, or t
  misc_feature (693)..(693): n is a, c, g, or t
  misc_feature (696)..(696): n is a, c, g, or t
  misc_feature (699)..(699): n is a, c, g, or t
  misc_feature (762)..(762): n is a, c, g, or t
  misc_feature (828)..(828): n is a, c, g, or t
  misc_feature (984)..(984): n is a, c, g, or t
  misc_feature (999)..(999): n is a, c, g, or t
  misc_feature (1005)..(1005): n is a, c, g, or t
  misc_feature (1020)..(1020): n is a, c, g, or t
  misc_feature (1032)..(1032): n is a, c, g, or t
  misc_feature (1050)..(1050): n is a, c, g, or t
  misc_feature (1104)..(1104): n is a, c, g, or t
  misc_feature (1137)..(1137): n is a, c, g, or t
  misc_feature (1167)..(1167): n is a, c, g, or t
  misc_feature (1172)..(1172): n is a, c, g, or t
  misc_feature (1174)..(1174): n is a, c, g, or t
  misc_feature (1182)..(1182): n is a, c, g, or t
  misc_feature (1986)..(1986): n is a, c, g, or t
  misc_feature (1989)..(1989): n is a, c, g, or t
  misc_feature (1992)..(1992): n is a, c, g, or t
  misc_feature (1998)..(1998): n is a, c, g, or t
catggtttaggtgttactgagcattctcaaggaacaaagactgttatgctaatttctaatttggcaatgatgacaggaaatctaggncgacctggngtnggtgtaaatccacttcgnggtcagaataatgttcaaggcgcagccgatatgggatgtcagccacatcatggnccaggatatttgtggatggatcaaaaagatgttcaaganttttatgaggataagttgggtcttccnacaccaacaactcctggaagaaaaattcctgaaatgttcgatggtgcagttganggctcacttaaagcactttggatttttgctgaggatgttgttcagactgatccaaatacccatcatgtcgttaaggcaatgcaggggcttgatttacttgttgttcaagaaatatttatgagtgaaactgctaagatggcagatgtagttcttccaggaactacttttcttgaaaagagtggaacttttacaaacacagaaagacgaattcaacaagttaatgctgctgttaaacctcttccaggnacaaaaacagatggtcaaattatngttgaaatgatgcgtaaattaggccttgatcagcctgattttgatgcagcagaggttcttaaagaggttgctagtgttgtatcattttttgagggagtaacttgggaaggtcttgcagcaagnccaatgggnctncantggcctgtaaacaaaaaaggtgaagatacacaaatccttcatattggagagtttaagcgtggnaaaggtaagtttcattaccatgactggaaagagagtgaagagcttactaagcataagaatgagtanccatttattcttacaactagtcgtgaacttcaacattacaactgtgcaacaatgactaggagaacttcaaatgttcaaatcctaactaaagatgtcattatgctcaacccaagagatgcaaaagcaaaggatctcatatctggtgatcgtgcaacnttgaagtctgatagnggtcangtcacacttgatgtngaggttacaganagggttaaaaaaggtgtngttagaacaaccttccacttcccagaagtgctaatcaatgaggttactagtggngttacagatgaagagacaaagtgtcctgaatanaaaattgtagctgtagacgtattaaaagcntcctnangaaaatcnataaagtgagtctaaagggctcactttattaaaacctaataccttctctctagtttacttttttgaagtatacgtcccgcaatttcttcgattgagatgtggctggtgtcgatataaggaacatcattttgaacaaacatatcctccgctcttctcacctcttttcgacattgttcaatagaagcataaccgctattagatcttctaacatctcttatgttttggagtctaactgggttaatacttaggccatagagtttatttttaaagcctttaagagcatttggaagtttagaggtatctaaatcttcatcaataagtgggtagtttgcagcatagattccatactgaagtgctaaaaaaagacatgttggtgtttttccagacctagagacccctgtcagaattatgtcagcagtttcataatttttagtagtaagtccatcatcattattaagggcaaaatttatgctatcaattcgacctgaataggtatttttattacccacgccatgagaaagccccatctcatgtgaagattgagtttcaagtattttctccatttttgaaatataagtctcaaaaaaatcaaaaataatcccaccactattttcaagaagatgacgatattcatttgaaacttgagtgctgaaaattagagcagcctgaccatcagtctctgacgcctctttaatcaattgagctgctgtttgtgcctttttttgagtgtcaataaaggcaagattgactcttttaaaatcaatttggggaaactgagtaagaagactatttccaagtgcttcngcngtnattccngttctgtctgaaataaaaaatacggttctcatgctattaaagcgtacccagtttggtccaggtttcaacaacagtatctggattaagagagatacttgtaatttctttttctaaaagccattgagctaaatccatatgatcagagggcccttgtccacaaataccaatatacttgccttcacggtgacaagcatcaatagccatcgtgatcattttcttaactgctgcatttctttcgtcaaaaccatcagcaataaggccagagtctctatccattcctagagtcagttgtgttaaatcatttgagccaatagaaaagccatcgaagtattccaaaaactcttcagcaataactgcattcgaaggaagttcacacatcatgattattctcaaaccatctttacccctttcaaggccattttctttgagaagatcaattacttttgaggcttcagatgtggttcgaacaaaagggatcatgatttcaacatttgttaaacccattacatttctgacattttttatcgccttgcattcaagttcaaaacactctctaaaatctgttgagatgtaccttgaagcgcccctaaatccaatcattggattttcttcattgggttcatagagttctcctgcaaataaatttgaatactcgttagatttgaagtctgacatgcgaatgattacaggggatttagaaaaactggctgctatggttgaaattccttcagtgagtttttgaacataaaagtccacaggtgatttatagcaggatgttctttttttgatttcacttttgagttcagacggcaagctatcaaactcaagtaaagcctttggatgaatgccaatcgtattattgataatgaattcaaggcgagcgagccctaccccagtattgggaatacttgcaaaatcaaatgcgcgagatggatttcctacattcatcataattttgactggaatatcaggaaggttgcttacttcagaaaatgtgtgttcaaaatttaatttaccttcgtagactttgcctgtatcaccctctgcacaagaagccgtgacctcttcagaattttttaatagttcagtcgcatttccagttccaacaatggcaggaactccgagctctctagcaataatcgcagcatggcaagtcctcccaccacgattggtgataattgcagaagctaatttcatgactggctcccagtcagggtcggtcatgtctgtaacaagtacgtcaccctcatggactgagtccatttcagataagtcattaattatcttagtttttcctgtgccaattttttggccaatggctcttccttcaacaatcgtttttgatgtttcaagaagtttatagcgttcaattttttgagaactttgtctgcttttaacagtttctggtctggcttgaacgatatagatttgtccatcaactccatccagtgcccactcaatatccattggtcttccataatggctttcaattttaattgcataatgagcaagctcttcaatttgagaatcatttaaactaaatcttattcgatcatcagaatttacttcggttgtattaactagtgatcccgaatctttttctgcgtaaaccatttttattgatttagagccaaggcttctagatagaattgaaggttttccagattttaaggtaggtttgtgcacataaaattcatctggattgacagagccttgaacaaccgtttcacctaggccataagccgaagtgatgaatactacatcatcaaatccggattccgtgtccagcgtaaacataacaccactagagcctatatcacttcgaaccatctgctgaataccagcagacaatgaaaccatttcatgttcaaagccttgatggaccctgtaagagattgctctatcattgtatagagatgcgtaaactcttcgtattgaggttaagatgtcatcaattccactgacattaagataggtttcttgttgcccagcaaaggatgct

SEQ ID NO: 134 - DNA, 4000 bp, Escherichia coli
  misc_feature (1)..(1): n is a, c, g, or t
  misc_feature (6)..(7): n is a, c, g, or t
  misc_feature (9)..(10): n is a, c, g, or t
  misc_feature (14)..(14): n is a, c, g, or t
  misc_feature (17)..(18): n is a, c, g, or t
  misc_feature (20)..(20): n is a, c, g, or t
  misc_feature (28)..(31): n is a, c, g, or t
  misc_feature (35)..(39): n is a, c, g, or t
  misc_feature (41)..(44): n is a, c, g, or t
  misc_feature (47)..(53): n is a, c, g, or t
  misc_feature (55)..(67): n is a, c, g, or t
  misc_feature (70)..(83): n is a, c, g, or t
  misc_feature (86)..(88): n is a, c, g, or t
  misc_feature (90)..(97): n is a, c, g, or t
  misc_feature (99)..(101): n is a, c, g, or t
  misc_feature (103)..(111): n is a, c, g, or t
  misc_feature (113)..(119): n is a, c, g, or t
  misc_feature (121)..(122): n is a, c, g, or t
  misc_feature (124)..(129): n is a, c, g, or t
  misc_feature (133)..(133): n is a, c, g, or t
  misc_feature (135)..(135): n is a, c, g, or t
  misc_feature (138)..(138): n is a, c, g, or t
  misc_feature (140)..(142): n is a, c, g, or t
  misc_feature (144)..(145): n is a, c, g, or t
  misc_feature (149)..(159): n is a, c, g, or t
  misc_feature (161)..(172): n is a, c, g, or t
  misc_feature (174)..(174): n is a, c, g, or t
  misc_feature (176)..(181): n is a, c, g, or t
  misc_feature (183)..(189): n is a, c, g, or t
  misc_feature (191)..(193): n is a, c, g, or t
  misc_feature (196)..(201): n is a, c, g, or t
  misc_feature (203)..(209): n is a, c, g, or t
  misc_feature (211)..(219): n is a, c, g, or t
  misc_feature (223)..(224): n is a, c, g, or t
  misc_feature (226)..(227): n is a, c, g, or t
  misc_feature (229)..(229): n is a, c, g, or t
  misc_feature (231)..(233): n is a, c, g, or t
  misc_feature (235)..(235): n is a, c, g, or t
  misc_feature (238)..(238): n is a, c, g, or t
  misc_feature (240)..(245): n is a, c, g, or t
  misc_feature (249)..(249): n is a, c, g, or t
  misc_feature (251)..(253): n is a, c, g, or t
  misc_feature (258)..(258): n is a, c, g, or t
  misc_feature (260)..(260): n is a, c, g, or t
  misc_feature (262)..(262): n is a, c, g, or t
  misc_feature (264)..(264): n is a, c, g, or t
  misc_feature (267)..(267): n is a, c, g, or t
  misc_feature (270)..(271): n is a, c, g, or t
  misc_feature (273)..(277): n is a, c, g, or t
  misc_feature (282)..(282): n is a, c, g, or t
  misc_feature (285)..(286): n is a, c, g, or t
  misc_feature (288)..(290): n is a, c, g, or t
  misc_feature (292)..(293): n is a, c, g, or t
  misc_feature (295)..(295): n is a, c, g, or t
  misc_feature (297)..(297): n is a, c, g, or t
  misc_feature (300)..(300): n is a, c, g, or t
  misc_feature (303)..(304): n is a, c, g, or t
  misc_feature (306)..(306): n is a, c, g, or t
  misc_feature (312)..(313): n is a, c, g, or t
  misc_feature (315)..(318): n is a, c, g, or t
  misc_feature (320)..(320): n is a, c, g, or t
  misc_feature (325)..(325): n is a, c, g, or t
  misc_feature (327)..(327): n is a, c, g, or t
  misc_feature (329)..(330): n is a, c, g, or t
  misc_feature (334)..(335): n is a, c, g, or t
  misc_feature (339)..(344): n is a, c, g, or t
  misc_feature (346)..(346): n is a, c, g, or t
  misc_feature (348)..(352): n is a, c, g, or t
  misc_feature (354)..(360): n is a, c, g, or t
  misc_feature (364)..(364): n is a, c, g, or t
  misc_feature (366)..(367): n is a, c, g, or t
  misc_feature (371)..(373): n is a, c, g, or t
  misc_feature (375)..(381): n is a, c, g, or t
  misc_feature (384)..(387): n is a, c, g, or t
  misc_feature (396)..(396): n is a, c, g, or t
  misc_feature (398)..(398): n is a, c, g, or t
  misc_feature (401)..(402): n is a, c, g, or t
  misc_feature (404)..(405): n is a, c, g, or t
  misc_feature (407)..(409): n is a, c, g, or t
  misc_feature (411)..(414): n is a, c, g, or t
  misc_feature (416)..(416): n is a, c, g, or t
  misc_feature (418)..(418): n is a, c, g, or t
  misc_feature (421)..(422): n is a, c, g, or t
  misc_feature (424)..(424): n is a, c, g, or t
  misc_feature (426)..(429): n is a, c, g, or t
  misc_feature (432)..(432): n is a, c, g, or t
  misc_feature (435)..(435): n is a, c, g, or t
  misc_feature (438)..(439): n is a, c, g, or t
  misc_feature (442)..(443): n is a, c, g, or t
  misc_feature (445)..(445): n is a, c, g, or t
  misc_feature (447)..(447): n is a, c, g, or t
  misc_feature (452)..(452): n is a, c, g, or t
  misc_feature (456)..(458): n is a, c, g, or t
  misc_feature (460)..(460): n is a, c, g, or t
  misc_feature (463)..(465): n is a, c, g, or t
  misc_feature (468)..(468): n is a, c, g, or t
  misc_feature (470)..(470): n is a, c, g, or t
  misc_feature (472)..(472): n is a, c, g, or t
  misc_feature (476)..(477): n is a, c, g, or t
  misc_feature (483)..(484): n is a, c, g, or t
  misc_feature (486)..(486): n is a, c, g, or t
  misc_feature (489)..(490): n is a, c, g, or t
  misc_feature (493)..(493): n is a, c, g, or t
  misc_feature (496)..(497): n is a, c, g, or t
  misc_feature (500)..(501): n is a, c, g, or t
  misc_feature (503)..(503): n is a, c, g, or t
  misc_feature (507)..(507): n is a, c, g, or t
  misc_feature (509)..(510): n is a, c, g, or t
  misc_feature (512)..(516): n is a, c, g, or t
  misc_feature (518)..(520): n is a, c, g, or t
  misc_feature (523)..(524): n is a, c, g, or t
  misc_feature (527)..(528): n is a, c, g, or t
  misc_feature (531)..(535): n is a, c, g, or t
  misc_feature (538)..(539): n is a, c, g, or t
  misc_feature (541)..(542): n is a, c, g, or t
  misc_feature (544)..(545): n is a, c, g, or t
  misc_feature (548)..(549): n is a, c, g, or t
  misc_feature (553)..(554): n is a, c, g, or t
  misc_feature (556)..(557): n is a, c, g, or t
  misc_feature (559)..(561): n is a, c, g, or t
  misc_feature (565)..(568): n is a, c, g, or t
  misc_feature (570)..(571): n is a, c, g, or t
  misc_feature (573)..(573): n is a, c, g, or t
  misc_feature (575)..(575): n is a, c, g, or t
  misc_feature (578)..(578): n is a, c, g, or t
  misc_feature (581)..(582): n is a, c, g, or t
  misc_feature (588)..(588): n is a, c, g, or t
  misc_feature (592)..(592): n is a, c, g, or t
  misc_feature (594)..(598): n is a, c, g, or t
  misc_feature (600)..(600): n is a, c, g, or t
  misc_feature (602)..(603): n is a, c, g, or t
  misc_feature (605)..(605): n is a, c, g, or t
  misc_feature (608)..(609): n is a, c, g, or t
  misc_feature (612)..(616): n is a, c, g, or t
  misc_feature (618)..(622): n is a, c, g, or t
  misc_feature (624)..(626): n is a, c, g, or t
  misc_feature (628)..(628): n is a, c, g, or t
  misc_feature (630)..(631): n is a, c, g, or t
  misc_feature (637)..(638): n is a, c, g, or t
  misc_feature (640)..(640): n is a, c, g, or t
  misc_feature (643)..(643): n is a, c, g, or t
  misc_feature (645)..(647): n is a, c, g, or t
  misc_feature (649)..(649): n is a, c, g, or t
  misc_feature (652)..(661): n is a, c, g, or t
  misc_feature (668)..(668): n is a, c, g, or t
  misc_feature (672)..(672): n is a, c, g, or t
  misc_feature (674)..(674): n is a, c, g, or t
  misc_feature (676)..(676): n is a, c, g, or t
  misc_feature (679)..(680): n is a, c, g, or t
  misc_feature (683)..(683): n is a, c, g, or t
  misc_feature (686)..(686): n is a, c, g, or t
  misc_feature (690)..(692): n is a, c, g, or t
  misc_feature (694)..(694): n is a, c, g, or t
  misc_feature (697)..(697): n is a, c, g, or t
  misc_feature (699)..(702): n is a, c, g, or t
  misc_feature (706)..(708): n is a, c, g, or t
  misc_feature (711)..(711): n is a, c, g, or t
  misc_feature (714)..(714): n is a, c, g, or t
  misc_feature (717)..(717): n is a, c, g, or t
  misc_feature (720)..(720): n is a, c, g, or t
  misc_feature (724)..(724): n is a, c, g, or t
  misc_feature (726)..(726): n is a, c, g, or t
  misc_feature (730)..(730): n is a, c, g, or t
  misc_feature (732)..(733): n is a, c, g, or t
  misc_feature (736)..(740): n is a, c, g, or t
  misc_feature (745)..(749): n is a, c, g, or t
  misc_feature (751)..(751): n is a, c, g, or t
  misc_feature (754)..(755): n is a, c, g, or t
  misc_feature (757)..(759): n is a, c, g, or t
  misc_feature (761)..(762): n is a, c, g, or t
  misc_feature (764)..(767): n is a, c, g, or t
  misc_feature (769)..(769): n is a, c, g, or t
  misc_feature (772)..(777): n is a, c, g, or t
  misc_feature (779)..(781): n is a, c, g, or t
  misc_feature (783)..(787): n is a, c, g, or t
  misc_feature (789)..(789): n is a, c, g, or t
  misc_feature (792)..(798): n is a, c, g, or t
  misc_feature (801)..(802): n is a, c, g, or t
  misc_feature (805)..(805): n is a, c, g, or t
  misc_feature (810)..(813): n is a, c, g, or t
  misc_feature (815)..(815): n is a, c, g, or t
  misc_feature (818)..(818): n is a, c, g, or t
  misc_feature (820)..(820): n is a, c, g, or t
  misc_feature (822)..(822): n is a, c, g, or t
  misc_feature (826)..(827): n is a, c, g, or t
  misc_feature (829)..(830): n is a, c, g, or t
  misc_feature (832)..(833): n is a, c, g, or t
  misc_feature (837)..(841): n is a, c, g, or t
  misc_feature (844)..(845): n is a, c, g, or t
  misc_feature (847)..(847): n is a, c, g, or t
  misc_feature (849)..(851): n is a, c, g, or t
  misc_feature (853)..(853): n is a, c, g, or t
  misc_feature (859)..(860): n is a, c, g, or t
  misc_feature (863)..(866): n is a, c, g, or t
  misc_feature (868)..(870): n is a, c, g, or t
  misc_feature (872)..(874): n is a, c, g, or t
  misc_feature (876)..(878): n is a, c, g, or t
  misc_feature (881)..(881): n is a, c, g, or t
  misc_feature (883)..(884): n is a, c, g, or t
  misc_feature (887)..(888): n is a, c, g, or t
  misc_feature (890)..(892): n is a, c, g, or t
  misc_feature (894)..(894): n is a, c, g, or t
  misc_feature (901)..(901): n is a, c, g, or t
  misc_feature (904)..(904): n is a, c, g, or t
  misc_feature (906)..(906): n is a, c, g, or t
  misc_feature (908)..(911): n is a, c, g, or t
  misc_feature (913)..(917): n is a, c, g, or t
  misc_feature (919)..(919): n is a, c, g, or t
  misc_feature (921)..(922): n is a, c, g, or t
  misc_feature (924)..(925): n is a, c, g, or t
  misc_feature (929)..(931): n is a, c, g, or t
  misc_feature (933)..(933): n is a, c, g, or t
  misc_feature (935)..(935): n is a, c, g, or t
  misc_feature (937)..(937): n is a, c, g, or t
  misc_feature (939)..(939): n is a, c, g, or t
  misc_feature (941)..(942): n is a, c, g, or t
  misc_feature (944)..(947): n is a, c, g, or t
  misc_feature (950)..(950): n is a, c, g, or t
  misc_feature (956)..(956): n is a, c, g, or t
  misc_feature (960)..(961): n is a, c, g, or t
  misc_feature (968)..(968): n is a, c, g, or t
  misc_feature (970)..(976): n is a, c, g, or t
  misc_feature (978)..(978): n is a, c, g, or t
  misc_feature (981)..(983): n is a, c, g, or t
  misc_feature (985)..(985): n is a, c, g, or t
  misc_feature (990)..(990): n is a, c, g, or t
  misc_feature (993)..(993): n is a, c, g, or t
  misc_feature (996)..(996): n is a, c, g, or t
  misc_feature (998)..(998): n is a, c, g, or t
  misc_feature (1005)..(1006): n is a, c, g, or t
  misc_feature (1009)..(1012): n is a, c, g, or t
  misc_feature (1014)..(1014): n is a, c, g, or t
  misc_feature (1016)..(1020): n is a, c, g, or t
  misc_feature (1022)..(1026): n is a, c, g, or t
  misc_feature (1028)..(1031): n is a, c, g, or t
  misc_feature (1038)..(1038): n is a, c, g, or t
  misc_feature (1040)..(1040): n is a, c, g, or t
  misc_feature (1043)..(1045): n is a, c, g, or t
  misc_feature (1047)..(1047): n is a, c, g, or t
  misc_feature (1053)..(1054): n is a, c, g, or t
  misc_feature (1057)..(1057): n is a, c, g, or t
  misc_feature (1059)..(1059): n is a, c, g, or t
  misc_feature (1066)..(1066): n is a, c, g, or t
  misc_feature (1069)..(1076): n is a, c, g, or t
  misc_feature (1079)..(1079): n is a, c, g, or t
  misc_feature (1083)..(1084): n is a, c, g, or t
  misc_feature (1086)..(1086): n is a, c, g, or t
  misc_feature (1088)..(1088): n is a, c, g, or t
  misc_feature (1090)..(1090): n is a, c, g, or t
  misc_feature (1092)..(1092): n is a, c, g, or t
  misc_feature (1098)..(1098): n is a, c, g, or t
  misc_feature (1101)..(1102): n is a, c, g, or t
  misc_feature (1105)..(1105): n is a, c, g, or t
  misc_feature (1108)..(1110): n is a, c, g, or t
  misc_feature (1113)..(1113): n is a, c, g, or t
  misc_feature (1115)..(1117): n is a, c, g, or t
  misc_feature (1119)..(1120): n is a, c, g, or t
  misc_feature (1122)..(1123): n is a, c, g, or t
  misc_feature (1127)..(1128): n is a, c, g, or t
  misc_feature (1131)..(1133): n is a, c, g, or t
  misc_feature (1139)..(1140): n is a, c, g, or t
  misc_feature (1143)..(1144): n is a, c, g, or t
  misc_feature (1146)..(1146): n is a, c, g, or t
  misc_feature (1149)..(1149): n is a, c, g, or t
  misc_feature (1152)..(1152): n is a, c, g, or t
  misc_feature (1154)..(1155): n is a, c, g, or t
  misc_feature (1158)..(1166): n is a, c, g, or t
  misc_feature (1171)..(1172): n is a, c, g, or t
  misc_feature (1175)..(1175): n is a, c, g, or t
  misc_feature (1177)..(1177): n is a, c, g, or t
  misc_feature (1179)..(1182): n is a, c, g, or t
  misc_feature (1184)..(1185): n is a, c, g, or t
  misc_feature (1191)..(1196): n is a, c, g, or t
  misc_feature (1198)..(1198): n is a, c, g, or t
  misc_feature (1201)..(1204): n is a, c, g, or t
  misc_feature (1206)..(1206): n is a, c, g, or t
  misc_feature (1212)..(1212): n is a, c, g, or t
  misc_feature (1215)..(1217): n is a, c, g, or t
  misc_feature (1219)..(1219): n is a, c, g, or t
  misc_feature (1222)..(1224): n is a, c, g, or t
  misc_feature (1228)..(1237): n is a, c, g, or t
  misc_feature (1239)..(1239): n is a, c, g, or t
  misc_feature (1242)..(1242): n is a, c, g, or t
  misc_feature (1245)..(1246): n is a, c, g, or t
  misc_feature (1249)..(1249): n is a, c, g, or t
  misc_feature (1251)..(1251): n is a, c, g, or t
  misc_feature (1254)..(1255): n is a, c, g, or t
  misc_feature (1258)..(1258): n is a, c, g, or t
  misc_feature (1263)..(1266): n is a, c, g, or t
  misc_feature (1268)..(1270): n is a, c, g, or t
  misc_feature (1273)..(1273): n is a, c, g, or t
  misc_feature (1275)..(1279): n is a, c, g, or t
  misc_feature (1283)..(1283): n is a, c, g, or t
  misc_feature (1285)..(1285): n is a, c, g, or t
  misc_feature (1290)..(1290): n is a, c, g, or t
  misc_feature (1293)..(1293): n is a, c, g, or t
  misc_feature (1295)..(1301): n is a, c, g, or t
  misc_feature (1304)..(1304): n is a, c, g, or t
  misc_feature (1306)..(1306): n is a, c, g, or t
  misc_feature (1308)..(1308): n is a, c, g, or t
  misc_feature (1310)..(1312): n is a, c, g, or t
  misc_feature (1314)..(1317): n is a, c, g, or t
  misc_feature (1320)..(1321): n is a, c, g, or t
  misc_feature (1323)..(1323): n is a, c, g, or t
  misc_feature (1326)..(1326): n is a, c, g, or t
  misc_feature (1328)..(1329): n is a, c, g, or t
  misc_feature (1331)..(1331): n is a, c, g, or t
  misc_feature (1333)..(1335): n is a, c, g, or t
  misc_feature (1337)..(1337): n is a, c, g, or t
  misc_feature (1339)..(1339): n is a, c, g, or t
  misc_feature (1341)..(1341): n is a, c, g, or t
  misc_feature (1344)..(1345): n is a, c, g, or t
  misc_feature (1347)..(1349): n is a, c, g, or t
  misc_feature (1351)..(1351): n is a, c, g, or t
  misc_feature (1354)..(1357): n is a, c, g, or t
  misc_feature (1360)..(1360): n is a, c, g, or t
  misc_feature (1362)..(1362): n is a, c, g, or t
  misc_feature (1364)..(1365): n is a, c, g, or t
  misc_feature (1370)..(1370): n is a, c, g, or t
  misc_feature (1375)..(1384): n is a, c, g, or t
  misc_feature (1387)..(1389): n is a, c, g, or t
  misc_feature (1391)..(1391): n is a, c, g, or t
  misc_feature (1394)..(1398): n is a, c, g, or t
  misc_feature (1403)..(1403): n is a, c, g, or t
  misc_feature (1406)..(1408): n is a, c, g, or t
  misc_feature (1410)..(1416): n is a, c, g, or t
  misc_feature (1418)..(1418): n is a, c, g, or t
  misc_feature (1420)..(1421): n is a, c, g, or t
  misc_feature (1423)..(1424): n is a, c, g, or t
  misc_feature (1427)..(1427): n is a, c, g, or t
  misc_feature (1434)..(1434): n is a, c, g, or t
  misc_feature (1454)..(1455): n is a, c, g, or t
  misc_feature (1467)..(1467): n is a, c, g, or t
  misc_feature (1473)..(1474): n is a, c, g, or t
  misc_feature (1476)..(1476): n is a, c, g, or t
  misc_feature (1498)..(1498): n is a, c, g, or t
  misc_feature (1567)..(1567): n is a, c, g, or t
  misc_feature (1987)..(1987): n is a, c, g, or t
  misc_feature (1997)..(1997): n is a, c, g, or t
nttttnnanntaanctnnanaaaaaaannnncatnnnnnannnnaannnnnnnannnnnnnnnnnnncannnnnnnnnnnnnnttnnntnnnnnnnnannnannnnnnnnntnnnnnnngnnannnnnntctntncgntnnncnntgannnnnnnnnnnannnnnnnnnnnntnannnnnngnnnnnnnannnaannnnnnannnnnnnannnnnnnnnaaannanntnannncnaancnnnnnnccangnnnagagntnanancanaannannnnnattgnatnntnnntnncnanganatnnanttaatnnannnngnacacnangnnacgnnatgnnnnnntntnnnnntnnnnnnnttcntnnaagnnntnnnnnnncgnnnnttaggttangnganncnncnnntnnnntnanaanntncnnnncgnctnganntgnnananaatgntttnnntnttnnnttnananattnngttttnntnttnnttnagnnatnntnggtntnncnnnnntnnntannatnntannnnnatnntnncnnaanntcanntnnannncatnnnncnntncnttncannccattncatntnnnnnancnnantannttnnnnngnnnnnannnantnngtttanncnctnannntnaannnnnnnnnnttctctnccancnanaanngcngcngcgnnncngtnannnnaaannncantgnctntgntatnantttnanngtnnnnntctcnnnnnantgnnannntnnannnntnaannnnnntnnnannnnntncgnnnnnnngannggngcgannnnantcnantncacnncnnannccannnnnacnncntnnncntcccannccnnnnannngnnntnnnttnanntgnngnnntnatttaanttnantnnnnannnnngngnntnnactnnntntngngntnncnnnnctngaaatnaatnngatatgntnnnnnnnanaannntntgcgnttnttntnttcatannatnnnntntnnnnncnnnnnannnnttacacncnttnnnancgtatnnttngntacgctnttnnnnnnnntgntgtnngntngncnattccnttnnttnagnnnaangnnntnntnntatnntannnttatcnnatnnantgnttnanntannnnnnnnntctcnnccntnannnnanngttgannnnnnanatnnnntncttcanttnnntntannntatnnnnnnnnnncnatntannaananaanntanttttnnnntnnnttncnnnnnctcnanatctntantnnnnnnnacntncnannntnnnnttnntntanannanannnantntntanntnnntnatnnnnttngntnnaattngattnnnnnnnnnngannngnaannnnnttatnttnnntnnnnnnnanannanntancttatcntatcctcttacttccagaanncctttcattccntttttnngntgactgccaaatagaccttttntattacagtagaattcaaagctaccggtctttgtcggtgtaaaagttattttgatttcttcccctggtncaatatcttggtctatatttaatcctgcttcaggataattgagagtaaaattgtgagggacaatctttgttacactctttaatgtaatttctacaggtttatttacagctactattatttgattgggatcaaacgagtagctatctactataacctctaccctttgaatgccatcttctgagagtttagcttcaaatggtttggattcttcttgagcagcaaaagtcacaaaagacataaaacaatatgtgaatacacaaaatagagatttagaaacatatttcatttcattagcactcctttttgaatcattttgttaatattttatgctctcataatgtttttaccaagtaagtttcttatgccagatataattataaccactaataaacttgtttaatatggtaaactattttattntaataaattnactataatagttttttattttcatagagaactatcttaagttttaatattaataattcatgaataaaaaacttattttgataagaggaggagtgacaacgtggactttaaactcagtggagaagacctattacaagtaaagtgcaatcttttggttctcggaagatttgaaggagaggttattaagggcccggttaaaagggtggatgaggcattaggaggagctcttagcaggatatctcaggaggagaagtttaacggcgaaattgggaaaggcgtgatgataaatacacttggcaaaatccgtgctgaaagggttttacttattggtttaggaaaaaaacagaaattttcttctgatgtgttaagaaaagcaggaatatttacagcaaagagagctaaaccattttctgagagcatagcgtttggttttgcagttgatggaaaaaaagaaaacgcttcagcccttatcgaaggcataatgcttggaggttatgaattcaacaaatataaaacaaatgataaaaagtgggagggcattaaaaacgttaaatttgtctcaagcggtatcagagaaagaaactttaaagaagatctagaatatgcaagcattatctcagaagccaccaattttgcccgtgatttgataaacgaacctcctgtagttttaaccccaacaaaactttcagaaacagcaaaagagattgcgctaaaagaaaaacttgaatgtaaaatctttggcaaggaagaaatggaaaaaaagggcatgggtgggctccttgctgtgtccagaggaagtgatgagcctcccaaatttatccatcttacgtataagccaaaaggtagtatcaaaaaagcagtagcagtcgttggaaaaggaataacatttgacagtggcgggctatgtataaaaccaagggacagtatgcgtacaatgaagggtgatatggcaggagcagcttgtgttctcggggttatgaaggttatttcaaggctaaaacctcctatcaaggttcatggccttatttctgcaactgaaaatatgcccggagcaagagcctataaacctgacgatataattcgtgcattaaacggaaagaccatagaggttatagatacagatgctgaggggagaatcgtgctctctgatgctctttcttatgctatggaactaaaagtagatgaaatagttgacctggcaacactaactggagcttgtgttgttgctttaggggattatacagcgggtgtaatgggaaataatgagcgactgataaataggattataaaggcagcaaaacttgcaggagaaaaggtatggcaactacccatggacgatgagctaagaaaagagatagaaagcgacgtagcagatgtaaaaaacgttggtagccgcttcggtggggctattacagctgcaatgtttcttgagaaatttgtaggagataccccttgggcacatctcgatatcgctggtccagcattcattgagaagggcggtgaatggtatccaaagggcgctacaggctttggagttagaacaataattagataccttctttcgtgaatcgtgaatcgtggttcgtgacttcgcagtaagctcagtcgaacgtttcgatacacgatgtaagatacacgataaccgaaacacgaaccacggaatagattatacaatgccactaaaaatcattgaccctattcgacgatacaattttcttgagattgaactccacggcgaaatctcagaagaagaggagaggtttgttatacccttttttccaattaggagaaaactgacactttgggatttggaaaagatttttttacatgcatcgtctgctccgtctattaaagggattctactaaaaattagagagcttaatatcggtcttgcaagaggagaggcgataagaaggggtattttagagctcagagaaaaaggaaaaaaggttttcgtttacctcgaaaacccaggaaacattgagtatatgataggctcagctg

SEQ ID NO: 135 - DNA, 4000 bp, Escherichia coli
  misc_feature (1115)..(1115): n is a, c, g, or t
  misc_feature (1829)..(1829): n is a, c, g, or t
  misc_feature (1989)..(1990): n is a, c, g, or t
  misc_feature (2163)..(2163): n is a, c, g, or t
  misc_feature (2644)..(2644): n is a, c, g, or t
cctcacccatgaggacggcgaagagcgcgtccgcccctgcggcgtcctcgattgtgacctgtttcaggacacgtcggtcaggatccaacgtcgtctcccaaagttcctccgcgttcatctcgccaaggcccttgtaccgctggtaggtgacgcctttctcgccgagctgcgcggcgaggtcctgccgttgtttctcggtgtaggcgtagaagatttccttgccgcgcttgatcttgtacaggggcggctgggcaatgtacgcgtatcccgcatcgatgagcggtcgcatgtaacggaagaacagggtcaagagaagggtcgtgatgtgctgcccgtcgacgtccgcgtccgcagccgtcacgacgcgatggtatcggaccttcgacaggttgaactcgtccccgatcccccctccgatcgcggtgatcagggtccggatctcctcgttcttcagcatctggtccagtcgcgccttctcgacgttcaggatcttcccgcggaggggcaggaccgcctggaactcccggcggcgcgcctgcttcgccgatccgcccgcggacgcgccctccacgatgaacatctccgccttcgcggggtctctttcctggcagtcggcgagcttcccgggcaggttgaagccctcgaggagccccttccgtcgcgtgagctcccgtgccttccgggcggcctctcgggcctgggacgcgaggacggccttgccgatgcacgtctccgcgaccttcggggtctcgaggaagaactccgtgagcttctcgtacacggccgactccacgatccccttgacctcggagttcccgagcttcatcttcgtctgtccctcgaactggggctcggggatcttcacggacaggatcgcggtgaggccctcccggacgtcgtccccctcgagggactccccctgcttgaggtacttgtgctccttcgcgtagttgttgaacgtccgcgcgaggcccgccttgaacccgacgaggtgggtcccgccctcgactgtgtcgatgttgttcacgaacgtgaagatggactcgttgtacccgtcgtggtactgcatcgcgacctcgacgagggtgctgttggattgcttcgagaacgtgatnggatcgggatggaggggcgtcttcgcgcggttgatccacttcacgtactccgagattccgccgtcgaagcggaacacgtccccgcggccccgggccttgtcgacgatgatgatctccagcccggcgttgaggaacgcgagctcccggaggcgccccgcgaggatgtcgtagtcgaactcgatcgtctcgaacacctgcgcgtccggcctgaacgtcacgatcgtccccgtgccctctgcggggccgaggtcctcgagctcggacgctttcgtcccgcgctcgaagcgcatccgcttctctcggccgtcccggtggacgcggacctcgagccattcgctcagtccgttcacgacgctcaggccgaccccgtggagcccgcccgacacgcggtagagcttccgctcgaacttcccgccgctgtgcatccgcgacaggacgagctcgacggcgggcacgccgtacttcgggtggacatcgacggggatcccgcgtccgtcgtccgcgatggtcacgctgccgtccgggttgagggtcacgtggatcttcttgcagaaccccgccatcgcctcgtcgatcgagttgtcgacgacctcgtggacgaggtggtggagacctctcccgtcgacgctgccgatgtacatcgcggggcgcttccggacggcctggagcccctcgaggacctggatctgttccgcgtcgtacgcggtctctccngccatctaatccgcaaccttctgagacgtgatccggagcgccttccgcaccccatcccgagtgacgtccggagtatggtctgggccgttataaacgttcggaccccgttcgtatggagaaaaacaggggtcgggggacgaccgttttcgatgccgcttgnntaaatactgtagcacggccgctcgacccttcagactctcaactctgagagcatcctcgggacccgcggcgacgacccggctccgcgggccttcagcggcgcttccaccgcacaccgtcccgcgtgtcctcaagcacgattccgaggtccgcgaggcgcgttcgaatcccgtcngacgccgcgaagtcctttcgcttccgcgcctcctcgcgcagctcgacgatgaagtcgaggacgcccgacaggacgcggtccgcgtccgcggcggcccccggaaggatcgcgaggacttggtcaaacgctcggaacgcctcaagggcctcgtggacggcggtcctgcccgcgcccgactcgagcgccttgtttgacgcgcccacgagctcgtacaccgcggccacggcctcccgcgtgttgaagtcgtcgtccatggaggcctcgaagccctcccgcgctttcgcggcggcggcccggagggccgcgtcccccggacccgcgtctttcgcggtggcctccgccgccctcaggttctccaccgcgtcccggattctgcgatgggcggcccgcgcctcgtcgagcgcctcccgggtgaagtcgatcggcgagcggtactgcgcgttgaggaggaagaaccggagctcctcgggggacacgactntgagggcgtccgccacggaccagtagttcccgagggacttgtgcatctcctcccccttgacgatgagcatccccccgtgcatccagtacctgacgaagggcgcgacgcccgtatacgcctccgcttgggcgatctccgcctcgtggtgggggaacgcgagctcacgcccgcccccgtggaggtcgtactgggcgccgaagtggtggatcgtgatcgccgtgtcctcgatgtgccagcccggacggcccttgccccacgggccgtcccacgctggctctccgggcttctgggccttccagagggcgaagtccgcggggttccgcttccgctcgtcgatggccacgcgggccccgggccggtgctcctcgaccttctgcccgctgaggttcccccagcccgcgtacttcgtcgtgtcgtagtacacgctcccgtcctccgcgacgtacgcgtacccgcggtcgaggagtccctggatctgccggacgatctcgtccatgtagtccgtcgccttcgcgtacaggttcacggagtcgcagcggagggcggtcatgccctcgaggtactccgcccagtactcctcgacgagggacgtccagtcccggcccagggtctgcatcttctcgatgatccggtcctcgatgtccgtgacgttctgcacgtagaacacggcgtacccgcggtaccgcaggtagcgcgcgacaacgtcgaacgcgacgtaggtcttcgcgtgcccgacgtgggtcgtgtcgtggggcgtgatcccgcagacgaacatggacacccgtcggccacggagggggacgaactcctccttccgtcgggtgagggtgttgtacacacggaggggcatcgcgcggcccccatgagggcccccgctattaaggttcaccggggagacgaggcgaggccgcagacccttaaggcgggcgggtggcatgaggggtcccgtgacgatccccttcgcgccccggggccgcacggtggagacgatgcgggctctcgcgcggcgacggttcttcctcgcgtcgatcggcctcgcgtttggatctctcctcctgtccctcgcggccgcattcctcctcgcgactttccccgtcggcagcgtcacggtcctcgtcttcggcgcactcctccagatcctcgggtgtgcgatcgcggcccagtccgcggtcgccgtgtcccgcgggttccccctcagcgagcccgcctcgacgtcccggcggatcctcctcgcgtccgtcgcaggcgtcctccccgcggggatcgccctcgcggctgcatggatggccttcgtcgtccgggactccctcctcctgctccccgccctccccctgttctggggaccgctcggggcat

SEQ ID NO: 136 - DNA, 4000 bp, Escherichia coli
  misc_feature (1923)..(1924): n is a, c, g, or t
  misc_feature (1926)..(1928): n is a, c, g, or t
  misc_feature (1930)..(1930): n is a, c, g, or t
  misc_feature (1932)..(1934): n is a, c, g, or t
  misc_feature (1942)..(1942): n is a, c, g, or t
  misc_feature (1945)..(1945): n is a, c, g, or t
  misc_feature (1947)..(1947): n is a, c, g, or t
  misc_feature (1950)..(1950): n is a, c, g, or t
  misc_feature (1956)..(1958): n is a, c, g, or t
  misc_feature (1962)..(1963): n is a, c, g, or t
  misc_feature (1965)..(1967): n is a, c, g, or t
  misc_feature (1971)..(1973): n is a, c, g, or t
  misc_feature (1977)..(1978): n is a, c, g, or t
  misc_feature (1982)..(1982): n is a, c, g, or t
  misc_feature (1986)..(1987): n is a, c, g, or t
  misc_feature (1990)..(1991): n is a, c, g, or t
  misc_feature (1996)..(1996): n is a, c, g, or t
  misc_feature (1998)..(1999): n is a, c, g, or t
  misc_feature (3687)..(3687): n is a, c, g, or t
  misc_feature (3708)..(3708): n is a, c, g, or t
  misc_feature (3729)..(3729): n is a, c, g, or t
  misc_feature (3963)..(3963): n is a, c, g, or t
aattaatgcactagatttcgaaatagagttagaacaaaatctacttatacttcaaaaacagttgatatctcatagatacaaaccttcaagatctatttgttttgctgtgacatatcctaaaataagggaaatatttgctgcggattttaaggatagaattgtacatcacttactagtatcatatttagaaccatattttgaaaaaagattcatctactcttcttttgcctgtagaaaagaaaggggtactctttgtgctacaacatatatacaaagaagtttaagaaaaataactagaaactgtacaaaaaaagcttactacggacagttcgatataaagagtttctttacatgtatagataagggggtgctagaaaatatattaattaaaaatatcagaaagggatataaagataatactcagaaagaattaatatggctaaccaaagtaatactaaaaaacaatccaactcaaaacttttcaattagaggagatagtaatctacttaaacaggtacctactcataaatctctgttctatgtttctaaaaacaagggtcttccgatagggaatctaacatcacagttttttgccaatatatatctaaatgaattagatcaatatgtaaaaagagaattaaaaatcaaatactatactagatatgtagatgatatagtcgtactctctgataaccttgaggatgtgtataggtggagagaacagatagacacctttttaaagagaaaacttaaacttactctacacccaaataaagacaaatatggctctgtatactcaggtatagactttgtaggatatgttattaaacctagatataccctttcaagacaaagggtcgtaggtaatttaaaaaacaaattaaaactttttaatcaaggtcttttactagtatctcaaaatcagaaacaaactgtatttccactacatactccaccttctaaggaagagctttctaaaatgttagctatgattaattcttactatggtcattttagacatgttaactgttttaatttaagaaaagatatatatgagaatcactttggttgcttgaaggaatacttagagcctgtagagcagtattcatattttaaattaattaaataatatatatgggtagtacaaacaatttgcctttgtacagaagtgtgtacaaacttttaatatatctttactctttagttagtaattttaaaaaagagtataaatatacattgggtcagtcaataacagattgtatttgggaggtattagatagtgtaattattgctaataccctacctaatttaaaaaagaaagagtatatattaaaagctagtaatcattttgatatgcttaagactcgtattagggtagcatatgaattaaaactaatagataacagaagatatacattcattgttaatcagtttgaagagattggaaagatgttaagtggttggtataaatggagtactaaagccccaaattaagtaccgggagacacaacgaaccccgttgtttgtatttgtcttattgttgttgttggtatttccattgtttaggtttacgttccatgcgttatttgaattgttagagacctccgagctagaccaacgctaacatctttctactaacttgtttaccactgtaaaactgattaatatttcaactaaaaagttttactgtatattaatacctattaggtgtagtagaacggacttaaatatttgggctttctctactatctattgcctacaggaaggttgaatagtagactccatgcacttagatattacaatttgaaatagataatatcaagagattttaaaacaacccatccactttgtggatgggtaaattaaaaattactaaattaacaaattctaaacactagtcccgggagacacaacgaaccccgnngnnngnannngtcttatngtngncgncggtannnccanngnnnaggnnnacgnnccangcgnnatnngaatngnnagagacctccgagctagaccaataataattatctgtaacaaatgctgctgcagatgcctcgtctatacccgcctggttatatatcccatctatatatgcttgcatcaattctttttgagaaggtaaataccaatctgttcttcctgcaaaatctaatgtcgcacagtagtttattgctaaaccacaatcagaatctgaaccatcatatgaacttctaggaattgaagtaaagtaatcacatgaagccatagtaaaaatatttgacatagtaccttggtgtgcagaccaatatactccagttctctcatctctccatgctatatcctctcctactgacatattactccactctgactcttctccctgatagtcatcagttaatgtccctccccaacccaaataatcaccaccagcataatcatcatatgtactgtattgcatattactaaaatctattggtgttggaggtgtatatgtacctgttaatagagtacctgagttggaatagaatttcttaccctctagaacctgatctactgctgcatctcctagaaatgtccatgtacctgttaatagggttcctgaattagaatagaacttctttccactcattacatctgttactagtgcatcccccctatatgttgtagaacttactaccggtatcttaagtgtacctgttaaaagctctttagtatttgagtaaaactgtttaccttctaatacatcactctgtgaagcattacctaagaaatcaaactcctctggaacatatgtaccagtttgtaaatctctagatttattgtaaaaagtcttaccctctattacatcattagaggtaacagtaccctgaggtatccaattagaagcctcttgtattttttctactaccaactgtatatcatcatccgttaaatcctgtgtatatcctaactctactaacttaccatatatacccctaacatctccctctaactccgaaacattaacttctttatttggattaaagaaaagaaatattactgctaaggtaagtattactcctaagaagaatgtaaggattttattcatttaatatatatataacaaattaaagattttttaatatattaatgttagcagaatattaaaaagaagacaaacaaaaagggactcaaaagagtcccttttacaaccacaaagatccgtattacatcattccaggcattccacccatctcattagcatgagaatgctctttttcatcaggtatctccgcaacaacagcctctgtagttactaacattgaagctacagatacagcatttgttaaaactaatcttgtaacttttactgggtctattattcctgcctctatcaagtcaacaaattcacctgtcttcgcattgaaaccaacattccctttacattccgatgccacaactgccccatctgctccagcattctctgctatctgctttaaaggctcacttagtacagatttaagaatatcaatacccaactgttcatcagaatcctcaagtttaaccttctccaaagactttttggaattatgcaatgcaagtccccctcctgcgacaactccctcttcaattgcagctcgagtagcattaattgcatcctctattctcattttcttttcttttgcctccacctcagaagctgcacccactttaataacagcaacnccaccatcaagctttgccaanctctcctggagcttctccttntcatattccgacgaagtcttctcaatttgcgttttaatttcttttactctttcagaaatactgttttttgcacctttaccttcaacgataattgttttctccttcgtaactacaactctcttcgcagaacctagatctgttaattcaactttgtccaaagttttacctagttcctccgaaatatattctgcacctgttaatactgaaagatctttaagcatctctttttttctntcaccaaatcccggtgcctttattgcaacaacatcca

SEQ ID NO: 137 - DNA, 4000 bp, Escherichia coli
  misc_feature (1991)..(1991): n is a, c, g, or t
  misc_feature (1996)..(1996): n is a, c, g, or t
  misc_feature (2003)..(2003): n is a, c, g, or t
  misc_feature (2015)..(2015): n is a, c, g, or t
  misc_feature (2017)..(2018): n is a, c, g, or t
  misc_feature (2023)..(2024): n is a, c, g, or t
  misc_feature (2029)..(2029): n is a, c, g, or t
  misc_feature (2044)..(2045): n is a, c, g, or t
  misc_feature (2054)..(2054): n is a, c, g, or t
  misc_feature (2056)..(2057): n is a, c, g, or t
  misc_feature (2062)..(2063): n is a, c, g, or t
cgaaaatatcttcattcaaggattcagtttcctcaaagtccactacttcgttcataagtccatcggtatgttataggtttcacaatcggcatctaccatttcacgaatagccaaacggtctttcaaaaagtcctcatagggggctttcgcactttcggcaagcaagcccagcatggcagactgatattcgtttaccagcttactttctgtcttagccgggtattttgcagtaagcaacgtactgaaaatattatcagccgtcttaggatattccaccctcacgctgtcatattggaacatcgtgccagtggcacgttccacatcagtcgtaatctcaatgctaccctctttgtcggcaataaccttaacctctttgatattatggttataaaggaacgttccctgcccgttattaagagagtctatcacttccggcttagtcttagccagcaaccctgtagtcaaaacatttgcttccatcgttcaaacaattattaaaaatgaatttactgtgttcctccgagcatctgattatccagccatattcagacgggaagaggtgtttaatatccgtttcatctttgatttcgtatttattgatggtgcggtggaatttcttataaaaccttttcagaataccgcttcttagcaatatgccgtaatggttttgtttgaatcccacataatcaatgctacgagcatcaaccgggaatatctgccagttgcttttaatctctactttcaattcgccacccaagtaaagccccatcatgtcgagtacgaaatgcagtgcctctttgtcagcgcatagtatcaccatatcatccatatagcgatagtagtagattttcactccaaaacgcttcatcactatcttagccagttcctctttaacccaatggtcgaagtatgccaaatagagattagcaaaatattggcttgtgaaattgcctattggcagccctttgtctttaccgttactatctattatcttatccaacagccttagcagttgttcgtccgctatggtgtagcggattatctttttcaatgctacgtggtctatgttatcatagaacttcttgatgtcaatcttcaaacagaatcgtgtacccattctgtctatgattaaagccgtatgcacatcctccatacatttatgaataccacgccctttgatacaagcgtatgtgttcgcaatgaagaagttagtccagtaacgccccaacacattaataatgcaatggtgtactatcctgtccgggaagaacggggcaatcataatcaccctttctttcggctcatatataaccttaatccgatactctccgggggtataagtttcattgcgcaagtcccagtacaagccatccaaattctccaaaatattctcgttgaacttggttatttcggtacgctctcctttgccttgctgtgccttatattgcgcccgtatgaggttggagcattcatatatcaggtgatagacattcttaatcttcttagcttgggaaatgaatatctttcctgtatcaccgacatataaaccgcaatcctcaaaatccgagtattgataaaagcaggtatcagccgtataacataacccgtattcagtctttactacacccatttgtgccgttgttctaaaacagagctttcaattacttacttgcaccgtcctaatccatattattttaccaactatcagacgtgccgatagtccctgtgaggtaagggcgtggcagcaacagttataagttgaaaccacggtaaaagcggaacccaatgttcgcattcgcattcgaggaacgattattcgcattcagataaccgaaacccgcattcgcaccattattcgcattcgcagacaaaagggcaccagccgccacaaccctgttatgtttttattttttcaatccaacgccattttcgttgctccgttcaccgagttttgcagtccgtcaaaaacggcacaagcggaacccaatgtncgcantcgcatncgaggaacgatnanncgcanncaganaaccgaaacccgcanncgcaccatnanncgcanncgcagacaaaagggcaccataccagccagcagtaaagctggaatcatcagcaggcgtatagtaataatcacaatagcccttattacttgcacctcctaccttttcggcaaaggaatagcccttagcggaatgagccatagaaagtacatatccgtcagttcttgggaactccgtaatagcttcatatccggcaggcacggtagttgcactgtctgaatgagaggtgaatttggtcgggtcttcacatacataggcaatagaaacatcagccttatgccaaaccaacacatcatcagcaagcagccacaaatattcaaaaggagtctccaaaccacggtaagaggttacttgtaccaccttatcgccaccagtccatcccttgatagtgtaggacaccttacccgtgttgtttccaagcgttgcagtaacaccacaaggtacaaacggtttatagccgccccatgtattccattccgtaccatttacagcacatccactacccaaaccgccttgatggaatccgtcagcggtcagtgtttcggtgtaagtgtcttgacaatgcaaagaagcatattccacacgttgcaaccaagcaatttcattgtacaccctgtacgctccgtggtgtgtaccgttcttgcagaaaggacgaacaccagcctttgaaatggaagtacggggcatacccaacatggaattgtaagtaccatccttagcggcatcaccagcacccgaaccacctctgaattgtgccgcattcgctttgagaataacaaagccgtccgaatcccttgcaatctcatcgccattccaagtgagccaacagcccgaaacggctatagaattggtaatatccaccgttgcataccacgggcttaccgtctttcgttccatcttgataaagccgggcaacggatattcggaataggcacgaatccatttcgtcccctctatctccaatttgaagtaatattccggcttttcaagcattacattaccgtccgtgctgtcaatcacagccgttgcacccgaatcctttttacggctgtcattttggttaaggtaatacttaaccgaaccgtccgggttttccacaaagcgtttcagtttcgcttgaataggtaatgtacggtgcaaatccaaattgcccacacgctttagcttgtagtcctgtgaattgaaatcaccttgcaccccataccattggtcgtaaggatattgcggtttcgtgtttccgcttcctaataataatcccatagctataagttatttaatagtttcaccagcaccccaatacacatcatataccgaaaggtcgataccgtttggggatattacggttatcgctccgggcgtccaatccccgataggtacggggaacattccaaaatccttatcacaaatgagcttgcatttaagcagcgtgcttgtttccatcgtaacctctttaggtcgtacaaagacggtaaacggagcaccacccaaagcaaaaccattggaaaggtctgtaaccttacctttggaaagaatccgtaggctgtacatcgttgtttccataattcactgagtaaatcaagtttatttaactgcaaatataatcataaatgtgtttaatgaacacatttatagatacaattaaagtgtatcatcatataacgaggcataacgtgcttcaagttcattgattttatctcttaacaactgcctttcattatgcaatgcctttatctcatacggcatttcagaacccattagggcggcttcgtagcatttgattaccttataatcgctacttgccaatacctcctttgagcgttcaatctcatgtgccaccttttgaaagtcggggacttctatgtatctgaatgaaatcctatccccggcatcgtatggtacaatgcgcacaacatagccctctttatctgagttttgtttac

SEQ ID NO: 138 - DNA, 4000 bp, Escherichia coli
  misc_feature (2887)..(2887): n is a, c, g, or t
  misc_feature (2956)..(2956): n is a, c, g, or t
  misc_feature (2967)..(2967): n is a, c, g, or t
  misc_feature (3159)..(3159): n is a, c, g, or t
  misc_feature (3162)..(3163): n is a, c, g, or t
  misc_feature (3165)..(3165): n is a, c, g, or t
  misc_feature (3169)..(3169): n is a, c, g, or t
  misc_feature (3176)..(3177): n is a, c, g, or t
  misc_feature (3180)..(3180): n is a, c, g, or t
  misc_feature (3183)..(3189): n is a, c, g, or t
  misc_feature (3192)..(3192): n is a, c, g, or t
  misc_feature (3194)..(3194): n is a, c, g, or t
  misc_feature (3196)..(3203): n is a, c, g, or t
  misc_feature (3205)..(3211): n is a, c, g, or t
  misc_feature (3213)..(3215): n is a, c, g, or t
  misc_feature (3217)..(3220): n is a, c, g, or t
  misc_feature (3222)..(3224): n is a, c, g, or t
  misc_feature (3226)..(3233): n is a, c, g, or t
  misc_feature (3235)..(3235): n is a, c, g, or t
  misc_feature (3237)..(3239): n is a, c, g, or t
  misc_feature (3241)..(3243): n is a, c, g, or t
  misc_feature (3245)..(3249): n is a, c, g, or t
  misc_feature (3252)..(3252): n is a, c, g, or t
  misc_feature (3254)..(3260): n is a, c, g, or t
  misc_feature (3263)..(3263): n is a, c, g, or t
  misc_feature (3265)..(3268): n is a, c, g, or t
  misc_feature (3270)..(3270): n is a, c, g, or t
  misc_feature (3272)..(3272): n is a, c, g, or t
  misc_feature (3274)..(3276): n is a, c, g, or t
  misc_feature (3278)..(3278): n is a, c, g, or t
  misc_feature (3281)..(3284): n is a, c, g, or t
  misc_feature (3287)..(3290): n is a, c, g, or t
  misc_feature (3292)..(3292): n is a, c, g, or t
  misc_feature (3294)..(3295): n is a, c, g, or t
  misc_feature (3299)..(3312): n is a, c, g, or t
  misc_feature (3314)..(3314): n is a, c, g, or t
  misc_feature (3317)..(3317): n is a, c, g, or t
  misc_feature (3319)..(3320): n is a, c, g, or t
  misc_feature (3323)..(3329): n is a, c, g, or t
  misc_feature (3331)..(3332): n is a, c, g, or t
  misc_feature (3334)..(3338): n is a, c, g, or t
  misc_feature (3340)..(3341): n is a, c, g, or t
  misc_feature (3343)..(3344): n is a, c, g, or t
  misc_feature (3346)..(3346): n is a, c, g, or t
  misc_feature (3348)..(3353): n is a, c, g, or t
  misc_feature (3359)..(3359): n is a, c, g, or t
  misc_feature (3364)..(3367): n is a, c, g, or t
  misc_feature (3369)..(3373): n is a, c, g, or t
  misc_feature (3378)..(3380): n is a, c, g, or t
  misc_feature (3382)..(3385): n is a, c, g, or t
  misc_feature (3387)..(3395): n is a, c, g, or t
  misc_feature (3397)..(3397): n is a, c, g, or t
  misc_feature (3399)..(3404): n is a, c, g, or t
  misc_feature (3407)..(3407): n is a, c, g, or t
  misc_feature (3409)..(3410): n is a, c, g, or t
  misc_feature (3414)..(3417): n is a, c, g, or t
  misc_feature (3419)..(3422): n is a, c, g, or t
  misc_feature (3424)..(3431): n is a, c, g, or t
  misc_feature (3434)..(3436): n is a, c, g, or t
  misc_feature (3438)..(3439): n is a, c, g, or t
  misc_feature (3443)..(3443): n is a, c, g, or t
  misc_feature (3446)..(3453): n is a, c, g, or t
  misc_feature (3456)..(3459): n is a, c, g, or t
  misc_feature (3461)..(3463): n is a, c, g, or t
  misc_feature (3465)..(3469): n is a, c, g, or t
  misc_feature (3472)..(3472): n is a, c, g, or t
  misc_feature (3474)..(3480): n is a, c, g, or t
  misc_feature (3485)..(3490): n is a, c, g, or t
  misc_feature (3492)..(3494): n is a, c, g, or t
  misc_feature (3496)..(3499): n is a, c, g, or t
  misc_feature (3501)..(3503): n is a, c, g, or t
  misc_feature (3506)..(3508): n is a, c, g, or t
  misc_feature (3510)..(3510): n is a, c, g, or t
  misc_feature (3514)..(3520): n is a, c, g, or t
  misc_feature (3523)..(3524): n is a, c, g, or t
  misc_feature (3526)..(3527): n is a, c, g, or t
  misc_feature (3529)..(3533): n is a, c, g, or t
  misc_feature (3535)..(3543): n is a, c, g, or t
  misc_feature (3545)..(3546): n is a, c, g, or t
  misc_feature (3548)..(3548): n is a, c, g, or t
  misc_feature (3551)..(3566): n is a, c, g, or t
  misc_feature (3568)..(3573): n is a, c, g, or t
  misc_feature (3575)..(3577): n is a, c, g, or t
  misc_feature (3579)..(3580): n is a, c, g, or t
  misc_feature (3582)..(3586): n is a, c, g, or t
  misc_feature (3588)..(3595): n is a, c, g, or t
  misc_feature (3597)..(3599): n is a, c, g, or t
  misc_feature (3601)..(3605): n is a, c, g, or t
  misc_feature (3607)..(3607): n is a, c, g, or t
  misc_feature (3609)..(3609): n is a, c, g, or t
  misc_feature (3611)..(3614): n is a, c, g, or t
  misc_feature (3616)..(3616): n is a, c, g, or t
  misc_feature (3618)..(3619): n is a, c, g, or t
  misc_feature (3621)..(3624): n is a, c, g, or t
  misc_feature (3628)..(3629): n is a, c, g, or t
  misc_feature (3631)..(3634): n is a, c, g, or t
  misc_feature (3636)..(3640): n is a, c, g, or t
  misc_feature (3642)..(3643): n is a, c, g, or t
  misc_feature (3646)..(3659): n is a, c, g, or t
  misc_feature (3661)..(3664): n is a, c, g, or t
  misc_feature (3667)..(3667): n is a, c, g, or t
  misc_feature (3670)..(3670): n is a, c, g, or t
  misc_feature (3672)..(3672): n is a, c, g, or t
  misc_feature (3674)..(3677): n is a, c, g, or t
  misc_feature (3679)..(3695): n is a, c, g, or t
  misc_feature (3697)..(3700): n is a, c, g, or t
  misc_feature (3702)..(3702): n is a, c, g, or t
  misc_feature (3704)..(3715): n is a, c, g, or t
  misc_feature (3717)..(3719): n is a, c, g, or t
  misc_feature (3721)..(3721): n is a, c, g, or t
  misc_feature (3724)..(3725): n is a, c, g, or t
  misc_feature (3727)..(3730): n is a, c, g, or t
  misc_feature (3732)..(3755): n is a, c, g, or t
  misc_feature (3757)..(3758): n is a, c, g, or t
  misc_feature (3760)..(3765): n is a, c, g, or t
  misc_feature (3767)..(3769): n is a, c, g, or t
  misc_feature (3772)..(3776): n is a, c, g, or t
  misc_feature (3778)..(3802): n is a, c, g, or t
  misc_feature (3804)..(3809): n is a, c, g, or t
  misc_feature (3811)..(3830): n is a, c, g, or t
  misc_feature (3832)..(3832): n is a, c, g, or t
  misc_feature (3834)..(3836): n is a, c, g, or t
  misc_feature (3838)..(3839): n is a, c, g, or t
  misc_feature (3841)..(3847): n is a, c, g, or t
  misc_feature (3849)..(3855): n is a, c, g, or t
  misc_feature (3857)..(3857): n is a, c, g, or t
  misc_feature (3859)..(3880): n is a, c, g, or t
  misc_feature (3882)..(3886): n is a, c, g, or t
  misc_feature (3888)..(3900): n is a, c, g, or t
  misc_feature (3902)..(3914): n is a, c, g, or t
  misc_feature (3916)..(3944): n is a, c, g, or t
  misc_feature (3946)..(3953): n is a, c, g, or t
  misc_feature (3955)..(3961): n is a, c, g, or t
  misc_feature (3963)..(3967): n is a, c, g, or t
  misc_feature (3970)..(3970): n is a, c, g, or t
  misc_feature (3972)..(3981): n is a, c, g, or t
  misc_feature (3985)..(3994): n is a, c, g, or t
  misc_feature (3997)..(4000): n is a, c, g, or t
gcgcggcaggaaacgcagcgggcgggaacagccagcccgagcgtatcatcgccctccttggcggacgggagaacattgaatttgtggacgcctgcatgaccaggctccgcgtgacagtgaaggatctctccaaggtggctgaacttccggcgtggaaggcagagggcgccatgggccttgtgaagaaagacaacggcatccaggcaatttacggacccaaggcggacgtgctgaaatcggatatcaacgatatcctgtaacaattcagcaccccggaaaaaatgagtgaaatatgaacggggagcctgctcaccgggcagattttgctcaatacgcagaggaaagaactatgagactgcttactatcaatattcacagccatggaagtgactttgaaccggaactttatcatcagaagatgaaggcgctggcggcatttatgaaggaagaagagatcgatgccgcggcgatccaggaatgcagtgaagaggaggacaggccggtggtctccggccccctccccatgcattgggtgccggccggaccggactcccgcgtccgggaggataactgtgcgctggtcctggcggaggaacttcagggcctgcagcaggagtactggtggacctggaccggagcgaagctcgggtacggaaaatacaatgagggtctggccatcttcagccgccgccctgttacaggcgcggacagtttctatatttccggcgtccgggacttctccaactggaagacccggaaggcgctggcggcctgcaccgctgacgggcctgcctttttgagcgtccacatgggatggtggaatgatccggaggaaaacttccgggggcagatggaacggctgcagaaggcgctccgcgaaaggaagcttcgtccgcaggacggttctgacagtttccttatgggagatttcaacagtcccgcagcgatccgcggagagggaagggacatggtcctggacctcgggtggcgggacagttatgaggatgccgaaataaaagacagcggcatcaccgttccgggaaacatcgacggatggagggacggtgaacatacgggcatgcgcctggattatatctggaccgcaaaaaggcacagggtgcttcagtcaaaggtggtcctgaacgggatcagcgggccggtgctttccgaccatttcggagtcctggcggtgatcgaatgaataaaggagcagacagcatgagagaaagtggaattcttcttgccatcagcagccttccttccgaatacgggatcggctgcttcagcagggaagcatatgagtttgcggaccgcctttcagaggcgggccagagttactggcagatcctgccgctggggccggtgggatacggagattcaccgtaccagtccttctccaccttcgcgggcaacccttactacatttcacctgagacgctggtggaaaagggatggatcactgaggcggactgccgcgaagccggcctttcttccgacccgcgcggtgtggattacgtgctgcagtaccaacgccgctatgagctgctccggaaggcgtacagaaacagccggatcgaagagaatgagaagttccgggcgttcacggagaagacggaatggcttccggactacgcgctgttcatggctctgaaggaagagaacggaggaaggccctggtacgaatgggaagatccgctgagactcagggatccggaagccttggccgcggcgcgggaacgcctggaggaaggcatcggtttctgcagtttcctgcagtttgagttttacgaagagtggatgcagctgaaggactacgtgaaccggaagggaatacggatcatcggagacatcccgatctatgtatccctggacagttcagacgtctgggcggatccggaacttttccggctggatgaaaaccgccgacagaccgcggcggcgggctgcccgccggatggcttcagcgctgtgggacagctctggggcaacccactctatgactgggactatcacaaaaagacctgttttgcctggtggctgaaacgtcttaaaaactgctttgatatttatgatgtgatgcggatcgaccatttccgcggcttcgatgaatatttttccattcctgccggtgcggaggacgcaagagcaggccattgggagaagggacccggcatggatctgttccggaaggtctcggaagccttcccgggacgggagatcatcgcggaggatctggggtatgtgacggacagtgtccggcagctggtgaaggacagcggctatcccgggatgaaggtcctggaatttgcctttgactcaagagattccggctgtgcggaggattaccttccccacaattacgaaaagaacagtgtggtctacaccggcacccatgacaacgagacggtgaccggctggttttccgagggcctgaagccggaggagaaggaggcagtcagagactatttctgcgaccatacgactcccgacgccgggatgcacatacccctgatctgcgccgccatgcgaagcgtcagcagactctgcatcatccccatgcaggaccttctggggtacggaaacgaggcaaggatgaacgctccttccacctacggaaacaactggaaatggcgtcttctgaaggatgaattcggagagaaggaagtgaagacgctgtatgagatcacgaagcggtacggaaggatcggaaaatgagaaaagaggacagtgaataattaaaaagctctttaccgccagtcagagcaataatcggctggcggtattcttatgccgcagcatcgaaatgatcatggaattccgcaggtgtcatcagatgcatcttccgctggatccgctctgtgttgtaatacctgatgtaggattcaanagcagtaatcaggtctccttttgaggtgaacttcttgccatagtacatttcccgcttcaaaataccccngaaaccttccntcggcccatggaaaaaatgaaaaagccaatcgatatcttcgagaggctgctttggaaatcaggtatgctttgtctgacctgtcaaatgcattattcgagctgtccacatctcccgaagatatcgatgatgataacaatcttgaatgacgattgatttaaagagggttaaaaaacataggaagttaaggatanaanncncggngaaaaannttntgnnnnnnnaananannnnnnnnannnnnnntnnntnnnngnnnannnnnnnnancnnntnnnannnnnaanannnnnnnaantnnnnangngnnnanaannnnggnnnnanannaaannnnnnnnnnnnnntnttntnntcnnnnnnntnncnnnnncnntnntngnnnnnngcggcngaagnnnnannnnngagannngnnnngnnnnnnnnngngnnnnnnagncnnagannnngnnnncnnnnnnnnagnnncnnaagnttnnnnnnnncannnncnnngnnnnngantnnnnnnnggcannnnnngnnnannnngnnnagnnngnggannnnnnnctnntnntnnnnngnnnnnnnnncnngnacnnnnnnnnnnnnnnnncnnnnnntnnngnnannnnnannnnnnnngnnntnnnnntntntnnnngngnngnnnncganngnnnngnnnnngnngcnnnnnnnnnnnnnnannnnaanaanangnnnntnnnnnnnnnnnnnnnnntnnnngncnnnnnnnnnnnngnnnangannannnngnnnnnnnnnnnnnnnnnnnnnnnnannannnnnncnnncannnnnannnnnnnnnnnnnnnnnnnnnnnnngnnnnnnannnnnnnnnnnnnnnnnnnngngnnngnnannnnnnntnnnnnnncncnnnnnnnnnnnnnnnnnnnnnngnnnnngnnnnnnnnnnnnngnnnnnnnnnnnnnannnnnnnnnnnnnnnnnnnnnnnnnnnnnannnnnnnnannnnnnngnnnnnganannnnnnnnnnaaannnnnnnnnngannnn

SEQ ID NO: 139 - DNA, 4000 bp, Escherichia coli
  misc_feature (738)..(738): n is a, c, g, or t
  misc_feature (1669)..(1669): n is a, c, g, or t
  misc_feature (2868)..(2868): n is a, c, g, or t
  misc_feature (3028)..(3028): n is a, c, g, or t
  misc_feature (3077)..(3077): n is a, c, g, or t
  misc_feature (3130)..(3130): n is a, c, g, or t
  misc_feature (3133)..(3133): n is a, c, g, or t
  misc_feature (3155)..(3155): n is a, c, g, or t
  misc_feature (3217)..(3217): n is a, c, g, or t
  misc_feature (3352)..(3353): n is a, c, g, or t
  misc_feature (3435)..(3435): n is a, c, g, or t
  misc_feature (3587)..(3587): n is a, c, g, or t
  misc_feature (3609)..(3609): n is a, c, g, or t
  misc_feature (3675)..(3675): n is a, c, g, or t
  misc_feature (3689)..(3689): n is a, c, g, or t
  misc_feature (3753)..(3753): n is a, c, g, or t
  misc_feature (3947)..(3947): n is a, c, g, or t
  misc_feature (3962)..(3962): n is a, c, g, or t
  misc_feature (3995)..(3995): n is a, c, g, or t
taacttgcgatattgaaaatttatttttgccaattttttttttaagaaaattattgtctataccagataaataaatatttccaacaaaattttggagatttaaaccagacatcttccaaaatgaattcgtttttggcttagttaaattaacacttttaactgctggtatttcttttgaaaaaaaggtttcagaagtataaactttaactacgtctattacacgcctttgttctttttctaatttagaaacttttttttttgctttttcgcttccactccaaattccagatttattatcaaacgaacaactcgcaaataaaataaatatcaaaaaaaaaattaaatattttacctttttaatcatttgtaataaatattaactgagatctggcgtggttatataattctttatgtaaattcttcaaagataaaatctgcacataaaattcttttgcctttaaatattcttttttagaagcaaaataatctccaagcaacaacaaggcatgtggcttccatactgtctctgtgtttattaatggttttacagcatctaacaactctaactcgcttacaaaatttgattgaaatagtgcctttttaaaaattattaaatttttaacttctttttcaaatttgttattttctaagacgtgatcaaacaaattagacagttctccttgatcaactatcaaattttcattcaatattaaaaaaagagataaagtcgaataagtnctgtcattagcgaaaattattgtttttaaaatatttttcactttattcctgtcaccattctctaagtaaacttttgctgctagataattgtctgacaaaagtatttttttcttttctttagtttctgaataaaaactaacagaagcaatagcaattattagaattaatataactgaaaaaattaaaattttatttacttcataaaacttttttagtttcgatttttttgttacatcatattgagtttcgaataaattttcattcatttaaataattattttaaaatctatacacattttgagaagatggaaattttctgcgttttatatcactacaataattcttaacacttttttctattattttttttacattagaatactttttaacaaatcttggacgaaaattacttaatcctatcatatcgtcagtaacgagtatttgaccgtcacaatatttagatgcacctatacctatagttggaacagaaacgctatcagtaattttttttgccaaactctctacaacacattcaattactattgcaaacaccccagaatttgaaagagccatagcatcttgtaaaatttgttttttttgaattaagtttttaccttttaatttaaaaacttttgaagactggggcaataatccaatatgacccataactggaattcctttctttgtgagatatttaattatattaactatttttctccccccttccaacttaactgcgtcacatttggttgatttcattaccttttttacatttttatatgcaataaatttatttgaatatgttttgtggggcatatcaaaaactacaaaacttctcttagcagagtttttgactgctttcccatgaagaatcaaagtttcaattttcacttcccttgttgttttcattccatacaaaaccataccaacngaatcaccaaccaaaattatatcgcaatatttgtcaataatttcagccataggttttgaatatgcagttaagcaagtaatgggttcttttccttttttttctaaaatatttttaattgttatcccttgcattttagggtatcaatttatcaaatttttcttggatttctgccctttttgaacaaaaggattcgcaaactagattaaattttttaatcagttctttagcttcattataatctgattgtttaattttaagaagagtaagcatataaatagcttcatcattttgtggattcaataaaagaacattgcttaaattcatttcttgttcttgatcgttattattttcattaaaaattttagctagatataaatatgatttttcactttgaggattaaatactatatctttttcaaagaaaattttggatttctgaaatttttttttatcaaaaagtatttttcctttatcaaagtagttagatttgacggcaaatccacttgagataaaaaataaatatataattaaaatttttactagaaaataagttttcttcataatttaaactttaaatttttgatcatatttacattatgtatcataccttggaaaagttaaaggattttgaaatccctttacaataaatataaatttctttggattcttttctgctagataagggtttgtatttaacaacttttttaaagtatttattagcttttttatgaatttcgataaatatagatcccataaataatttagataaaaaaacaccatctttatgtaaaattttttgcactaaatccattgcccttaaacaaagctctccagttctataagaatcaagatctttattgccagaagtgcttgcggccatatcagatataacgacatcaacttttttatcaaaataagcacaaattttctcataaattacagaatcacacaaatctccttttaaaaaattaacgttatcaatattttccataggcttaatatctactgctaaaattttccctttagttattatttttgttactacttgcgaccaacttccaggactagagcccagatccaataaaaatgtatttttttttaagaatttaaactttttattcatttctattaatttaaaagcagacctggatctgtaaccctgaatttttgattgcctaaagaatggatctttgtgttgnttaattaaccaattttttgaaattttattttttttcaattatttctaataatttttctaaatcattaatgtaaagattttataaaacatcttccgtttcttcttctttaactatagtcatagattttttgtttatatatcgataatgaagataacttatnggaagcaacaaaatataaattaaaccactaaaaaataaggttttaaaantataaaaaattaaaagacttaaatatattccaattcctagtaataaaaaaatngtnaaatgtcttggaatcaaaattnttttcaatgagtaagtgggtattttgcttaccatcaaaattgataccattaaaataactatngaacttataattgcagtattttcaaattgaactaaatcacttaaatttagaataagaggtaatagtatcaaaccagcagcagcaggtgatggaattccttcaaaaaaatttattttccatgtttctgtttcttcnncaacagttaaattaaatctcgctaaacgaagagcgcagcatacagtataaattaaaacaagcatccatcctatttttcctanttcatttaacgtccaaaaatacattacaaaacttggtgctacgccaaaactaataacgtccgtgagagaatctagctcttttccaacctttgaagtggctttgatcaaacgagcaactcttccatcaagagtatcaagaattgcagcaaatnctattgcaattactgacatcgnatagtttgtatctaatgcaaattttattgaacttaatcctaaacaaacaccaaaaatagttaacgngtttggaagaaganatctaggatttttttttgaaataagtttaaattcctttttattttcgagcatggttctatattntttttgctaataaagtttctccggcaactgtgttttgatttttacaaactagtaactgataattttcaaaatataagtcaactttactaccaaatctaataattccaaacctatccccttgtttaattgtgtctcccactttgacatcgcaaactattcttctagcgatcattcctgcaatttgaacaacaatnaattcgtctccgttngaattcttaagtttaagataatttctttcgttntcttc

SEQ ID NO: 140 - DNA, 4000 bp, Escherichia coli
  misc_feature (135)..(135): n is a, c, g, or t
  misc_feature (724)..(724): n is a, c, g, or t
  misc_feature (1976)..(1976): n is a, c, g, or t
  misc_feature (1981)..(1981): n is a, c, g, or t
  misc_feature (1988)..(1988): n is a, c, g, or t
  misc_feature (1993)..(1993): n is a, c, g, or t
  misc_feature (1997)..(1997): n is a, c, g, or t
  misc_feature (2001)..(2001): n is a, c, g, or t
  misc_feature (2006)..(2006): n is a, c, g, or t
  misc_feature (2010)..(2012): n is a, c, g, or t
  misc_feature (2015)..(2015): n is a, c, g, or t
  misc_feature (2017)..(2017): n is a, c, g, or t
  misc_feature (3191)..(3191): n is a, c, g, or t
  misc_feature (3235)..(3235): n is a, c, g, or t
  misc_feature (3545)..(3545): n is a, c, g, or t
  misc_feature (3681)..(3681): n is a, c, g, or t
ccaatcaatatgtggaaaacggttcttatctgcgtttccaaaatatcacgttaggttataatgtgcctactgaatttttgagttttacaaagtatgtatcgggattacgggtgtatgcttctttgcagaatttcnttacgataacaagctattctggtgataatccggaagtcagcaaatatggtcaggataacctgggagccggatatgatgcattctcttatccgtttgcaaagtcagtattgtttggtttgaatgttaaattctaaaagagtctaagtagtttatgaaaaaaatagcatttataatattgagttcggtcatgatgaactcatgtacggatatgaatctgataccggagtctaatctgagtcctgaaaacttctttaaatccgaagaggatgcaacagctgctgtttatggaacgtattcggtttttaccgataatgatatttataaccagttttgggaagtattgcagagtcagggtactgatgattgcgagtggagtggtgggcgcacgacgactaacctggacaaaaatgctttagataaatttgagtatgatgggaatacgaatttagtttactccgtttggattaagcactatgtggcagttaaccgctctaacttcgcgatagaaaatatttcgaatatggggagcgaacagataagagatgatgtcaggaagcggctgatcggagaagctaagttcctgcgggcnttggcctattttaatttggttcgcatatatggaggagtccctttagtattgaagcaaaccacttcgttggatggcttagaagttccccggaatacagttgacgaatgttatgaacagattatctcggatttgcaagaagcaaaatctgttcttcctgctatcgggcaacttccagagggatatttaggacgggcaacaaaagggtccgcctctgctatgttggcaaaagtttatttgacccgtgaagattatcagaatgtagtgaaggagacgtcggaagtgatgcagatgggatataaattatggaagaattatgctgataattttgatgtggaaaaagaaaatggacaggaatctatatttgaaatccagtataagcggaatactccgggtgtgtcgggtagtaattacaacggatattatcgtcctccgtttgtcaatataaatggttgggtcggatatggagatgatccagtgacacgtaatcattatgaatgttacgaggaaggtgatttgcgtcgggatgtaaatgtgcgtctttatacgaaggaagagtatccgaatatgtcttccaattatgagtttccttgttatgtaaataaatttcaggatccttcgccgttggccgtaagatctcaaggaggagaaaataattatccgatattgcgttattcggacgtctatctaatgcgtgcggaagccttgaatgcaataaatacttctgatgcagaggcgtatgagtgcttaaatgtcatacgtcgtagggcttttggacttaatatgaacgaggcttctgctattgatattaagctaggattgagtaaagaagatttcttggatataattcttttggaacgtcgtaaagaatttgcatttgaaggacaacgtcgttttgatttggtacgtacgcataaattgaaggaagccatgatggcgcagaatccgactattggtgctgtggtagaggaaaaacattatctgttgcctatacctgtgacagaattggatgcaaataagttattagagcaaactccgggatggtaaattaagtattatatgaagagaagaagttttatcagaaacataagttctttaggtttggcatctgtagcagtgggaacatcttttgctgcagaaactcctcaaagtaacagtttgccgggaaaatcgaaaataccggtatatgatgggtgggacgtaatagttgtggggggaggaccttcgggatgtgctgcggctacggctggggggnggggngggggcnaaaantttnttantgganggannnggngncttaggtggaatggggacttctggcttactgaatgcgtggtgcccttttacggatggtgagaagattatttataaaggaattgcggaacgggttttttccgagtcaaagaaaggtgttcctcatattcattatgataattgggtgcctataaatggtgaatatctgaaagtcgtgtatgacgatttggtaacctctgagggcgtatctgttctttttttcacaacaatggctgctgtcgaaatgaaacgtaagggggttgtcgatgcaatagttgttgctaataaagcaggattgtcaacttacaaagctaaagtatatattgattgtacaggcgatggtgatcttgcggcttgggctggtgctgattttgtaataggagatgagagtggttccgttcaagaaggtactttgtgctttaccttgtcgaatgtcgacccttatgagttttctttaatagggaatgtccatactaatcggaaggatggtccgattcattctatttatggtaaccctaaatacccattggtgaaagataagcacatgaatgacaagttaatcggaccgggtatcttaggattcaatgccggtcatgtgactgttgatagtacagatccagtatctttgactgaagcaatgataaaaggacgtaaattggtaagacagttacatgaaggattggtcgagtttgaaccaaagtcatttggtgcttcttttttggcaagtacggctaatttgatgggaatcagggaaagtcgccggataaaatgcgattatacattcacattggaagattggctcgctcgtaaggagtttgaggacagtatcggacgtaactgttattatattgatgtccataaacaggatgcaaccgtgtatcctcgctataagaaaggagaatctcatggaatcccctttagttgtctgactcctgcgggtttgaaaaatgtaatggttgcaggacgttgtatctcgacggattcttatgctcatggtagtctgcgtgtgatgccaccgtcgcttgtaacaggtgaagcagttggtgttgctgccggtcagatttgtaaatccaaatctcctgatatacataatgttgatattcaaaagttgaggaaacgattgaaagaagtaggtcagttgatctgatgtaaatggatactcgtctgttattttctngtttaaacaaggaatcggcagacgggtatattatgtcctatagngggtatatatgtagatgaaatattgtgtacattctgttttaaagttttaatttgactattgctaataaatatgaagcaaatcgttctgattctatttttatgtattgtaggctgttcctttgtatggggacaagatgcgaattattatcgtaatcccgataggatttatctggattcaaaagatggacaccaaggtgcattcctttggaaaatgaaaaaagcaggagatgttacagcctgtgcggaagccgtgtcgaagcccggatataagacgggtgactggatgccggcaattgttccgggtactgtnctaaattctctcgtatataacaaagtgtatcccgaaccttattatggattgaataataaactgacgagcaatatcattccggatttgtctgttgtcggacgtgatttttatacttattggtttcgtaccgatttcntcgttcctgctgattataaggggaaagtcatttggttacagttggacgggatcaattatcgggcggaagtctgggtaaacggtcatttgctgagtaatatttccggcatgtttattcaggattatgtggatataacagagttcgcccgagtaggcgaaacgaacgctttggcagtaaaagtctatccggtcgatatgtctggaaccgtcaaacaaaaacagtggggagctgtaggagaatttcataacggtggtgacgggaatatagggctgaacacgacgatgctgatgtctgtcggttgggactttactttcttgga

SEQ ID NO: 141 - DNA, 4000 bp, Escherichia coli
  misc_feature (44)..(44): n is a, c, g, or t
  misc_feature (79)..(79): n is a, c, g, or t
  misc_feature (124)..(124): n is a, c, g, or t
  misc_feature (136)..(137): n is a, c, g, or t
  misc_feature (142)..(142): n is a, c, g, or t
  misc_feature (157)..(157): n is a, c, g, or t
  misc_feature (262)..(262): n is a, c, g, or t
  misc_feature (265)..(265): n is a, c, g, or t
  misc_feature (268)..(268): n is a, c, g, or t
  misc_feature (270)..(270): n is a, c, g, or t
  misc_feature (274)..(274): n is a, c, g, or t
  misc_feature (334)..(334): n is a, c, g, or t
  misc_feature (363)..(363): n is a, c, g, or t
  misc_feature (397)..(397): n is a, c, g, or t
  misc_feature (402)..(402): n is a, c, g, or t
  misc_feature (415)..(415): n is a, c, g, or t
  misc_feature (418)..(418): n is a, c, g, or t
  misc_feature (422)..(422): n is a, c, g, or t
  misc_feature (426)..(426): n is a, c, g, or t
  misc_feature (2560)..(2560): n is a, c, g, or t
  misc_feature (3662)..(3662): n is a, c, g, or t
  misc_feature (3914)..(3914): n is a, c, g, or t
tggatgcttaggacagacaatctgttatgatttacgtttccctnatctttatcggaatttgtcgcaatctggcgcaganatattatttgtacctgcggtatttacaaaaaaaacaggtgcggcncattggcatgtnntaaanagagcgcgtgccatngaaaacggagcttttgtggttgccccgtgtgcagtcggcaatgttgaaggtggaggaggaggctacggacattcactgatcatcaatccgtggggtgaaatactngcngangnaggngcagattcagggtttatcaatgtaaatattgatctggaagaggttagttctgcgcgaacncgaattccaagtcttagtcatgacaaagncttttcgtcttagcttgcgataaaatcacaaaanccgtnttaataaaatatnccntaanttgntttaagctgagcaataatatctcgcagatttgtgtcatcttcaatttcaagactcagtgcatattttgtttcaacctgatcaacaaactccacaatcaccaccgagtcagctccgcagtccaaaattggctgatccagttccggttccagcgagacgacatttttgaaaagcgcagtcagttctgtctcaagcgaaggtttgttttctgcaacgtcaaaatcttcggtctcctctgaactggaaacgcgctcaatgagtcccgcaaaagtatcatcagcaaaagtatttctgtttcgaagatgctttatttttccgctggaggtttttgcaatagtacccggttccagatacaggcgttcactgggtgctatttgaaaatgtttgccgacgatttcaataatttgctgatcaatggaagtcaaaacgtatttacggaaaacatcaatgtctttaatcaaatcagcgcgaacttccactgccaccgccaaatgttctgactcatcttctgctccggaagcataagccatcaagcatccaggccgtaattcttcaattcctgcgagtaccagttcaatatcatgcggataataatttcgtccgcgaatgatgatgatgtctttgattcttcctgcaaaatataactcgcctttccagagcaaagcagtgtcgccggttgcgagaaaaggctgttctttgccaataattttttgccggaaaatttcttcggtggcctgtttgttttcgtaatatccttgcgcaaccgagggtccgctgaccatcagttcgccgacttctccttccggaagttgttgattttcaaggcctttgatcacaatttcgtgaccatccatttgtgaacccagattgaccaacatctttttgtctgttgccggtgcatcgtcgttcaggactttgacccgtccttctttttccaaaatatgccgatccacgcaaagtccatggagtccggttttgctgccggaaaacatgatcactatttccgccattccaaagccgggacggataacatccgcttttaaaccacatgcagagaaacgctcattaaactttttggttggtaaataatgaaccggttctgaaccgtctgtcacggaaaccatgcaggataaatcgagttgctgcaactcctcatctgagatttttttcaggcacaaatcaagcgcgaagggcggtacataactatgtgcgcacttgtattttgacattgccgcaagccagcgtagtggtttacggataaaatgcgcgggcgtcatcaaaaccgtaaaacctccggaataaagcgcacccataagtccggcagccaagccaaaatcatgaaacagtggtagccagaccgcggtgccgtcttcctcttcaagctgcatgaacttgcgggcttcttccaaatttgccatcaagttactgtgcccaatcatgatgcctttcggcgtacctgtgcttccggaagtgaactgtaaatatgctgtgtcctcagctttaatttccggtgcagaatattctgcggaagtttcagcaagtatttcctgagcagtcgcgatttctagtccgctgaaaactttttgcagttccggtggtaattgattgcgtaaaaattccgccagttgagagcttactattattaaacttggtttgctgacttttaaagttggcaaaaaagtttccagataagccgccatattttgcggtcctgcaggttccgacaatggtaccgcgaggattcccccatacaaacaaccgtaaaagattttgacgaattccaaactgtttggcagaatgaccagcacacgctcaccttgtttaatgccgcgtttttgcagggaagcagctacttgacacgcagcctgatcattttgttgataagtcatcgaagcggaagttccgccgccgacagtcttattttctccatcttcgaggaaaataacacagtctctttcaggatgttctactgccctttgccgggcaacttcgacgaaatgtgagtaattgcttggtttcatgttttcaggttgattgctttaaatttggtgttctgttatcaaaagaatatttttcattgaagcacagtctatcacataaaagtctgacctcaagaaaaaaggtgctgcaactgantactgtaatatttttttaacaaatttcatagttgttgaaatcacctcttcaaattcctgatcgagaatgacaacgtgtcttgatttctccatccaatgcgattcacggactgcagactgaacaccgcggaaaataatctcaccgctatttaaatctacggtttcatccaaatttgcctggatgatcaaaattggctgataaattcgagcaagacgcttttttatgtcagcttgcaatttcagcagttgtacaccggctttcagaggattaactttgtaaccttgccacggcattgcgtctcggtcatcttcagtttttttgggcacagcaaaaacgaaaggagaagcaacaaccataaaaagtttacgcagcagtgaagaggcaagtcgcattgcgggagcatacagcagcaaggctttaatttcaggatgttctgtggcaagatgcagcgcaaggatgccgccggtagattctccgccaacaataactcttgaacattttttctgtagttcagcgtaggctttttcgcagactgcaatccattccctgcgatgagtatgactcaacttctcaggagttgttccgtgtcccgggagcaagactgctgaaacagtgaatccttcatcatgaaaacgcttggccagtgggcgaacttcagccgtagttgcagtaagaccatgcagcaaaagaacaccgtcagctcctccttgccaaaaaaaaccacctccttccagctcaggatttaccagaggaggttctgctgagattgatgaatttgatagttcaggcttgatttgggaacggttcattttgtttgtttttaactatttttatttagtctttaaattacacgatttccgtaattatcagcaggtatcgtctgttgtgttttgtgttttgtcttgatacaaaaatcagcaagttatagactagattgttttattctcaactattaagtctatagtatttttagtctaggttctttatgattcgtgttcaagcactgagcaaaaattttaacaacttccaggcagtcgatcaagtttcatttgaggttcagcgtggagaagttttaggttttctaggtccgaacggcgcaggnaaatctacaactatgaaaatgctgacctgttttatccctcccagttcaggcacagctgatatttgcggctttagtattctggacaatcctcttcaggttcgtgctcaaattggttatcttcctgaaagcgcgccttcttatgacgaaatgctggttggagagtttctcagttttgtcggcgagatccgcggttacagcggtaaggaacttcaaagaagagtcagtattgtgaccgagatgactgcgcttggngaggtcaaagatcaaatgatcgagactctttccaaaggttttcggcagcgtaccagtcttgctcaggcattgattcatgatccgcc

SEQ ID NO: 142 - DNA, 4000 bp, Escherichia coli
  misc_feature (1)..(9): n is a, c, g, or t
  misc_feature (11)..(46): n is a, c, g, or t
  misc_feature (48)..(116): n is a, c, g, or t
  misc_feature (118)..(122): n is a, c, g, or t
  misc_feature (124)..(241): n is a, c, g, or t
  misc_feature (243)..(243): n is a, c, g, or t
  misc_feature (245)..(554): n is a, c, g, or t
  misc_feature (556)..(562): n is a, c, g, or t
  misc_feature (564)..(567): n is a, c, g, or t
  misc_feature (569)..(595): n is a, c, g, or t
  misc_feature (597)..(597): n is a, c, g, or t
  misc_feature (599)..(695): n is a, c, g, or t
  misc_feature (697)..(801): n is a, c, g, or t
  misc_feature (803)..(920): n is a, c, g, or t
  misc_feature (922)..(1222): n is a, c, g, or t
  misc_feature (1224)..(1266): n is a, c, g, or t
  misc_feature (1268)..(1270): n is a, c, g, or t
  misc_feature (1273)..(1274): n is a, c, g, or t
  misc_feature (1277)..(1281): n is a, c, g, or t
  misc_feature (1283)..(1286): n is a, c, g, or t
  misc_feature (1289)..(1290): n is a, c, g, or t
  misc_feature (1293)..(1295): n is a, c, g, or t
  misc_feature (1298)..(1300): n is a, c, g, or t
  misc_feature (1303)..(1304): n is a, c, g, or t
  misc_feature (1306)..(1311): n is a, c, g, or t
  misc_feature (1313)..(1313): n is a, c, g, or t
  misc_feature (1316)..(1316): n is a, c, g, or t
  misc_feature (1320)..(1320): n is a, c, g, or t
  misc_feature (1405)..(1405): n is a, c, g, or t
  misc_feature (1579)..(1580): n is a, c, g, or t
  misc_feature (1993)..(1994): n is a, c, g, or t
  misc_feature (2053)..(2053): n is a, c, g, or t
  misc_feature (2452)..(2454): n is a, c, g, or t
  misc_feature (2457)..(2462): n is a, c, g, or t
  misc_feature (2465)..(2465): n is a, c, g, or t
  misc_feature (2467)..(2468): n is a, c, g, or t
  misc_feature (2470)..(2471): n is a, c, g, or t
  misc_feature (2478)..(2479): n is a, c, g, or t
  misc_feature (2481)..(2482): n is a, c, g, or t
  misc_feature (2485)..(2486): n is a, c, g, or t
  misc_feature (2490)..(2490): n is a, c, g, or t
  misc_feature (2492)..(2492): n is a, c, g, or t
  misc_feature (2497)..(2498): n is a, c, g, or t
  misc_feature (2500)..(2501): n is a, c, g, or t
  misc_feature (2503)..(2503): n is a, c, g, or t
  misc_feature (2505)..(2505): n is a, c, g, or t
  misc_feature (2507)..(2507): n is a, c, g, or t
  misc_feature (2509)..(2511): n is a, c, g, or t
  misc_feature (2513)..(2516): n is a, c, g, or t
  misc_feature (2525)..(2525): n is a, c, g, or t
  misc_feature (2528)..(2528): n is a, c, g, or t
  misc_feature (2531)..(2531): n is a, c, g, or t
  misc_feature (2533)..(2534): n is a, c, g, or t
  misc_feature (2536)..(2537): n is a, c, g, or t
  misc_feature (2545)..(2545): n is a, c, g, or t
  misc_feature (2547)..(2552): n is a, c, g, or t
  misc_feature (2559)..(2560): n is a, c, g, or t
  misc_feature (2565)..(2566): n is a, c, g, or t
  misc_feature (2569)..(2572): n is a, c, g, or t
  misc_feature (2575)..(2584): n is a, c, g, or t
  misc_feature (2586)..(2588): n is a, c, g, or t
  misc_feature (2590)..(2590): n is a, c, g, or t
  misc_feature (2604)..(2604): n is a, c, g, or t
  misc_feature (2607)..(2607): n is a, c, g, or t
  misc_feature (2609)..(2609): n is a, c, g, or t
  misc_feature (2611)..(2611): n is a, c, g, or t
  misc_feature (2615)..(2615): n is a, c, g, or t
  misc_feature (2617)..(2618): n is a, c, g, or t
  misc_feature (2623)..(2623): n is a, c, g, or t
  misc_feature (2626)..(2626): n is a, c, g, or t
  misc_feature (2634)..(2636): n is a, c, g, or t
  misc_feature (2638)..(2639): n is a, c, g, or t
  misc_feature (2641)..(2642): n is a, c, g, or t
  misc_feature (2644)..(2644): n is a, c, g, or t
  misc_feature (2648)..(2648): n is a, c, g, or t
  misc_feature (2650)..(2652): n is a, c, g, or t
  misc_feature (2654)..(2654): n is a, c, g, or t
  misc_feature (2656)..(2657): n is a, c, g, or t
  misc_feature (2659)..(2659): n is a, c, g, or t
  misc_feature (2667)..(2667): n is a, c, g, or t
  misc_feature (2669)..(2673): n is a, c, g, or t
  misc_feature (2675)..(2675): n is a, c, g, or t
  misc_feature (2677)..(2678): n is a, c, g, or t
  misc_feature (2682)..(2683): n is a, c, g, or t
  misc_feature (2685)..(2686): n is a, c, g, or t
  misc_feature (2688)..(2693): n is a, c, g, or t
  misc_feature (2698)..(2707): n is a, c, g, or t
  misc_feature (2709)..(2710): n is a, c, g, or t
  misc_feature (2712)..(2714): n is a, c, g, or t
  misc_feature (2716)..(2716): n is a, c, g, or t
  misc_feature (2718)..(2718): n is a, c, g, or t
  misc_feature (2721)..(2721): n is a, c, g, or t
  misc_feature (2723)..(2728): n is a, c, g, or t
  misc_feature (2741)..(2743): n is a, c, g, or t
  misc_feature (2745)..(2745): n is a, c, g, or t
  misc_feature (2747)..(2747): n is a, c, g, or t
  misc_feature (2750)..(2751): n is a, c, g, or t
  misc_feature (2753)..(2753): n is a, c, g, or t
  misc_feature (2758)..(2759): n is a, c, g, or t
  misc_feature (2764)..(2766): n is a, c, g, or t
  misc_feature (2768)..(2769): n is a, c, g, or t
  misc_feature (2771)..(2777): n is a, c, g, or t
  misc_feature (2781)..(2781): n is a, c, g, or t
  misc_feature (2787)..(2787): n is a, c, g, or t
  misc_feature (2792)..(2793): n is a, c, g, or t
  misc_feature (2795)..(2797): n is a, c, g, or t
  misc_feature (2799)..(2804): n is a, c, g, or t
  misc_feature (2806)..(2806): n is a, c, g, or t
  misc_feature (2814)..(2814): n is a, c, g, or t
  misc_feature (2818)..(2818): n is a, c, g, or t
  misc_feature (2821)..(2821): n is a, c, g, or t
  misc_feature (2824)..(2824): n is a, c, g, or t
  misc_feature (2826)..(2827): n is a, c, g, or t
  misc_feature (2829)..(2829): n is a, c, g, or t
  misc_feature (2832)..(2837): n is a, c, g, or t
  misc_feature (2845)..(2850): n is a, c, g, or t
  misc_feature (2852)..(2854): n is a, c, g, or t
  misc_feature (2856)..(2856): n is a, c, g, or t
  misc_feature (2858)..(2859): n is a, c, g, or t
  misc_feature (2868)..(2868): n is a, c, g, or t
  misc_feature (2870)..(2870): n is a, c, g, or t
  misc_feature (2872)..(2873): n is a, c, g, or t
  misc_feature (2875)..(2875): n is a, c, g, or t
  misc_feature (2879)..(2880): n is a, c, g, or t
  misc_feature (2886)..(2886): n is a, c, g, or t
  misc_feature (2896)..(2896): n is a, c, g, or t
  misc_feature (2900)..(2900): n is a, c, g, or t
  misc_feature (2902)..(2903): n is a, c, g, or t
  misc_feature (2905)..(2905): n is a, c, g, or t
  misc_feature (2907)..(2909): n is a, c, g, or t
  misc_feature (2911)..(2913): n is a, c, g, or t
  misc_feature (2915)..(2915): n is a, c, g, or t
  misc_feature (2917)..(2918): n is a, c, g, or t
  misc_feature (2920)..(2920): n is a, c, g, or t
  misc_feature (2922)..(2922): n is a, c, g, or t
  misc_feature (2928)..(2928): n is a, c, g, or t
  misc_feature (2933)..(2933): n is a, c, g, or t
  misc_feature (2935)..(2937): n is a, c, g, or t
  misc_feature (2939)..(2942): n is a, c, g, or t
  misc_feature (2944)..(2946): n is a, c, g, or t
  misc_feature (2948)..(2952): n is a, c, g, or t
  misc_feature (2954)..(2956): n is a, c, g, or t
  misc_feature (2958)..(2958): n is a, c, g, or t
  misc_feature (2964)..(2964): n is a, c, g, or t
  misc_feature (2966)..(2968): n is a, c, g, or t
  misc_feature (2973)..(2973): n is a, c, g, or t
  misc_feature (2975)..(2975): n is a, c, g, or t
  misc_feature (2977)..(2977): n is a, c, g, or t
  misc_feature (2980)..(2981): n is a, c, g, or t
  misc_feature (2983)..(2983): n is a, c, g, or t
  misc_feature (2988)..(2990): n is a, c, g, or t
  misc_feature (2992)..(2992): n is a, c, g, or t
  misc_feature (2994)..(2994): n is a, c, g, or t
  misc_feature (2996)..(2997): n is a, c, g, or t
  misc_feature (2999)..(3000): n is a, c, g, or t
  misc_feature (3002)..(3009): n is a, c, g, or t
  misc_feature (3011)..(3023): n is a, c, g, or t
  misc_feature (3025)..(3027): n is a, c, g, or t
  misc_feature (3030)..(3031): n is a, c, g, or t
  misc_feature (3033)..(3034): n is a, c, g, or t
  misc_feature (3036)..(3038): n is a, c, g, or t
  misc_feature (3040)..(3042): n is a, c, g, or t
  misc_feature (3047)..(3047): n is a, c, g, or t
  misc_feature (3049)..(3051): n is a, c, g, or t
  misc_feature (3053)..(3054): n is a, c, g, or t
  misc_feature (3057)..(3058): n is a, c, g, or t
  misc_feature (3061)..(3061): n is a, c, g, or t
  misc_feature (3063)..(3063): n is a, c, g, or t
  misc_feature (3065)..(3071): n is a, c, g, or t
  misc_feature (3073)..(3073): n is a, c, g, or t
  misc_feature (3075)..(3075): n is a, c, g, or t
  misc_feature (3077)..(3077): n is a, c, g, or t
  misc_feature (3079)..(3082): n is a, c, g, or t
  misc_feature (3084)..(3084): n is a, c, g, or t
  misc_feature (3089)..(3089): n is a, c, g, or t
  misc_feature (3091)..(3092): n is a, c, g, or t
  misc_feature (3094)..(3099): n is a, c, g, or t
  misc_feature (3101)..(3101): n is a, c, g, or t
  misc_feature (3103)..(3103): n is a, c, g, or t
  misc_feature (3105)..(3112): n is a, c, g, or t
  misc_feature (3115)..(3115): n is a, c, g, or t
  misc_feature (3118)..(3126): n is a, c, g, or t
  misc_feature (3128)..(3128): n is a, c, g, or t
  misc_feature (3130)..(3131): n is a, c, g, or t
  misc_feature (3133)..(3135): n is a, c, g, or t
  misc_feature (3137)..(3137): n is a, c, g, or t
  misc_feature (3139)..(3139): n is a, c, g, or t
  misc_feature (3142)..(3143): n is a, c, g, or t
  misc_feature (3145)..(3145): n is a, c, g, or t
  misc_feature (3148)..(3148): n is a, c, g, or t
  misc_feature (3150)..(3150): n is a, c, g, or t
  misc_feature (3153)..(3156): n is a, c, g, or t
  misc_feature (3159)..(3162): n is a, c, g, or t
  misc_feature (3167)..(3167): n is a, c, g, or t
  misc_feature (3170)..(3170): n is a, c, g, or t
  misc_feature (3173)..(3180): n is a, c, g, or t
  misc_feature (3183)..(3183): n is a, c, g, or t
  misc_feature (3185)..(3191): n is a, c, g, or t
  misc_feature (3195)..(3195): n is a, c, g, or t
  misc_feature (3197)..(3197): n is a, c, g, or t
  misc_feature (3199)..(3199): n is a, c, g, or t
  misc_feature (3202)..(3202): n is a, c, g, or t
  misc_feature (3206)..(3220): n is a, c, g, or t
  misc_feature (3222)..(3222): n is a, c, g, or t
  misc_feature (3224)..(3224): n is a, c, g, or t
  misc_feature (3226)..(3229): n is a, c, g, or t
  misc_feature (3232)..(3232): n is a, c, g, or t
  misc_feature (3234)..(3234): n is a, c, g, or t
  misc_feature (3237)..(3238): n is a, c, g, or t
  misc_feature (3240)..(3243): n is a, c, g, or t
  misc_feature (3246)..(3246): n is a, c, g, or t
  misc_feature (3248)..(3250): n is a, c, g, or t
  misc_feature (3253)..(3253): n is a, c, g, or t
  misc_feature (3255)..(3263): n is a, c, g, or t
  misc_feature (3265)..(3265): n is a, c, g, or t
  misc_feature (3268)..(3268): n is a, c, g, or t
  misc_feature (3270)..(3276): n is a, c, g, or t
  misc_feature (3278)..(3278): n is a, c, g, or t
  misc_feature (3280)..(3281): n is a, c, g, or t
  misc_feature (3284)..(3284): n is a, c, g, or t
  misc_feature (3287)..(3287): n is a, c, g, or t
  misc_feature (3289)..(3291): n is a, c, g, or t
  misc_feature (3297)..(3297): n is a, c, g, or t
  misc_feature (3299)..(3303): n is a, c, g, or t
  misc_feature (3305)..(3306): n is a, c, g, or t
  misc_feature (3308)..(3313): n is a, c, g, or t
  misc_feature (3315)..(3316): n is a, c, g, or t
  misc_feature (3318)..(3319): n is a, c, g, or t
  misc_feature (3322)..(3322): n is a, c, g, or t
  misc_feature (3327)..(3330): n is a, c, g, or t
  misc_feature (3332)..(3351): n is a, c, g, or t
  misc_feature (3353)..(3361): n is a, c, g, or t
  misc_feature (3365)..(3365): n is a, c, g, or t
  misc_feature (3367)..(3373): n is a, c, g, or t
  misc_feature (3375)..(3375): n is a, c, g, or t
  misc_feature (3377)..(3377): n is a, c, g, or t
  misc_feature (3379)..(3382): n is a, c, g, or t
  misc_feature (3384)..(3384): n is a, c, g, or t
  misc_feature (3387)..(3397): n is a, c, g, or t
  misc_feature (3399)..(3399): n is a, c, g, or t
  misc_feature (3401)..(3401): n is a, c, g, or t
  misc_feature (3405)..(3405): n is a, c, g, or t
  misc_feature (3407)..(3407): n is a, c, g, or t
  misc_feature (3409)..(3427): n is a, c, g, or t
  misc_feature (3429)..(3448): n is a, c, g, or t
  misc_feature (3450)..(3451): n is a, c, g, or t
  misc_feature (3453)..(3457): n is a, c, g, or t
  misc_feature (3459)..(3459): n is a, c, g, or t
  misc_feature (3461)..(3461): n is a, c, g, or t
  misc_feature (3463)..(3477): n is a, c, g, or t
  misc_feature (3479)..(3487): n is a, c, g, or t
  misc_feature (3489)..(3520): n is a, c, g, or t
  misc_feature (3522)..(3527): n is a, c, g, or t
  misc_feature (3529)..(3531): n is a, c, g, or t
  misc_feature (3533)..(3540): n is a, c, g, or t
  misc_feature (3542)..(3544): n is a, c, g, or t
  misc_feature (3546)..(3547): n is a, c, g, or t
  misc_feature (3549)..(3576): n is a, c, g, or t
  misc_feature (3578)..(3582): n is a, c, g, or t
  misc_feature (3584)..(3616): n is a, c, g, or t
  misc_feature (3618)..(3621): n is a, c, g, or t
  misc_feature (3623)..(3623): n is a, c, g, or t
  misc_feature (3625)..(3627): n is a, c, g, or t
  misc_feature (3629)..(3629): n is a, c, g, or t
  misc_feature (3634)..(3634): n is a, c, g, or t
  misc_feature (3636)..(3644): n is a, c, g, or t
  misc_feature (3647)..(3660): n is a, c, g, or t
  misc_feature (3662)..(3663): n is a, c, g, or t
  misc_feature (3665)..(3676): n is a, c, g, or t
  misc_feature (3678)..(3678): n is a, c, g, or t
  misc_feature (3680)..(3680): n is a, c, g, or t
  misc_feature (3682)..(3683): n is a, c, g, or t
  misc_feature (3685)..(3685): n is a, c, g, or t
  misc_feature (3687)..(3688): n is a, c, g, or t
  misc_feature (3690)..(3699): n is a, c, g, or t
  misc_feature (3701)..(3701): n is a, c, g, or t
  misc_feature (3705)..(3711): n is a, c, g, or t
  misc_feature (3714)..(3714): n is a, c, g, or t
  misc_feature (3716)..(3716): n is a, c, g, or t
  misc_feature (3718)..(3728): n is a, c, g, or t
  misc_feature (3730)..(3731): n is a, c, g, or t
  misc_feature (3733)..(3734): n is a, c, g, or t
  misc_feature (3736)..(3738): n is a, c, g, or t
  misc_feature (3741)..(3749): n is a, c, g, or t
  misc_feature (3751)..(3751): n is a, c, g, or t
  misc_feature (3753)..(3753): n is a, c, g, or t
  misc_feature (3755)..(3763): n is a, c, g, or t
  misc_feature (3766)..(3771): n is a, c, g, or t
  misc_feature (3774)..(3774): n is a, c, g, or t
  misc_feature (3776)..(3778): n is a, c, g, or t
  misc_feature (3780)..(3782): n is a, c, g, or t
  misc_feature (3784)..(3795): n is a, c, g, or t
  misc_feature (3797)..(3800): n is a, c, g, or t
  misc_feature (3804)..(3804): n is a, c, g, or t
  misc_feature (3808)..(3821): n is a, c, g, or t
  misc_feature (3823)..(3824): n is a, c, g, or t
  misc_feature (3826)..(3833): n is a, c, g, or t
  misc_feature (3835)..(3838): n is a, c, g, or t
  misc_feature (3840)..(3855): n is a, c, g, or t
  misc_feature (3857)..(3857): n is a, c, g, or t
  misc_feature (3859)..(3859): n is a, c, g, or t
  misc_feature (3862)..(3864): n is a, c, g, or t
  misc_feature (3866)..(3890): n is a, c, g, or t
  misc_feature (3893)..(3893): n is a, c, g, or t
  misc_feature (3895)..(3900): n is a, c, g, or t
  misc_feature (3902)..(3902): n is a, c, g, or t
  misc_feature (3904)..(3904): n is a, c, g, or t
  misc_feature (3907)..(3919): n is a, c, g, or t
  misc_feature (3921)..(3924): n is a, c, g, or t
  misc_feature (3927)..(3937): n is a, c, g, or t
  misc_feature (3939)..(3940): n is a, c, g, or t
  misc_feature (3942)..(3945): n is a, c, g, or t
  misc_feature (3947)..(3962): n is a, c, g, or t
  misc_feature (3965)..(3966): n is a, c, g, or t
  misc_feature (3968)..(3968): n is a, c, g, or t
  misc_feature (3970)..(3970): n is a, c, g, or t
  misc_feature (3972)..(3972): n is a, c, g, or t
  misc_feature (3974)..(3985): n is a, c, g, or t
  misc_feature (3987)..(3992): n is a, c, g, or t
nnnnnnnnnannnnnnnnnnnnnnnnnnnnnnnnnnnnnnnnnnnnannnnnnnnnnnnnnnnnnnnnnnnnnnnnnnnnnnnnnnnnnnnnnnnnnnnnnnnnnnnnnnnnnnnnannnnnannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnanannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnannnnnnntnnnnannnnnnnnnnnnnnnnnnnnnnnnnnnanannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntnnnnnnnnnnnnnnnnnnnnnnnnnnnnnnnnnnnnnnnnnnnannnaannaannnnntnnnnaannttnnnccnnnccnntnnnnnngnggnaaangtgtacataagcttacgggttattagtactactcgactatgacattactgcctttacatctatagcctatcaacgtggtcatctnccacgacccttaaaagaaatctcatcttgtggtgggtttcgcgcttatatgctttcagcgcttatcccttccaaacgtagctactctgcggtgcccctggcgggacaacagatacactagaggtttgtccaattcggtcctctcgtactagaatcagatccactcaaatttctnncgcccacagtagatagagaccgaactgtctcacgacgttctgaacccagctcgcgtgccactttaatgggcgaacagcccaacccttgggaccttctccagccccaggatgtgacgagccgacatcgaggtgccaaacccccccgtcgatatgagctcttgggggagatcagcctgttatccccggcgtaccttttatcctttgagcgatggcccttccatgcggaaccaccggatcactatgctctactttcgtacctgatcgacctgtatgtctctcagtcaagctcccttatgccattgcactctacgcacggttaccaagcgtactgagggaacctttagaagcctccgttactcttttggaggcgaccaccccagtcaaactacccaccaagcaatgtcccccgcaanncggggttaggcctcagataaacaaagggttgtatttcaacaatgactccacaacgcctngcgacgccacttcacagtctccaacctatcctacacatcatttatccaaggtcaatactaagctatagtaaaggtgcacagggtcttttcgtcccactgcgggtaaacggcatcttcaccgttactacaatttcaccgagctcatggctgagacagtgtccagatcgttacaccattcgtgcaggtcggaacttacccgacaaggaatttcgctaccttaggaccgttatagttacggccgccgtttactggggcttcaattcaatgcttctccgaagataacatctcctcttaaccttccagcaccgggcaggtgtcaggccctatacttcatcttacgattttgcagagccctgtgtttttgataaacagtcgcctggacctcttcactgcggccannnttnnnnnnggngnncnntctcccnnanntannggtntnttttnncnnantncntnnncnnnnatctctcgngcnccntnngnntctctccncnnnnnnctgtgtnngtttnnggnnnnggnnnnnnnnnncnnnantttagaggtttttnttngnancccntnngcgcnctntctctttnnncnnanncnccgngnnntntnntntttccccnannnnngngnntttnncnncnnnnnntatannnnnnnnnntnnannnantnttncnnnnnntcgcggcgctttnnncncnccnncnccccnncacannnannannnnnnngggnatattnacccnntnnncnnnnnntntccctttngggntcnccntnngnccnnnnnnacccacannnnnntnnnananntgtggaaancntnntntttnngtgtgngggtttctcncccncnntntnnntnnntntnncnanattttnttttntnnncnnnncnnnannnnntnnnanacaccntnnnccctntnanaanncnccccnnncncntnnannannnnnnnnannnnnnnnnnnnntnnnatnntnntnnncnnntattntnnntnntcnnccncncnnnnnnngngntntnnnncnctctntnnannnnnngntncnnnnnnnncancannnnnnnnntntnngnnnananacnncnttntntcnnnntannnnatatntgnggnnnnnnnntgntnnnnnnngttntntnccnctcnnnnnnnnnnnnnnncncncnnnnccncnctnntnnnnaanannntanannnnnnnnngnttntnnnnnnntngnnggnggngnnncccccncnnnnnannannnnnncnncnnctntatannnntnnnnnnnnnnnnnnnnnnnnannnnnnnnngggngnnnnnnntntntnnnngnttnnnnnnnnnnncncncccncncnnnnnnnnnnnnnnnnnnntnnnnnnnnnnnnnnnnnnnncnncnnnnntntntnnnnnnnnnnnnnnncnnnnnnnnngnnnnnnnnnnnnnnnnnnnnnnnnnnnnnnnnannnnnncnnncnnnnnnnncnnncnntnnnnnnnnnnnnnnnnnnnnnnnnnnnntnnnnncnnnnnnnnnnnnnnnnnnnnnnnnnnnnnnnnnannnncncnnncnccccncnnnnnnnnnccnnnnnnnnnnnnnngnntnnnnnnnnnnnntntntnncncnntnnnnnnnnnntntttnnnnnnntcncncnnnnnnnnnnntnncnntnnntcnnnnnnnnntntntnnnnnnnnnggnnnnnnccncnnnannnannnnnnnnnnnncnnnncccncccnnnnnnnnnnnnnncnntnnnnnnnntnnnntnnnnnnnnnnnnnnnncncnctnnntnnnnnnnnnnnnnnnnnnnnnnnnnttntnnnnnnananaannnnnnnnnnnnncnnnnccnnnnnnnnnnnannannnntnnnnnnnnnnnnnnnncgnncncncncnnnnnnnnnnnnannnnnntttttttt

SEQ ID NO: 143 - DNA, 4000 bp, Escherichia coli
  misc_feature (40)..(40): n is a, c, g, or t
  misc_feature (70)..(70): n is a, c, g, or t
  misc_feature (1958)..(1959): n is a, c, g, or t
  misc_feature (1964)..(1964): n is a, c, g, or t
  misc_feature (1982)..(1983): n is a, c, g, or t
  misc_feature (1985)..(1986): n is a, c, g, or t
  misc_feature (1988)..(1989): n is a, c, g, or t
  misc_feature (1991)..(1992): n is a, c, g, or t
  misc_feature (2000)..(2000): n is a, c, g, or t
  misc_feature (2006)..(2006): n is a, c, g, or t
  misc_feature (2009)..(2010): n is a, c, g, or t
gaccatcaaggtcatcggaattatcacgacggcctacccnaacttcgacaagttccgggacgaaaagcanatccgctcgatggtagccatctgggccgatatgttttccgaggacgacgccgggctcgttgcccttgcggtcaaggagcatatcagcacgtcgaagtggccgccgtccatcgcggagatacgcgagattatgacacgcatcgcccacccggacatcataccgccggacgaagcgtgggaggtcgtctccaagtacctcgacaccgagggagagtacaaccacggggacatctaccgggccctcccgaggactattgccgaggcggtggacagcatcggatacgggcagctttacgccatgcacgtcgcatacgcacggggccacgccgcaaaggcgggcctcgacagagtggcgttcatgcaggcatacgaagacaaggtcgaacggcagcgccggaaggcgatgctacccggaagcctccgccagaaaatcgaggcggtcagcgccgggctcgacgacggaacccgcagcctcatcgagggagtgaaccggcggtacgaggagcggcaggctctttaccggcgacttgcggagcccagagacctcctcgccctggtcggcggagaggacgcggaagcgaagctcctcgaggagcgagaaagaagggctcttgaggcccgctacgaaagggatgattacgaatgagcaaggtgaaggacgcggtcacactggctatgctgctggtggcgattgtgttttcggcaggattgctcaccctgccagagtactcctctgcgggccttgacctccccgggctgtcctctgccgccccggagggggaaacataccgccccaacgtcacaagccctcctgtgtcctctgtggcgcctcctgcggtcacgccggagcccctctacaccgagagggacgtcgaaatgctggcgaagaccatctgggcggaggccagaggtgtccccagcgacgcagagaaagcagccgtcgcatggtgcgccctcaaccggctggacgctggtacatacggggagaccctcgcggaggtgctcactacgccgtggcagtttgcctactacgagagctcgccggtcacgccggagctcgaggcgctcgccagagacgtcctcgagaggtggcaggcagagcagcgcggcgcagaaggtgtcgggagaaccctcccggaggactacttcttcttcgagggggacggccttcggaaccatttccgcaagacctacgagaaaaccggggcgacgtgggattggagcctaccagacccctacggggaggcggctgtatgagcaagactaccccgagaatgtgcaaaatcttcaactgcgacaggcggcacgggaatttctgctgcgccgactgcggctacaagcggaacggtaactgcaagaacccctgcctcaacgggccagagcggtgcaactgcgtcgccgagccggaaaccaagaaaccaaaaacgggaggtaacacgaaatgaaagcgaagctcaaaaccctcaaacgcgggcagaccttctacggcgcgggcatccagtggctcgtgctgggtcacaccaacagcagccaagggctacccatcgtcacacacatcgtttccaccggcatcgtcgagcgccgggccttcgatgagaagaaccgcaacgacctaggcgtcagcaccctgctcgcctacctcaacggggaattcctcgagaggctcgaggacgccttcggagaaggggccgtcgcggaacagttcatcgacctcaccagcaacgacggcctcaaggactacgggaacgtcaaggcgaaggtgggcctgctcaccgaggaggaataccggcagcaccgcgacatcctcccgcccctcggcgacgaaggctggtggtggctggcgacgccgtactccaccgagcgggcaggctacccctccctcgtccgcnncgtgnactcggacgggacgctcnncnncnncnncgcgtacnacggcnacnncggcgtccgcccggctttgtatctgaaatccgacatctcggtatctctggacgggaacgacgaaagcaccattgaggtgagcgaggaggagctctataaggcggcggtgcagaagttcggcgagcgggcccaaatcctcgtcgccatcgaggagatgagcgagctcaccaaagccctcctcaagtacatccggcacgaagacttcaaccaaggggactacgacgacattgtcgagagcatcgcggaggagcgggccgacgtgtccatcatgctcaaccagctcgccgtcatcttcggcaaaaacgaagacgcggagacggagaagctcgaacaccttgcggacatcgtcaaggacgccttatgaacaggcggattttgaagaagcgggcaaagcggttcatggacagcttcacccgcgagaagatacccgcagcctttacctccaaggaggaacgccgccagtacgtcagcgcctttgcccggcagtacgtcgggcaggcggcgcacttcccggaaacagcgaaggaggcccagcatgaacatccacaagacgaaaattgagtggtgcagccacacatggaaccctgtcaccggctgccggcacgattgcccctactgctacgcccggcgcatcgcaacgcggttcggccccaagattgacgaattcccagatgagagcggcatcacggcgtttatcaacgaaggagtggactgctacgtcgtcgagaagcccacggagctcaaggactggcagggaaattaccggcgctcgacgccttaccccaagaacttcgcccctacgctccacaagtacacgctcacatacccggagaagcgcctcacccccgccgccatcttcgtcggcagcatggcagacctgttcgggcgctgggtgccggacgactggatagagcaggtctttgacgcttgccgccgggccccgaggcacacctacctgttcctcaccaagaacccgcagcggtattgcgacctcgccagcgccgggaagctccccacggagccgaacttctggtacggaaccaccatcaccggcccggatatgcctttcttcttttgggacaaggcaaacaccttcgtgagcgtcgagccccttttggagcccttcgacaccgaggccaccggcggcgaaaaccccttcgagcgcgtcggatgggtaatcatcggagccatgacgggccccggaagcaggaagcagcagccgaagcgggaatgggtggaggctatcgttaagaaggcccgcgaggcgggcacggcggtcttcatgaaggacagcctcaagcctatctggggcgacgacatcctccgggagcacccgcccggcatgataggaggcgacaacagtggatgagcgaaggaaaatcgactgtgtttcagccgcagaccgcgataccctcgtcacgatacttgcccggaacggttacgccgtccggcaggccaaggagaagcgcggaacctccaaaagctacacctacttcgtcgaatactggaaggaaggaggaaagccgctgtgaggaaaggaaccaagcgcatcaccgtcgtcgtgacggcccagagctactaccacctgcgccacctcgcggatatggccggctacaacagcatcgggcgcgtcatcgacaagctcgtgcgggagcaccagctcgccatgcggggcggatacacaacggagaagccaaacgaaggagagagaccatgcagagaacgcacagaccgacatcccacaagaaagacccgatgaagcagtaccaaggggccgtgagccgggcgcagggcaagcacttcgaggagtacatcgacctctccctccgctactacgagcagaggggcgaggccgtagtcgagaagacgccagagcccatgcggcccaccaaagacctcggcaacgggaaattcatcgcgtactacgagaaggccgcgcagccggattacaagggcaccctcaagggaggcagggccgtcgtcttcgagg

SEQ ID NO: 144 - DNA, 4000 bp, Escherichia coli
  misc_feature (342)..(342): n is a, c, g, or t
  misc_feature (549)..(549): n is a, c, g, or t
  misc_feature (621)..(621): n is a, c, g, or t
  misc_feature (870)..(870): n is a, c, g, or t
  misc_feature (954)..(954): n is a, c, g, or t
  misc_feature (957)..(957): n is a, c, g, or t
  misc_feature (1050)..(1050): n is a, c, g, or t
  misc_feature (1054)..(1054): n is a, c, g, or t
  misc_feature (1298)..(1298): n is a, c, g, or t
  misc_feature (1987)..(1988): n is a, c, g, or t
  misc_feature (1993)..(1994): n is a, c, g, or t
  misc_feature (1999)..(2000): n is a, c, g, or t
  misc_feature (2012)..(2012): n is a, c, g, or t
  misc_feature (2014)..(2015): n is a, c, g, or t
  misc_feature (2020)..(2021): n is a, c, g, or t
  misc_feature (2026)..(2026): n is a, c, g, or t
  misc_feature (2143)..(2143): n is a, c, g, or t
  misc_feature (2193)..(2193): n is a, c, g, or t
  misc_feature (2732)..(2732): n is a, c, g, or t
  misc_feature (2753)..(2753): n is a, c, g, or t
atttagaagatcctgagcaatccgtacctatgatacgggctatatcttctttcgtacaaggctgtccgtttggcataaccataacaccacgttctacactttcccacatatagcataacatatccatccacaagcccctaacgtctggtggaagtacccttaattcaggacacctcaaccaatcgccaacatagaaaggcataggagtttcttgttttcttgccatagagagaatttttaaggaagccgggataattcccagctttcctataatcatgtttgaacggttacacttccagaattgcaatatcgggggcaatatccttgatcttatccagcacntcatcaatacacttatctctgtaactttccatcacttcatttgctcctggcgaaacaagttgcaaaaacacttctccatttgtcagataatgatcgaactcaatttcgatgggctgttttgcagttcccttgaagatagccatgtttacggtaaagctcttcggtaaattactttctacctggcaacggtaaacatcagcaacgganccagaaggatctctttgtttctcaatctctgcctttgcttttgcattgaagtttttgagattggaaacaagnaccatgcacttttctttatcttcaaacaaaccacgattcagacgcaagaattgtcctaatttggcagggatccagcccttttcaccatcattaataccgaacttctcaaacgtttcagatacttcaaccgtaccagtgaatgtgtttttattgtaataatcatcttcgtttacagtgagctgaattgtcattttctcacgattcacaacgacatttgcacgtttctgatctacagtatctattcgcttngaaagccattcatacggagtggagatagtgccggaaacactgatcttttccggggctttggttgcaagcggttgttgtgcttgngcngcgtcaccaagtctataaactacttcaataggtttctctccagtgtaatgttcgatgttaatgttcaaacctttgtttttttcttccataatntttnaaaaattaagatgttaataaattaattatctgtgccagtcaagcgcactgccatttgaattgttttctgcctttcttccggcttcataggtctttcctccagcaaataaccgtctggcgtatagtaacctactcttccttcgtcttgatctatgaacttgtagcactcacctttaatgtactcaccgccttttctcaaatcatcaagcatttttccgatccgttcttgcagtggcttcattttncctttgaagtcagctttaactacatcaaaattttctgtcagttcttgcatctgtatctgaacttctacaaggttagcccgaagctcattagtttcttcctgagagaactttgagagataacttttctctacgacctcatcgcagctatcacgtaaaatttgcgctctttgctccactggagtatcagccaacattatatctttcattgcaaaataagtttgattattaatgaattgaagtctatttgaaagtggtacttattcaagagaacaaacagtaagattgcgattcctaatatgttatctataattctccatgtaaaccacttcttagggataaggcttaaaacaatcaatgcaagaaaacctatccattgagagcttattaaacctatgaagcacaatataaggtagatccagttgcacattctccaaacagcgaaaaccgggcttatctcagtgagatcgtttttgtccttatacttttccacagcagcgaaaacttttttgcaagctgccaaattcagcacttcaaagaaaaggcagaaggctatcagtatataaaatattgttgtcattcttgcaccttctttacattaaacatcaaataatcaaaccacaattcaatgaattgctgcccgaaatactttgctttctctcttgattcttgccaaagccgagagccgacanncgcanncgtanncgagggggcgtnanncgtanncgcanaaccgaagcccgcacgattgtttagagcgtcaataattggaatatacacaagcccttctgtttctttgatttctctctcagtccacaaagcaaaccaggggaaatagaaacggctgntaccgcttgcatccggtttaggctggtaattcttaccccacaaagcccgnctgattgtttcaagtttgattaaggcaataatcccttttcttactccagcagaacgcaaagccttctcatcaataggggaacactttaaagcagcacacgcatcctcataacttcggattgtcgtgtaatcatcaagggtaggggttggtttcttttcacctttgcagaacaaggctaccaacacgtttttcacttcttcacttttagcaacgtctaaagctgcctttacttcaatctcagtaatttcaattactttcatcttttaaagattttaatcgtttgacaattttgttagttaatcgtatcgcattatccactctggtacttctaccttcgtgtgggatattttctattagcactggaataagccggataagctcatttaccaagtgattgggtattttcttcatcggctttcctccagttaggatcgggatcaggtatttctatattcaagtattccaaagcatactctctgagcttctcgcaatatgttgagaatgttaacgtgtccattgttgcagttgatccgggaaantctataatctcacccgtatgnttgtttactactttgtctttagtcatttgagccttaaaaaactcgtgtacttgttccacgcttgtaaactcccatccggcattaagcaacccatctaacagcattggatagatacacccccatagccagccgttttgatcgttggaacgtggcttcctaacctttttcactattacctggtaaatcccatctaccgaatgagaaaacaagtcgtataacggtctaaggttgaatagcccacccttcttttctatcaaaactttatttgtcatatagctgtagctgtttttctaaactctttctaactgcgtgtatagctccttctctaccttcaaggcttctcaggtaatcttccagctccttacgtgtttctgcgatatagtagccttcacttgtggcgatcagcccaatcaccatacccgaaagtctaatatggttgataatctttcttattcgtggactatcaattttacacccataagactttaaagccgaacacatcgctttatttgtaatcgctttatatttacctaccttaccgtgaagcccttgtactatgagaggcagaataactttgtcctcataatcggttagaggttttgtttgctctgaaaatccttgtatcatacctaaaaattgtttaaggttatactcaaacctggtttagcagcataaaccgcctttccagtaattttttgcacctcagatacaaataaatgctcatcgctgttattagatgagaggtgtaaaagaactatgtttgcaacgttgctcaaatcgttttcttttagagcttgtttgcaactttccagctccatgtgagaaaccattaatctgtttctttgtgtaggaaggacacgcccggcattaatgctttctatcagttttgtatcagagtaattacattcaatcagtatatgattcaatccagaaaaagtatatccagactggcaactatccgttaaaaacataatactaccacaatccgggtgcttaatgaaatagccaacacaaggtacatcatggaaagcagggaaggggatcacccgaaaaccaccaagcagatagcccgatcctattttaatggcttttactctggaacctttcaattccttgctttctatcacttctggaagagccaatacatgaaagccacaatctaccattgccttagcatatttagcatgatcgttatgctgatgagttattaagcagcctacgactttgcgaatattgaaatccaaagc

SEQ ID NO: 145 - DNA, 4000 bp, Escherichia coli
  misc_feature (1075)..(1075): n is a, c, g, or t
  misc_feature (1084)..(1085): n is a, c, g, or t
  misc_feature (2005)..(2005): n is a, c, g, or t
  misc_feature (3239)..(3239): n is a, c, g, or t
  misc_feature (3675)..(3675): n is a, c, g, or t
  misc_feature (3683)..(3683): n is a, c, g, or t
  misc_feature (3782)..(3782): n is a, c, g, or t
aaatcgggtggaatgtgagagcctatgccaccaatattgcatcatgtcatcgaaaatcaaaagtagcgctatgtgcaagagaataggggaatctacaagtattccctgatattggggaaatgctagtgccatcattgttgcagaacaaaatagaaccagtggctgggttacaataaataagagtaacgtacctatcagctctacttttccatcatcgcttacttctgtcgcttttttaaatagcttaccattcttcgcttccagcaaagcaaacatgataaaaaccgctaaaattgcccattgataacccattgtaatgactcccaccaagagattgttgagagtgaatttacattgcgttaacatgcaagaatatatacttgtatagatttgaatgtcatgtcttacattcacggcaagcagcaaaccattatgcctgacgactacgtcgagctttgtttgccttttggaacgctaagaacctatgcggctacctcgacaattcacgataggggaagtaaaaacaaagggctgtctgttgtggtatcaggagaagtaaagattggtaattatggcctggacggcagttatcaaattactactgtattgcaacgaggagatacgtttggcgagttcacattgtatgcatcacttgcaagaacgcatcacgctgaagcgctaacggaatgtaaggtattacaaatacctgaacctgcttttcgttctctgacaagccaacatccagcgattgctgaattcatcacccggtcactggcaataaagcttcactcggcgctggaaaggttggatgatattcgacgcttacccactcacgtccagttagctaagctaatttatcaatcgtatcttacctctaagcacgtctttataccgttaaggcaaagcgattatgctgaaagattgggcgttaccgtacttaccgcacataaatcattaacgaagctgtatgatttaaagttgattgaaaagcgctacgggggcgtggcaattacccaggtcgagcgactggaaggttttttgaaagaaagttcgtcactattaccattgtaagagnggttaatgnnctccacatgcgagagcgccaaaagaccctccctcaaatttattccacgcccatggcaactcatgcatcaagtattacgctggctttagcccgcctaaaataatgtgctgaatgttgcttagcgtgctctcgaagaaagcgggatcgcttaaatctttaccggttacggctttgatctgcacgctgaaatcggcgtaatgctgagtaatggcccaaatgctgaatatcaagtgtatagggtcaacaggctttagcttacccgcttcaatccattcgataatgacggcgcttttcgcgtccagcagtgttttgagcggcgtttctaattcctttattaaaagaggggcaccttgtaccacttccatacaaaaaagcttagattcagctggattgtccctcgacatttcaagttttactttaatgtagtcgctcagggtttctatagggtcttgttctgctgaaaagctctgaaggggcgttaaccacacatctaaaaggtgggtaataaccgataagtacaaaccctctttacttttaaagtaatacagtaaattactttttgagacattcgctagttccgatacttgctctacagtggtgccactcacgccgttctttgagaacaaggaaagggcagcatccataatgcgagtacgcttttctaataacgctttttctcttcgcttttgcgtggtcgggctaaatgctctcgctgatttcgtaattgtttgaccttcagatttactcactacttgtctcttctttaccggaatttccgtgatcaggcgcttagtttacgtggagttctcgtcgctataaacccatttgcacaaatatgcaccaattaagttcaattgcactggacttggtgttccaaattgaaccaataagtccaatttgggttgttgaattttgtaagtnactgaaatttatagattaaataaattggcctgctttatgctgttcactaagtataccgccacttcaatgttttgaattcggcaaccttaaaaaaagcgggataaaccgcttaaaacgcatacaagcagaggtacaacatggatataggtgtatttattccgattgggaacaacggctggctaatttcgaaaaattcgcctcagttcaaaccttccttcgatctcaacaaagagattgtaatgaaggctgaaaagtacgatatggattttgcgctctctatgatcaaactgcgagggtttggcggtgaaaccgaattttgggactacaacttagagtcgtttacgttaatggcaggccttgctgctgttacctcaaaaattcaactatatgccacggctgccacactagtcttgccgcctgcaatcatggcgcgcatggccagtaccatcgactctatctccaacggacgttttggcgtaaacctagtcactggctggcaacgccctgaatactcgcaaatgggtatgtggccgggcgatgaatttttcggtaaccgctatgagtatttggatgaatacattcaggtagtcaaagaattatgggaaaccggaaaaagcgattttaaaggcgagcatttccaaatggatgattgccgaatgttgcccaagccacagcgaaaaattccacttatctgtgccggtcaaagcgcagcaggcatggatttctctgcccgtcatgccgactataatttctgctttggtaaaggcgtaaatacacctaccgcttttgcaccaaccgcagcgcgcttaactgaagcggctgaaaaacacggtcgcagcgtaggttcagcggtacttatcatggttattgccgatgagacggatgaagccgccatggcgaaatgggaaagctataaagacggcaaagatcagtcagcgttggactggatggcaacgcaaggagctgctgataagaaatcgggtaaagacacgaatatccgcgatatgaccaacccaacctcagcagtaaacctgaacatggggacgctggtgggttcctatgagtcggtggcctctatgcttgatgaaatagccacagtgccgggctgtgaaggtgtattgctgaccttcgatgacttccttaaaggcatggatgatttcggcactaaaattcagccgctaatgaaatcccgtcagcatttgcttagcacatcgggagccgcctaatgtcagcnggtgaaatatttgaggtctcagggtgctttcaagcgcgccagacggggcagcccgtactgccagctaagcctgaaccgttgacgttaaaccctgcggaaactgccgttattgtggtggatttgcaaaacgcttatgccagtaaaaacggctacttagacaaggcgggttttgatgtgtccactacggcgccagtcattgaaaacaccactaaagtgcttgaaacagcgcgggctgcaggcatgcctgtggtgttcttacaaaatggatgggatgccgactacaaagaggccggcggccctggttcgccgaactggtataagtctaatgcccttaaaaccatgcgcaaacaaccagagcttaagggaagtttgctggccaagggtacttgggattacgcgcttgtcgatgcgctaaagcctcaagatggcgacatcnttattccnaaaacccgttacagcggtttttacaatactaatttagacagcatgctgcgcgcacgcggtattcgcaacttagtgtttacaggcattgcaaccaatgtntgtgtggaatctacgctgcgcgatggcttccacctggaatattttggtgtggtgctggccgatgcggcatatcaagctggcccgccagacattcacgaggcctcacttttcaacattcagacgtttttcgggtgggtgtctaccaccgcgcagttctgtgaagtatttgaagggacgagttaggtgctttcttcttagcatctactagccacgcagac

SEQ ID NO: 146 - DNA, 4000 bp, Escherichia coli
  misc_feature (1981)..(1981): n is a, c, g, or t
  misc_feature (1985)..(1986): n is a, c, g, or t
  misc_feature (2025)..(2025): n is a, c, g, or t
catgcgatcattcgcaagcgtttgcagcaacgtgatgcgacgactgacttacaaagcgatgaagtttcgaagccgctctagaacccagccgatgcctggtaggtgttcataaaagtctctggcagcatcccaataatcaatatgcgctgacacgcggccatcatcggcaaaaattaattttgtcgtgccgtcaaaaatccagggcttatctctgagtatgccttcgaagcgccattccatgatacagacctgaccatcgatcgcggcgtggtaaacaaaaaatttcacatcgccaatggtttcaaacatatgcgcaaagatcgcacgcatattctctataccctgcacatcgttgaaggggtctttaaagcgcacatcttcagttacatatgtagatagatctgcgagagacgcaggcgtcaacgtttccatatatagctgatatgcgtcacataatgttgtcatggccgtgtcatcctccgtgtgatggcaaaatacagagcgtcaggtatcaatttgaacgctgtcaaaatccaggcaagtcgccttggaaatctgatctcgaaagtgttagatttgagtcctgctacaattcgctcgacagcgtcatcaagagacatcaggaaaggcattgaaaattcgttcttatcggtcagaggcgttttcacaaagcctggattaatcaattgtagtttgacgtcattggcatcgagttctggctttaaagactcacacatatttattagtgctgctttggatgcgccgtaagctgcagatgttggcaagccacgataccctgcaacagacgcgacgacagcaatgtgaccagcgcggcgttccataaatcttgggatgatttcgctcaggccattgactgtccccatcaagtttatatcgatgagtttttggaagggctcccgtgaaaaatgagaggcggtcacttcttgatgcgttccagcatttagaatagccaggttaatgttaccaagcttagcttcaatatctttgatcactttcgttgtcgcatcgacgtcggtcacgtctaggggaaatttatgtacggtgccatttgcacattcggcttcaagtgacgcgaggtcattttctgtgcgcgcgctgacagcaactgtccatccatccagtgttagacgcttggcaagcgcacgtccaattccctttccagctcctgtgatccaggcgacacgacgttctgtgagattggtcattgagccatctgtgaggtcatcccaccctgacattgacgacatacgtattcgatcacagacccgtctcttcctttgaaacgtaattttacccagcggcccatatcatcgtaccaaacttcattaatgagatcccctgtataggtataacgcattgctggaataataccggattcagtttttacgttttcatagccagcggcattgatcaggacattgttgatttcaccggtcagagtattcaggacctgatcctgttttagaacctcagcattccagtggttggttgggtaaatcggtagatttatatcgagactattcgttccacgtgtaagccgtaaacgcgacccttgttggtcggcaagcattgaaaatagcgtgccgtcgtcattaacactaatttctagtttgttgaggatgccgtcacgccaaatggcgcgtgagtcatatcgatactgaaaggcagtaaaaaaaaggatatctatctgcattcgcgatgcactgttgacgacaattttgtcatcgttggtgtcaaaccgtacaaggtggtcgccgattttcttgcccgatcgcataatatcgaactgcatttctgtcccatataacgcaattgggtctttagcattaaaggctgcgggtacagccttttgtgcaggcgcagtcccaacgaatgtgagagatagaaaaaatataccgcagagagatcgaaaatttgtcataaaattagctattaagatcctgaattaacttaatttgtncctnnattatttacgttgcattcgacctattggatcactgtgtnacgactctttagtattaggggcataagcgaccctatcatgtgtcgacgtcattaccttggcacgatagagttttctccttagtatgattatgtgccgtatctcgggggtgcgtaactgccctgcaacttgagagcggtgacgtattaagagaaggcgctgcgatcttgcaattcatcgcagaccagcatgcggatctaaaactggccccaccagctggctcgttggaacgcgcacatcttcaagagcacctgaattacacaagttcagaacttcacaaagctttttggccgttcttttcaagaacttctagcgaagcagagaaggatcaggcgaagtcgaacgttacaaagaaattcgattatctcgatgctatgctcagcgatagccggatgtacttgcttggtgatcagttcaccgtagctgacgcctatatgtttgttgtctgcaattggtcaaacttcgttggcattgatttgtcagagtggccagccctgtctgcaaatgtggaccgcgttgctatacgtcccgccactcaatccgtaatgaaggccgaaggattgctcaactaatggaaaaacaaaattttgcagccattgtccgcgcgatggaaatctactttgacggcctctatcaagctgatagcaagacattggccaatgtctttcatccggatgcttggtacgtcaacgccctcgaaggcgattatatgaacaggtccatgctcgagtactacactgttgtaggtggccgcgtgctacctgcacaaaccggtgatgaacgcgacgaccagatactctctattaaatttggcgttaatcgcatggtattcgttgaagctcaaatgacaatgtcaggtcgagtatatctcgattaattaacattgattttagatgatggcgaatggcgaatcattgcaaaaatattctcatcgacctccataatggagactacctagatgccttatgtgaacatcaaaataacccgcgaaggcggcccagatggcaacgaccttagtgatgccgagaaagccgagttgatacatggcacaacagagttgttggcacggattcttggcaaatccccagcatcgacgtttatcgttatcgatgaggtcggtctgaatgattggtgcattggcggtttacccgtccctgaataccgcaacaagctcgagcaaacccaaaaataaaactgaggggttttcgtttgcgatattttcaaacgggaccccttactcggctctgtgcttggcctgctgatcaaaaaaggacgccgtactcggcagctggggcaattcaagttgaaacgggactgagcgcaccctgtttgttttctctccacggacaaccatgccttcgtattttgttggcatcgcgcttgaagatacggggaccgcatcctcagctgtatagacgcaaataaataatgttcgtggattctcagacatattggccgttgagccatgcaaaaggcgggtatgcatcaggcaaacggaccccgcttggccaacgcatcgctttgcctttggcagactcgcttccgcaacttcatccgtgaccgcccccgtaaaaacaccatcatgccacaggccatgtaactcttctttgtgtgaacctggcacgacttccaaagggccattttccaaagtgacctcatcgatcatcaaaagtgccgtgacgatgtcatcatttgtatgaggtgtgaatgggaagtcctgatgccattttacggcggtttcaccacccggcaatttggagttaattttagagtgatggaattttacattcgggccgataagatctgcgatacagtctgtcatccggcttaaggccatcgcctggtagtaagcgcccgatacttcgacaggagcattcacccggcgcagcctcggcttatcagctcgatgccctggctcaaggtcaaactggggacgtccattgatcgtctcgccgtatgattctgagtgaccacagc

SEQ ID NO: 147 - DNA, 4000 bp, Escherichia coli
  misc_feature (1989)..(1989): n is a, c, g, or t
aaaagggccccgggtttccccggggccctcgagttccttgatcgatgtggagggtcgggccgcaggcagcccggggcctcgtcactcgtacttgaagacgaggttggcgccgctggtcgagatgctgatcttcgacgcaccgctcaggcggtagaaggccgagctcgacggcgccgggatggtgatggtcttggccgtgccgtcaacggtcgctccagcgacggcggtgaacgcgccgccaagggccgaggcgctctgcagcgtgaccgccgagggggcggacgggagcccgcggatgatcatgccgctgatgccgccggagttgtcctccatctcggcgaaccagaggaattcgcccgccttgatgtctacgacgatcgtccgcggttgccccaacggatagacggttccgtcggcgcccttgccggaataattccccgtgttctgggcggccggggctttcaaacccttgatgtcgtcgacccagatcttaccggttcggttggcgtcggaggtgcggccctcgaagaccgtcacgttgtacttgccgggattcaggccggcgaagcgcatgaggatctcgctgccgtcggtgtccgggttgcggtacaggtagtcgtccttgaccgcggcgggcacgaggacgccgtcatacatgaccgcgatgccttccttggtggggttgttggcggtctggcctgtggccggagggaacgacttttccgtgtcgagcgcgacgttgttgaagatcgacaccgtgacgttcttgttctggctcttggagaagtcggtgagcttccaggtgacttccgtggcgtcggcgttggccgtgcctttgatgctgcccgacccatccgtcacgttggcattcggttcggagaaggtccacgtggggatcacattccactcggccaacggcgctggggcggaaccctccgaaccggcatcggactggttggcggtcgtgattttagggatccgctcgttttcgagttggccgaaatcgattttgaacagtccgttcgatgcccccggatcaatcaccgagcggatgatcatgccgctgatgccgccggaattgtcctccatctcggcgaaccagaggtagtcgcctggattgatcttcacggtgacggtcctgggttgcccgtcgggcactgcctccccggcgtcgttcttgccggagtagttgccggtgttttgggtggcgggctccttgaggcccttgatgtcgtccacccaaatcttgccggcccggaacgcgtccgaagtgcggccttcaaagacggttacgttataggtcccaggggtgagatttgcaatgcgcatcaagctctcggtatctggggtatcgggattccgatagaggtagtcatccttgacgacgccaggtacccgcacgccgtcatacaccacgtcgcgtccttccttcgtgggattgttggcgcttccgcccagcatgtaaggcggggcgtcgggggagagcttctcggcgagcgtccggttgtccattatggtcagggtgaccttggtgtttggcttgtccgagctgtccctgagcttccaagtgacctcggtgccggcggcgttggcttcgcccttgatgctggccgaaccgtcggtgacgttcgagttgggttccgcgaaagtccaggtgggaatgacgtcccagtcgagcaggagcggttggggatccaagggagtgccctcggcatcggtcgggatccgttcgttttcgatgtggccgaagtcgatcttgaagagttcggcctgcgtggcgaggggcgcctggaggagcgccgcggcgatggccgcggtccagaggccggtgcggggatgggagggtttcatgggtggttggttctgatgcgttgcgaacgaccccgttggatcgtgccgggcggattcccgtgcgggcggtcgggcaacctctggagggggattgccgagcgcgcgctcgcggactgtcgcctgaaagaccgaccgggngtggatgttgttacacacccgacgcccgaaactgtcgaggaaaaaccggaatccataaaaagattatcaagaacaactttttagaccccatctctccatcccctcccacctcagtgccatccagccgagctcggccgatcctccaaggggtgtccccggagcttcaccggctcaggaagcccttgacccgcagctccggacggaaggcctcatggggcagacggtccggcgtgacggtgaccgaggtggtgaccttgagtggcgccgccgcaccgaggtcataggtcaactccaccatcgccgcggtccagccctcggagggcgcggtcgcctggccgaggtactcaccctgggcatcgggctgcaggtcggtggaagtccatgccgggccgagggtgtcgaggcggaagtcccgggccttggggttgtgggcctgccagagcttcacggccttcggagtgtcggcggtcctgacacgcaggcgtcctggggcctcctgggtccaggtgaaccggggcagggatgtccggttcaggatggcgtgctgccaggccaggagggtggcgtaggcgtcggagcctttcagggagtggtcggcgttggggatgtagcgcaggtacttcggccccttcagttcatcgaagtagaactgcgaggaatccggcaggaagaactggtcgccgcaggcgttcatcaggagcttgggctgggtgagccggtcgcggtactcgtagggttcctcgatcttcatgagggcccggtattccggggtgccctgccagttcatgatgccctgctccacgtagttgccgacggccggcgcgaaggccccgtaggcccggtagtggtgcgtgaacgaaggctcgatgttcagcaggtcgatcacgatgggacacacggccaccacgcgccggtcgaccgccgcggtggtccaggtggtccagccccgcttggagcctccggcgacgacataggtcgcgacggcccggccgccgcccgcctcggccgccgtgaaggcgctcactgcgtccatggcccggacgaccgacttggtcatcggcaaccgggccggccaccgggtgtcgcccgtgcgcaggaactggtcccaggtgtaggcgatgaggtcgtcctcgacgcgttccttgccgtcccggtggaagatgagcggctggttgggcaccatcttcaactccacgaccaccgagcgggtcgcctcggcgatgcgggtgagttcgacgctgggcttgggacggtcgccctcccggttggcgccgccggcgatcaccagcagggccgtgtcgtgggcgcggtccttgggtcgggccacggtcagccagtgcttccagagggtgcggttcacctcgttggtggtgagccaggtctgtgaggtcaggtcgatgagggccacctcgcaacggccgatgttcgtggtcccggcgaccgtccaggcgaaggacggatcgggctgggccacgtagcggtcgagggcggtctcggggctgtggaacggggcggtggcggcgagggctctggaacctccggcggcggtgttgatggcggccagcgccagcaggagggtcgccacggacgggcaatgcaaggtcaggggcatgattcctaagagtgccagccgtcgtgcgcaaggcaacgccggagagccggaaagcccggaggccccagatcccgccgtccggttcagagggcgtcgcggatggcccgggccaagcggtcgacctgaccggtggccaaggtcgcacgcagggcgatgcggaagaacccctcggcggggccgcctgggtagcggatccatggcggcacgaagccggccgcctgcagggccgagtcgatccgctgggcctgggccgcgtcaaccggatggatcgcggtgacgggtgtgcgcgggtcggtgagcacccccggccggtccggtagggcggcggaaaaccgcgcggccagcgcctgcaaccggcgcacgcggcccggcgtccgccgcagccggccgacggccgcg

SEQ ID NO: 148 - DNA, 4000 bp, Escherichia coli
  misc_feature (288)..(288): n is a, c, g, or t
  misc_feature (1983)..(1984): n is a, c, g, or t
  misc_feature (1986)..(1986): n is a, c, g, or t
  misc_feature (1989)..(1990): n is a, c, g, or t
  misc_feature (2001)..(2003): n is a, c, g, or t
  misc_feature (2017)..(2017): n is a, c, g, or t
  misc_feature (2019)..(2020): n is a, c, g, or t
  misc_feature (2049)..(2049): n is a, c, g, or t
  misc_feature (2052)..(2053): n is a, c, g, or t
  misc_feature (2055)..(2056): n is a, c, g, or t
  misc_feature (2061)..(2061): n is a, c, g, or t
  misc_feature (2074)..(2074): n is a, c, g, or t
  misc_feature (3771)..(3771): n is a, c, g, or t
  misc_feature (3807)..(3810): n is a, c, g, or t
  misc_feature (3819)..(3819): n is a, c, g, or t
  misc_feature (3821)..(3821): n is a, c, g, or t
  misc_feature (3862)..(3862): n is a, c, g, or t
cgcaccgctaaattgaacggttaaagtgctcatcgccactggcacgccacttagattaaaactctgcgcctcagctgaacttgctccccagcccaaaaacgcgctgtctccagtaagcacaaaccagccgtcgccgtcgccacctccgtagggcgcgtcatttgccaacgctttaagcggaaaaatgcccaaaagcgtaaccaaactaacaacaacgctaaattttgtaacaaaatttttcatagtgatattttcatatttctgcataacccaaacagttgcgcgganaggacgaaacccaatattgttgttgcgagtcgaatttgaccagctggcgttgttgcggtccgacaaacgcaagttagtggcgttattgttccaatcgcctccgcgaataccttattgacaaaataccatttttcaaaactgcgtttttgatttttttaaatctggtaaattaccttcccaactgttctttttattttctttgataaaaccataattttatcaaattcttaaaataaaatcatttttttatccaaccccctgcggtcaagccaattttttctatctggtctatcactgctccgtatcctttggcggagataaaacggaaataatatgccaaccgatacaaactccttaaaacatcaagcttgcaatttatatccttaaccaaagcgactctattgctgggaaacagaattgcttcctgcgatttttctaataaatccagttgcaaattttcaattctttgggcgagaagatatctttgatctttgggaaattttctaagtcgtggcaaagtgtctaaaagtaaattaaaaatcaaattataaagtgggtatttgtcatacactatccccataaaacatccctggccattttatttaaaccgctacttttggctaaaagggagaatccgtgccagcccgaccaatgttttttcttgtcgcagttgctaataccaattttattcaaaatatggaaattttttaaagtttttctaagttttactccgcgaatttttagcccccttcttctgattatatatcccaaaaatggtagcccagcacaaaacggaaacaattgctttttcttgttatgccaatttaaatgtaattgcttgcttaaataattctctatgtcgttctgcgctatccaaagttcttttttgctactcccaaatagtaaaaaatcatctaaatatctgatatagtcataatcagggtatttctttaacacatattgatctaactcatttaaatagatgttgccaaaaatttggctggttaaattcccaattggcaagccaacttgataattcggttttgtagaataagagcttattattttttttattaagtccagaactgcccgctctttaatttttctctcaatcagagaaaacaatattttgtgatcaattgacggaaaaaatttctcaatatcgccctttaaaacaaaggggtgtttttttaacattgtttggctggtaataatcgctctgtgaactcccctttctttccgacaagcaaaactattattaatcatctcttggtcaaacattggctcaataatattgcaaagggcgtgatggataatacggtcgtaaaaatttggagcatttatctcccgcctttttggctcaaagaccacaaaagagctgtatggacggggttcgtatctacccgaaagcaactctgctctaatttgtaataaaatcttttcctgtaaataaaaatatcgatacttatttttgtttttgcaagctcggtaagctttttcaaacgccaaaaataaattttcccaactaacgatttgttcaaataaatttttcatagtttttttatggattcccattaaaatttattccgtgcttgatacggggcgggaatgacaggaaaataaatttttcataattctaaaattctaaaaatccaaaattctaattagttgcgcggagaggacgaaacccaatanngntgnngcgagtcgaannngaccagctggcgtngnngcggtccgacaaacgcaagtaagtggcgncanngnnccaancgcctccgcgaanacctttggcagtcgttgcgcctggccaagaagctggaggggtggttgtgccgttgccactgccaagtgtctgcgtccacgaacagttaaccaaatgctcccaatcattacccgccaaatctgctatcccgtagaccgaggcgccggtctgctgattggtgcgagccacatcggctgataaataatgccccacatcagccggaccagtcgatgtgtttccgtagttagcataatattttctaaaagtattgccatcccagctgtaagtagtggcagacggagcatcatctccccacggataaaccgacttaaccgccgagccaatagaggttcctctgccagctttttcaaactccatctctgtcattggtctgagtcctgcccacgaagcgtatgctttggcatcgtcccaattcaaaaaattgcatcctcgattaggcgtagtggtgctgtagcgactgccgtaagggttagcagagttgtaagcaatggtgtagcggtaagtattatatagagagccatcatgccgactttgggattcgccagaagagatagtgttgagaaaatcgatgtattgaccttgggatacctcatattttgccatataaaaggcgctaaacccattttgccagccaaccgaggcgccactgggcacattgctggtggaggaaaccagtgcttcgcttcctcctccgtagttattgtaaccacttccgcctatcccaccaacattgtagtaaaactgcccctccggcacatagaccatctctatcgccattattttaatccgagcggtagcgccgtttgcaacactatcagcgccgtaattccagataactgtttgattattacccgggtcaacaaaagcgcccaaattatccgtaacaggggtaattgtccccccgctagagagcgtggcgtgattccatgttccgtccgcgcccccgccagttgaatatttgacaaaaatccacgccttgtcccaaaacgctttggaatcatagaccaacgagtagttattgctccatgtgatgttgagggtgatagtggctttgctgttcacagtgtcaactgacgagatggcaacattgctgacagagatatcatttgccttgactttgggcagggattggcgagaaaaataataaccgataaacgcgattgcaatgattgcaattagagaaatgattgtttttttcataatacctttcttttagttaataattaatagcgaataactaataaccacaacttaaaaccatttaacttcgtttgcctttcatggtcaacaaactggcggctatcattttagctaactctgttgcctcttggatatgtttgctgattttctctttatcaattaaatcactatctcttagcaggcatagccaatacattgtttcattggcgctctttaaagaaatctgataaaacttaataaaatcttttttactagacgaagcaatggcttctatgatgttagccccaattgaagtggcgctcctaagtagttggtcgccaataacccaataaattttttcttttggcagagaaattgtcaacctaattatatcaagggaaaatttataggaacgatatttgagattggttttggggtttaagttatggttattagttattagttttgacatattagtttacttgatacattagtttaacggtattttgaattagttngaagttttaagttgtggttattagttattagttttnnnntattagttnantttaattattcccaaatccaatttccaaccaatcagtgccntcgtaaaccagagttaaagtatcatttatgcccaaaacgcgtgtggctccgcccaatttcactcctaaattattggtgatagtgatggtgttagtgtcgctggtgccgataatagtaatttgctgaccaactaatccg

SEQ ID NO: 149 - DNA, 4000 bp, Escherichia coli
  misc_feature (1972)..(1973): n is a, c, g, or t
  misc_feature (1975)..(1976): n is a, c, g, or t
  misc_feature (1979)..(1979): n is a, c, g, or t
  misc_feature (1984)..(1985): n is a, c, g, or t
  misc_feature (1988)..(1988): n is a, c, g, or t
  misc_feature (1992)..(1992): n is a, c, g, or t
  misc_feature (1996)..(1997): n is a, c, g, or t
  misc_feature (1999)..(2000): n is a, c, g, or t
  misc_feature (2006)..(2006): n is a, c, g, or t
  misc_feature (2036)..(2036): n is a, c, g, or t
  misc_feature (2038)..(2038): n is a, c, g, or t
  misc_feature (2044)..(2045): n is a, c, g, or t
cccccgacccgatgccattcaagcgttttagtttctcactggttacttgggtggatagaagcgcctgatcttgggagagatgctacgggcaaggtctggattcacctcgcggatggtgcgccacatgaagcccagggagtgcgtgtgcttggcgtggccgagcagtgaggtcacgctgtccacctttcccttctttaccgcacgccggaacttgaacaggctgtatttgcggataaacttagctcgccgccatgtgcggtatccgacgaaattcaccccacgcttggtcttggccatcgtccacttcgacagctcgaggtgcagctcatcgcgcaggaacgtctcgatcctgaacttgtattctaggcactgctcccggtcgaggtcgaacaggatgaagtcatcgacgtagcgacagtagagcttgaccttcagctcgcgcttcacgaagtggtcgagcgcgttcaggtagatcagggcgtaggtctgcgacagcaggttaccgatagggatgccagttggctccggcatatcggcgaacagcatcatcatgtccactaggcgcttgtccttaattttgcgctcgatgaggttctgcaggactgttcggtctatccggtaaaagaacttccgcacatccagcttgattgcgtaactgtcggggtggctttttagtagtgcatctttcgcgtattccgaggcgcgatgggttcccttgccgatgcggcaggcaaaggactgatcgatgaatgcgcgctcgaagataggcctgatgacgtggtagatcgcatgctgcaccacgatgtcgccgaaccacggagcacagatttcacgctccttcggctcgtagaccttgaagcggtggtagccgcgcacggcatagctgccgtcatgaatgcgccggtatagccagtcgagcactgcgccggaacgcacgtcaaaccagaagcactggctgcgcaggcgctttccgcgcctggcttcgatgtaggcgttatagagggcttcacgcgtgaaggtctgctcgaacaaattgccgtgtcgcttcattcactactccgaaaaaaaagctccgcgctggtcttcgggcaagccctaccgaaaagcacggagctactacgagttcgccgtcctgcaacgcaggctggcaggacaacctatccctatggttccactattcccatttgagatttgagggggaaaccgcagtccgggcgcgcgccgacgttgttgttcacattcgtccgtggattattcagattgcgcgcgaacgcccccgccagggcaccattgttatagttgccaccggccagaggcaggcgtggtcgtaggttgccctcataacaccacaatggacgggtcacttcttctggccttcttctttcagctcggccagttcgtgccgtatccaaccgccgatcatgcgaccgaggtcatccaccagcttgctgatcgcctgccagcggtgcgcttcaacctccgccgcatcacttgcggtgcgcccatccgtgaacttgaaatagcccaactcataggccagaaacaactgcatccgcagttgctcgtgcgctatatcaagctgcgtcagggtcgtcttcttgtggtatcgcttttgcccctcgaccaccagatcatagacctcgtaggccgagttgcggattctgttcgagagggcgtagcgttcgtgacgtggaaagtggtttagatagacgttgaggagcttggatagctccacaaacttcctaaccaacgccgcctcccgatcaaccgccatcaccgccccctttacagaaccaagtgtgattctatcgcgttagcctgttcctgaaaatgaaaccgggcgcagaagcgcccggccaaaccatctactttcctgcttattccccttgcgagccgcgttactgcttcggctgctgggtgggtgctatcgcacccccctgtcaaagaacataggccgggcgcgcgccgacgnngnngcncacanncgnccgnggannanncagatngcgcgcgaacgcccccgccagggcaccatngntatagnngccaccggccagaggcaggcgctcatccgttacatcaacccagaatccgtcgccgccaaggccggtgctggcgaccggataaagccccagagattttgccagcgacaatgcggctgcacctactggcgtagtgccagggttggtcataccttccaggcttgcacccgatgcacgcaccagtgtgtagttggttgtaccggatgtcgcatacttgatcgcattggccgagccaggcgcaaccaatgcaccagtagagccgtcaatagccttccaaagtgacgaagtcgcgctctgatccttggtgttatccgccgcatcattgttctggatgatttggatttcgccagcttgcaggcgcataccggcgttccactcccacaaattgccgttcagatcggcgatgccgctaggctggccgttatgacgccaagaggccgggcctgcaccagtgtaggtcttgccattgccggtagcgctcccgatagcgccgccatcggcgcgcgctgccgtttcccacggcgagcctacatcccggccccagtcgttattgccgcgaggcatagtgccattcttccagctccacagagcaatggcagccatctcggcggtagtcatcatgtgccagcctgggccattggccgcagccaaaccacggaacgtatcgaagttcacgctggcggtcggtgaaacgcccggaatggacagcaggttgccatccttctggatgccgaggtgctggccgatgaagatttcactcttctcgacgccattgacaataaacgcctcatgcacgccggtgccgagaccggcatcgatgtcctgcttgttgaacttcgggatgacattcatatagcacgggtgtcctgccgccgtgtaaagcacggtgacatggccgccagttgcggcctcaaccgaggctcgaagatcgtctttgatgaagatggtagtcatggtgattggtctccttaattagtttgctggccacagcgtgaggacgatgcggtttgggtcgaatgccaccggagtggtaacggtagtcgggtgtccgtctgcatcgagcgggcctgcctcctcgatgtagcgcctggcgggaatttcgacctgcgccaggaaagcgccatcaccaccctcgtgagggatgccgtcaagttcgcggatttcaatgatctgtgcttcgtcagtctcacgcgcagcgcagtcgattactacgccagccacggtcactacatcactcgtaactgagaactcggaaacgacttggccaggctgtttcatgttgatttgcggcatttgtaactcctttcatggttaagcgttgaggcggctcacgcggtagcgagccaccacattgtcagcggctgcggcaagcatcaccgtgaagccgttattggcacgactggacaccaccaggcttttagcctcggctggcccgccctgggcggatagcacgtcaaaggtgatgtgataggcgctgtccggcaggccgttgatctgcggcgaagcctgcgccgggttgtccagcatgatcggaaagccagcctcgatgcgccgcacatccatgagcgtcacagaggacaggtttggatctgtcgcatccgtcgaattcgctggcacggtcaggttatagatcagaatgccatcgtccggcacagcctgaccgatggtggtcacggccaagcgccagaagccataggcatcctgataaaggtaggcatacaccgttacagcgccggtaccggtgttgctcggcaccgaggcagaattgttgccatcagccaccgcaaactgctggcctttcgcaaaacagattcccgccgcgatgctaaggttgcgcgccgccgtcgtagatttcgacaatatgcagcccgtgacaacgccacgattcttgatggtcacgatgccttcctgctgtgcgaattgatgcagtccgcgcacgcctttgttggccacgttcg

SEQ ID NO: 150 - DNA, 4000 bp, Escherichia coli
  misc_feature (789)..(789): n is a, c, g, or t
  misc_feature (2739)..(2739): n is a, c, g, or t
  misc_feature (2753)..(2753): n is a, c, g, or t
  misc_feature (2759)..(2760): n is a, c, g, or t
  misc_feature (2765)..(2765): n is a, c, g, or t
  misc_feature (2768)..(2768): n is a, c, g, or t
  misc_feature (2774)..(2774): n is a, c, g, or t
  misc_feature (2777)..(2779): n is a, c, g, or t
  misc_feature (2781)..(2781): n is a, c, g, or t
  misc_feature (2785)..(2785): n is a, c, g, or t
  misc_feature (2788)..(2788): n is a, c, g, or t
  misc_feature (2791)..(2791): n is a, c, g, or t
  misc_feature (2793)..(2795): n is a, c, g, or t
  misc_feature (2797)..(2797): n is a, c, g, or t
  misc_feature (2801)..(2801): n is a, c, g, or t
  misc_feature (2803)..(2804): n is a, c, g, or t
  misc_feature (2806)..(2807): n is a, c, g, or t
  misc_feature (2809)..(2809): n is a, c, g, or t
  misc_feature (2813)..(2813): n is a, c, g, or t
  misc_feature (2815)..(2815): n is a, c, g, or t
  misc_feature (2819)..(2823): n is a, c, g, or t
  misc_feature (2825)..(2825): n is a, c, g, or t
  misc_feature (2828)..(2831): n is a, c, g, or t
  misc_feature (2835)..(2835): n is a, c, g, or t
  misc_feature (2837)..(2837): n is a, c, g, or t
  misc_feature (2840)..(2842): n is a, c, g, or t
  misc_feature (2845)..(2845): n is a, c, g, or t
  misc_feature (2849)..(2851): n is a, c, g, or t
  misc_feature (2853)..(2853): n is a, c, g, or t
  misc_feature (2855)..(2855): n is a, c, g, or t
  misc_feature (2858)..(2858): n is a, c, g, or t
  misc_feature (2861)..(2861): n is a, c, g, or t
  misc_feature (2864)..(2864): n is a, c, g, or t
  misc_feature (2868)..(2870): n is a, c, g, or t
  misc_feature (2874)..(2874): n is a, c, g, or t
  misc_feature (2877)..(2879): n is a, c, g, or t
  misc_feature (2881)..(2885): n is a, c, g, or t
  misc_feature (2887)..(2887): n is a, c, g, or t
  misc_feature (2889)..(2891): n is a, c, g, or t
  misc_feature (2893)..(2894): n is a, c, g, or t
  misc_feature (2896)..(2896): n is a, c, g, or t
  misc_feature (2898)..(2899): n is a, c, g, or t
  misc_feature (2903)..(2904): n is a, c, g, or t
  misc_feature (2908)..(2909): n is a, c, g, or t
  misc_feature (2913)..(2913): n is a, c, g, or t
  misc_feature (2917)..(2917): n is a, c, g, or t
  misc_feature (2920)..(2922): n is a, c, g, or t
  misc_feature (2924)..(2925): n is a, c, g, or t
  misc_feature (2927)..(2930): n is a, c, g, or t
  misc_feature (2934)..(2934): n is a, c, g, or t
  misc_feature (2936)..(2937): n is a, c, g, or t
  misc_feature (2942)..(2943): n is a, c, g, or t
  misc_feature (2949)..(2949): n is a, c, g, or t
  misc_feature (2951)..(2951): n is a, c, g, or t
  misc_feature (2954)..(2954): n is a, c, g, or t
  misc_feature (2956)..(2956): n is a, c, g, or t
  misc_feature (2959)..(2959): n is a, c, g, or t
  misc_feature (2961)..(2961): n is a, c, g, or t
  misc_feature (2963)..(2965): n is a, c, g, or t
  misc_feature (2967)..(2968): n is a, c, g, or t
  misc_feature (2970)..(2970): n is a, c, g, or t
  misc_feature (2972)..(2972): n is a, c, g, or t
  misc_feature (2974)..(2975): n is a, c, g, or t
  misc_feature (2977)..(2979): n is a, c, g, or t
  misc_feature (2983)..(2983): n is a, c, g, or t
  misc_feature (2985)..(2985): n is a, c, g, or t
  misc_feature (2988)..(2989): n is a, c, g, or t
  misc_feature (2991)..(2991): n is a, c, g, or t
  misc_feature (2994)..(2995): n is a, c, g, or t
  misc_feature (2997)..(2997): n is a, c, g, or t
  misc_feature (2999)..(2999): n is a, c, g, or t
  misc_feature (3001)..(3002): n is a, c, g, or t
  misc_feature (3004)..(3004): n is a, c, g, or t
  misc_feature (3006)..(3007): n is a, c, g, or t
  misc_feature (3010)..(3014): n is a, c, g, or t
  misc_feature (3017)..(3022): n is a, c, g, or t
  misc_feature (3024)..(3024): n is a, c, g, or t
  misc_feature (3031)..(3031): n is a, c, g, or t
  misc_feature (3034)..(3034): n is a, c, g, or t
  misc_feature (3036)..(3038): n is a, c, g, or t
  misc_feature (3040)..(3042): n is a, c, g, or t
  misc_feature (3044)..(3044): n is a, c, g, or t
  misc_feature (3048)..(3049): n is a, c, g, or t
  misc_feature (3053)..(3058): n is a, c, g, or t
  misc_feature (3062)..(3063): n is a, c, g, or t
  misc_feature (3066)..(3069): n is a, c, g, or t
  misc_feature (3072)..(3073): n is a, c, g, or t
  misc_feature (3077)..(3077): n is a, c, g, or t
  misc_feature (3079)..(3080): n is a, c, g, or t
  misc_feature (3084)..(3088): n is a, c, g, or t
  misc_feature (3090)..(3091): n is a, c, g, or t
  misc_feature (3093)..(3101): n is a, c, g, or t
  misc_feature (3103)..(3105): n is a, c, g, or t
  misc_feature (3108)..(3109): n is a, c, g, or t
  misc_feature (3111)..(3118): n is a, c, g, or t
  misc_feature (3122)..(3123): n is a, c, g, or t
  misc_feature (3126)..(3126): n is a, c, g, or t
  misc_feature (3128)..(3128): n is a, c, g, or t
  misc_feature (3131)..(3131): n is a, c, g, or t
  misc_feature (3134)..(3134): n is a, c, g, or t
  misc_feature (3136)..(3136): n is a, c, g, or t
  misc_feature (3138)..(3138): n is a, c, g, or t
  misc_feature (3140)..(3142): n is a, c, g, or t
  misc_feature (3144)..(3144): n is a, c, g, or t
  misc_feature (3148)..(3148): n is a, c, g, or t
  misc_feature (3152)..(3152): n is a, c, g, or t
  misc_feature (3154)..(3156): n is a, c, g, or t
  misc_feature (3158)..(3158): n is a, c, g, or t
  misc_feature (3160)..(3164): n is a, c, g, or t
  misc_feature (3166)..(3168): n is a, c, g, or t
  misc_feature (3171)..(3171): n is a, c, g, or t
  misc_feature (3173)..(3173): n is a, c, g, or t
  misc_feature (3176)..(3179): n is a, c, g, or t
  misc_feature (3184)..(3184): n is a, c, g, or t
  misc_feature (3187)..(3187): n is a, c, g, or t
  misc_feature (3191)..(3191): n is a, c, g, or t
  misc_feature (3193)..(3194): n is a, c, g, or t
  misc_feature (3198)..(3199): n is a, c, g, or t
  misc_feature (3201)..(3201): n is a, c, g, or t
  misc_feature (3204)..(3204): n is a, c, g, or t
  misc_feature (3210)..(3211): n is a, c, g, or t
  misc_feature (3214)..(3214): n is a, c, g, or t
  misc_feature (3217)..(3217): n is a, c, g, or t
  misc_feature (3219)..(3219): n is a, c, g, or t
  misc_feature (3223)..(3225): n is a, c, g, or t
  misc_feature (3227)..(3227): n is a, c, g, or t
  misc_feature (3231)..(3235): n is a, c, g, or t
  misc_feature (3237)..(3241): n is a, c, g, or t
  misc_feature (3243)..(3248): n is a, c, g, or t
  misc_feature (3250)..(3252): n is a, c, g, or t
  misc_feature (3254)..(3254): n is a, c, g, or t
  misc_feature (3256)..(3263): n is a, c, g, or t
  misc_feature (3265)..(3265): n is a, c, g, or t
  misc_feature (3268)..(3270): n is a, c, g, or t
  misc_feature (3272)..(3278): n is a, c, g, or t
  misc_feature (3280)..(3282): n is a, c, g, or t
  misc_feature (3285)..(3297): n is a, c, g, or t
  misc_feature (3302)..(3302): n is a, c, g, or t
  misc_feature (3306)..(3312): n is a, c, g, or t
  misc_feature (3314)..(3316): n is a, c, g, or t
  misc_feature (3318)..(3318): n is a, c, g, or t
  misc_feature (3320)..(3320): n is a, c, g, or t
  misc_feature (3322)..(3323): n is a, c, g, or t
  misc_feature (3325)..(3325): n is a, c, g, or t
  misc_feature (3327)..(3327): n is a, c, g, or t
  misc_feature (3332)..(3332): n is a, c, g, or t
  misc_feature (3335)..(3335): n is a, c, g, or t
  misc_feature (3337)..(3338): n is a, c, g, or t
  misc_feature (3340)..(3342): n is a, c, g, or t
  misc_feature (3344)..(3344): n is a, c, g, or t
  misc_feature (3349)..(3349): n is a, c, g, or t
  misc_feature (3352)..(3353): n is a, c, g, or t
  misc_feature (3355)..(3358): n is a, c, g, or t
  misc_feature (3360)..(3367): n is a, c, g, or t
  misc_feature (3369)..(3369): n is a, c, g, or t
  misc_feature (3371)..(3371): n is a, c, g, or t
  misc_feature (3374)..(3375): n is a, c, g, or t
  misc_feature (3378)..(3378): n is a, c, g, or t
  misc_feature (3380)..(3380): n is a, c, g, or t
  misc_feature (3382)..(3385): n is a, c, g, or t
  misc_feature (3390)..(3394): n is a, c, g, or t
  misc_feature (3398)..(3400): n is a, c, g, or t
  misc_feature (3403)..(3403): n is a, c, g, or t
  misc_feature (3406)..(3407): n is a, c, g, or t
  misc_feature (3409)..(3409): n is a, c, g, or t
  misc_feature (3413)..(3413): n is a, c, g, or t
  misc_feature (3415)..(3415): n is a, c, g, or t
  misc_feature (3417)..(3421): n is a, c, g, or t
  misc_feature (3424)..(3426): n is a, c, g, or t
  misc_feature (3429)..(3433): n is a, c, g, or t
  misc_feature (3435)..(3435): n is a, c, g, or t
  misc_feature (3437)..(3440): n is a, c, g, or t
  misc_feature (3443)..(3443): n is a, c, g, or t
  misc_feature (3445)..(3445): n is a, c, g, or t
  misc_feature (3448)..(3454): n is a, c, g, or t
  misc_feature (3456)..(3461): n is a, c, g, or t
  misc_feature (3463)..(3463): n is a, c, g, or t
  misc_feature (3466)..(3467): n is a, c, g, or t
  misc_feature (3471)..(3471): n is a, c, g, or t
  misc_feature (3474)..(3474): n is a, c, g, or t
  misc_feature (3477)..(3480): n is a, c, g, or t
  misc_feature (3483)..(3483): n is a, c, g, or t
  misc_feature (3485)..(3485): n is a, c, g, or t
  misc_feature (3489)..(3491): n is a, c, g, or t
  misc_feature (3493)..(3493): n is a, c, g, or t
  misc_feature (3496)..(3497): n is a, c, g, or t
  misc_feature (3499)..(3499): n is a, c, g, or t
  misc_feature (3501)..(3502): n is a, c, g, or t
  misc_feature (3504)..(3510): n is a, c, g, or t
  misc_feature (3512)..(3512): n is a, c, g, or t
  misc_feature (3516)..(3516): n is a, c, g, or t
  misc_feature (3518)..(3518): n is a, c, g, or t
  misc_feature (3520)..(3525): n is a, c, g, or t
  misc_feature (3528)..(3528): n is a, c, g, or t
  misc_feature (3530)..(3531): n is a, c, g, or t
  misc_feature (3533)..(3534): n is a, c, g, or t
  misc_feature (3538)..(3538): n is a, c, g, or t
  misc_feature (3541)..(3542): n is a, c, g, or t
  misc_feature (3546)..(3546): n is a, c, g, or t
  misc_feature (3551)..(3551): n is a, c, g, or t
  misc_feature (3553)..(3557): n is a, c, g, or t
  misc_feature (3559)..(3559): n is a, c, g, or t
  misc_feature (3562)..(3564): n is a, c, g, or t
  misc_feature (3570)..(3571): n is a, c, g, or t
  misc_feature (3573)..(3573): n is a, c, g, or t
  misc_feature (3576)..(3579): n is a, c, g, or t
  misc_feature (3585)..(3586): n is a, c, g, or t
  misc_feature (3591)..(3597): n is a, c, g, or t
  misc_feature (3599)..(3601): n is a, c, g, or t
  misc_feature (3603)..(3604): n is a, c, g, or t
  misc_feature (3608)..(3609): n is a, c, g, or t
  misc_feature (3611)..(3611): n is a, c, g, or t
  misc_feature (3613)..(3613): n is a, c, g, or t
  misc_feature (3616)..(3617): n is a, c, g, or t
  misc_feature (3622)..(3629): n is a, c, g, or t
  misc_feature (3632)..(3632): n is a, c, g, or t
  misc_feature (3635)..(3636): n is a, c, g, or t
  misc_feature (3645)..(3645): n is a, c, g, or t
  misc_feature (3647)..(3648): n is a, c, g, or t
  misc_feature (3650)..(3650): n is a, c, g, or t
  misc_feature (3653)..(3653): n is a, c, g, or t
  misc_feature (3655)..(3655): n is a, c, g, or t
  misc_feature (3657)..(3657): n is a, c, g, or t
  misc_feature (3659)..(3659): n is a, c, g, or t
  misc_feature (3663)..(3665): n is a, c, g, or t
  misc_feature (3667)..(3667): n is a, c, g, or t
  misc_feature (3669)..(3669): n is a, c, g, or t
  misc_feature (3671)..(3671): n is a, c, g, or t
  misc_feature (3673)..(3674): n is a, c, g, or t
  misc_feature (3678)..(3679): n is a, c, g, or t
  misc_feature (3681)..(3682): n is a, c, g, or t
  misc_feature (3686)..(3687): n is a, c, g, or t
  misc_feature (3690)..(3692): n is a, c, g, or t
  misc_feature (3694)..(3700): n is a, c, g, or t
  misc_feature (3702)..(3702): n is a, c, g, or t
  misc_feature (3705)..(3706): n is a, c, g, or t
  misc_feature (3709)..(3712): n is a, c, g, or t
  misc_feature (3714)..(3716): n is a, c, g, or t
  misc_feature (3719)..(3720): n is a, c, g, or t
  misc_feature (3724)..(3724): n is a, c, g, or t
  misc_feature (3726)..(3727): n is a, c, g, or t
  misc_feature (3729)..(3730): n is a, c, g, or t
  misc_feature (3733)..(3733): n is a, c, g, or t
  misc_feature (3735)..(3735): n is a, c, g, or t
  misc_feature (3737)..(3738): n is a, c, g, or t
  misc_feature (3741)..(3741): n is a, c, g, or t
  misc_feature (3743)..(3743): n is a, c, g, or t
  misc_feature (3745)..(3745): n is a, c, g, or t
  misc_feature (3748)..(3748): n is a, c, g, or t
  misc_feature (3751)..(3751): n is a, c, g, or t
  misc_feature (3753)..(3754): n is a, c, g, or t
  misc_feature (3756)..(3756): n is a, c, g, or t
  misc_feature (3759)..(3759): n is a, c, g, or t
  misc_feature (3761)..(3761): n is a, c, g, or t
  misc_feature (3764)..(3764): n is a, c, g, or t
  misc_feature (3768)..(3768): n is a, c, g, or t
  misc_feature (3771)..(3771): n is a, c, g, or t
  misc_feature (3773)..(3773): n is a, c, g, or t
  misc_feature (3775)..(3775): n is a, c, g, or t
  misc_feature (3779)..(3779): n is a, c, g, or t
  misc_feature (3781)..(3782): n is a, c, g, or t
  misc_feature (3784)..(3793): n is a, c, g, or t
  misc_feature (3796)..(3801): n is a, c, g, or t
  misc_feature (3803)..(3804): n is a, c, g, or t
  misc_feature (3807)..(3808): n is a, c, g, or t
  misc_feature (3811)..(3812): n is a, c, g, or t
  misc_feature (3814)..(3816): n is a, c, g, or t
  misc_feature (3820)..(3823): n is a, c, g, or t
  misc_feature (3834)..(3837): n is a, c, g, or t
  misc_feature (3839)..(3839): n is a, c, g, or t
  misc_feature (3843)..(3843): n is a, c, g, or t
  misc_feature (3845)..(3850): n is a, c, g, or t
  misc_feature (3852)..(3858): n is a, c, g, or t
  misc_feature (3864)..(3865): n is a, c, g, or t
  misc_feature (3873)..(3873): n is a, c, g, or t
  misc_feature (3877)..(3877): n is a, c, g, or t
  misc_feature (3880)..(3880): n is a, c, g, or t
  misc_feature (3883)..(3883): n is a, c, g, or t
  misc_feature (3886)..(3887): n is a, c, g, or t
  misc_feature (3890)..(3891): n is a, c, g, or t
  misc_feature (3894)..(3894): n is a, c, g, or t
  misc_feature (3896)..(3896): n is a, c, g, or t
  misc_feature (3898)..(3899): n is a, c, g, or t
  misc_feature (3905)..(3906): n is a, c, g, or t
  misc_feature (3911)..(3911): n is a, c, g, or t
  misc_feature (3913)..(3913): n is a, c, g, or t
  misc_feature (3916)..(3916): n is a, c, g, or t
  misc_feature (3920)..(3921): n is a, c, g, or t
  misc_feature (3929)..(3930): n is a, c, g, or t
  misc_feature (3944)..(3944): n is a, c, g, or t
  misc_feature (3952)..(3952): n is a, c, g, or t
  misc_feature (3954)..(3954): n is a, c, g, or t
  misc_feature (3956)..(3956): n is a, c, g, or t
  misc_feature (3960)..(3961): n is a, c, g, or t
  misc_feature (3963)..(3963): n is a, c, g, or t
  misc_feature (3965)..(3966): n is a, c, g, or t
  misc_feature (3968)..(3968): n is a, c, g, or t
  misc_feature (3970)..(3970): n is a, c, g, or t
  misc_feature (3972)..(3973): n is a, c, g, or t
  misc_feature (3975)..(3977): n is a, c, g, or t
  misc_feature (3979)..(3979): n is a, c, g, or t
  misc_feature (3986)..(3987): n is a, c, g, or t
  misc_feature (3991)..(3991): n is a, c, g, or t
  misc_feature (3994)..(3996): n is a, c, g, or t
  misc_feature (3998)..(3998): n is a, c, g, or t
acacagaagtgtggataaatttatgatctgataagtggatatatgttgagatactctatgaagttgatttactcctctcaaacgcatgtcttgaagggatttctccatatttttccatatccgtatttcgatagtgttgtttgccgtttgtgaaatcctgcggggagttaagcagttactgcttttcagctcgttacttaatacttcgaaacgacgttgggcatctgccgtgtttttttctttcataacggcctctttagtcgcagacataacctcatccatactctttgttccttcttcgggagcaaacagcatgaagctaatcaacagacctaatatgaatagaaaattcttcatggcgcaaatatacaagtatttctttagataataacaacagtatatgttatttgttttttatttttgtagttattttaagaataaaacaatagaatggagaataacagatcgagaattcaagcttggttagaggcggcacgtccgaaaacgttgccggcatcatttagtccggtattagttgggtgtgcgctggcttacagggatggagtatttaaattggctccggcgatcctttgtgttttggtggctttacttgcccagatagccagtaattttgccaatgattattttgattttaagaagggggcggataaggaggaccggttaggcccggagcgagcggtggcttccggttggataactcctaaggcaatgctatgggggacttttatcacgttggggctttcttgtctatgtggctgtttcttgttnttctttgccggctgggagctcatcggtgtaggaattgctattgcgatttgtgtcttggcttattcagcagggccatttcctttggcttataacgggctgggggatgtgtgtgtcgtattgttttatgggattattccggtttgttttacgtattatgtacaagcattatcgttttccttattgtcattcttgctttcgttgtcattggggctgttgtccgctaatattttgatcgtgaataattaccgggattatgagcaagataaggcggctcgtaaacggactacgattgtgctattcgggcgtacgttcgggttggtaacttatttgctgaacggtatattggcttttttgatcacgctgcctttattgatggatgcctcaccttggcttgtttgtttattcgcggcttttagcgtgctgtttgccgccacatggctggagatgaaacagtatcaaggccgtgagcttaatagaactttagggcatacggcacggaatgtatttatctatgccgtgttgctttcagttgtattgttatttggttcttaagatgtgccgtgctttgaacaatcgcttggcctcatggagatttttctgtatgtatttggacaggataatcaatgtaaccgctacgataatcagtaagattcctaaagcgaggtgaggggtgaaaggctctccaaagactaaaacacctacgcagacggctgtcacgggttctgttgctcccagtacggaagttagggtggaaccgatatggtgtacggcttgtaccaatgtaatgttagatactacggttggcaagaaggctaataagacgaggttaataaaagagggcaggtctggaatgggttggattcctgttcctgcctgtgcttttatgaaaaataaagaggtactgacgataaatacatagaacgtaagttttcgtcccggcatatcatgtaccctcgatttattgacggtgacgatatagagggcataagcgacggcggaaagtaatacgatgattacgcctagcccgtttaatcgcatctctcctccatcaatggatagacgggctactccacaaatagcgagcccgatcgccaagagcgtaatccatgatgttttttctttgaatacaaacagcatgaatagggttacgaatatcggataggtgaaatgtagagtcgtggcgattcccgccgccataaaattatagccccaaaacaggaacattgccgagcctgtataaaaagcacccaataaaatcaatatcggtaggtttcgcatctctgttctgaaagattccttttttgctagaagcatacccgataaggcgatggccgcgaataagaaacgatagaacaatatcgaatcaaaccgcatacccttctccataagaggcaatgtaaacaaagggattaaaccgaatgtaacagaagtcgctattccataagcgaaaccttttagattattattcatattatactttttgataaaatgaccgcaaacatacaaaaaagtcttgaaataacatggggttaaaatgcccctgctacttttgtggcattatatgctaaatgtataaagagaaggaatcgctctcttactaataatgtaaataagaactttcatcaatgtgaaatatcctctatcgtcggattatggcaagtcatacctccatcagagatgatagtctgtccggaaatgtaacgggttaaattgatgacgccagctttgctcataccataaagagttccccggaaatctcctgtcaatcctccaatggaggctacgtttacgatgcttccttttccttttacggtcattgaaggggtcgctagcatgtccaatgccgcttgctccgccggtaataagtgctgtttgtctatctaaaatttcttttcttgaaaacatccttttcctgtcgcttgtttttatcaaaaatgatacttatgaganatttctttattttntttgcnnttgcnggnttgctnatnnntncttncgntgnannngnttgnanngnnantacntnaaannnnnangannnnacgncnatnnnagnacgnnngntngantgnggnggannnaatntgnnnannnnntntnnngnngntnnaagnngatnnaccnaacnatnnnanncnnnnaatngnnttganngaatgncnttnanggnangnnntnnanangnngnnntggnantgnngnaanngnantnnancnncgnnnnnctnnnnnngnttgggtnatngnnngnnntntttnntttnnnnnngtanngtnnnnatnngaantnnaatnnnnnanntnnnnnnnnnannntcnntnnnnnnnnattnntgncntgnttntngngnnnangttnaaangnnnangnnnnnannnagncngtnnnnaaagngcntgtnannaatnnanatncccgtnngtntancnttcnnngncggnnnnncnnnnngnnnnnncnnnancnnnnnnnngngannntnnnnnnngnnntannnnnnnnnnnnnatacnttannnnnnntnnntnantnncncngtttngantnncnnntnacganccnnannnntnnnnnnnntntnttnncgngnannnnccccnnnnnacannnagnaannancgantngnnnnnatnnngtnnnnnangnnnnttncntgnnnnnnngnnnnnngnaannccancgncannnntcntncgtnnngnttnntncnnannnnnnncnccanancnnnnnnccncnntnnaaanggnnttcnagtgntnnnnnanatnnnataatnntnatnnnnccgtanngatcnnnnnnncnnnanngcanntncnttnngatannnnnnnngcnacnnaatggactncnntnacngntntncgannncntntnanntatnncnntacnntgnnnannnnnnntnttnngannnnannnttnngttncnntnnttncncnncgntncnttntcntnngntancnatngatnggncnangcgncnngnnnnnnnnnngannnnnntnnaannggnnannnagcnnnntgggggatatnnnntnagtnannnnnntnnnnnnnaaaacnnaatggaanaggnaanatnacnnaanngantncnntccctnntctantnggnttcnnctgatganntaaatcttataatngtaatccngncncaanntncnncncnanngnnncnccttttnntacngannntnaa

SEQ ID NO: 151 - DNA, 4000 bp, Escherichia coli
  misc_feature (1984)..(2013): n is a, c, g, or t
  misc_feature (2050)..(2050): n is a, c, g, or t
  misc_feature (2052)..(2052): n is a, c, g, or t
  misc_feature (2054)..(2058): n is a, c, g, or t
  misc_feature (2060)..(2067): n is a, c, g, or t
  misc_feature (2069)..(2078): n is a, c, g, or t
  misc_feature (2116)..(2125): n is a, c, g, or t
  misc_feature (2127)..(2145): n is a, c, g, or t
  misc_feature (2182)..(2194): n is a, c, g, or t
  misc_feature (2196)..(2207): n is a, c, g, or t
  misc_feature (2209)..(2210): n is a, c, g, or t
  misc_feature (2248)..(2272): n is a, c, g, or t
  misc_feature (2274)..(2277): n is a, c, g, or t
  misc_feature (2314)..(2332): n is a, c, g, or t
  misc_feature (2334)..(2343): n is a, c, g, or t
  misc_feature (2380)..(2381): n is a, c, g, or t
  misc_feature (2383)..(2392): n is a, c, g, or t
  misc_feature (2394)..(2409): n is a, c, g, or t
  misc_feature (2446)..(2446): n is a, c, g, or t
  misc_feature (2448)..(2453): n is a, c, g, or t
  misc_feature (2455)..(2461): n is a, c, g, or t
  misc_feature (2464)..(2474): n is a, c, g, or t
  misc_feature (2512)..(2518): n is a, c, g, or t
  misc_feature (2520)..(2530): n is a, c, g, or t
  misc_feature (2532)..(2532): n is a, c, g, or t
  misc_feature (2534)..(2541): n is a, c, g, or t
  misc_feature (2579)..(2587): n is a, c, g, or t
  misc_feature (2589)..(2593): n is a, c, g, or t
  misc_feature (2595)..(2598): n is a, c, g, or t
  misc_feature (2600)..(2604): n is a, c, g, or t
  misc_feature (2606)..(2606): n is a, c, g, or t
  misc_feature (2645)..(2651): n is a, c, g, or t
  misc_feature (2653)..(2655): n is a, c, g, or t
  misc_feature (2657)..(2659): n is a, c, g, or t
  misc_feature (2661)..(2661): n is a, c, g, or t
  misc_feature (2663)..(2667): n is a, c, g, or t
  misc_feature (2669)..(2672): n is a, c, g, or t
  misc_feature (2710)..(2712): n is a, c, g, or t
  misc_feature (2714)..(2725): n is a, c, g, or t
  misc_feature (2728)..(2738): n is a, c, g, or t
  misc_feature (2776)..(2793): n is a, c, g, or t
  misc_feature (2795)..(2799): n is a, c, g, or t
  misc_feature (2801)..(2802): n is a, c, g, or t
  misc_feature (2804)..(2805): n is a, c, g, or t
  misc_feature (2842)..(2844): n is a, c, g, or t
  misc_feature (2846)..(2853): n is a, c, g, or t
  misc_feature (2855)..(2871): n is a, c, g, or t
  misc_feature (2908)..(2908): n is a, c, g, or t
  misc_feature (2910)..(2937): n is a, c, g, or t
  misc_feature (2974)..(2982): n is a, c, g, or t
  misc_feature (2984)..(2992): n is a, c, g, or t
  misc_feature (2994)..(3002): n is a, c, g, or t
  misc_feature (3040)..(3053): n is a, c, g, or t
  misc_feature (3055)..(3069): n is a, c, g, or t
  misc_feature (3106)..(3115): n is a, c, g, or t
  misc_feature (3117)..(3132): n is a, c, g, or t
  misc_feature (3134)..(3135): n is a, c, g, or t
  misc_feature (3172)..(3201): n is a, c, g, or t
  misc_feature (3238)..(3267): n is a, c, g, or t
  misc_feature (3304)..(3320): n is a, c, g, or t
  misc_feature (3322)..(3322): n is a, c, g, or t
  misc_feature (3324)..(3330): n is a, c, g, or t
  misc_feature (3332)..(3333): n is a, c, g, or t
  misc_feature (3370)..(3396): n is a, c, g, or t
  misc_feature (3398)..(3399): n is a, c, g, or t
  misc_feature (3436)..(3438): n is a, c, g, or t
  misc_feature (3440)..(3458): n is a, c, g, or t
  misc_feature (3460)..(3465): n is a, c, g, or t
  misc_feature (3502)..(3511): n is a, c, g, or t
  misc_feature (3513)..(3515): n is a, c, g, or t
  misc_feature (3517)..(3522): n is a, c, g, or t
  misc_feature (3524)..(3527): n is a, c, g, or t
  misc_feature (3529)..(3531): n is a, c, g, or t
  misc_feature (3568)..(3597): n is a, c, g, or t
  misc_feature (3634)..(3637): n is a, c, g, or t
  misc_feature (3639)..(3649): n is a, c, g, or t
  misc_feature (3651)..(3653): n is a, c, g, or t
  misc_feature (3655)..(3663): n is a, c, g, or t
  misc_feature (3700)..(3727): n is a, c, g, or t
  misc_feature (3729)..(3729): n is a, c, g, or t
  misc_feature (3766)..(3794): n is a, c, g, or t
  misc_feature (3825)..(3827): n is a, c, g, or t
  misc_feature (3832)..(3833): n is a, c, g, or t
  misc_feature (3835)..(3838): n is a, c, g, or t
  misc_feature (3840)..(3843): n is a, c, g, or t
  misc_feature (3845)..(3861): n is a, c, g, or t
  misc_feature (3863)..(3863): n is a, c, g, or t
  misc_feature (3867)..(3867): n is a, c, g, or t
  misc_feature (3871)..(3872): n is a, c, g, or t
  misc_feature (3874)..(3874): n is a, c, g, or t
  misc_feature (3878)..(3878): n is a, c, g, or t
  misc_feature (3883)..(3884): n is a, c, g, or t
  misc_feature (3886)..(3886): n is a, c, g, or t
  misc_feature (3889)..(3889): n is a, c, g, or t
  misc_feature (3892)..(3892): n is a, c, g, or t
  misc_feature (3898)..(3902): n is a, c, g, or t
  misc_feature (3904)..(3911): n is a, c, g, or t
  misc_feature (3913)..(3926): n is a, c, g, or t
  misc_feature (3928)..(3928): n is a, c, g, or t
  misc_feature (3934)..(3935): n is a, c, g, or t
  misc_feature (3937)..(3940): n is a, c, g, or t
  misc_feature (3946)..(3946): n is a, c, g, or t
  misc_feature (3949)..(3950): n is a, c, g, or t
  misc_feature (3952)..(3952): n is a, c, g, or t
  misc_feature (3957)..(3959): n is a, c, g, or t
  misc_feature (3963)..(3967): n is a, c, g, or t
  misc_feature (3969)..(3969): n is a, c, g, or t
  misc_feature (3971)..(3973): n is a, c, g, or t
  misc_feature (3975)..(3981): n is a, c, g, or t
  misc_feature (3983)..(3989): n is a, c, g, or t
  misc_feature (3991)..(3993): n is a, c, g, or t
aaatttggtgagtaataatgggatggcggacaattgttgtaaatcaacattcaaagctgacctataaaaataaccacttgatttataaagattcgtctcggacagaaatgatacatctgtccgagatagatattctattgttagagacaacagacattgttctttcgaccatgttggttaagagactttcagatgagaatatattagtgatattttgcgatgacaaaagattgcctgttgcacagttgattccatattatggtaaacatgattctagtttgcagttttctaagcaaattgagtggaatgaaacagtgaaaggtcttgtttggacggagattatcgctcagaaaattttcaaccaggcagtttttctttacgagtgcggctttgataagaagagtgaatccttaactcgattatatgacgaattacaagtgtttgatcccaccaatcgcgaagggcatgcagcacgaatctacttcaacactttgttcggcaatgattttaaccgcgaacaatcaaatgatattaatgcggggttggattatggttattcactactgctaagtatgtttgctagagaaatagtagcaactggttgtgtaacgcaactagggctgaaacatagtaatcagtttaatccatttaattttgcaagtgatattatggagccgttcagaccgattgtagatcgtatagtatatgagaatagagaaagtgactttaataaaattaaatcaaagctatttcagatttttatctacaattatggttattcagggaaagaaatgtttttaacaaatattgtgtcggactatacgaaaaaggtagtaagggcgttgaataataaaggagaagggattcctgtgtttcgggtatgagttatcgttttatgagaatgattattatgtttgatatgccaactgaaacgattgaagataagaaggtttatcgaaaatttagaaagttcttgttatcagaaggctttcttatgcaccagtactccgtttatagtcgattattattgaatgggaacgctaattcgttattggttgaccggttgaaggcgaataatcctaataaaggatttattactatattaacagtaacagaaaagcaatttgcaagaatggtctatttacatggagaaaaagatgaaagtgttgctaatacggataatcgattagtatttttgggagaggattatggggaagagtattagattgaatttaccaattctggacgaatctatttcgatagaaggttttactttatttatcatagagaatcgtgaaatattatcgaatctcgtgcaaatgatttactcgtacgatgaaggtagtcagttgaagttgtatgattcggaagtccgtacaatcaaaccttcggagctgatagtaatctcggatttgcttggtttttccattaatagtactgcagttgttaaagctgtgcagttggatgtattagaccagctgaatgagaatattgaacaaaaaaataagttggatttgttgcttactcagattacaagcattgttggttcgcaatgcatagagagcgaattgaatttaacgtataatgaacttaagattgaaaaaattatttctgcattagaggttcgtgtagacgcgttgtcgaatactttgttcgagcaactctttgaagtgcttcaaattttcaagtatcttgtaaagaagaaactacttatctttattaatgttgcatcttactttagtgaggaagaactaggtgctataaaagagtttattgagttgaatcaaataaatgtattatttattgagccaagaggtgtgtataactatccgcagtatattcttgatgaagattttataatgaccaaaaatttgtaaaaatagagaaaatcattcaaatcagtagtctggctgagacgagcagcgcgattacgaaaccttctacgaggttttagagctgtgttgatttgaatggttacaaaacnnnnnnnnnnnnnnnnnnnnnnnnnnnnnngttttagagctgtgttgatttgaatggttacaaaacncnannnnnannnnnnnngnnnnnnnnnnagttttagagctgtgttgatttgaatggttacaaaacnnnnnnnnnngnnnnnnnnnnnnnnnnnnngttttagagctgtgttgatttgaatggttacaaaacnnnnnnnnnnnnnannnnnnnnnnnncnnagttttagagctgtgttgatttgaatggttacaaaacnnnnnnnnnnnnnnnnnnnnnnnnntnnnngttttagagctgtgttgatttgaatggttacaaaacnnnnnnnnnnnnnnnnnnnannnnnnnnnngttttagagctgtgttgatttgaatggttacaaaacnntnnnnnnnnnnannnnnnnnnnnnnnnngttttagagctgtgttgatttgaatggttacaaaacnannnnnntnnnnnnntannnnnnnnnnnagttttagagctgtgttgatttgaatggttacaaaacnnnnnnntnnnnnnnnnnnantnnnnnnnngttttagagctgtgttgatttgaatggttacaaaacannnnnnnnntnnnnntnnnnannnnntnagttttagagctgtgttgatttgaatggttacaaaacannnnnnnannnannntntnnnnncnnnnagttttagagctgtgttgatttgaatggttacaaaacnnnannnnnnnnnnnnttnnnnnnnnnnnagttttagagctgtgttgatttgaatggttacaaaacnnnnnnnnnnnnnnnnnnannnnntnntnngttttagagctgtgttgatttgaatggttacaaaacnnnannnnnnnnannnnnnnnnnnnnnnnngttttagagctgtgttgatttgaatggttacaaaacnannnnnnnnnnnnnnnnnnnnnnnnnnnngttttagagctgtgttgatttgaatggttacaaaacnnnnnnnnnannnnnnnnntnnnnnnnnnagttttagagctgtgttgatttgaatggttacaaaacnnnnnnnnnnnnnntnnnnnnnnnnnnnnngttttagagctgtgttgatttgaatggttacaaaacnnnnnnnnnnannnnnnnnnnnnnnnntnngttttagagctgtgttgatttgaatggttacaaaacnnnnnnnnnnnnnnnnnnnnnnnnnnnnnngttttagagctgtgttgatttgaatggttacaaaacnnnnnnnnnnnnnnnnnnnnnnnnnnnnnngttttagagctgtgttgatttgaatggttacaaaacnnnnnnnnnnnnnnnnntntnnnnnnntnngttttagagctgtgttgatttgaatggttacaaaacnnnnnnnnnnnnnnnnnnnnnnnnnnnanngttttagagctgtgttgatttgaatggttacaaaacnnnannnnnnnnnnnnnnnnnnngnnnnnngttttagagctgtgttgatttgaatggttacaaaacnnnnnnnnnnannngnnnnnncnnnntnnngttttagagctgtgttgatttgaatggttacaaaacnnnnnnnnnnnnnnnnnnnnnnnnnnnnnngttttagagctgtgttgatttgaatggttacaaaacnnnnannnnnnnnnnnannntnnnnnnnnngttttagagctgtgttgatttgaatggttacaaaacnnnnnnnnnnnnnnnnnnnnnnnnnnnnangttttagagctgtgttgatttgaatggttacaaaacnnnnnnnnnnnnnnnnnnnnnnnnnnnnnagttttagagctgtgttgatttgaatggttnnnaaacnnannnntnnnnannnnnnnnnnnnnnnnngntttngagnngngttnatttnnanggntanaaaacnnnnncnnnnnnnntnnnnnnnnnnnnnnanttttanngnnnngttganttnnanggttnnnaaannnnnantnnnannnnnnnannnnnnntnnngttttag

SEQ ID NO: 152 - DNA, 4000 bp, Escherichia coli
  misc_feature (1966)..(1966): n is a, c, g, or t
  misc_feature (1968)..(1968): n is a, c, g, or t
  misc_feature (1971)..(1971): n is a, c, g, or t
  misc_feature (1975)..(1975): n is a, c, g, or t
  misc_feature (1990)..(1990): n is a, c, g, or t
atgatctccggctcgaagatattcagctacgccggccagcgcatcgccatcgcggccatctccgacaaactctacccgcggcactaccccgcgctcaaacagcgctacggcatggggcgcttgggcgacgcctatgtcctgacgttcctctatgccgcctcgtcgggcacgagccactcggcgcagcacgccctggcggcgatgttccgcgctgcggccgacgggcagctcgatttcgtgggcgaaacctcggaatacgcccggcgcgcccgcctcaccaaggagatcttccagcgccacggcttccgcatcgtctacgacaaagaccaggacgaaaccgtcagcgacggattcttctacaccgtcggctacggcggtctctccagcgcggagctgctgagcgaactgctcctctacggcatctgcgccatatcgctcacatcgaccggcagccgccagccgggcatccgggtctgcgtttcgcaactgaaccgccccgagcagttcgagctgctcgaaacacgcctaaccgccttcgggcaaaaccaccgataagcctatgcgattcacgacagccgccgaagccgtaaagctcatctgcccgcacagcagcgtctacattcagggcagcacctcgatccccgaagtactcgtccgtgccatgaccgaccgtgccgccgagctcaccgatgtcacgctctactccggattcgccgtcgggagggcagacgccccctattgcagccccgaatacaaggatacgttcctggtcaacagcctgttcgtggccaataacatccgccgctggctggcccagggctacggacagtcgaccccggccttcctgggcgaaatcccagggctgttccgcgacgggacgctgcccgtcgacgtggcaatcctcaacctctcgcgccccaacgaggagggctactgctcgttcggcgtctcggccgacctggccgtttcggccgtggaatgcgccaggacagtcatcgcgcaggtcaacacggccatgccgttctcctacggcgacgccgtgatccacctctcgcgcgtcgccgcggccgtcgaggtcgacgacccgctggtcgaagtgccctcggcgacccccaccgacatcgaacgcaggatcggcaaccacatcgccgaactgatccccgacggggcgacgttgcagatcggcgtgggcgggatccccaacgccgtgctggccgcgctcacgggccacaaacacctcgggctgcataccgaggcgatgaccgacggcgtgctgccgctgctcaaaagcggcgtgatcgacaactcgctcaaacgggtcatgccgggtgtaacggtcgcctcgctggcgctgggatcgcgccggctgtacgattacatggactaccgcaaagacctcgtgatgaaggatgtggcatggacgaacgacccgttccgcatccgcgagaacccgcgcgtgatggcgatcaactcggccgtcgaggtagacctcacggggcaggtttgcgccgactcggttggcgagcgcatcatttcgggcgtaggcgggcagcacgatttcatgtacggaggggccctgtcggagggcggcaaaaccttcatcgccatcccgtcgactacccccaagggcgaatcgaagatcaaggcgctgctgacgcccggcgcaggcgtcgtgacgacccgccacatggtgcagcacatcgtgaccgaatacggcgttgcgcatctgcgcggccgcaacctcgcccagcgggcgcgggcactgatcgccgtcgcccacccctcggtgcgcgaagaactggaaaaagccgcctgcgaacgcttcggctactccttcctgaggctcaaatagaagcgccccgatcaaacgggacgcttatcggaggcatctacccagcccctataccaggcattgctgccggacaacggggatctgagatcaaatccgtgtggccgggcacacacncnccncccnccgcaaacaagcagncctgccatatggcaggtctgcttgacacgtcgggatgccgcggttaccaccggcacaccggattattttgcgaacttcatttcgtcgagcaaccacccggcatcggcatacttgtcgatcacccacatcacatagcggatatccacgcacaccgtgcgcgccagttcgggatggaaccacacgtcgccggccatcgactcgcggttgccgtcgaacgcaagcccgataagatgccccttgccgtcgagcacggggctgcccgaattgcctcccgtaatgtcgttgtcggtcaggaaattgacatagagcgtatcgttctcgccccagcgtccccagtcccgtttggcgatcagccgccgcatacggtcgtcgacgcggtattcgtattcgtcggggttgtacttctccatatagcccgcgatcgtcgaacgcgaatcgtaatgcacgccgtccgaagggttcaggggttgcacgctaccgtaggtcaggcgcatggtcgagttagcgttgggatactgcgccagcccttccgaagcacggaaatcgtaaagcacgtcggcatagcggctctcgcttcgcccgacacgcgcacggccgcgcttctcggccttgtccacaccgcccgtaaaacgttgtactgtgaccgattcggtaagcgcaaccatggggtcgcggcgtatttcggcaaccgaccggttcttcgagaaataggcgtcgtaacgcgcaggatcgctgcaaaacgaggcatcgaacgccgcacgcgccatgcggtcggcattgcctcccgccttgtcgtacatcgcctgcaactgcgcaccccacatctcgcgcggcacgttggccgtgaagttcactaccatccgcgccaacaggtcgcggtcggtcgcggcatcgtagttacggctcaggcggccgctcccggccacgacgctccgggcatccttcgaatccacgatcagcgagtcctgcttcagccgttcgagcttgcccaggtacgacgacacgcggttggccacgagcagcgcctcgctggggccgagccatgcctcgcggaaataattgaggttgcgctcggcgccctgccgcgccttataaccgcgcgcgagctcttcgagcaacgtcccgtcctcggccttgcgggccgaatcggcctcgatccagcgctgcaggtgttcctcctcggcctcacggatcgccacgacatcgaagcggcgcaggcatttgttctcccacttggcgtagtcggcgtagttgctcaggccgaaataggcatccgaatactccatgcgcacccgcggatcgcgttccatatggcgtttgagaatatccatccggtcatggcggttggccacgacgatcgggttgcggacacactgtttctcagccaccgcgaacgacgacgcatagcggttcgtacgccccgggaatccgatcaccattgcgaagtcgccgtcatgcacgccgcccgtggcgacctgcaacacgcggcggggtttgagcggcacattgtcggcggaataggccgcagggcgcccctcccggtcggcataaacgcggtaaagcgcgaaatcgcccttgtgctggggccagccccagttgtcgtaatcgccgccgaaggcaccgatcgacgcaggcggcgtacccaccagccgcacatccttgtagatgtcgtagtagaacatcaggtacattttgccgccccacatcgagtagcacgacacctcgcactccgtttcccggccgtagcgcccttccagttcggcatagaggcggcgcggggccatcatgccccatttcccggcggctttcatctcctccttgagcgcattggcctcgtcggtcacgtcgaccaccttgcgcacgaaccacacggtcttgccggggacgggaatctcctcatcgcgcgtgcgtgcccagaatcccgtttcgagcaggttgcactcgggcgtcgacagggcgcagatgtcgctgtaagccacatggtggttggtaatcatcagcccctggtcg

SEQ ID NO: 153 - DNA, 4000 bp, Escherichia coli
  misc_feature (56)..(58): n is a, c, g, or t
  misc_feature (60)..(60): n is a, c, g, or t
  misc_feature (62)..(62): n is a, c, g, or t
  misc_feature (64)..(64): n is a, c, g, or t
  misc_feature (66)..(66): n is a, c, g, or t
  misc_feature (69)..(69): n is a, c, g, or t
  misc_feature (72)..(76): n is a, c, g, or t
  misc_feature (78)..(79): n is a, c, g, or t
  misc_feature (81)..(82): n is a, c, g, or t
  misc_feature (84)..(84): n is a, c, g, or t
  misc_feature (86)..(87): n is a, c, g, or t
  misc_feature (1019)..(1019): n is a, c, g, or t
  misc_feature (1225)..(1225): n is a, c, g, or t
  misc_feature (1236)..(1236): n is a, c, g, or t
  misc_feature (1243)..(1243): n is a, c, g, or t
  misc_feature (1254)..(1254): n is a, c, g, or t
  misc_feature (1560)..(1560): n is a, c, g, or t
  misc_feature (1741)..(1741): n is a, c, g, or t
  misc_feature (1992)..(1992): n is a, c, g, or t
  misc_feature (2006)..(2006): n is a, c, g, or t
tactaattatatgagtgatttatgatatgccaggaagcttagactataatatttannnananananttnatnnnnntnntnntnannaggtgtgtaaaggtcctcagcagcacgaggaagcatctcttgggctcctttacatcatattagtggaaccagctgctgcagcaaaggtttcaaatgagtctttattttttgtttagtactattattttgtcatgttgagtcattgctgactacactgtacatgtctttgagcaattttgcatggaatatatatacatctactttacaggccaaagggattgcagcattatacgcatattacacacattgaccatacattttacacacacgaaacacacacatgtacacgcaaatgcgtgtaacagaataactgataattacatgcagtagacttgatattatggctaaaattacacacagtcgttcaactggctgcatgtaatgaaaacaaacatttaacattgtgtgtaatgggttgttagtaaaacttgtaacggtgtaacaggtaacggcataacaataaacagtgtaacaggatttttttctgatgctgtggttaattttttagaagcgaaaattgttatttttatctttcgcaaaataataagaaagatctaaaagatacaaaaaagtgagtaaaaacatggcaggctggttcttgttacttgggcttctgtaggaaagcctgagtcaaaaaatgcaagccattggtcattgttgttgtgtttggtcgccaaattgggggtcatggtcccaggcgttcctagcatagtgcgaggaaactggggatgagacagctctcactcttcatgaacaaaaaattatgtaaatgctgtgttttgcgaagaaagtttgggaaagactcgaagaagatgttgattgtttttagaacgggttggcccatgaattatactgcttgaaagcctgccagataagcaaagttctcacaaataacaaaggagccatttatgagtccaactactaaaacaccnacaaaaaacaaatcatgatactgagacgaataactcagagttgttgtaagcagaacttggaagatcagacaaacaacatgcaattggataaagaggatactcaatgaagcaacttgaatagtaaatatctaagggtaactctttatgttaaaaagtatcctgattcttttatttgtttttacccagcagccgggaagtgttttcanaaggctggatncctggcngtctgaaattnttatagagtttccacagaataattcattcaattcttagaatacagtagatctgccgtcactcagtaggtcttggtatcaacaatgtcacgcaacctatagtggtctttcgtcaggttatggtctgtctgttattaattttgcttccatggtcttccatgccgaggcagtgtgaattcaatgcagtttggaaatccattggtatttctatgcagattaagcattctcagcgcgtttgaatggtcatttcggtggaaaaatggaaagaatttctgactgccgggtacatgtatatatagtttttttgnaaaactgtgcccgtgggtcacacaaagttcatcagacaacttgcaaactcaaatcattgaataaaatcgcttggtgtttatgaccaaagatcaaaatactcaaataatctcaggaggtttctaataataacaataattttgtggaaattgattacctatgaatttttgaccttaaacaatnctgcccgtgagtcaagatttttgtagttcgtccacttcaaaaccacagcgttattacagttgcttggcatttctgaacaaaatattattttcattgtggactaaatgtcaaaacatgaagattttatagtatgtccaagcttgaaaatttcctcaactacaaagccaaaataatacttgaaattgcttgacattctctgaacaaagatctactattctaagagtgagttgttttgtggaaattctataatnatttcagactgccnggtatctagttttctgaaaacaattcccggctgccgggtatctagacacaatgaaaagatttattgtgttcaatatgcttacttgcggtatgaagcccgagtcaacgctcttagagcatctagttttgagaggaaacaaacacaaaatagataaagatctagctagtattaatacagataaaattttctttaagcgcagggagtagaggagccaaatttgaccttaggaattattacttggaatgttcaattttatcttagggacagaccattattcttttggagggggttggggataccggtcggacaattttctgggttagggttagggtggaggaatacgctggaggaatttgaaaatggaggttttactctgaaaatgcatcaaacgttttcttccacactactctagagaatttaaaaacacaacaattactggtcattttggatttgtgtttgaggaaaactcagagaggaaaatcacatgattatcgtgcagctatcatttttgaaaagtcgaaattttcagcttttgaaagccgaaaattgtcagctttcaaaatgttttccgtccatgtgaaaatgaaaagctggcgttttcaaattccattatggattagtgtggatgaagtcctaaccgtagaaatgaagctgcaattccaaatttctccggtgtagtgcggacattacctatatgtgtcacacaatgttccccctaaaaacagttggaaaggagactaatcttatcttgatgcttttgtcatgttctccgatctttcgttatgggacgttttgttgatgcaacaggtgggcaacaaacggaaagaaacttttctgaacggtaggtcaggtgcgaagagccagaagtcatggcaccgtcaggtggtctgcggtcaaactcagagtattaacaaagtaaactcgctacccactgggtttaactgctatcagatctttttgtgtaggtaagcaaaaagatccaatgctagtagggtgaaaagatctgacatactgccaatgcaaggatggatttggctcctctttccaatactctgtgttttacccttaagtcttgaagtacatgattttagacaagggtcaaactttaaattacataataatattattagtgttgtacgttgaaatataaaggggggtataaacacttctcagcttttaaaagaatattgctttaaagcaaaaataaaagttaaaggagtcatgttgaccagtagctcctttgcagacattcttaggcctgtcacacagaggaacgattgtaaggcgggcttaagaatgtctgaaaggctaggagaccagtagatatatgtcagtttcgttacggcaacagaagttctaaattgtttgctcaggaaacgtaactttagccttatatgaacacattcttagggtcttcatgtgcagggattgagtgacaggccaaagaatgtctgtgtaggcgaataacataaccaagaattaaaaaataagggctgccctttttctgagaaaaaaaagacttgtggaattaacacttgttgagttttctattgctgatttttgatggaaattctcttttaactaaccagggcttgcatatccttaaaacacaccattcacaaaacaaagacaacaaaaccttctttagcgaactttttgaaatgaaggttcctttttaacttcttaacccactgactcctgtgccagccataaccggctgtgatgagtgttggcctttgttccacttctgacatcatcacctttgaccaaaattggcatcgtctatactcaacttctgcaggaggaaaagatctttccaataataccagatcagagtgattggctcaatggagcctgaaacttgcagcaaaatttcctgcgactacccttaacttctccatggtaaaaattgcctgttttgatgatgctttctcaggtatttttcaactggccagtagaactaagcccagtagaaggtcaatcactgcagcaaa

SEQ ID NO: 154 - DNA, 4000 bp, Escherichia coli
  misc_feature (173)..(173): n is a, c, g, or t
  misc_feature (218)..(218): n is a, c, g, or t
  misc_feature (246)..(246): n is a, c, g, or t
  misc_feature (251)..(251): n is a, c, g, or t
  misc_feature (256)..(256): n is a, c, g, or t
  misc_feature (261)..(261): n is a, c, g, or t
  misc_feature (288)..(288): n is a, c, g, or t
  misc_feature (432)..(432): n is a, c, g, or t
  misc_feature (470)..(470): n is a, c, g, or t
  misc_feature (1178)..(1178): n is a, c, g, or t
  misc_feature (1301)..(1301): n is a, c, g, or t
  misc_feature (1304)..(1304): n is a, c, g, or t
  misc_feature (1593)..(1593): n is a, c, g, or t
  misc_feature (1980)..(1980): n is a, c, g, or t
  misc_feature (2014)..(2014): n is a, c, g, or t
  misc_feature (3678)..(3678): n is a, c, g, or t
cgccaatcgtcacgctagttcccaccggtccgctctccggggtgaaggtcgtgatcgtcggggcgactcccgtcaaaaacgcgttcaagacgttcgcggtcgtttgctggatacgcgggtcagcaaaattgtatccgttgaagttgtctaacccccagctccaggcgatcgtnccggctgcgaatacccaggctccgctcggcgcttgataaacagangagttggagtaatccgatgggccgccantgccnagggntgagntcgacagcggcgtgtacgtgctgctcncggcgtttggcggggggtactggctgaacaggcgatcagcttcatatccgtcgatccccggcacggtgtcaccgtctttaaatcctgtcccggcatacacccagttcccgctgttcgtaacgacgtaggaggcccagcccccantttgagaattatacggcacctcggcagtgtactggacncccattagcgtctgctctggacggttcaggggcgggtcgcgccatagaacggttttcagtgttgggtcgctgacggggtcgagagtggcgtccctgtaacagacctcgactcggtttggcacgccactactcgaagactcgaaccgtgcctgccagtagatggcattggcactgaagaagccaaggctgaccccagcgtcgcgggcggccatgacggcgtcatacatgggtttcgaccagtattcgtcgtgcccgacagaaaggaaaccacggtagttcaacaacctgccaccgttcgagtgcgtgtcgatgtcggtcgcgtaggtcacatcatagccggacttctccatccaacggacgaaagggtactcccaggagaaaaaggattggctataagcgttgccggtgccattcccctcgtagggccggtcgaaggaaaccttcacggcgttcttgcctccgcttatcgtcgtcgcgccattgctgttgaaggcgtagaggctcttgccggtggtgttgtcatcaggatagttgttgtaagcctgataggtcgttacgggctgctggtagaggagggcggcgactcggctgtcgtcgcgaacgacaaacacgatgtagttctgatacgcctgcgcgttggtcagtagagcgagatagattccgctggtccacgaggactgggtggccaaagtataggcggacgcccantggcattcgatcattcccgtcgtagcatccgttgggcaagcgggttgcagcgtaccgttgagtgggccgatgtgctgcaccaggcgcccccccagcccctggtaccaacccatccgatagacntcnatcgtataggtctgcgcagggttgacgctcacatagaaggtgatgttctcacccttgttcacgctagtggcggacgcataacccttgatctggcccccggcgtccgatgccgtagagccgaagttagcccgccactgggtcgtcccgggctgctgattctcgatgacgatcgcgttgctggcctgcccatgagctgagctcactaacagccccgtcaccgacatcagatacaggagaattccgacgcgccgaagcgcgctcagtactcggccgccgacaggccgcggancggcagcagaaacggtgaattctgggcttccaacgggctcgacgccggaagcaaggaagctgtaaaggtgggattcaattggaatcttcatttgcgtattccttgatggccatatgcatcacaagctgcgctatctcaaagaaatggggcgtaattggtccccagtgagagtagagagcccagccgtcggccgatcatcgtgtggtgactcaggcagtggtctttcgacaggttcatgggccatgaccgggcattcttagcacgctttgaaatagctagtaaatcgggccaattccgcaaatgcaaatcgagtattcacactaaggcttgtcagaccttggagctttccgggttcgctgatatgttatagtagtagtaaaataagcnatatagtagatagacagttaattgatactcgatnaccaatctcactccgatgttgaacaatcgaagagagcacaaaatgacgtccgcgcacgatcaaactgccgccgatggactgggagaggacctccagacctttgggcagatacatccggcgaagtcaaatttgaaaacaggccgcccgatttcgccgcacctcgggctcgaagcgaaaactgctgccagtactttcttgatttcgctttaataatctcgagaccttgctcggcgaaaccggccgcgactttcgcctccgccgtcgtcaagatactgccgttgaatatcctacagttctgagttgctcgaaaaaactccagatggccatttcgcgttcaggccgcgcaatccggtttggagtacccactcttcgactgaccagccaagctactgccacagagattttctggtttctcgacaaggcgttgccgatttcgagctggcaaaggttgttccagtgtcctgctggcaccctcgcccgatgatgtccattcctctttactctaaggatccccgatccgcggaatctgccgtcggccggcctacgacttcgtcccaaatcctcgttccatgagtttcgcgcaacgcgaggcttccaaccgccaaggtcaccgccgctacggcgatcgggtaatacaatcccgcgtaaatcttacccgtggccgcacaaatggatagaccaatcagcggcagcagtccgccaaagaccccattcccgatgtggtacggcaaggaaagcgaggtgtagcggatcctcgccgggaaggcctcgacaaggtaggcggcaatcggtccgtacaccataccgacgtagatactctgaagcagaattagcagaatgagcttgcccttgttcggttggatagcctcgctagcggcaactaggccgccggtggcatccgtagtcatcggagtaagggtgatggctccggtcacctcgctgcgggtcgacttgacagtgacgacgtggttgcccgcggcacgttccatggcgtggtagatcggaacataggtgagtacggcaagcaggaacccggccatcattatttttttgcgcccgactttgtccgagagcgctccgaagacaatcaaaaacggcattcccatcccaagcgcagcggcctcgatgacaatggccgtgcggggattcagcttcagaatggtctgcagatagaagagggcgtagaactgcccggtatacgccaccacgccttgtccggccgctgcgccgaacaaagagaccaggacttgcttcaagttggaccacttggtgaaagcgtccttgagcggctgaagggaagtttttccggcagccttgaggtgagagaagattggcgattcgcgcagcttcactcggatatagatggaaatgcagacgagaaaaagagaaagtagaaaaggaatacgccatccccaatcggtaaaatcttctttgctcatcgcagattgtgtgcccagtatgaccagcaaggaaacgcacagtcccaggatcgccgtgatttggataaagctcgtatagaagccgcgcttgccgtcaggggagtgctcaccgacataaaccgctgcgcctccgtattcgccaccaagggccagtccctgcagcatccggatcacaatcaggatgatgggggcgaaccatccggcggttctgaaagtcggcaggangccaatcaacgccgttgagccgcccataatggacagcgtcaggagaaacgtgtacttcctcccgatgcggtcgccaatgctgccgaagaataacgcgccaaacggtcgaaccacgaaaccggcggcgaaggttgccaggtaagcgatcaaagcaaaggtatcattgccggggggatagaatttgacggaaagcaccgtcgccaaactaccgaaaatataaaagtcataccattcgatcatggtgccgagagaggatgcgacaaggaccagcggcaaggaactggattgcggatttccagcggcggcaccgattgcgtctgcc

SEQ ID NO: 155 - DNA, 4000 bp, Escherichia coli
  misc_feature (44)..(44): n is a, c, g, or t
  misc_feature (74)..(74): n is a, c, g, or t
  misc_feature (130)..(130): n is a, c, g, or t
  misc_feature (328)..(328): n is a, c, g, or t
  misc_feature (1115)..(1115): n is a, c, g, or t
  misc_feature (1191)..(1191): n is a, c, g, or t
  misc_feature (1281)..(1281): n is a, c, g, or t
  misc_feature (1595)..(1595): n is a, c, g, or t
  misc_feature (1640)..(1640): n is a, c, g, or t
  misc_feature (1651)..(1651): n is a, c, g, or t
  misc_feature (1666)..(1666): n is a, c, g, or t
  misc_feature (1807)..(1807): n is a, c, g, or t
  misc_feature (1987)..(1987): n is a, c, g, or t
  misc_feature (2813)..(2813): n is a, c, g, or t
  misc_feature (2833)..(2834): n is a, c, g, or t
  misc_feature (2839)..(2839): n is a, c, g, or t
  misc_feature (2845)..(2847): n is a, c, g, or t
  misc_feature (2849)..(2849): n is a, c, g, or t
  misc_feature (3540)..(3540): n is a, c, g, or t
gctcgccgaccgccgtggcgatcatgcgtcccgatccggcaacnacgctcgtgccagccaggagctgatcgccntccttcttcttgaccgggcgcgactcacccgtcagcagcgactcatcgatctcgangcctaccgaggccagcaccgtaccgtccacgctcacctggtcgccgagtgccagctcgatgacgtcatcgagcacgacgtcgcgagcagggatgaccgacacctcgccgttacgcaggacggaggcttgcggtgcatccacgattgcgagcgaatccagggtgcgcttggcgcgcaactccgacatgataccgatgancgcattaatgaccatgacaccgccgaagatgccgtcgcgcaggtcgccgaacaacagcacgatgatcgaggcacccacgatgatcgcgttgaagagcgtgaacacgttctcgcggacgatggataccaccgaccgcgacgtacggtccttgacgcggttcaccgcgccgcgcgacatgcgctcgaacacctcgtcggtgctcagaccgcgctcgtccgtgctcgccacctcagttaccatgggcatccccctcatccatcgcgctacgaatcagcgacgcgacaacagtaaccgccaacgtcacgacgatgacgcccagcgataccgatacggaaatctccggtgcccactccacgcccgatcccccattgataaacggcagagtgttcgcatgcaacgcctcaagaatcagcttgacgccgataaaactcaaaattacgccgaggccgtagcccaggtacacgagcttgctgagaagagcatccactaagaagaacagctggcgcaaacccatcagcgcaaacacgttgcacgcaaagaccaggaatgcctgctgcgtgataccgaaaatcgcgggaatcgagtcaaacgcgaacatcaggtccgccgaaccgagggccaggacaacgacgagcatcggcgtgatgtaggtgcgcccgccgtggcggaagagcatgcggttgccaatgaagccgtcggtgatcgggagaacacgccgaaccgcgcggataaaaccactctcgtggtattcctcgtcttcgtcgctcccccgcgctgtctcgcgaanctggctgaacgcggtccacagcagccagagtccgaagatgaagaacacccacgagaagcgcgacaccagcgcggcnccgaggaggatgaacacgagacgcaggagcagggcgatgacaatgccgaggagcaaggctttctgctgattctctcgaggaacgcggaangccttgagaatcaggatgaacacgaagaggttgtcgacggacagggaccactccatggcccatcccgcatagaactcctgagcgtagagccccccgtttgtcagccagataccgacgccgaaaagcccggcgagtccgacgtagaacagggtccatcgagcggcctcgaccgctgtgggcgggtgcgggttgcgcgcatgaccgaggaaatcgatcacgaccaggccgatggccacaagagcgaggattccccacgcccacgggtgaataaccatgaataccccttaactatttgaccgcggcatcatagcgcncttacgccgcgctatcctcgcctccacgctgggagcgtgacaccnccagggaggcngcgaccgtgatgagnatggtgaccacgatgaagccgagcgagaaggcgatgttcggctcgggaaccgcaacaatgggttgcccgccgttgatgaagggcagctcgttcgtgtgcagcgcgtggttgattagcttgaagccgatgaagccgaggatngctgcgagtccgtagtgcaagaaaatgatgcggtcaagcagaccatcgatgaggaagtagagctgacgcaagccgagcaaggagaacgcgttggcggcgaacaccaggtacgcctcgttggtgagcgagtagatcgcggggatcgagtcgacggcgaacatgacgtcggctgtgcccacngcgatgacgcacaggagcatcggagtgacgtaggtgcggccgccgtggcggtagagcatgcgcgagccgatgaagccgtcggtgacgggcacgatcttggacacccaccgcacgattgacggcgggcggtattcctcttcctcctcgtcctcgcctacgccctcgcggacctgattgatggcggtccacagcagccaggctccgaagatgtagaacacccacgagaagttttcgatgagggctgcgcccgcgagaatgaagatgaggcgcaggatcagcgcgatcacgatgcccgccagcaggacttcctgctgatccttgcggggcacgcggaagctcgagaggatgatgacgaagacgaacaggttgtcgatgctgagcgctttttcggtgatatagccgcccaggtattcctgaccgtactgcggtccccacacggcccagacgatgccgccaaaaaggagggcgatcgcgatgtaggcgaccgaccaccaggtggcttccttgagggtgggttcgtggggtgtgcgaacgtgaccgacgatatcaacggcgatcatggtcaggataatgccagccaggacgatccaggcgagcgcgtgcacgtgcatacgtggggcctccggtacgagtcgggtaccggaggtctcctcccgccaggaatccctggccggtggcgccggaggcctcgccgcgtgggcggggccgtcgtgatgacgacgccactgtttgtgggagtactcccctccgctaacgccgtctagtttagtggggcggctgcgcgcgcgtccacgcccgaacagtggcatcggtcgcttagcgccgngatttcttaggaacgaggcnntggcngcctcnnngntcagcgcgaggcaggtggtcggtgggcgtcagtgggcgcgcttcatggcgcgcaattccttcttgaggtcctcgatttcgtcgcgcaggcgcgcggcaacctcgaactggaggtgctgagcggcggtcatcatctgggcagatagctcctcgatgagttcggcgagttccgcttccgcgcgctgaccaggattcgagacggcgggtctcttcgcagcggcactgcggtcgcgtgcgctcttctccttgcggtacccgccctcgaggagggtctgagtgtcgacctgttcgcgggcgagcatgtcggtcacgtccgaaatcttcttgcgcaggggctgcgggtcgatgccgtgctccttgttgtaggcgatctggatctcgcggcgacgcatcgtctcggagatggcctcgttcatcgagtccgtcatgttgtccgcgtacatatggacctcgccggacacgtttcgggcggcgcggccaatggtctggatgagcgagcgggtggagcgcaggaaaccttccttgtccgcgtcgaggatggacacgagggagacctcgggcaggtccaagccctcgcgcagcaggttgatgccgacgagcacgtcgaaggtacccaggcgcaactcgcgtagcagctcaacgcggcgcagggtgtcgacgtcggagtgcaggtactcgaccttgacgccgcnctcggccagataggtcgtgagttcctcggccatcttcttcgtgagagtggtgacaaggacgcgctcgtcgcgttcgacgcgcaggcgcacctgctcaagaagatcgtcgatctgcccctcggtgggcttgacgacgacaagcgggtcgacgaggccggtcgggcgaatgatctgctcgaccacgccgtccgagcgctcgagctcgtagggacccggcgtcgcggacaggtagacggtttggccgatgcgctgggtaaactcgtcccacttgagggggcggttgtccatcgcggagggcaggcggaatccgtagtcgacaagggtgcgcttacgcgacatgtcgccttcgaacatcgcgccgatctgtgggacggtcacgtgggactcgtcgatgatgagcaggaagtcgtccgggaagtagtccagcagcgtgtgcggaggggtgccgggaccgcgcccg

SEQ ID NO: 156 - DNA, 4000 bp, Escherichia coli
  misc_feature (1924)..(1925): n is a, c, g, or t
  misc_feature (1930)..(1931): n is a, c, g, or t
  misc_feature (1936)..(1937): n is a, c, g, or t
  misc_feature (1949)..(1949): n is a, c, g, or t
  misc_feature (1952)..(1952): n is a, c, g, or t
  misc_feature (1958)..(1958): n is a, c, g, or t
  misc_feature (1979)..(1979): n is a, c, g, or t
  misc_feature (1984)..(1984): n is a, c, g, or t
  misc_feature (1990)..(1991): n is a, c, g, or t
atcattatggtaaaggtttccaaagaattgtgaggaacgcagtcctttgcttatgccatgcttcccgttgggatatagtgctttgacaaaattttcaagaataggcaataagacagggtctccgacatatcgcctgattgtggagattaatatatcatggtcaatactgtcataatatcctttataatcgctttgataataatagtgtatattggggttctctgccaatgtatcctgcacctgatggaacagaccatgcggtccgcgtccttgtatggatgcagccgttgtttctatcaataggggtgaaagatgcttttccaacggctccataatcgcattgcttccaatacgctctatgactgacggggcttgcacaattcttactttcggtccgtcatccacagtaaacgacttgaggttctttatacggaatgtgccgttacctatctgttctttcagcgcatcaagtatcttatgcttgttttttacataacgggccattcttggtgaacattcaatgccatctattacagctatctctctttgccgatttccgcttcgggtatctgcacttctcagatttgccatgacacgcttgaatgacctttccaaattctcatcggatataatctccggtatgagattatataacggataacagaccgcagttgcagctacggccggttggaataaatcgtatatatcgctgaccgccttccggtctcgtggggagtggtccaacctctccccacatgtggttaaagatatgttccggctttccattaataaatatatattatcatgctgttgccgaggctcgaatccctcggagaatggcggtggtaatctcgtacctgtgcagggtctccgattaatttaaccaacagaatttcagacgcgccccgtagttcgtgttcgagttcgatgaagcgttgttcgcgttcgcataagcgagaccgctgttcgcattcgagttgttgccggaccgcaaaacacaacggcgcgagggattgtccgccttttatttttttaaagagttatgcttcctaaaccggaaatactcaaagacgccttcatacccatggccttaaacactcgcgcaatggtggaaagggtcagattacgtccgctttctatcttggatacttgtgaacgctgtacaccgattttttgtgccaattcctcttgggtcatgttttgggatttacgggctttttttatggcttccccaatcaaaaatgattgcaattcagcttcatacttatccctgtgcggtgtaccgacctcacctatatgtttatccttaacttcatcaagggtataaaatttaattgcttccatatacttatttttttgagttgaaatataatattctgacggcttccgccttgtttatctctttgcgtggggtcttttgtgttttcttcacaaatccatgcgtggcaatgaccaacgtttccgcgtcggtgtcccaaaaagccaacagacgatattgaatacctttatacagggtgcgaaactcccaaatgtcagtatcatctaatttcttgaataaatctttgtccatataaccattggctaccttatctacattatagataattttatccttaacgtcttggcgcagagtgtcaagaaatgcatcggcttcactcgacattattactttgaatctcgttttcaattccatatcttatatcattcacaatgcaaatatagtgaaaatgttctatatatggaacgttttacagacaaaaatacaaccacataaaaattagtttcaaaaatcgactcgcttacgcgagaaaaagaaagagggagcagcctacggctctccctccaacgcttttttcgaaatcgcgaggtccgctctattcaattataacgaattttccgcggaaggccagacgcgccccgtagnncgtgnncgagnncgatgaagcgtngtncgcgtncgcataagcgagaccgctgtncgcantcgagnngttgccggaccgcaaaacacaacggcctcggcttccacttatccaaaatcctgctgcataatgtgttacatacatacttgtatctcccttgtgtactctgctgggcaatacatcgcacttggcaccatgtactatgcgcacgacacaatttccattggaagcgtcaactgttttaacagtccgttcggttttgtttacggggtcataaatatgcgctgtataatctattggatatgaactgtcgttctccgtgcattttgccttgtagaacgcttcatagctcggcacattaaaagcgatatagtccatccattctgaatcacaacccacataatgcttcaatccaagtatggagttgagcgtattgccggtattattgctgtcagccatgccgatggaatccagtttattcagaatgctgtcatgtccgccattgcccacaaccgactgttcgttggttgttccgctcaaagcccaccatagattgctaatctctttatgctgttcgtaatcctgcaactgatagccaactccacgtaagcggcagatgttttggaaatcctttgccgtgtaattcaaaccgccgataggcatctcaataggattaccctcactgtcgtatttccattcgttagatgtaacggacgtcccgttgcctttcttcgaacgtatatcaccggaaaggctgcgtggcatcttcaaaccgtcaacggtaataggatatacaccgaccagactgtcgttgtcgccaaccgtgtgttcggtccattcaggttctatggcttcaatactgctgctgtctacaacaaggcactctatgtcgccaatgtcacggaaagaagtgaaataaaaccattttgcaccgttaggtatgtcacagaacacataatcaccgatgttgaagtcaaaataggtatggcttacagacatgatgaacgtactgagcacacggttgttttcgtcagtgaacacgcctccaagccgggcatggttcagaccgggccatcttacctgcttcattcctctcacatccatcttgtagctgttcgtattggatgcggtggttatgacatcctcgcctatgacttcaccgacaacggcatcaatcgcatacactccggtattttccatatatagcaattccgacaacagggattttctgctatgcaatgcagttgagagcggttcggtctctgttatagaagggaaaaaatactttacttggttcttgtagtcgttcactcccttgtaccaatggtgcggagcatgccagaatatatcaaagccctctccggcggtgtccgttatgtcaaagctgctgccgtttttcaggtagttgaaatccgtatcgcttaactgcacgccttccatctggtttttcttcgtgttgaatgagcatttataggcatggcatcctttcttgatggcaagggtatgcccgcttggaatatatgtgttgccataatccgcccccgtcttattttcgggattgctatacttctcacacgaatcattgtctaccgtatcgctgattttcacaatagagaactgcgaattatgaagttcaagttggggaaaataccggacaagctcttcgatttcgttctgctctatcagttcgaccaatatccatcgtccggttattccgctacactgtcctttttcatcgtacgcattaccattcgcatccaatcctatagccccaccgttttttatggaacgaagcatttcaacactcgccgtagcatttacgttgggaatacggacggttttcaattcacttgcattgaccacctgttccaacagagtcatcgtatcaatatacggacattcattcacgaatatttttgtaaccttactgacaccaccaagagaaagcccgccgggataagtcagattaggcagattgttcaatacaagttcagtgatagtaccgggaagggcaagcgtacttatcggagaagtttcagcaaacgttattgcagacaaagaagtattatcggcatgca

SEQ ID NO: 157 - DNA, 4000 bp, Escherichia coli
  misc_feature (1952)..(1953): n is a, c, g, or t
  misc_feature (1956)..(1956): n is a, c, g, or t
  misc_feature (1964)..(1964): n is a, c, g, or t
  misc_feature (1968)..(1968): n is a, c, g, or t
  misc_feature (1983)..(1983): n is a, c, g, or t
  misc_feature (1988)..(1989): n is a, c, g, or t
  misc_feature (1991)..(1991): n is a, c, g, or t
  misc_feature (1994)..(1994): n is a, c, g, or t
  misc_feature (1997)..(1997): n is a, c, g, or t
  misc_feature (2004)..(2004): n is a, c, g, or t
  misc_feature (2006)..(2006): n is a, c, g, or t
  misc_feature (2009)..(2009): n is a, c, g, or t
  misc_feature (2012)..(2013): n is a, c, g, or t
  misc_feature (2015)..(2015): n is a, c, g, or t
  misc_feature (2018)..(2019): n is a, c, g, or t
  misc_feature (2021)..(2022): n is a, c, g, or t
gaccattgcaggctttgtgctgtggtatctcaagaaacacagccaggcaattcgtgtggcggatgaggcgcttgccgaggaattttttgaccgcctgcttttgggaggcggctgcctggtgatgctggatggactggatgaagtggtcagccaaaccgaccgcggacaggtgcgggcggaggttgaacgcctggctgatgaaatttaccccgacaacctgttcatcgtcacagcgcgcgaatcgggttacaaggaaaatgccatcttcagtgaagactttgttcgtttggacgttcaagcgctcactgactcacaaattgatacgctggtacgaaattggtgcgagcagttgtatcccgaccaggtggaataccagacaaaggatatcatcaccgccattcgagccatcaacgcgcgctatgaagcgcaaaacataccggctttggtgcgtacgcccctgatgacaaccatggtggttagtgtgaagtggggtgaagcggaattaccgcgtgaacgcgcccgcctgtatgaggcggtggtcaaggtgattttacaggcgcaatatttggacgacgattccacgcggcaggaactgatcagttggggcggtatctgggaggatcaacgagattggctttcgtatcttgcattggaaatgcatcgaagcggacagaacggcgcggcgatccccgaatcgcggctgcgcgaaatcctcaagcagaaacttacgggcgaaaatcttgaacaattcatccgcgcggtgcgcagccgcggcggattgtttgaagaacgcgccgaactctttcaattcacccatctgacctttcaggaatttctggcggcgcgcctgttgaccaaggagcgcgaaaaatccctgcccaatttggaagcctatattgtcaacccctggtggcgggaagttttacttttggtatatggatttgccaaacaggattacccgccctttgcaaccgattatcttcattggctttccacgcgcgatggagatggaacccgccgcctcagcggactggaactggctggttcagcagtgctggaaattgaacgacccgataccgaattgaatctggagcaggcgcggtgtctcacccaggcattaaccgaccccgccttgagtgtgcctgctgtattacgcgccagcgctggaaatacacttgcctttttaggcgatccgcgtttcgataaggagtattggcttttacctgccgaagacttgtttggctttgtgcgcatccctgctggaaaattcattatgggcagtgaccctgcgaaagataaacaagctgatgatgacgaacagccccagcatgaagtgaacattccttatgattactacatggcgcgctaccccgtgacgaccgcccagtaccgcacatttgtggaacaaagcggatatcaaacccaggataaagacagcctggacgggactcccaatcatcctgttgttaatgtgacttggtacgacacgcttgaatactgcaactggctgaccaaacaattgggcgatgttagcgttgaacggttgaaacaggcaaggaccgcagggcaaaaagccttttggcagggaattgccgaacacaaattgcgcgttatgttgccgagcgaagccgagtgggaaaaagccgcgcgcggcacgaacggcgttatctatccctggggcgataagtttgatcccgaccaattaaattctagcgaaagtgaaattgggagtctttcggctgtcggtattttcccagtaggcgcttcgccttatggcgttttggatttgagcggcaatgtttgggaatggacaagaagtgtgattcgcttgcgaaaagaaaaaggcgatgaagtcataaaggaatacaattatccctatgtagccaatgatggtcgtgaggatttgaaagccaacagcaattcatctcgtgtacttcgcggcggttccttcnncgntgagtccnaccncgcgcgttgcgcctnccgcnncnggnacnacccagncntcnggnncnggnncnncggtttccgagttgtggtctccccatttcttccatcatgacgactctgatctctggcgctctgaactctggggctctggagtcgttgtactctgattgcgcaagactacaaaattctttagaagacaacctccctgcgaagcagggtcgcgataaaaaaatttggaggcaggatggcaaatgaacaggaaatgccgctcttcacacgcacattcgatttcatcacctggctgttgcccgtgacgaataactttccgcgcgcgcaccggcacacggccacaaagcgcctgctggatgcggctttcaatttgcgggaacacatcgaagcggccaaccatcgcatgggaaaggatcgaatggaatacatccagcgcgccgatgaagacctggataacgtgcgcctgtacctgcgcctggccgcccgctgggagtggttgacggcgggccaataccagcatgtggccgtcatggccgcggaaattggccgcctgctgggcggctggaaaaagatcacgcatccgtagcggctttggtggtcgagtagcgcgttagcgcgtatcgagacccaatgccgctactgcgagggatatgcccacagacttcgcggcggttccttcaacaatgaatccaacaacgcgcgttgcgcctaccgcaacaggaacaacccagacaacaggaacaggaacaacggtttccgagttgtggtctccacgctcttctgcggccctgccggaattaccttgcgggtttgcgccttcaaggtcgaggcatccattcatgatggaagaatggccgggcatattcctggtctccaccccacatcttccctccctaaatccgttctttggatttggggagggtcagggaggggcggggagcgaatagcaactgtcccgcgccatgtgagccagcctggcgcgggacaccctctgaaaccaaaatgacagattcaatgtttgacctgctcgtctcatggagcaatctgcttctcgcctatcaaaaagcaagcaaaggcaagcgcggacacgccaacatcgccgcgtttgaccaccgcctggaagataatctcctgcaactgcaaggcgaactgcaggcgcatacgtatcgtcccggaccctatgacagtttccatatccatgaaccgaagcgccgcctgatctctgccgcgccctttcgcgaccgcgtcgtgcatcacgccctgtgcaatttgatcgagcccatcttcgagcgcagtttcatcttcgatagttatgccaatcgcatcggcaagggcacacatcgcgccctgaaccgcgcccaggaattttcccgcaagtatccgtatgtcttgcaatgcgacctccaacaattttttccatccattgaccatgccgttttacgcgagaccctggcgcagaaaatttccgaccccggcctgctctgggtgtgcgaccagatcctggccagcggggcgggcgtgctggccgaggaatacgaaatgacctggtttgcaggcgatgacctactcgccgcttcacgtccacgcggcctgccgatcgggaacctcaccagccagttttgggcgaacgtgctcctcaacccgttcgatcattttgtaaagcgaaaattgggatgcgatgcatacctgcgctatgtggatgatttcctgctcttcgcgcgggacaagcaaacgctctggcgctggctggcgcagatcgagttgcggctgggcggcatgaggctgtccatccatcccactgccgcgccgcgtcctgttaccgaaggatttacatttttaggtttccaaatcttcccgcaacagcgcaggctcaaacaccaaaaagggctatactaccagcgaaaactacgcgatttggtcaacgactacacagagcagcgcctatctttcgatcaactgaccgccagcgtacaaggctggtccaatcatgtcagattcgggaatacaatagggctgagaaagtcgctgttgggaaaaacga

SEQ ID NO: 158 - DNA, 4000 bp, Escherichia coli
  misc_feature (52)..(52): n is a, c, g, or t
  misc_feature (187)..(187): n is a, c, g, or t
  misc_feature (343)..(343): n is a, c, g, or t
  misc_feature (436)..(436): n is a, c, g, or t
  misc_feature (463)..(463): n is a, c, g, or t
  misc_feature (496)..(496): n is a, c, g, or t
  misc_feature (511)..(512): n is a, c, g, or t
  misc_feature (514)..(514): n is a, c, g, or t
  misc_feature (691)..(691): n is a, c, g, or t
  misc_feature (754)..(754): n is a, c, g, or t
  misc_feature (817)..(817): n is a, c, g, or t
  misc_feature (829)..(829): n is a, c, g, or t
  misc_feature (850)..(850): n is a, c, g, or t
  misc_feature (868)..(868): n is a, c, g, or t
  misc_feature (886)..(886): n is a, c, g, or t
  misc_feature (934)..(934): n is a, c, g, or t
  misc_feature (940)..(940): n is a, c, g, or t
  misc_feature (1009)..(1009): n is a, c, g, or t
  misc_feature (1051)..(1051): n is a, c, g, or t
  misc_feature (1072)..(1072): n is a, c, g, or t
  misc_feature (1088)..(1088): n is a, c, g, or t
  misc_feature (1090)..(1090): n is a, c, g, or t
  misc_feature (1141)..(1142): n is a, c, g, or t
  misc_feature (1218)..(1218): n is a, c, g, or t
  misc_feature (1237)..(1237): n is a, c, g, or t
  misc_feature (1240)..(1240): n is a, c, g, or t
  misc_feature (1246)..(1246): n is a, c, g, or t
  misc_feature (1260)..(1260): n is a, c, g, or t
  misc_feature (1423)..(1423): n is a, c, g, or t
  misc_feature (1441)..(1441): n is a, c, g, or t
  misc_feature (1516)..(1516): n is a, c, g, or t
  misc_feature (1654)..(1654): n is a, c, g, or t
  misc_feature (1791)..(1791): n is a, c, g, or t
  misc_feature (1867)..(1867): n is a, c, g, or t
  misc_feature (1964)..(1964): n is a, c, g, or t
  misc_feature (1986)..(1986): n is a, c, g, or t
  misc_feature (1991)..(1992): n is a, c, g, or t
  misc_feature (2131)..(2131): n is a, c, g, or t
  misc_feature (2289)..(2289): n is a, c, g, or t
  misc_feature (3062)..(3062): n is a, c, g, or t
  misc_feature (3083)..(3083): n is a, c, g, or t
  misc_feature (3086)..(3086): n is a, c, g, or t
  misc_feature (3104)..(3104): n is a, c, g, or t
  misc_feature (3230)..(3230): n is a, c, g, or t
  misc_feature (3239)..(3244): n is a, c, g, or t
  misc_feature (3247)..(3250): n is a, c, g, or t
  misc_feature (3252)..(3252): n is a, c, g, or t
  misc_feature (3254)..(3255): n is a, c, g, or t
  misc_feature (3257)..(3257): n is a, c, g, or t
  misc_feature (3260)..(3260): n is a, c, g, or t
  misc_feature (3262)..(3262): n is a, c, g, or t
  misc_feature (3264)..(3266): n is a, c, g, or t
  misc_feature (3268)..(3268): n is a, c, g, or t
  misc_feature (3271)..(3271): n is a, c, g, or t
  misc_feature (3274)..(3275): n is a, c, g, or t
  misc_feature (3277)..(3279): n is a, c, g, or t
  misc_feature (3282)..(3283): n is a, c, g, or t
  misc_feature (3289)..(3289): n is a, c, g, or t
  misc_feature (3292)..(3293): n is a, c, g, or t
  misc_feature (3295)..(3296): n is a, c, g, or t
  misc_feature (3300)..(3300): n is a, c, g, or t
  misc_feature (3302)..(3308): n is a, c, g, or t
  misc_feature (3310)..(3312): n is a, c, g, or t
  misc_feature (3314)..(3314): n is a, c, g, or t
  misc_feature (3319)..(3320): n is a, c, g, or t
  misc_feature (3323)..(3325): n is a, c, g, or t
  misc_feature (3328)..(3329): n is a, c, g, or t
  misc_feature (3332)..(3332): n is a, c, g, or t
  misc_feature (3334)..(3334): n is a, c, g, or t
  misc_feature (3336)..(3336): n is a, c, g, or t
  misc_feature (3338)..(3341): n is a, c, g, or t
  misc_feature (3343)..(3346): n is a, c, g, or t
  misc_feature (3351)..(3353): n is a, c, g, or t
  misc_feature (3355)..(3357): n is a, c, g, or t
  misc_feature (3360)..(3366): n is a, c, g, or t
  misc_feature (3368)..(3368): n is a, c, g, or t
  misc_feature (3370)..(3371): n is a, c, g, or t
  misc_feature (3373)..(3375): n is a, c, g, or t
  misc_feature (3377)..(3381): n is a, c, g, or t
  misc_feature (3383)..(3383): n is a, c, g, or t
  misc_feature (3388)..(3394): n is a, c, g, or t
  misc_feature (3396)..(3406): n is a, c, g, or t
  misc_feature (3408)..(3421): n is a, c, g, or t
  misc_feature (3423)..(3423): n is a, c, g, or t
  misc_feature (3425)..(3428): n is a, c, g, or t
  misc_feature (3430)..(3430): n is a, c, g, or t
  misc_feature (3432)..(3433): n is a, c, g, or t
  misc_feature (3435)..(3437): n is a, c, g, or t
  misc_feature (3439)..(3442): n is a, c, g, or t
  misc_feature (3444)..(3446): n is a, c, g, or t
  misc_feature (3448)..(3448): n is a, c, g, or t
  misc_feature (3450)..(3450): n is a, c, g, or t
  misc_feature (3453)..(3462): n is a, c, g, or t
  misc_feature (3466)..(3468): n is a, c, g, or t
  misc_feature (3470)..(3472): n is a, c, g, or t
  misc_feature (3474)..(3474): n is a, c, g, or t
  misc_feature (3478)..(3479): n is a, c, g, or t
  misc_feature (3481)..(3481): n is a, c, g, or t
  misc_feature (3483)..(3485): n is a, c, g, or t
  misc_feature (3487)..(3492): n is a, c, g, or t
  misc_feature (3494)..(3498): n is a, c, g, or t
  misc_feature (3501)..(3501): n is a, c, g, or t
  misc_feature (3503)..(3503): n is a, c, g, or t
  misc_feature (3505)..(3506): n is a, c, g, or t
  misc_feature (3510)..(3511): n is a, c, g, or t
  misc_feature (3513)..(3514): n is a, c, g, or t
  misc_feature (3516)..(3517): n is a, c, g, or t
  misc_feature (3520)..(3524): n is a, c, g, or t
  misc_feature (3526)..(3527): n is a, c, g, or t
  misc_feature (3529)..(3533): n is a, c, g, or t
  misc_feature (3535)..(3535): n is a, c, g, or t
  misc_feature (3537)..(3539): n is a, c, g, or t
  misc_feature (3541)..(3543): n is a, c, g, or t
  misc_feature (3545)..(3551): n is a, c, g, or t
  misc_feature (3557)..(3557): n is a, c, g, or t
  misc_feature (3559)..(3559): n is a, c, g, or t
  misc_feature (3562)..(3567): n is a, c, g, or t
  misc_feature (3569)..(3571): n is a, c, g, or t
  misc_feature (3573)..(3578): n is a, c, g, or t
  misc_feature (3580)..(3582): n is a, c, g, or t
  misc_feature (3584)..(3589): n is a, c, g, or t
  misc_feature (3591)..(3599): n is a, c, g, or t
  misc_feature (3601)..(3612): n is a, c, g, or t
  misc_feature (3615)..(3615): n is a, c, g, or t
  misc_feature (3617)..(3617): n is a, c, g, or t
  misc_feature (3619)..(3621): n is a, c, g, or t
  misc_feature (3627)..(3632): n is a, c, g, or t
  misc_feature (3634)..(3637): n is a, c, g, or t
  misc_feature (3640)..(3640): n is a, c, g, or t
  misc_feature (3642)..(3643): n is a, c, g, or t
  misc_feature (3645)..(3647): n is a, c, g, or t
  misc_feature (3649)..(3649): n is a, c, g, or t
  misc_feature (3651)..(3651): n is a, c, g, or t
  misc_feature (3653)..(3658): n is a, c, g, or t
  misc_feature (3660)..(3660): n is a, c, g, or t
  misc_feature (3663)..(3663): n is a, c, g, or t
  misc_feature (3665)..(3667): n is a, c, g, or t
  misc_feature (3669)..(3673): n is a, c, g, or t
  misc_feature (3675)..(3675): n is a, c, g, or t
  misc_feature (3677)..(3680): n is a, c, g, or t
  misc_feature (3682)..(3686): n is a, c, g, or t
  misc_feature (3688)..(3688): n is a, c, g, or t
  misc_feature (3690)..(3696): n is a, c, g, or t
  misc_feature (3700)..(3701): n is a, c, g, or t
  misc_feature (3703)..(3703): n is a, c, g, or t
  misc_feature (3708)..(3709): n is a, c, g, or t
  misc_feature (3712)..(3715): n is a, c, g, or t
  misc_feature (3717)..(3718): n is a, c, g, or t
  misc_feature (3720)..(3720): n is a, c, g, or t
  misc_feature (3724)..(3724): n is a, c, g, or t
  misc_feature (3726)..(3728): n is a, c, g, or t
  misc_feature (3730)..(3733): n is a, c, g, or t
  misc_feature (3735)..(3737): n is a, c, g, or t
  misc_feature (3739)..(3739): n is a, c, g, or t
  misc_feature (3741)..(3741): n is a, c, g, or t
  misc_feature (3744)..(3744): n is a, c, g, or t
  misc_feature (3746)..(3750): n is a, c, g, or t
  misc_feature (3752)..(3752): n is a, c, g, or t
  misc_feature (3754)..(3766): n is a, c, g, or t
  misc_feature (3769)..(3773): n is a, c, g, or t
  misc_feature (3775)..(3775): n is a, c, g, or t
  misc_feature (3778)..(3786): n is a, c, g, or t
  misc_feature (3788)..(3799): n is a, c, g, or t
  misc_feature (3802)..(3802): n is a, c, g, or t
  misc_feature (3805)..(3805): n is a, c, g, or t
  misc_feature (3807)..(3820): n is a, c, g, or t
  misc_feature (3822)..(3822): n is a, c, g, or t
  misc_feature (3824)..(3826): n is a, c, g, or t
  misc_feature (3828)..(3831): n is a, c, g, or t
  misc_feature (3833)..(3838): n is a, c, g, or t
  misc_feature (3840)..(3841): n is a, c, g, or t
  misc_feature (3844)..(3844): n is a, c, g, or t
  misc_feature (3846)..(3850): n is a, c, g, or t
  misc_feature (3852)..(3854): n is a, c, g, or t
  misc_feature (3856)..(3858): n is a, c, g, or t
  misc_feature (3860)..(3861): n is a, c, g, or t
  misc_feature (3865)..(3871): n is a, c, g, or t
  misc_feature (3873)..(3875): n is a, c, g, or t
  misc_feature (3877)..(3889): n is a, c, g, or t
  misc_feature (3891)..(3901): n is a, c, g, or t
  misc_feature (3903)..(3913): n is a, c, g, or t
  misc_feature (3915)..(3923): n is a, c, g, or t
  misc_feature (3925)..(3926): n is a, c, g, or t
  misc_feature (3928)..(3937): n is a, c, g, or t
  misc_feature (3939)..(3943): n is a, c, g, or t
  misc_feature (3945)..(3945): n is a, c, g, or t
  misc_feature (3947)..(3949): n is a, c, g, or t
  misc_feature (3951)..(3951): n is a, c, g, or t
  misc_feature (3954)..(3965): n is a, c, g, or t
  misc_feature (3967)..(3969): n is a, c, g, or t
  misc_feature (3972)..(3973): n is a, c, g, or t
  misc_feature (3975)..(3979): n is a, c, g, or t
  misc_feature (3981)..(3985): n is a, c, g, or t
  misc_feature (3987)..(3992): n is a, c, g, or t
  misc_feature (3994)..(3995): n is a, c, g, or t
  misc_feature (3997)..(4000): n is a, c, g, or t
cgagctaaaagatagtggcgcaagctatccagatgatagcaaagtaagggcngcgcaaagggcgataaatgagtatatagccttgcaaaatggcgctagcgatgtggctaaaaagacatttggcgagcagaatttatttgagctatttaagagtaaggtttttgctagagaaagcctagactaccgnacttttaataaaatttacaccccagagcttgataggctcttttttgagctaaaagaggcagcgaaaaactacattttagaggtcgaaaagtataggctaagtggctttagcaagctattaaagctttataaggcgtcaaatttagagctaaacaangagataaatgcgctaagttttgctgatataaacaagctggtttttaagcttttggtgcaaaatttggataaagaggcgctttattttaggctngatggcaggataaatcacctcttagtngatgagtttcaagatacaaacgtgatccagtangagatcatcttgccnntnatcgctgaaatcgtctctggatacggacaaaacgggcttggaagcttcttttacgtgggcgacacgaagcagagcatctataaatttaggggtggcaaaaaggagctttttgacaagcttggagatgattttactcagatagatatagaaaatttgccaagcaactaccgcagtttnaaggctttggtgaaatttaataacgccgtttttgaagaaatttatcatagatatgggcttagntttgagccacaagagccagctaaaaaagatgagacgctaagctatgaggtaagtggcgagtgngactattttgangtagagaaggacgactacggntacttgcgtgtgctaagngatgaagatatcgcaggngcggtcgtttcgcaagcaagtgagcttttaaaagctggcgtaaatgcnagcganataaccgtgctttgctggaaaaatagcgacattagcctcatctcagaagtgcttagtagcgcagggatnaaaagcgtcaatgaaggcactttggagctaaaaagaacgccncttgtcgcagcgatcatcgantatgcgaaattttgcntntttaaagaagaaatttatgagaaaaatgtaaaagcgctagtaaatgcaaanntcaaaaaactaaatataaagccagaagtgagcgcgacaaatagcctattttacctagctaaaaatttaggcataancatggcagacgttgatatnttnaggctntttgagctaagcgnggggtataaaaatttaagtgattttatatttaaccttgaaaactttagctctaaaatcagcccaaaaagtagcgacggcgtgagagtgatgaccgtgcataagtcaaaggggcttgagtttgctcacgtcatagtttgcgacatgatgggcaagggcaggggngatgactcaaatttcatnaccgaatacagcgaaaagggcgagtggatcgtaaagagtaaaatttcaggtagagaaaattttgatagcgactangcaagcgttttagagcagatgaaagagcttgaaaagcaagaaaatatcaataaaatttacgtcgctttcacaagggcaacaaagtcgctcatcatcatcaaacaagccgtcccaagcggaaatagcccaagctttttntcattttacacaagaagcgacaagagcgaagcaaacgactatcttgatctaaaagagtttagctttggcaaaattttgcctagtaaaactgagcaaaaagagctaaaaaaagatgaaaaaatgcctgaaattttaangatagagaggcaagaggtagaggcgaaagagcaaaagacgagtggtaaaaatttaagtgcgatatattttggtctngcgtttcactatctgcttgagatgagcgagaaatttgatgaaatttcactagaaaaagctaaaaatttgatgctaaataaatttcataaatttttgncacttgaagcacttgaagatgnctttnntagggcaaaaatgcttataagagagccaaaatttatagagtgcataaaagacaaagaaatttataaagagcagccatttaaagtgaaaaatgagctaaagcagatggatcttttttgctttaatgagcgtgaaatttgngtgattgattataaaacgacagataaaaatatagaagagaacaaaaagcaggtaaaagagtataaagatgcgctcgctaaattttatgaaaaacatagtataatcgccgtcattttctatgcacttgaaggcaaaatttcatatattgaagtttaaangctacttaatttaagctttgtcaaagcattgtttaaatacaatcacaactcaaaaattaacttggcaaaggtaagaaaatgacaaaaataacaaagccaaacgaagttaagcgagactggatcgtagttgatgcagctggtaagcgctttggtagattgctaactgaggtagcaactatacttcgtggcaaaaacaaaccatgcttcacgccaaacgtagattgtggcgactatgttatcatcataaatgcttctaaagtagaatttactggtaataacaaagctgaagataaactttatcacagacactcaggatattttggcagcgtaaagagcgagaaatttggcgatttgatagcaaataagccagaaaaactatttaaattagctgttcgtggcatgcttccaaagacaaaacttggaagagagatgataaaaaaactaaaagtttatgctggcagtgagcatcctcatacggcacaaatagctaaaaaagaaggaaaataattatggcaaaagtttatgcaactggtaaaagaaaaactgccgtagcaaaggtttggataaagtctggaagcggtaaaatcgtagtaaatggtatggatcttaacacttggcttggcggtcacgaggctatcaagcttaaagttattcaaccacttttagtaacaaaacaagagagtttaatagacgtagtagctacaactttaggtggcggttattcagcacaagctgaggctttaagacacggcatttcacgtgctttagctganatggatgctgattttagagcngcncttaaaccaaaaggcttnctaactagagattctcgtgttgttgaacgtaagaaatttggtagaagaaaggctagaagaagcccacaattctctaaacgttaatggttttttgcaagtgcttttgcatttgcaaaatttaggttntgtaaattnnnnnnttnnnntnannanttngntnnnanttnaanntnnnttnntttttnttnngnnaaantnnnnnnnannntnaaaannccnnnttnnaangnantnnnntnnnnaaaannntnnnttnnnnnnngntnncnnnannnnngnttttnnnnnnnannnnnnnnnnnannnnnnnnnnnnnncnannnntngnngnnntnnnncnnnangnaannnnnnnnnnaaannncnnnantttnntngnnntnnnnnngnnnnnaancntnnaganntnntnnttnnnnnanntnnnnntngnnntnnntnnnnnnnaaaaantnaannnnnnannngnnnnnntnnnannnnnngnnnnnnnnntnnnnnnnnnnnnaancntnnnaaaaannnnnntnnnnttngnncnnntngncnnnnnngnttnannngnnnnngntnnnnannnnntncnnnnnnntttnntnaaaannaannnngnngntttngnnnannnngnnntngnttnannnnncnannnnnnnnnnnnnttnnnnntnaannnnnnnnnannnnnnnnnnnnaanttnannnnnnnnnnnnnnancnnntnnnntnnnnnngnnttngnnnnngnnntnnntnnaaannnnnnncnnntnnnnnnnnnnnnncnnnnnnnnnnncnnnnnnnnnnncnnnnnnnnntnntnnnnnnnnnnannnnngngnnncnaannnnnnnnnnnnannnccnnannnnncnnnnngnnnnnntnntnnnn

SEQ ID NO: 159 - DNA, 4000 bp, Escherichia coli
  misc_feature (103)..(103): n is a, c, g, or t
  misc_feature (118)..(118): n is a, c, g, or t
  misc_feature (926)..(926): n is a, c, g, or t
  misc_feature (1307)..(1307): n is a, c, g, or t
  misc_feature (1802)..(1802): n is a, c, g, or t
  misc_feature (1829)..(1829): n is a, c, g, or t
  misc_feature (1832)..(1832): n is a, c, g, or t
  misc_feature (1835)..(1835): n is a, c, g, or t
  misc_feature (1883)..(1883): n is a, c, g, or t
  misc_feature (1988)..(1988): n is a, c, g, or t
  misc_feature (2138)..(2138): n is a, c, g, or t
  misc_feature (2183)..(2183): n is a, c, g, or t
  misc_feature (2199)..(2199): n is a, c, g, or t
  misc_feature (2216)..(2216): n is a, c, g, or t
  misc_feature (2380)..(2380): n is a, c, g, or t
  misc_feature (2464)..(2464): n is a, c, g, or t
  misc_feature (2471)..(2471): n is a, c, g, or t
  misc_feature (2568)..(2568): n is a, c, g, or t
  misc_feature (3527)..(3527): n is a, c, g, or t
  misc_feature (3942)..(3942): n is a, c, g, or t
  misc_feature (3956)..(3956): n is a, c, g, or t
  misc_feature (3994)..(3995): n is a, c, g, or t
agttttacatgaaagatttggtttgggcacagtgacagaaacagccggaagtggtgaaaacgcggaggccactattgattttggatctcatggcgtgaaacgnttactacttagatangcaccggtagaaaaactttaattaatcgttgccccataaccaaataccaggatttttgtattgtccgttaaccaatgtttcaaaatgtagatgtgcaccaaaagcgtttccggtggcaccaatgtttccaattctttctcccacatctacttcttgtcccacttcaactctggttcgagataaatgggcataccttgttacaacaccatctaaatgtcttatttcaactgttcgaccatatgcaccgcgccaaccggtaaaaattactttgcccactctggcagcgtaaacaggatcaccataatcaccgttgaaatctattccggtgtgccaacctaattcccaaattctgccttttcgggcataaccaaccgaaatacgagcacgtgcaggattaactgtgtacttagctcttagtgctcttcgttctgcagctttcttttctttttcagcagcaatgcgtgcaacttcttgcgccgcaatgtttgcagcttgggccttaaacttttgaattttttcttcagtaccaggagctcctaaatttgcagctactggaactttcacaattggtaaatcagctgctccaacatcttgattagccaccgttaactcttgaggagcatcggcaacaacaacgggatcagatgagccagaaaaattggatggcaaagctaacgcgattgttaaaccaatcgccacgagcaggatcgagcctgaaatccagcgattattcggtgctataactttgatcatcttgttcccaaccttgcccgatgtcacaccagtaacactcaggtgggttagtganttatggcatttgactcaaagtcagaacaaaaagtgtgggtgaataggcttaggaagaattgttgaatgttgatttgatttctataaggggaaagtcacaaaagtggatctttatgaataccaagcaaaagaactttttgctacccacggggtaaccacacaagtaggaaaagttgtgagcaccccagcggatgctcaaaaagcagcagcagaatttaattgcgcagttgtggtgaaagcccaagttaaaactgggggacgtggcaaagctggtggcgttaaattagccaataacgcggctgaagctttagaaaaagccaaaaacattttaggtcttgatataaaaggccacattgttaaaaaaatattaataactccggcngaagatattaaagaagaatattacgtatcatttttactagatagaacaaatagaacatttctttcaatggcaagtgttgcaggtggaatggatattgaagaagttgctgccaccactcctgaaaaattagccatgataaaaattaatccactcacaggtgttgacaacaacaaagcattagaaatatctgtagctgcaggtattcctacggaagtacaaaaagatgttgcggtgttgattgaaaaaatgtggaaactttttgttgccacagatgcaacattggtagaagtaaatccacttgttagaactaacgatgatcgaattgtggcattagatggcaaagtcacattagatgaaaatgcaaattttagacatgctgaaaacgaaaactttgtcgacaccgaaaatgttgaccccctagagaccgcagctaaagcaaaagatttaaattatgtgaaacttgatggcagcgtaggaatcatcggcaatggtgcnggattagtaatgagcacccttgatgtngtngcntatgccggagaaaaatttggtggcataaaaccagcaaacttcctaganattggtggtggtgcatctgcccaagttatggctgatggtttaggaattattttgtctgaccctgcagttaaatcagtttttgttaacgtatttggtggaatcacngcttgcgatgaagtagcaaatggaattatccaggcaattgaaattttaaaatcaggatcaaattatgttcaaagaccaattgtggttcgactagatggcaataacgccgaagaaggtatcagaatcttaaaagaagcaaaacctgaaaangttgaaatagttgacaccatggataacgctgcagctcgagcagcncaattagcagcaggtnttaaataatggcaattntattaaacgcaaatagtaaagttattgtgcaaggcatgactggttcagaaggaaaaaagcacaccgaaagaatgattaaatctggtaccaaaattgttggtggggtaactccaggtaaaggtggacaaagtttagaagttgctggacaaaacgttccagtattnaattcagttcaagaagcaatggcagcaactggtgcaaatgtttctgtagtttttgtgccaccaaaatttgctaaagcagcagtngtggaancagtagatgcagttatgcccttagttgttgtgattacagaaggtatcccagtgcatgacaccgcacatttcttcacctacgcacaaaaatctggtangaccagaattattggaccaaactgcccaggaattatttctccaggattaagtaacgctggaatcattccagcagacataaccacaaaaggttcaattggattagtttccaaatcaggaacacttacctatcaaatgatgtatgaattaagagatcttggttttactacagcaataggtattggtggggatccaattattggtacaactcatattgatgctttaagagaatttgaaaatgatccagatacaaaagcaattgtgatgattggtgaaattggcggagacgcagaagaaaaagcagctgaatttatcaaagcaaatatcaagaaaccagtagttgcctacgtggcaggcttcaccgctcccgaaggtaaaaccatgggacatgcaggggcaattgtctcaggttcaagtggaactgctgaagcaaagaaagttgctttagagaaagccggagtaaaagttggtaaaactccaagtgaaacagcacttttgttacgcgccgcaataaaataaatttgtgaccgatactccagttcaacgccatagcgttgttatcgctggacttttagtaacactgtggacgtttctcataacttttggtttatcagtaattcttatttttactacctggattttggcaggagatagctcaacatcaatttcaaatgctttcaaagttgtggtgtggggttatttagcaatgcaaggtgttcccattgttattaattccacagtgctttctttgccatttttgggcttcattttaataacgctactttcgttatatagatcttctaggtgggcaattagatccgcgttacatgacgaaatgaaacgaccaacctttatttctttattggtcgtttcaattgcctcaatttcatattgtggagtcatcgtacttttaagacaatttgtagatccactaaacatcaattggtttgaagtaatgatnaagccaaccatcatggtggtttctatgtcaatttatgcagtgggcacagtgggtggaacttggtcattaatatttgatgatctggatgaatttataaaacaaattcttaagtctattttacgatttattctgtttactttttttatcggatttgtgattgttgctattgctattgggtttaattatgaaaatatgttgctggttcaatcttccttattgggtggggtagtagccattgttgcggtggttatttcaggtattggttggatcccaaattttattttgtggtcatgggcttggttgactaaagctacggtttcactaggtgctggttcaagtatttccttgactgaggcaaacatttcacaattaccagcttggccttggtttgggttaattccaactgaattgcctncttggacaaaattnctaattattattccaatttttatgggagtaattatggnnctatc

SEQ ID NO: 160 - DNA, 4000 bp, Escherichia coli
  misc_feature (1962)..(1962): n is a, c, g, or t
  misc_feature (1974)..(1974): n is a, c, g, or t
  misc_feature (1986)..(1986): n is a, c, g, or t
  misc_feature (1994)..(1995): n is a, c, g, or t
  misc_feature (2000)..(2000): n is a, c, g, or t
  misc_feature (2016)..(2016): n is a, c, g, or t
  misc_feature (2028)..(2028): n is a, c, g, or t
cttgctccatgcacatcaatcatacggtggtcaatatcattgtgataaagattaccgaggaattgagacgatcgcaatcccttactgataccacattctccatcaggatagagtgccttcacaaaattttcaagaatgggcaaaagaagaggatcgcctacatatcttttaataatagaaattaaagtttcgtgattaatactgtcataatatcctttgtagtcgctttgatagtaatatttgagattaggattttctgccattgcagcttgtatctgatgaaacaacccatgcgggccacgcccctgtatggaagcagcggtagtttttatcaataaagaagaaagtcgattttccaacggttccataatagcattactcccaatgcgttctatgaccgaaggagcttgtactgttcttactttcgggccatcttcagtgagaaatgatttaaggttcttgatacggaatgtaccattaccaatttggtttttcaacgtttcaaatatttttcctttatttgtcacataacgaatcattcttggagaacattcgataccgtctatgatagttttcggcatagccctgttcccatttcgagcatctgcatttcgtagattcgccatgacacgcttaaatgagcgttccaaattttcgtctgatataatttccggtataaggttatataacggataactgaccagaggtatatttccggtcagtttaaataaatcatcaattttacagaccgccttccggtctcgtggggagaagtcaagccactccccacatatggttaatgttatgttccggctttccataaaatatatatattatattattatgctgttgccgaggttctaatccctcggagaatatcggtggtaatctcgtaccttatatagagtctccgattagtttaaccaacagaatttcagccgcgccccgtagttcgtgttcgagttcgaagatgcattgttcgcgttcgcataagcgagaccgctgttcgcattcgagttgttgccagaccgcaaaacacaacggcgcgtgggattgtccaccttctatgttttaaagagttatacttccaaaacctgcaatacttaaagaggcctccatccccattgctctgaatacacgcgcaacagtcgaaagtgtcagattcctaccactttctattttcgacacctgtgcacgctgaacaccaatcttctgggctagttcctcttgtgtcatattttgggatttccgggctttcttaatagcctcaccgataaggaacgactgcaattcagcctcatatttatccctatgtggtgtcccgactttcccaatgtgcttatccttaacttcatcaagggtataaaatttaatcgtttccatatcactatttttttgagttgaaatacaattttctaatagcttccgctttgttaatctctttacttggggtcttttgtgtctttttgacaaatccatgcgtagcaataactaatgtttccgcatcagtatcccaaaaagccaacaaacgatattgaatacctttataaagagtgcggaactcccaaatatccgtaccatccaattttttaaaaaggtctttatccatatatccattggcaaccttatctacattataaacaatcttgtctttaatgtcttggcacaaagtatcaagaaaggcatctgcctcgcttgacattatcactttgaatcttgctttcaattccataccttgttattgcattgcaaagatacaaaaaatgttccatatatagaacattttaaggcacaaatattcatgctgctctataatatattacccaacctacattagaaaaagagagagggagcagtctcccgttggtcgactctccctctgacgcttttttcgcaagaacgagtttcgctctattcaattattacgaattttccgcggaaggccagccgcgccccgtagtncgtgtacgagtncgaagatgcatngttcgcgnncgcanaagcgagaccgctgtncgcattcgagtngttgccagaccgcaaaacacaacggcctttgctactattgatccaataaccagccgcataatgagtaacatacttactcgtatctgcattatgaaccctgcttggcaaaatatcgcattttgctccatgtaccaagcgtaccacacaatttgcattggaagattcaactgatttcactgtacgttcagtctttttcacaggatcataaatatgggctatataatccgaaggatacgaactatcagtatcaatacatcttgctttgtagaatgtttcataacttgggatattaaatgcaatataatccatccactctgaatcacagcctacataatgcttcaaaccaagtatagaattaagagaattgccagcattactactatctgccataccaatggaatccagcttatttaaaatagcgtcatgtcctccattaccgactacagattgttcgttggttgttccgtttaatgcccaccaaagattactaatctctttgtgttgttcataatcctgtaattggtaacctgcacctctcaaacgggaaatattctggaaatcctttgctgtgtagtttaaggtagcaatcggcatctcaataggattaccactactatcgtatttccattcacctgacgtagtggatgtaccattacctttctttgagcgtacctcgccagaaagacttcgtggcatcttcaaaccgtcaatagtaataggataaacacctacaagactgtcattatcacctactgtatgttcagtccattccggctcaagagcctcaatgctggcactatccacagaaagacactcaacatcaccaatgtcgcgaaaagaagtaaaatagaaccattttgcaccgctaggtacatcgcagaatacacactcacctatagaaaagtcaaaatacgtatgacttacggacataatgaatataccaagtacacaattaccttcatcagtgaatacaccacctagtcgcgcatgattcaatcccggccatttcacctgcttcataccttttacgtccatcttatagctgttagtattagaagctgtagatataacatcctcactcataacctcaccaataacagcatcattcgcatacactccagtattctccttgtacagaagttcagaaagtttagccttcttgctgtgtaatgcagttgaaataggctcgttttccgtaacagaagtaataaaatacttcacttggttcttataatcatttacgcccttataccaatagtgaggagcatgccaaaatatatcaaaaccctcccctgccgtatctgcaacatcaaagctactaccatctttcagataattaaagtctgtatcactcaactgtacaccttccatttgattcttcttcgtgttgaacgagcatttaaaagcatggcaacctttctttatagcaagagtatgcccactaggaatatatgtgttaccgtagtcttcacctgtcttgttttcaggattgctgtacttctcacatgaatcgttatccacaacatcattgattttcacaatagaaaattgcgaattatggagctctaactgtggaaaatatgcagtaaggacatttacttcactctcttctacaagttcactcaatatccaacgtcctgtaataccactacattgtccactctcatcgtatgcgttcccgtttgcatcaagcccaattgctccactatcctttatagaacgtaacaaatcaacactagcagttgcatttacattaggaatacgtacagttctgatcgcactcgcattaattatctgctctaaaagtgtcatagcatccacatacggacattcatttacgaatatctttgctaccttgcctacacctcctagcgtaagtcctccgggataagtcaggtttggcaaattgtccaatacaagttccgtcatcgtatcgggcagcgtcaatgtactaatgggagcagtttctgca

SEQ ID NO: 161 - DNA, 4000 bp, Escherichia coli
  misc_feature (1968)..(1969): n is a, c, g, or t
  misc_feature (1971)..(1972): n is a, c, g, or t
  misc_feature (1978)..(1978): n is a, c, g, or t
  misc_feature (1983)..(1983): n is a, c, g, or t
  misc_feature (1986)..(1987): n is a, c, g, or t
  misc_feature (1990)..(1990): n is a, c, g, or t
  misc_feature (2005)..(2005): n is a, c, g, or t
  misc_feature (2007)..(2008): n is a, c, g, or t
  misc_feature (2013)..(2014): n is a, c, g, or t
  misc_feature (2019)..(2020): n is a, c, g, or t
  misc_feature (2028)..(2029): n is a, c, g, or t
  misc_feature (2031)..(2031): n is a, c, g, or t
  misc_feature (2037)..(2037): n is a, c, g, or t
  misc_feature (2064)..(2065): n is a, c, g, or t
  misc_feature (2408)..(2408): n is a, c, g, or t
  misc_feature (2411)..(2411): n is a, c, g, or t
acatatttgctaatcatataaattaagaactttttatctttagcgaagaataatcgggttttggcaaaaatttttctcgcatctttcccaagcggctttcatatatatgtttcctcaaattaaaactggaagcatgtttgaaatggccataataagaatttattgttgccaatattttatttaaccctggaattccctctttggcgttatttaatctgtataatttgtcttttaatcttttaactacttttttgcggaccaaagtataatcaggtttcacgaaatatcccaaaaaatctattcctttatcaatgggctgaattttaattttgtttagatttagctctaattttaaattttcctttaaaaaatcattaatttcgtctcgccaaaatttaagtttttctttatctctatctaataagatgaaatcatcaacatagcggacataatatctgcactttaattctctctttatgaactgatctaactcatttaaataaaggttagcgaaaaactgggaagaataattgccgatgggaagtcccgcattctctccggattcaaataaggatttgcgaggcggaatgagtttaaataaagacgggctgcctttgataagataatttttggtcggcttgtagaagataatagtcctggctaaccatagaacttcttcctcccattgattgggcttatcttgtttagaaatgaactttttaaaaattgaaaataaaatatcgtggtcaattgacataaaaaacccagaaatatctagttggcaataaaatgcctcttttttataattttgggttacttttctaataaatctcttcaatctctttactgccgcgtgcgttcctttgtttttccggcaggcgaaagaatcaaaaataaattttctttctcccatttctaatatttcccggattaagagatggtgaactactctgtctttaaatgaggcggcaaaaatttctcttggggaaggttctttaactacaaaacaaatcgaacgacccggtttatatttctttgtttccagtgcttttttaagctgaaagagatttctttctaaattccattcaaacttcagagcatttatagttttcctctttgtttttctacaatccaaataggcttgatatagtttttcaaaagtaaatatggttttactcatagttttgagatgcccattttaaccaaccgccaatcatctctccgatttctttaaggtagttggtttggatatgagtaaattgcctttttgaaatcaaatttagttcctgggccattcttaatctcacttttaatttgtcaaaattgatgctcagctctaaaattttcgaatatttctttttaccaggcaaggcatttgcttctaaaactaagtccagacactgccagcttaaatctaagatattttgtcccagggtgtatttgtattgctttgggaaatttcttatcctttcatacaaaaattttatcaactgataaattttaaggtataaagggagatgttgggagctgggcatattagattgtcgcaaatagtagctaaaaatcgatttccctcggacgcaacgaacatagttgttgttggtcttatcgttgttgctgacactgccattgttgaagttcaggttccaggcgttgttgctatcatactcggtagaagaccaatagtagttggactgagcgttattctcttacacttaataataattctccaaaggcctgactatctttagagagaccttctggctactaatacccctattacttttatactttttagaggtggtaagagcgcaatagatttttagccgctctctcccccaccactgcccagtttaatgagcaaagtatgtggaagaatctggcgacaaagttttaaaagaattcgcgaatcaaattcccaaacccaaattaccaaattctattgccctcggacgcaacgaacatagnngnngctggncttancgnngtngctgacactgccacngnngaagnncaggnnccaggcgnngntgctancatactcggtagaagaccaatagtagnnggactgaatacctggtaatctagaatagggagctgaaccctttgcctggtcacggatgctgtctaactccaagatatttggcaatctccagcctgaccccttagctttacaggcatccattgcatcaaaagtaccggcagctgaagtatagtatctttctaaccaattcctagctccaataagtgtatttccagtcccggcccgtagatctgcgctatgagttccgccaatatcgcctcctgaaatggaaaaataggaatctgcccaggtgtatgttgtaggtgcgccggcatctgtttttgaccaaagcaaattagcatagacattagagtcagtggcaatncanactgctgcagttggagtggcggcactatctggtaaaagaatacaattagaagcatcgcagaaaatctttttagtagtagttgccagagcattgccgagattactaatatctcgcactatagtggtagttgaccaatcccaggaaggactgggagaatagcactcagccaacttaacctgaccagtggtagtggcaatatctactttttctgtccctttgccgattttcgtttcatcagtaaaggtatcgctgaccgaatcaggagaggccttggctatccaataaccaaccaaaacgctgacaataattgctcctatcactccaattagaatttttgatttttttgttttaagcatatatttaaaatgtgctataatttaaatgccgtggagcaaaagaggttgaaacctctggtgtgtgtgcaactgttaggggatcaatctcagctctgcggctttttgctagctttcagctttcagttttcagcttaaattagcttttagctcacgggtcacagcttttagtttttggtgtctggtcctttcattctttgaagcattacgtataacatctttaaaatctcctctaataaactctcggctttttgaacattaacattgggatataatcttccaataagattgagttgagtttctaattcggctgctgaaccatgagcaatggaaagaaattggatatattctttttgttttctcttacttccctcagcgatattagaaggaatagctaccgctgctctttgcatttgcgaagagagtccataggtttcggagtttggaagtgcttttgtaattttgtagatttcttcaactaaaaccattgattttccccaaaccgtgagttctttgtaagacctcgcatacattttattagctatcagcgtacagcttatagctgaaagctttctacaaactgaaagctaattagctaaaagctgaaagctaattactggattttgtcgtaggcagccagaagaatctcataaatctgaatcgtgacgccgcttggaacctcaactcgaagattccaatcatcggtagtagtagcaggaagatttactgccggagtaatataagcttcgcccttagctaagtcagttgaagcagaagggggaactgtgaaggtagcggttgtggtagagtcagtcacgttccaaaccgtccaagttgaagaagcagtggtggtggaatcagcatagcgaatgacaaacttatgaattcggttggtaccggctgaggcagaagaaaacgaataatcctcaatagttcgagaaacagtcgttgcggttccttgacaggaagtagcacatctgactggcaaatcaaagccgagaatgggaatcatttctctcaaaatctcagtgtttgctttgccaatttcatatcctgaagcagttttgatataatcgccactggcaataattatcttgcctgaaccgtccggatctaaataaatgttttggttgtttgccgaagcaatggtcgtggtggcatcacttggtcctgtgaacaattttgaagtaattcctccggctccgctgacggttaaattattggcgatggttatgt

SEQ ID NO: 162 - DNA, 4000 bp, Escherichia coli
  misc_feature (3)..(4): n is a, c, g, or t
  misc_feature (11)..(21): n is a, c, g, or t
  misc_feature (24)..(25): n is a, c, g, or t
  misc_feature (27)..(29): n is a, c, g, or t
  misc_feature (31)..(33): n is a, c, g, or t
  misc_feature (35)..(37): n is a, c, g, or t
  misc_feature (40)..(41): n is a, c, g, or t
  misc_feature (44)..(45): n is a, c, g, or t
  misc_feature (47)..(48): n is a, c, g, or t
  misc_feature (53)..(53): n is a, c, g, or t
  misc_feature (56)..(63): n is a, c, g, or t
  misc_feature (66)..(77): n is a, c, g, or t
  misc_feature (79)..(81): n is a, c, g, or t
  misc_feature (84)..(90): n is a, c, g, or t
  misc_feature (92)..(93): n is a, c, g, or t
  misc_feature (95)..(96): n is a, c, g, or t
  misc_feature (98)..(98): n is a, c, g, or t
  misc_feature (100)..(100): n is a, c, g, or t
  misc_feature (102)..(102): n is a, c, g, or t
  misc_feature (104)..(109): n is a, c, g, or t
  misc_feature (112)..(112): n is a, c, g, or t
  misc_feature (115)..(132): n is a, c, g, or t
  misc_feature (136)..(138): n is a, c, g, or t
  misc_feature (141)..(142): n is a, c, g, or t
  misc_feature (145)..(145): n is a, c, g, or t
  misc_feature (148)..(160): n is a, c, g, or t
  misc_feature (163)..(163): n is a, c, g, or t
  misc_feature (165)..(166): n is a, c, g, or t
  misc_feature (169)..(181): n is a, c, g, or t
  misc_feature (184)..(185): n is a, c, g, or t
  misc_feature (187)..(189): n is a, c, g, or t
  misc_feature (191)..(196): n is a, c, g, or t
  misc_feature (198)..(212): n is a, c, g, or t
  misc_feature (214)..(217): n is a, c, g, or t
  misc_feature (219)..(223): n is a, c, g, or t
  misc_feature (228)..(233): n is a, c, g, or t
  misc_feature (236)..(242): n is a, c, g, or t
  misc_feature (245)..(253): n is a, c, g, or t
  misc_feature (256)..(267): n is a, c, g, or t
  misc_feature (269)..(269): n is a, c, g, or t
  misc_feature (271)..(272): n is a, c, g, or t
  misc_feature (275)..(276): n is a, c, g, or t
  misc_feature (278)..(285): n is a, c, g, or t
  misc_feature (289)..(290): n is a, c, g, or t
  misc_feature (295)..(298): n is a, c, g, or t
  misc_feature (301)..(301): n is a, c, g, or t
  misc_feature (304)..(305): n is a, c, g, or t
  misc_feature (307)..(308): n is a, c, g, or t
  misc_feature (310)..(313): n is a, c, g, or t
  misc_feature (316)..(321): n is a, c, g, or t
  misc_feature (323)..(326): n is a, c, g, or t
  misc_feature (330)..(333): n is a, c, g, or t
  misc_feature (337)..(338): n is a, c, g, or t
  misc_feature (340)..(340): n is a, c, g, or t
  misc_feature (342)..(345): n is a, c, g, or t
  misc_feature (349)..(356): n is a, c, g, or t
  misc_feature (358)..(359): n is a, c, g, or t
  misc_feature (362)..(375): n is a, c, g, or t
  misc_feature (377)..(395): n is a, c, g, or t
  misc_feature (399)..(403): n is a, c, g, or t
  misc_feature (406)..(406): n is a, c, g, or t
  misc_feature (412)..(427): n is a, c, g, or t
  misc_feature (429)..(430): n is a, c, g, or t
  misc_feature (432)..(433): n is a, c, g, or t
  misc_feature (435)..(437): n is a, c, g, or t
  misc_feature (442)..(452): n is a, c, g, or t
  misc_feature (2012)..(2012): n is a, c, g, or t
  misc_feature (2810)..(2810): n is a, c, g, or t
  misc_feature (2828)..(2828): n is a, c, g, or t
  misc_feature (3273)..(3273): n is a, c, g, or t
ggnngaaggannnnnnnnnnnaannannnannnannnaannaannannggttnggnnnnnnnnccnnnnnnnnnnnngnnnaannnnnnncnncnncngnancnnnnnnttnttnnnnnnnnnnnnnnnnnntttnnnaannaanccnnnnnnnnnnnnnggngnnggnnnnnnnnnnnnnttnnannntnnnnnngnnnnnnnnnnnnnnntnnnncnnnnnaaaannnnnnaannnnnnnaannnnnnnnnggnnnnnnnnnnnngnannaannannnnnnnngggnnaaggnnnnggnggnntnntnnnnggnnnnnngnnnntttnnnngggnnangnnnnaaannnnnnnncnnaannnnnnnnnnnnnnannnnnnnnnnnnnnnnnnntttnnnnnttngggggnnnnnnnnnnnnnnnntnntnntnnnaaaannnnnnnnnnnaaaaaaaaatgaaaaaggaagtaacgacgatatcgttcatactactacctctactactaccactactaccctagcgagctactttcttttctactaagcgttgacgtactcaactctcgactactacgtcttggcgcgtttccgatccgcctcttctgtcgcagtagtatttgtcggtctgattttgcgatgaggatagacgatgcgttcgccctctccagtgtattcgtactcgaacacgttgcgctgaggctgcgggttctttgtggagaagtaatcgatgtttgtgagcgcctcgtacgccgtcggacgacgctcgggatcgtatcgacacaactcttgaaaaacaaagagttcatcctcgtttgcaaacgtagaatcgagagacgtcgccgcgggttgtccttttgggtgttcgtccgggtaaaagacgtgcttggcccggttcaagtatgggtgatacttgaaatttggccactcgtcctctgtcggcgttcccttcaccttgacgatggcttctatttgctcctcgcaaaacatcgatctcggatcttctgctttcgggatgcccttgaacggcaccgccaacgtggcgagctcggcaaagatgcaccccgcggcccagatatcgacggcgcgcgtgtagtgtctcgcgcccaacaagagctcgggcgctcgataccacagcgtcaccacgggtccgttttcgtgcaacggacgaagaagactatccggatcgcaataccgcgccagtccaaagtctgcgattttcaccaccccgagttcgcttccgtcacccatgatgagcacgttctgcggcttgatgtctctgtgcatgatccagttggagtgcaagtagtgcaaaccgtgcaacagttgccatgcgacgctcttcaccattctcggatgaatcatccgtcttctcgccctgtgccaactcaaaattaccccgagatcatactcggcgtaatcgatcgccaacgacagagacgcctcttttttatccacgatgatgtggtgcaaacgcacgacatttacgtgtcgaaccgctcgaagcagcgtcgtctctcgaaacgtcggttgcgccatcccgatccgttggttccctttcgcctccccagtcttcgggtctcgctgaatcggtggtgttttaaattctttcaccgccaccgtgcgtcctaatatcaatcgtcgtcgtcgtcaacacgatacgtaaacgtcagtcagtcaatcacccggtgaagtcaaaaaaccagcgaacatcttattcctcatccatctaccaccgtgacgacgcatccacgcaccttttcgactcctagcaaagtgtacgaacccgaacgcgccctcaccgatgatcccgacgagctcgaaggcgtcgccgtcgtcgtcgacaaagacgggtgcgggcatgatgtcttcggtgcgaccgattgacgtctgcgctaccgctactgcgctcgttgacgtctgtccaatcgccatattctgtgtacgtttcaccgatcaatggtgggttaaatacagacacatccttagttttcatttacaatacgtgtnccaactgaatacacatagccaccattggcacgcgcgcgctcgacgtcgcgtttgaacggccgagtcgaccgagccgcccgcactccgcgcctcgcgtcgagggaccccgaccccgtcccgccgagtcgagagccgagcgagagcgaagcgtgtgagacgcgggcgcgcgcggaggcggcggaggaaacccgaggacgtgtttcggtcgacggactgacagacatggagaccgagggagaagatcgaagagaggaggacttcaacgcgatcgttgaagcggaagatgacgcggtggatcggagcgtgcacccgagtggaatcgtgccggtgttgcagtacgttgaatccgaggcgaaaaacgcgcgggaaacgcgacgcgtgagggcggaaggggcaagatctggggagaattggaaggggaatgttttccattttaaatgactcgaggcggctttggacgcacgattccgagttgaaactgacggttttcgcgcgctcataggaatattgtggcgactgtgaacttggattgcaagttggatctcaagacgatcgcgtttcacgcgagaaacgtcgaatacaacccaaaggtgaggcactttaaccaaccctagcgcgcgttgtcgcgtcgacgcgagcgacatttcgcggttgaatgcgcattctcacgagctctgactgacggtgaacatgcctcgttcgtttgaaaacacgcagcgtttcgcggcagccatcatgcggatccgtaatccaaagacgacggcgctgattttcagctcgggaaagatggtgtgcacnggtgccaagacagaggcnttggcgcgggaagcggcgagaaagtatgcgaaagtgatcatcaagctcggatttccggcgcaattcaaagattttaagattcagaacatggtgggctcgtgcgatgtgcagtttccgattagattggagggattagcgtggcagcacggtcacttcgcgcagtacgaaccggaactctttccgggcttgatttacagaatgcaaatgccaaagatagtccttctcatctttgtttcgggtaagattgttttgacgggtggtaagcgcagagaagatatttaccaggcgttcgagaacatttaccccgtgctgactgagtttaaaaagctggcgcagccagacgaagccggcgcgacggcgaaggcgctcccgagcgccaagggaggcaaggcaaaggcttgagaaggacggacgtccgcctacttaagcaaagaggcttacgacngcgtccggcgtccgaggaagcgggacgacatatcttttagacacacacacactcacatccacacgcgtacgatgacttattagactgttgctcgtcgagcgcgaactcgccggctcgacgccgagacgccgagaagggcgcggcgagtaaaacaaaaaaacaaaattagcgagcatgtattagacaaacaaaccaaacagtagacaaacaaacggggtcacgaaacgaaacgaaacgaaacgaaacgaaacgaaaccgacgattgaggacccgcgtggccagactagatttacggattgattaatctcatcacagtccaaacaaacaaacaatgactccacgcgcatctagtactctatccaaagattcggtatctaatgcgtgatcctagaccaccgcaaaatcaacacatcgatctaagtacgtataatacacgagatggatttcgtattgtcacccaatcgtgatcgacagacgtaccctttacataacataacgagaacacattcctccctaaacccaaatcgacgtacatcccttacaatatgagacccgccgcgtgtcgcctcgcccccgtcgcgcgctccctccctggcgaacgactcgcccgcgtccgtcggcagactcgcgcgcgcgcacccggtcaccgccgcacgccccccacacctcgatctccacgatgatggcgtccaccaccgtccgattatccgcgccgatcgcccaccgc

SEQ ID NO: 163 - DNA, 4000 bp, Escherichia coli
  misc_feature (132)..(132): n is a, c, g, or t
  misc_feature (726)..(726): n is a, c, g, or t
  misc_feature (1305)..(1305): n is a, c, g, or t
  misc_feature (1308)..(1308): n is a, c, g, or t
  misc_feature (1344)..(1344): n is a, c, g, or t
  misc_feature (1359)..(1359): n is a, c, g, or t
  misc_feature (1368)..(1368): n is a, c, g, or t
  misc_feature (1373)..(1373): n is a, c, g, or t
  misc_feature (1473)..(1473): n is a, c, g, or t
  misc_feature (2023)..(2023): n is a, c, g, or t
  misc_feature (2729)..(2729): n is a, c, g, or t
  misc_feature (3002)..(3002): n is a, c, g, or t
  misc_feature (3173)..(3173): n is a, c, g, or t
  misc_feature (3365)..(3365): n is a, c, g, or t
  misc_feature (3434)..(3434): n is a, c, g, or t
  misc_feature (3771)..(3771): n is a, c, g, or t
  misc_feature (3785)..(3785): n is a, c, g, or t
  misc_feature (3791)..(3791): n is a, c, g, or t
  misc_feature (3808)..(3808): n is a, c, g, or t
  misc_feature (3887)..(3887): n is a, c, g, or t
  misc_feature (3902)..(3902): n is a, c, g, or t
  misc_feature (3935)..(3935): n is a, c, g, or t
  misc_feature (3985)..(3985): n is a, c, g, or t
gtacggtcccggtgaagcattgaccaggagagcattttttgggagtattccagcacaagatgcctgtaatccggatcttcagcgcgatttataaattcttccggatcttcctgtaaatcaaacaaaagcggngggagagctgtcatgtggacatatttatagcactcatcacgtataacggttaacgaacattgatcaggagacaggccgaatttttgttcaatcatcggttgatacgaaccgatttcgcgaaaatcaaattcccaatgtgcctcctttctccagttatccggaacatttccgttaagcaaaggcaggagtgaacggccgtccagctcttgcggaatttctaaatccagccaatccagaatagtaggcatcacatcaattgcttcagtgaatacttctacctgattatcagcagtggaggattttccagatgtagaatcataaatttctggattacggatgatcagcggaattgcatacgatgcatcaaaatatccggcttttccaaataaatagtgatctccaagttgttctccgtgatcactcgtaaaaacaatcagtgtggattcatattgtcctgttttttttaaatacgaaataactcttcctaaatgatgatcaatttctgtcatcaatccgtaataggtggcacgtgcctgtaaaatatccttttcacttgtttctgcagcaagtccttcataagtatcagggaaaaantttttacctggaattattgtaagcaacattttgagcagtggatgctgttccccttcctgctccaaactcttcatcctgaccggtttggagacatcatcaggatcatacattgaattataaggttccggtgctatccacggaggatgcggacgcaaataagataaatgcgcaaaccagttctcatcttcacgtacacttaaccacttgagaagttcatcggtcaaaaaagcggcgctgctgtcttcatcagaatatactggtggaggaaaagtaacaccgcgtttttctgctccgggatagtttgcgacaggatagtaaactgtatgctcattcaacgagtgatcatatcccctcgatatcaactcggcaatccacggacgttgattgtctgttaaagtaactccgctgctcattccaggcatcagcccttcataagtggtcagtagcggatcttgctggtggaattcacgagggtctgcggaagtatctgtgtaaccgaacagggtaggatcgtatcctgattttcgtgcttctaaagcgatatttgtgaagcgcgcattcaaaggggttccgttattnacngaacggtgattcattgcgtacagccctgtgtataangaagcacgtgatggnccacagggnacagnctgagcataatgtttgcggaacaataccccctctcctgcaagttgatccagatacggagtctgtactacagggtgattaatacatcccagagtatcaccncgccattgatctgccataatgaataagacgtttttacgtttttttttcatcaattgtctgaaattacaatgcagcagggtttaggcttcttcgtccagcaggaattctttataatcgtcagcggataaaagttctgaggactcatcctgatttgacagttccaggcgaatcacccaaccttcgtcgtaacactcttcattaattatttcaggaccgtccttcaactcagtgttgactgcaatgatacgtccgctcatcggcataaaaagcgaggtgactgctttcaccgattcaattgaaccaaactcatctcctgcatcaatttcatcttcaatgtctggcaattcaacaaaaacgatgtcacccaatgctgtttgagcgtgatcagtgattccgacttctgctttgttaccttcaattcttacccactcgtggtctctagtgtatagattgtctttaggtattgtgctcataattcctcttttgaatgattaatgtaggttggcccggatatgctccgtgatccgcctgaataatttcatgctttccnataagttaatactaatttagccattgatagatataagtccagcaaaaaaaagcatattttttattttaacttttattttaaagaaaaaaatcaatggaagatacacataaagcaggatatgataaaagctatgaaaagacgttaaaataattttacatcaacaaggaatacaaaaatgttattagattttagaatactcgcgctgttatttttcactgttttgttttggactgcacctgcgaccgcgcaaaattctgatgatttagaacaaatgctgcgtgcttcaaaaacacgggcgatcctggtgcaaaatgtccagaaagctgttgtccatatcaaggtcgaaaaaattatgcgtaaccccaatggacaagctctcaacaatccaaaagatctttataatgatgagttcttccgcagatttttccctgaactacgtacacctaaaaaccaacagccaaaaaaacgtcaacagccaaagcgggatttccggcaggaaggcatgggttcaggttctatcatcgacagtaaaggatacattttaacgaaccatcatgtagtaggagaagcagacagaattttagttatactttatgacggcacagaaaaggaagcaaaacttgtaggtactgatccggagactgacattgcagtgattaaaatagtagggaacggcctgccggttttacctatgggtaattcagangaaattcttgttggtgaagatgtgattgcagtaggtaatccatttggactgattcaaaccgtgacctacggaattgtcagcgcaaagggccgttcaaatgtcggcataaacgaatacgagaattttatccaaactgatgccgcaattaatccgggcaacagcggtggtcctttggtcagtctgagtggagaaattgttggtgtgaacagcgcgatttataccagaagcggtggttatcaaggtattggctttgctgtacctattaacatggcncgtaaaatcatgcgggatttgatcgataaaggtaaagtttcaagaggctggctgggagtagggatacaggatgtgagtcaggatttggccaaagcatttcaactggaaaataccaaaggcagtttaatatccggtgttatgcagggtacgcctgctcaaaaagcagggatnctcaaaggtgatgtggtgattcgcatcaacgacaaatacatccgtgacagtaaccatctccgtaacgaaattgcaaatgcaggtgcgtttgctgaaatcgaaatggaacttatcagagacggaaaaaacatcctcataaaactgaagctggatgaacgtccaaggaaactttctcaggttaaagttgcaccncagccaataccggagattgaacaggtggagatgctgggaatggttgtggaagaacttaccgaagaaacngcaaagcaattcgggattgagtcaggaaccggaattgtgattgtagcagtcacacctggaagtgctgcggataaaacaggtttgcttccgggtatgattgtccaggaagtggagcggcaggcaattgttaatctcagcatatttaaagaactcgtcagtgaaatggatccggaaaaagggatattgctgctgatcacaacagcaaacggttcacgttatatttttctgcaggccgattgaaaaatatgagccatctgcagaagaagaccaaattgcactttgatcatttactgttgaaattgcatgagatgaatcaacaggttgctgttcctgagancatggattattacnctctgntggatgaaatgtcagcntattacaatttaactgccgaagaattacagactcgtggattccggaaagcatatcggcaggctgttgaagggctttgantaaaagctcctactncttctcattttactatgaccttagtctccgatntgtcatcagaaataataccactggctggactccgcattttggttactcgnaaagacactccggaa

SEQ ID NO: 164 - DNA, 4000 bp, Escherichia coli
  misc_feature (9)..(9): n is a, c, g, or t
  misc_feature (12)..(13): n is a, c, g, or t
  misc_feature (15)..(15): n is a, c, g, or t
  misc_feature (20)..(21): n is a, c, g, or t
  misc_feature (23)..(25): n is a, c, g, or t
  misc_feature (32)..(32): n is a, c, g, or t
  misc_feature (34)..(34): n is a, c, g, or t
  misc_feature (36)..(38): n is a, c, g, or t
  misc_feature (40)..(40): n is a, c, g, or t
  misc_feature (42)..(42): n is a, c, g, or t
  misc_feature (45)..(45): n is a, c, g, or t
  misc_feature (48)..(53): n is a, c, g, or t
  misc_feature (57)..(57): n is a, c, g, or t
  misc_feature (61)..(61): n is a, c, g, or t
  misc_feature (64)..(66): n is a, c, g, or t
  misc_feature (69)..(70): n is a, c, g, or t
  misc_feature (73)..(73): n is a, c, g, or t
  misc_feature (77)..(77): n is a, c, g, or t
  misc_feature (80)..(82): n is a, c, g, or t
  misc_feature (84)..(85): n is a, c, g, or t
  misc_feature (88)..(91): n is a, c, g, or t
  misc_feature (97)..(97): n is a, c, g, or t
  misc_feature (99)..(99): n is a, c, g, or t
  misc_feature (104)..(105): n is a, c, g, or t
  misc_feature (107)..(107): n is a, c, g, or t
  misc_feature (2472)..(2472): n is a, c, g, or t
  misc_feature (3418)..(3418): n is a, c, g, or t
ccgcaattnagnnanattgnngnnngattcantngnnnancnggnagnnnnnnacantttnaannntgnngtnctgngtnnnannccnnnntggatnanaaaannangcaaaaaaatactcctaaaattcaatgaatttcgggagtatttatttttaggcaaaacctcaaaaaacagcggatgcgcaggaaaaagcaccgacagcgtgatcgaagttgtaccctcccaaccgataacgcccgacggacaggataacgcccccgccgccggcatatctgtcgccgatactccgcccggcagtccttcaccggacagtattcccatgcaggatacaccctctgccgagccttatgtccaccggatgcccgactttctcaccgacagacagcgtactccgcccaaactaagcggaatgcccaaaagcatcagcatcaaagaggcaatgagagtactcggcggcaagctcgtcatcggaggcgtccccaagtccggcaacaaggacgatcccgatcctgaccaatccgaaaagcccaaaccatgggtatatagaatatgttgtttccaataataatttgagaacaatccaaatctttcaatatcaattttggtaatcatggtatttaaataaaattcacatctacatgtcttccattgaaaaaagcctgctctctatctcatacttaaacaaacctttcttccgtaattcctctactttaagcgcaaacaaatccggcttgaaatttttggattgtcttttcacctctgctaccagagcttttttctcttccgcatatagtccgacaatatctatttcatcctgatcttttttattcttgccttgccaccaagaacctatatctgcaaattccttgccttccatcatcttttggcggaaatacatttccaaagccaagccggagaatgtcggataatccttttttataatatcagccaagcgttcaaaattctgtatctctatataattttgatacttgataaaataccggaaccagaaacgtaaaaacatatccgatacttcataacggacggtctgggaaccctcctttgaaagtataggccgtttcttctttaccagattataatcttcttccaatctcttcaattgtccgcccagactcataccacccataaccgtttctatttccggcagggtattcttaccgttggagattgctgataagatagaaaagtaattaccgtatttttttccgaactcctgtaccagcaaagcctgtccttcagtcaaaaaggatgaatcgggttgcaacatgaaatcgaccatgctttccatacttgtacatccattgtccataaattgctcgatatattttggaacaccaccggtaaaggtatagagtgccaacaagtcatctttagtatagtcagccttatgatccgacataatttcttttaatacggaagttgtaaaaggtgctaactttataatactgtcagcacggccatacaacggttcttttgaatccctgaagattttattcataagggtatagaccgaaccactcacgataagattgacatggctctgtttcctcagccgatcccaagtatcctgcatcaaactgtaaatctcttgatttatgtaatagaactcctgaaattcatctataaccagattatattccagccgtgttcccaaatccattaagaaacgaaatatttctgcaaagttggtaagttccggtacataaatatcaagtgcctgctggatctcgaaagcaaagcgtaaacagagatctgtttcattgcttcggctgacaaacagatacaccgtaggagtatcctcacagctcttgaatataagactggtcttgccgatacgccgccgaccggtaagtacagtcatttgggaatgcacagaaaaagacactcgccgaaccttttccaatgatgctaactctttttctctattgtagaatttcatatccttttctttttatattcgatttcattggctttaagtttaccgccgtaaagtttacggcggtaaacttaaagccaataacaaagttactaataaatccgagaatataataggattaaagcatcgaaaacccaaaaaagagtagattcttcctgcaaaaacaacggaaccccataaaataatcccactccggcaattctaacaggcaattggcagagtgagattacttagtccggagaactgaattttatttgtaaaccttctcatcacaacaaacttaattttcagtgtttaccacaaaagaagaacaataaaattaaaaaatggtaattacgccaaactaatgagcgttttatcatctctaaacagtccatatattcaatatcaacatacttattgaataaataatatctattttattcaatacagtaatttaattgaataaaaagtgctattttataacctaaaatgatttacgatgaaaacaacgatacttaatcaacgggcanaacgtgacgagcttatgtcacgtccctatcaacaacggcataccaagtataatacagacgagctattacaaaatccgcttatcaaacttatcacgggtcctcgacgtgtaggcaaatcggtttttgcgctgctcatgctacaaggaaagaatttcgcctatctaaatttcgacgacaaccagttacttgataaatgggatgaagatttggtcatgtcggccattgaagatgtatatcccggttacgatttcattttgcttgacggagttcagaatcttcccgactgggatttatggataggtaaactgtatcgtcgtggaaagaatttggtaattacaggaagcaatgccaagatgttgagcagcgaaatggcaactgtcttaaccggacgttaccttcaaattgaaatgttgccattcagtctggaagaaacgatgagctggaaaaatatcagtctgcttcgagaggaacaagctgcacaggcaaccatgctgatcgatgactatatgcgcaatggtggctatcttgaaaccatttctgcccgtagcattaccaaaagctatctttcgactttatttgattcaatcttgctgaaagatattaccaagcgacataatataagaaatacaaacgatttatataatctagccagttatctgctctcaaatttctgcaatccaatttcagcgaatgaccttgcgagagaattaggtttgtcaagcgttgcaactacaaagaaattctgcgactatctcagcgaaccatacctgttcttctatctgccccgtttcaacaacaagctgaaattgatgaacaaagcccccaaaaaagtttatgtagttgacaatggatttgtgcaaagcacggctttcaatctgagtgagaacctcggcagattattggagaatcaagtatttgtagaactattacgtcgtggttatatccnaggtcaaacattattctattaccgaagtcgcaatgacagagaaatagattttgttacccgtaaaggcacaatggtggagcagctgattcaagtgtgctacgacatgacctctgagaaaacccgcaagcgtgaacttgacgctcttgttgaggtagccggagaactccattgcgacaatctccttgttgtcaccaatgaccaacaagaaaaaattaattggaaaggcaaaaaggtttcaattattccaatttataaatataaataagaacgatatggatatcataaccaaagaaggtgaaacacctgcattgtttgtaaattcaatcacatttaataatggagaaacaataaaaataaataagaacgacatagttgaattgtcggtcctaataatgctggaaaaagtcaatcattaaaagatatttatgcttgtatagctaatcaacaccataagattgtaataaaggacatagatcttacttttcagaattcggataatgatgtcgcttttattgaatcttgttcaacgcaatcaaagaattcaacaagtggatatatatatattcaggtataaactattat

SEQ ID NO: 165 - DNA, 4000 bp, Escherichia coli
  misc_feature (1975)..(1990): n is a, c, g, or t
  misc_feature (1992)..(2001): n is a, c, g, or t
  misc_feature (2003)..(2004): n is a, c, g, or t
  misc_feature (2052)..(2065): n is a, c, g, or t
  misc_feature (2067)..(2070): n is a, c, g, or t
  misc_feature (2073)..(2080): n is a, c, g, or t
  misc_feature (2128)..(2135): n is a, c, g, or t
  misc_feature (2137)..(2145): n is a, c, g, or t
  misc_feature (2147)..(2149): n is a, c, g, or t
  misc_feature (2151)..(2151): n is a, c, g, or t
  misc_feature (2153)..(2163): n is a, c, g, or t
  misc_feature (2165)..(2166): n is a, c, g, or t
  misc_feature (2168)..(2169): n is a, c, g, or t
  misc_feature (2171)..(2171): n is a, c, g, or t
  misc_feature (2173)..(2174): n is a, c, g, or t
  misc_feature (2177)..(2183): n is a, c, g, or t
  misc_feature (2185)..(2185): n is a, c, g, or t
  misc_feature (2188)..(2189): n is a, c, g, or t
  misc_feature (2192)..(2194): n is a, c, g, or t
  misc_feature (2197)..(2201): n is a, c, g, or t
  misc_feature (2203)..(2205): n is a, c, g, or t
  misc_feature (2207)..(2209): n is a, c, g, or t
  misc_feature (2211)..(2213): n is a, c, g, or t
  misc_feature (2215)..(2218): n is a, c, g, or t
  misc_feature (2221)..(2233): n is a, c, g, or t
  misc_feature (2281)..(2281): n is a, c, g, or t
  misc_feature (2283)..(2283): n is a, c, g, or t
  misc_feature (2285)..(2287): n is a, c, g, or t
  misc_feature (2289)..(2294): n is a, c, g, or t
  misc_feature (2296)..(2297): n is a, c, g, or t
  misc_feature (2299)..(2301): n is a, c, g, or t
  misc_feature (2303)..(2316): n is a, c, g, or t
  misc_feature (2319)..(2319): n is a, c, g, or t
  misc_feature (2322)..(2322): n is a, c, g, or t
  misc_feature (2327)..(2327): n is a, c, g, or t
  misc_feature (2331)..(2336): n is a, c, g, or t
  misc_feature (2342)..(2342): n is a, c, g, or t
  misc_feature (2346)..(2347): n is a, c, g, or t
  misc_feature (2351)..(2354): n is a, c, g, or t
  misc_feature (2358)..(2361): n is a, c, g, or t
  misc_feature (2363)..(2366): n is a, c, g, or t
  misc_feature (2368)..(2369): n is a, c, g, or t
  misc_feature (2372)..(2379): n is a, c, g, or t
  misc_feature (2382)..(2393): n is a, c, g, or t
  misc_feature (2396)..(2396): n is a, c, g, or t
  misc_feature (2399)..(2399): n is a, c, g, or t
  misc_feature (2404)..(2404): n is a, c, g, or t
  misc_feature (2408)..(2413): n is a, c, g, or t
  misc_feature (2419)..(2419): n is a, c, g, or t
  misc_feature (2423)..(2424): n is a, c, g, or t
  misc_feature (2428)..(2431): n is a, c, g, or t
  misc_feature (2434)..(2434): n is a, c, g, or t
  misc_feature (2437)..(2438): n is a, c, g, or t
  misc_feature (2440)..(2442): n is a, c, g, or t
  misc_feature (2444)..(2446): n is a, c, g, or t
  misc_feature (2449)..(2451): n is a, c, g, or t
  misc_feature (2454)..(2456): n is a, c, g, or t
  misc_feature (2458)..(2459): n is a, c, g, or t
  misc_feature (2461)..(2469): n is a, c, g, or t
  misc_feature (2471)..(2481): n is a, c, g, or t
  misc_feature (2485)..(2492): n is a, c, g, or t
  misc_feature (2495)..(2496): n is a, c, g, or t
  misc_feature (2499)..(2501): n is a, c, g, or t
  misc_feature (2504)..(2507): n is a, c, g, or t
  misc_feature (2509)..(2510): n is a, c, g, or t
  misc_feature (2512)..(2521): n is a, c, g, or t
  misc_feature (2523)..(2524): n is a, c, g, or t
  misc_feature (2527)..(2533): n is a, c, g, or t
  misc_feature (2535)..(2546): n is a, c, g, or t
  misc_feature (2548)..(2549): n is a, c, g, or t
  misc_feature (2551)..(2552): n is a, c, g, or t
  misc_feature (2554)..(2554): n is a, c, g, or t
  misc_feature (2556)..(2557): n is a, c, g, or t
  misc_feature (2562)..(2566): n is a, c, g, or t
  misc_feature (2568)..(2568): n is a, c, g, or t
  misc_feature (2572)..(2573): n is a, c, g, or t
  misc_feature (2576)..(2577): n is a, c, g, or t
  misc_feature (2581)..(2584): n is a, c, g, or t
  misc_feature (2586)..(2594): n is a, c, g, or t
  misc_feature (2596)..(2598): n is a, c, g, or t
  misc_feature (2600)..(2602): n is a, c, g, or t
  misc_feature (2604)..(2606): n is a, c, g, or t
  misc_feature (2608)..(2613): n is a, c, g, or t
  misc_feature (2615)..(2619): n is a, c, g, or t
  misc_feature (2621)..(2621): n is a, c, g, or t
  misc_feature (2623)..(2624): n is a, c, g, or t
  misc_feature (2626)..(2627): n is a, c, g, or t
  misc_feature (2629)..(2630): n is a, c, g, or t
  misc_feature (2632)..(2632): n is a, c, g, or t
  misc_feature (2634)..(2634): n is a, c, g, or t
  misc_feature (2640)..(2644): n is a, c, g, or t
  misc_feature (2649)..(2650): n is a, c, g, or t
  misc_feature (2655)..(2655): n is a, c, g, or t
  misc_feature (2657)..(2657): n is a, c, g, or t
  misc_feature (2661)..(2663): n is a, c, g, or t
  misc_feature (2665)..(2668): n is a, c, g, or t
  misc_feature (2670)..(2679): n is a, c, g, or t
  misc_feature (2682)..(2682): n is a, c, g, or t
  misc_feature (2684)..(2689): n is a, c, g, or t
  misc_feature (2691)..(2701): n is a, c, g, or t
  misc_feature (2703)..(2703): n is a, c, g, or t
  misc_feature (2706)..(2707): n is a, c, g, or t
  misc_feature (2709)..(2710): n is a, c, g, or t
  misc_feature (2712)..(2713): n is a, c, g, or t
  misc_feature (2716)..(2721): n is a, c, g, or t
  misc_feature (2724)..(2724): n is a, c, g, or t
  misc_feature (2727)..(2729): n is a, c, g, or t
  misc_feature (2732)..(2734): n is a, c, g, or t
  misc_feature (2736)..(2737): n is a, c, g, or t
  misc_feature (2741)..(2752): n is a, c, g, or t
  misc_feature (2755)..(2755): n is a, c, g, or t
  misc_feature (2757)..(2758): n is a, c, g, or t
  misc_feature (2760)..(2774): n is a, c, g, or t
  misc_feature (2779)..(2782): n is a, c, g, or t
  misc_feature (2785)..(2793): n is a, c, g, or t
  misc_feature (2795)..(2798): n is a, c, g, or t
  misc_feature (2800)..(2802): n is a, c, g, or t
  misc_feature (2805)..(2806): n is a, c, g, or t
  misc_feature (2809)..(2817): n is a, c, g, or t
  misc_feature (2819)..(2819): n is a, c, g, or t
  misc_feature (2821)..(2821): n is a, c, g, or t
  misc_feature (2823)..(2824): n is a, c, g, or t
  misc_feature (2826)..(2826): n is a, c, g, or t
  misc_feature (2829)..(2832): n is a, c, g, or t
  misc_feature (2834)..(2834): n is a, c, g, or t
  misc_feature (2837)..(2843): n is a, c, g, or t
  misc_feature (2845)..(2851): n is a, c, g, or t
  misc_feature (2853)..(2854): n is a, c, g, or t
  misc_feature (2856)..(2857): n is a, c, g, or t
  misc_feature (2859)..(2859): n is a, c, g, or t
  misc_feature (2862)..(2864): n is a, c, g, or t
  misc_feature (2866)..(2867): n is a, c, g, or t
  misc_feature (2870)..(2871): n is a, c, g, or t
  misc_feature (2874)..(2875): n is a, c, g, or t
  misc_feature (2877)..(2877): n is a, c, g, or t
  misc_feature (2879)..(2880): n is a, c, g, or t
  misc_feature (2882)..(2882): n is a, c, g, or t
  misc_feature (2886)..(2894): n is a, c, g, or t
  misc_feature (2896)..(2900): n is a, c, g, or t
  misc_feature (2902)..(2908): n is a, c, g, or t
  misc_feature (2910)..(2924): n is a, c, g, or t
  misc_feature (2926)..(2934): n is a, c, g, or t
  misc_feature (2936)..(2944): n is a, c, g, or t
  misc_feature (2947)..(2954): n is a, c, g, or t
  misc_feature (2957)..(2957): n is a, c, g, or t
  misc_feature (2959)..(2959): n is a, c, g, or t
  misc_feature (2962)..(2963): n is a, c, g, or t
  misc_feature (2966)..(2966): n is a, c, g, or t
  misc_feature (2969)..(2970): n is a, c, g, or t
  misc_feature (2972)..(2976): n is a, c, g, or t
  misc_feature (2978)..(2986): n is a, c, g, or t
  misc_feature (2988)..(2989): n is a, c, g, or t
  misc_feature (2991)..(2992): n is a, c, g, or t
  misc_feature (2995)..(3003): n is a, c, g, or t
  misc_feature (3005)..(3005): n is a, c, g, or t
  misc_feature (3008)..(3008): n is a, c, g, or t
  misc_feature (3010)..(3011): n is a, c, g, or t
  misc_feature (3013)..(3015): n is a, c, g, or t
  misc_feature (3017)..(3018): n is a, c, g, or t
  misc_feature (3020)..(3030): n is a, c, g, or t
  misc_feature (3032)..(3036): n is a, c, g, or t
  misc_feature (3040)..(3041): n is a, c, g, or t
  misc_feature (3043)..(3043): n is a, c, g, or t
  misc_feature (3045)..(3047): n is a, c, g, or t
  misc_feature (3050)..(3053): n is a, c, g, or t
  misc_feature (3055)..(3055): n is a, c, g, or t
  misc_feature (3057)..(3058): n is a, c, g, or t
  misc_feature (3060)..(3070): n is a, c, g, or t
  misc_feature (3072)..(3075): n is a, c, g, or t
  misc_feature (3077)..(3085): n is a, c, g, or t
  misc_feature (3088)..(3088): n is a, c, g, or t
  misc_feature (3090)..(3091): n is a, c, g, or t
  misc_feature (3093)..(3102): n is a, c, g, or t
  misc_feature (3104)..(3105): n is a, c, g, or t
  misc_feature (3107)..(3107): n is a, c, g, or t
  misc_feature (3111)..(3112): n is a, c, g, or t
  misc_feature (3116)..(3118): n is a, c, g, or t
  misc_feature (3120)..(3121): n is a, c, g, or t
  misc_feature (3124)..(3130): n is a, c, g, or t
  misc_feature (3132)..(3133): n is a, c, g, or t
  misc_feature (3137)..(3137): n is a, c, g, or t
  misc_feature (3139)..(3140): n is a, c, g, or t
  misc_feature (3142)..(3144): n is a, c, g, or t
  misc_feature (3146)..(3162): n is a, c, g, or t
  misc_feature (3165)..(3165): n is a, c, g, or t
  misc_feature (3167)..(3176): n is a, c, g, or t
  misc_feature (3179)..(3180): n is a, c, g, or t
  misc_feature (3183)..(3183): n is a, c, g, or t
  misc_feature (3185)..(3190): n is a, c, g, or t
  misc_feature (3192)..(3199): n is a, c, g, or t
  misc_feature (3201)..(3201): n is a, c, g, or t
  misc_feature (3204)..(3208): n is a, c, g, or t
  misc_feature (3210)..(3212): n is a, c, g, or t
  misc_feature (3214)..(3227): n is a, c, g, or t
  misc_feature (3229)..(3231): n is a, c, g, or t
  misc_feature (3233)..(3256): n is a, c, g, or t
  misc_feature (3258)..(3261): n is a, c, g, or t
  misc_feature (3266)..(3272): n is a, c, g, or t
  misc_feature (3274)..(3294): n is a, c, g, or t
  misc_feature (3298)..(3306): n is a, c, g, or t
  misc_feature (3308)..(3312): n is a, c, g, or t
  misc_feature (3314)..(3318): n is a, c, g, or t
  misc_feature (3320)..(3333): n is a, c, g, or t
  misc_feature (3335)..(3336): n is a, c, g, or t
  misc_feature (3338)..(3340): n is a, c, g, or t
  misc_feature (3342)..(3349): n is a, c, g, or t
  misc_feature (3351)..(3352): n is a, c, g, or t
  misc_feature (3354)..(3354): n is a, c, g, or t
  misc_feature (3356)..(3363): n is a, c, g, or t
  misc_feature (3365)..(3374): n is a, c, g, or t
  misc_feature (3376)..(3379): n is a, c, g, or t
  misc_feature (3381)..(3383): n is a, c, g, or t
  misc_feature (3385)..(3389): n is a, c, g, or t
  misc_feature (3391)..(3403): n is a, c, g, or t
  misc_feature (3405)..(3405): n is a, c, g, or t
  misc_feature (3407)..(3407): n is a, c, g, or t
  misc_feature (3409)..(3409): n is a, c, g, or t
  misc_feature (3411)..(3411): n is a, c, g, or t
  misc_feature (3414)..(3424): n is a, c, g, or t
  misc_feature (3426)..(3430): n is a, c, g, or t
  misc_feature (3433)..(3434): n is a, c, g, or t
  misc_feature (3436)..(3438): n is a, c, g, or t
  misc_feature (3440)..(3440): n is a, c, g, or t
  misc_feature (3442)..(3442): n is a, c, g, or t
  misc_feature (3444)..(3445): n is a, c, g, or t
  misc_feature (3447)..(3454): n is a, c, g, or t
  misc_feature (3456)..(3457): n is a, c, g, or t
  misc_feature (3460)..(3460): n is a, c, g, or t
  misc_feature (3462)..(3462): n is a, c, g, or t
  misc_feature (3464)..(3468): n is a, c, g, or t
  misc_feature (3470)..(3484): n is a, c, g, or t
  misc_feature (3486)..(3486): n is a, c, g, or t
  misc_feature (3489)..(3491): n is a, c, g, or t
  misc_feature (3493)..(3494): n is a, c, g, or t
  misc_feature (3496)..(3500): n is a, c, g, or t
  misc_feature (3502)..(3503): n is a, c, g, or t
  misc_feature (3505)..(3506): n is a, c, g, or t
  misc_feature (3508)..(3513): n is a, c, g, or t
  misc_feature (3515)..(3520): n is a, c, g, or t
  misc_feature (3522)..(3524): n is a, c, g, or t
  misc_feature (3526)..(3532): n is a, c, g, or t
  misc_feature (3534)..(3535): n is a, c, g, or t
  misc_feature (3537)..(3537): n is a, c, g, or t
  misc_feature (3539)..(3544): n is a, c, g, or t
  misc_feature (3546)..(3564): n is a, c, g, or t
  misc_feature (3566)..(3570): n is a, c, g, or t
  misc_feature (3572)..(3582): n is a, c, g, or t
  misc_feature (3584)..(3585): n is a, c, g, or t
  misc_feature (3588)..(3596): n is a, c, g, or t
  misc_feature (3598)..(3599): n is a, c, g, or t
  misc_feature (3602)..(3603): n is a, c, g, or t
  misc_feature (3605)..(3608): n is a, c, g, or t
  misc_feature (3611)..(3624): n is a, c, g, or t
  misc_feature (3626)..(3636): n is a, c, g, or t
  misc_feature (3639)..(3641): n is a, c, g, or t
  misc_feature (3643)..(3645): n is a, c, g, or t
  misc_feature (3647)..(3651): n is a, c, g, or t
  misc_feature (3654)..(3658): n is a, c, g, or t
  misc_feature (3660)..(3675): n is a, c, g, or t
  misc_feature (3677)..(3678): n is a, c, g, or t
  misc_feature (3680)..(3685): n is a, c, g, or t
  misc_feature (3687)..(3693): n is a, c, g, or t
  misc_feature (3695)..(3704): n is a, c, g, or t
  misc_feature (3706)..(3708): n is a, c, g, or t
  misc_feature (3710)..(3715): n is a, c, g, or t
  misc_feature (3717)..(3717): n is a, c, g, or t
  misc_feature (3720)..(3720): n is a, c, g, or t
  misc_feature (3724)..(3728): n is a, c, g, or t
  misc_feature (3730)..(3731): n is a, c, g, or t
  misc_feature (3733)..(3735): n is a, c, g, or t
  misc_feature (3737)..(3744): n is a, c, g, or t
  misc_feature (3747)..(3756): n is a, c, g, or t
  misc_feature (3758)..(3760): n is a, c, g, or t
  misc_feature (3762)..(3765): n is a, c, g, or t
  misc_feature (3767)..(3767): n is a, c, g, or t
  misc_feature (3769)..(3771): n is a, c, g, or t
  misc_feature (3773)..(3774): n is a, c, g, or t
  misc_feature (3776)..(3790): n is a, c, g, or t
  misc_feature (3792)..(3797): n is a, c, g, or t
  misc_feature (3799)..(3813): n is a, c, g, or t
  misc_feature (3815)..(3820): n is a, c, g, or t
  misc_feature (3822)..(3831): n is a, c, g, or t
  misc_feature (3833)..(3837): n is a, c, g, or t
  misc_feature (3839)..(3847): n is a, c, g, or t
  misc_feature (3849)..(3849): n is a, c, g, or t
  misc_feature (3851)..(3859): n is a, c, g, or t
  misc_feature (3861)..(3865): n is a, c, g, or t
  misc_feature (3867)..(3867): n is a, c, g, or t
  misc_feature (3870)..(3876): n is a, c, g, or t
  misc_feature (3878)..(3878): n is a, c, g, or t
  misc_feature (3880)..(3880): n is a, c, g, or t
  misc_feature (3882)..(3884): n is a, c, g, or t
  misc_feature (3886)..(3888): n is a, c, g, or t
  misc_feature (3890)..(3891): n is a, c, g, or t
  misc_feature (3893)..(3898): n is a, c, g, or t
  misc_feature (3900)..(3902): n is a, c, g, or t
  misc_feature (3904)..(3905): n is a, c, g, or t
  misc_feature (3907)..(3907): n is a, c, g, or t
  misc_feature (3909)..(3912): n is a, c, g, or t
  misc_feature (3914)..(3914): n is a, c, g, or t
  misc_feature (3916)..(3916): n is a, c, g, or t
  misc_feature (3918)..(3927): n is a, c, g, or t
  misc_feature (3929)..(3930): n is a, c, g, or t
  misc_feature (3932)..(3949): n is a, c, g, or t
  misc_feature (3952)..(3952): n is a, c, g, or t
  misc_feature (3954)..(3968): n is a, c, g, or t
  misc_feature (3970)..(3976): n is a, c, g, or t
  misc_feature (3978)..(3980): n is a, c, g, or t
  misc_feature (3982)..(3985): n is a, c, g, or t
  misc_feature (3987)..(3990): n is a, c, g, or t
  misc_feature (3993)..(3994): n is a, c, g, or t
  misc_feature (3996)..(4000): n is a, c, g, or t
cgtatacaggaaatagaaaatcctgaattggctcaagaacgaatgaaagaactttatgagcaaaaaggttatcctaaagattggattgataagcgtttaaggggaattgctattagacaaaatctaactgatgaatggaaggaaagaggtattactgagaaaagtgattatgcaatacttacagccgaaatatctaaagcaacttttggcttaactccttctgaatacaaaaagtataagggattgatgaagaagaatcagaatttgcgtgatcatatgtctgacttagaacttatttttacgatgttgggtgagcgtgtaacaacagaaatttctcaaaaagaaaaaccggatacgtttattgagaataagcaggttgcacaaagaggaggaaatgtagctggagttgctcgtgagcaagcggaaaaagaattagggagaagtattgtatctaatcagaattttttgcttggttctgaattggatacaagtgaacctcaattgcctttcgatactgatgacgaataggggataaatgcttaattagaatttaccatgattaaaaagacattttattttggaaatccagtgtatctctcattaaagaatgcacagttagtaattaaacttccggagattgtgaaaaatgagtcattgccagagacatttaaacagcaatcagaagtaactaagccaatagaagatattggaattgttgttttggatcataagcaaattactataacttcgggagtgctagaagcattattagagaataattgtgctgtaataacttgtgattgtaaaagtatgcctgtaggtttaatgcttcctttatatggaaattcaacccaaaatgaaaggtttaggatgcagctggatgcttctcttcctttaaaaaaacagctatggcagcaaacaatgaaagcaaagatagaaaatcaggcttcagtgctatatacttgtaaaaaagaggaagtaaagtgtatgaaagtttgggcgaatgatgtgaaaagtggtgatcctgataatttggaagctcgtgctgccgcttattactggaagtgtatgttttcggacattgaagggttcacacgggaaagagaagggataccacctaataatttattaaattatggctatgcaattcttcgggcaatagtagctcgtgctttggtaacgagtggacttttacctactttgggaattcatcatcataatcgttataatgcttactgtttggcggatgatgtaatggagccttaccgaccgtatgtagatgaacttgtgtattctattgtaaaagggcatgagaactatgatgagttaacaaaagatttaaaaactattttattgaatattccaacgttagaagtaatgataaatgggaaaagaagtccgttgatggttgctgtagcacaaacgacagcttcactttataaatgttttactggagagcttcgtcgtattatttatcctgagaagtaatggatcgttttagtgaatatcgtattatgtggatattagtgctttttgacttgccaacagaaactaaaaaagataaaaaggcttatatcgattttagaaagaatttacagaaagatggttttactatgtttcaattttctatttatgttcgtcattgtgcaagtagtgagaatgctgaggttcatataaaaagaataaaatcatttttgccagaatatggtcaggttggaataatgtgcataactgataagcaatttgagaatattgaactcttttatgggaagaaaatattatctgttaatacaccaggacaacaattagagttattttgaataaaaaatcccgtaagactacgggattttttaatgaatttacagctcattttctttttctatattgtgatctaacttattgaaatacagcggctaatggcgattgtgctgtattcaatggttcaaagatactaatttgaaagcaaatcacaacnnnnnnnnnnnnnnnntnnnnnnnnnnanngctgtattcaatggttcaaagatactaatttgaaagcaaatcacaacnnnnnnnnnnnnnntnnnnttnnnnnnnngctgtattcaatggttcaaagatactaatttgaaagcaaatcacaacnnnnnnnngnnnnnnnnntnnntnannnnnnnnnnntnnanngntnnaannnnnnnanttnnaannnaannnnnannntnnncnnncnnnnacnnnnnnnnnnnnngctgtattcaatggttcaaagatactaatttgaaagcaaatcacaacngnannntnnnnnntnntnnngnnnnnnnnnnnnnnttnaanggttnaaannnnnnaatttnaaannaaannnnaacnnnntnnnntnnttnnnnnnnnttnnnnnnnnnnnnttnaanggttnaaannnnnnaatttnaaannaaannnnaanatnntnnntnnngtnnntannntnngnnnnnnnnntnnnnnnnnnnnaaannnnnnnnttnnaannnaannnnanncnnnnnnnnnncnntcnnnnnnntnnnnnnnnnnnntnnanngntnnaaaannnnnantttnnaannaaannnnannnnnnnnntnnntnnnannntnnnnnntnnnnntntnntnnanngntnaaaaannnnnatttnnaaaananacannnannnngnnnnnnnnnnaantnnnnnntnnnnnnnnnnnantanntnntnnaannnnnnaanttnnnaannnannacannnnnnnnnnnnatntnntnnnnnnnnnnnnnnntttannnnatnnnnnnnnnannnntnnntgnnaannnnnnnnnancntnnanttnnnnanctnnnnnnntnnnnnnntnnanncnatnnntnnaannaanntnanngnaaannnnnnnnnannnnncnnnnnnnannnnnnnnnnnnnnngnnnnnnnnncnnnnnnnnnaannnnnnnnatngnaanncanacnnannnnncnnnnnnnnnanngnntgnnnnnnnnntnttnanncnnngnntnnnnnnnnnnnannnnnaagnnanannnaannnngntnntnnnnnnnnnnntnnnncnnnnnnnnnaancnntnnnnnnnnnntnntnaatnngaannnanncannnnnnntnntttncnntnnnannnnnnnnnnnnnnnnnaancnnnnnnnnnnaannatnannnnnnannnnnnnnanttnnnnngnnntnnnnnnnnnnnnnntnnntnnnnnnnnnnnnnnnnnnnnnnnnannnnaaaannnnnnnannnnnnnnnnnnnnnnnnnnnttgnnnnnnnnnannnnncnnnnntnnnnnnnnnnnnnnanntnnncnnnnnnnnanncngnnnnnnnncnnnnnnnnnnannnncnnntnnnnnannnnnnnnnnnnncnanantnaannnnnnnnnnntnnnnncannannnancngnntnnnnnnnnannggnancnnnnnannnnnnnnnnnnnnnantannnannannnnntnnannannnnnntnnnnnnannngnnnnnnntnnanannnnnntnnnnnnnnnnnnnnnnnnnannnnnannnnnnnnnnngnnaannnnnnnnnannganngnnnnatnnnnnnnnnnnnnnannnnnnnnnnnaannnannntnnnnnaannnnntnnnnnnnnnnnnnnnntnntnnnnnnannnnnnnannnnnnnnnngnnnannnnnncnaanattnnnnnanntnnncnnnnnnnnaannnnnnnnnngnnntnnnnantnnngnntnnnnnnnnnnnnnnnannnnnnannnnnnnnnnnnnnnannnnnnannnnnnnnnntnnnnntnnnnnnnnnanannnnnnnnntnnnnncnaannnnnnnanancnnntnnnanntnnnnnnannntnntncnnnngntnannnnnnnnnntnnannnnnnnnnnnnnnnnnnttnannnnnnnnnnnnnnnannnnnnntnnngnnnntnnnnatnntnnnnn

SEQ ID NO: 166 - DNA, 4000 bp, Escherichia coli
  misc_feature (1196)..(1196): n is a, c, g, or t
  misc_feature (1400)..(1400): n is a, c, g, or t
  misc_feature (3622)..(3622): n is a, c, g, or t
  misc_feature (3663)..(3663): n is a, c, g, or t
  misc_feature (3675)..(3675): n is a, c, g, or t
agaaaaaagaggatcttgtagtgatactgaaacaatcgatgagactcgagtaatgatgacttgtaacctccctttaaatgaaattttggttgattttaatgatcggttaaaaagtgttacccatggctatggttctatggactatgatatggcggattatgttgaatcctctcttgtacgaatggaaattcttgtaaacgccgaaccagtagatgctttttcaactattgtacacaaggataaggccgagaaccggggtagggtgctatgttctaaattaaaggatatcctgcctcgacaattatttaagatcgccctgcaagcatcggtgggagggaaatttattgcccgtgagactatcagtgcaatgcgtaaagatgttacggccaaatgttacggtggggatatctctcgtaaaagaaaattgttagaaaaacaaaaagaaggaaagaagcgaatgaaacagattggtaatgtgaacattcctcaggaagcattcgtgcaaattttgaaaagctcaacctgatcaattatttatgaccgagaaaataaaagcgaaaagatctcagaaaaagggagcgaaagaaattctacgccttgggcaaaaagccctagactacagaagggatatattgagtattgatcaagttacaagattagagtctgcaactagtgagttaaaaaatgttttgggaaataagacaatttatatagacgaactcgaagaaaaagcagaaaaagtagacattgaattaaaagaatctggtggactctactatcacaagaaagggtgggttgaaaatgtggagatgcttatggtggcggccattgtggtgattggaatcagaagcttttttttacagcctttcattattcccactaattcaatgtatccttccttttttggcatgcagcccaacttatatgaagaggaaaatgaggttcctagcttattggaaagaagtatagataaagtcctcttgggggcatcgcattatcgattaaatgttgaaagtgcaggaaatttatatttggttttgcaaaatgggggaagtttccgatttgccgaagccacttttccgaatggtcgattctttctatttcccaatacggttaaagaatatgtttttgaagtgggaggaaaagaacatacactccaagttcctgctgaattcgattttgataccttgatcgcnaaaaaattcgcggggattgagagtttacgtgacctccctttgatcgtaagccaagaccaagggtttaccgggaatagactaaaattatctaatcagaattatcaaaaaggagatatagcaatcgcgtttgatattttattgggagatgccttattcgtggatcgaatgtcttataattttattacgcctaaatcgggagatccngccgttttccgcaccggttcaattgatgaatttaacagaaagattggtacaccggtccgaaattttattggggaagataaatattatattaaacgcttaattggagaacccggtgatcgtttagagatgaaagttcctgactcaatcttcacaaacggaacggatgttcgtaaaggagtacccggagttctttaccgtaatgagaaaccaatttcaggaaaagttgcttttgatgaaaatcgaaaacgtgcagaaagtttatcaaatgatcccaatgccaagaacccgatgaattatcctggttaccgatcagaaggcttactttcgaaccgcgaagttattactgtccctcaaaaagacgatgtaacaaaccctactggatttaatggatattttatgatgggagataattcaactgatagtttagatggtcgtgcttggggatttgtacctgaaaacgaaattattggacgtgcgtttgtcgtttattatccatttacaaagagatggggtttctccaactaatacatccctgtagacattatagcagtatgacatatttcgcacaatatggattatgtctaattgcgtaatctgtgagttcccttaggcatttaccaagttggttagattctcgtagttcgggagtcttactccatgtcacatcattgccaggtgattttgggattgggaatttagggaagtcttcattcgagtttatcgattttttaaatgtggctggatttagattttggcaaatttgtccagtaggtccaactggttatggtgactccccgtaccaagtattttcctcttctgcaggaaacccctatttgattgattggcatgctcttattgatttaaaaatgataaggcttgatgatctaggttcactacagagtaatccggatcatgatgtaaattatggtcatctttatgaacatttttataccgctgcctcaattgccttttctaattttgtgcaaagtggtgaaagtattgaatctaaatacggaaagtttgatctttttattgaagaaaataaaagttggttagagccctactgctgttatcaggccctcaagaagtccgctctgaataagccttggtggcaatgggataagaatgttaggaaatttagtgcatcgattttagagggtttatcgagtgcacagcttgaaacttataatcttcatttatttctccaatatatatttttctcacagtggaaggagttacggacttacgctcacaaaaaagaagttcaaatccttggggatttaccaatctatgttgctccagactcagctgatgtatgggaaaagcctgaactttttcaagtggatacaaacggagcgggattttcgcatgtagcaggagttcctccagactattttaatgaagatggtcaatattggggaaatccactgtacgactggcccgttcacaaggcagacggttaccaatggtggattaagcgtttggagtcgcaattatccctttttgatgtggttcgaattgatcactttaggggatttcatgattattggagtattccggcagatacttcagatgcaaaggcaggtaaatgggagaacggtcctggaattgatttttggaatgtggttgcaaaatatttccctaccctcccctttttagctgaagatttaggtttgatcaccaagggggttcgatctcttcgagaaagcgctggattaccgggaatggcagttttacagtttgcattcgatggcgatcctgaaaatctttatctaccgcataacttatccccggacctcgttctctacacaggtactcatgataatgatactacctgtggttggtatcattcaactgatgatgaaattcgcgggaattttaggagttactttaatattccgggcgatttcccatcttgggatatgttaaggatggcataccgtacgactgctcaattggtgatcattccaatgcaggatttgctcagtctgggttctgaagcacgcctcaatgaaccaggccattcatttggaaattggacatggcgaatgagtccatggcaacttaagaatatttcagttgaatgttctgcatatctaagaaatcaagctgaaatatcaggtagactagcaaagaagagtgtcgcttcgatcgcaaaattatcctagattaatcacttcacaggcttaatttgaaaagactatttccatactttctattantaaagccctattggtttgccttccttattgcattggtatgnggcgtcatttanggagtctcaagtggatttggtctgccttatatgatcgatcaagtctttcctataatatttcctggtgaaaaattggatgtgcggttaagcacatgggaattatttatgtatatttcttggttcccccttgtctttatcattcgcggtacaagtagctattttaattcttactttattaattattgtggaatccgggtacttgagaaaatcagatttcaggtcttcggaaagcttcagcgcctacctatttctttctttcatcgcaatcaggagggtgaccttcttagtcgaatgatctcagacactggtcagttacaggctgcca

SEQ ID NO: 167 - DNA, 4000 bp, Escherichia coli
  misc_feature (791)..(791): n is a, c, g, or t
  misc_feature (2447)..(2447): n is a, c, g, or t
  misc_feature (2461)..(2461): n is a, c, g, or t
  misc_feature (2469)..(2469): n is a, c, g, or t
  misc_feature (2473)..(2473): n is a, c, g, or t
  misc_feature (2477)..(2477): n is a, c, g, or t
  misc_feature (2479)..(2479): n is a, c, g, or t
  misc_feature (2483)..(2483): n is a, c, g, or t
  misc_feature (2490)..(2490): n is a, c, g, or t
  misc_feature (2494)..(2494): n is a, c, g, or t
  misc_feature (2496)..(2496): n is a, c, g, or t
  misc_feature (2506)..(2506): n is a, c, g, or t
  misc_feature (2511)..(2511): n is a, c, g, or t
  misc_feature (2514)..(2514): n is a, c, g, or t
  misc_feature (2516)..(2516): n is a, c, g, or t
  misc_feature (2518)..(2518): n is a, c, g, or t
  misc_feature (2520)..(2520): n is a, c, g, or t
  misc_feature (2526)..(2526): n is a, c, g, or t
  misc_feature (2534)..(2534): n is a, c, g, or t
  misc_feature (2537)..(2538): n is a, c, g, or t
  misc_feature (2540)..(2540): n is a, c, g, or t
  misc_feature (2542)..(2542): n is a, c, g, or t
  misc_feature (2544)..(2544): n is a, c, g, or t
  misc_feature (2546)..(2547): n is a, c, g, or t
  misc_feature (2549)..(2550): n is a, c, g, or t
  misc_feature (2553)..(2553): n is a, c, g, or t
  misc_feature (2555)..(2555): n is a, c, g, or t
  misc_feature (2559)..(2559): n is a, c, g, or t
  misc_feature (2565)..(2565): n is a, c, g, or t
  misc_feature (2569)..(2569): n is a, c, g, or t
  misc_feature (2583)..(2583): n is a, c, g, or t
  misc_feature (2585)..(2586): n is a, c, g, or t
  misc_feature (2590)..(2590): n is a, c, g, or t
  misc_feature (2594)..(2595): n is a, c, g, or t
  misc_feature (2597)..(2597): n is a, c, g, or t
  misc_feature (2603)..(2603): n is a, c, g, or t
  misc_feature (2606)..(2606): n is a, c, g, or t
  misc_feature (2626)..(2626): n is a, c, g, or t
  misc_feature (2629)..(2629): n is a, c, g, or t
  misc_feature (2635)..(2643): n is a, c, g, or t
  misc_feature (2645)..(2645): n is a, c, g, or t
  misc_feature (2647)..(2653): n is a, c, g, or t
  misc_feature (2655)..(2655): n is a, c, g, or t
  misc_feature (2657)..(2657): n is a, c, g, or t
  misc_feature (2660)..(2660): n is a, c, g, or t
  misc_feature (2666)..(2666): n is a, c, g, or t
  misc_feature (2668)..(2668): n is a, c, g, or t
  misc_feature (2671)..(2673): n is a, c, g, or t
  misc_feature (2675)..(2676): n is a, c, g, or t
  misc_feature (2680)..(2683): n is a, c, g, or t
  misc_feature (2685)..(2685): n is a, c, g, or t
  misc_feature (2688)..(2688): n is a, c, g, or t
  misc_feature (2690)..(2691): n is a, c, g, or t
  misc_feature (2694)..(2694): n is a, c, g, or t
  misc_feature (2697)..(2697): n is a, c, g, or t
  misc_feature (2703)..(2705): n is a, c, g, or t
  misc_feature (2707)..(2707): n is a, c, g, or t
  misc_feature (2709)..(2710): n is a, c, g, or t
  misc_feature (2713)..(2713): n is a, c, g, or t
  misc_feature (2715)..(2715): n is a, c, g, or t
  misc_feature (2717)..(2717): n is a, c, g, or t
  misc_feature (2719)..(2721): n is a, c, g, or t
  misc_feature (2723)..(2726): n is a, c, g, or t
  misc_feature (2732)..(2734): n is a, c, g, or t
  misc_feature (2736)..(2738): n is a, c, g, or t
  misc_feature (2742)..(2744): n is a, c, g, or t
  misc_feature (2747)..(2747): n is a, c, g, or t
  misc_feature (2749)..(2750): n is a, c, g, or t
  misc_feature (2753)..(2753): n is a, c, g, or t
  misc_feature (2755)..(2755): n is a, c, g, or t
  misc_feature (2757)..(2757): n is a, c, g, or t
  misc_feature (2764)..(2766): n is a, c, g, or t
  misc_feature (2771)..(2772): n is a, c, g, or t
  misc_feature (2776)..(2777): n is a, c, g, or t
  misc_feature (2780)..(2782): n is a, c, g, or t
  misc_feature (2785)..(2785): n is a, c, g, or t
  misc_feature (2787)..(2788): n is a, c, g, or t
  misc_feature (2790)..(2790): n is a, c, g, or t
  misc_feature (2792)..(2795): n is a, c, g, or t
  misc_feature (2798)..(2800): n is a, c, g, or t
  misc_feature (2802)..(2805): n is a, c, g, or t
  misc_feature (2807)..(2809): n is a, c, g, or t
  misc_feature (2814)..(2816): n is a, c, g, or t
  misc_feature (2821)..(2825): n is a, c, g, or t
  misc_feature (2827)..(2827): n is a, c, g, or t
  misc_feature (2829)..(2833): n is a, c, g, or t
  misc_feature (2837)..(2837): n is a, c, g, or t
  misc_feature (2839)..(2841): n is a, c, g, or t
  misc_feature (2843)..(2845): n is a, c, g, or t
  misc_feature (2847)..(2847): n is a, c, g, or t
  misc_feature (2849)..(2849): n is a, c, g, or t
  misc_feature (2851)..(2853): n is a, c, g, or t
  misc_feature (2856)..(2857): n is a, c, g, or t
  misc_feature (2859)..(2860): n is a, c, g, or t
  misc_feature (2863)..(2863): n is a, c, g, or t
  misc_feature (2867)..(2869): n is a, c, g, or t
  misc_feature (2871)..(2872): n is a, c, g, or t
  misc_feature (2875)..(2876): n is a, c, g, or t
  misc_feature (2879)..(2879): n is a, c, g, or t
  misc_feature (2883)..(2883): n is a, c, g, or t
  misc_feature (2885)..(2885): n is a, c, g, or t
  misc_feature (2887)..(2892): n is a, c, g, or t
  misc_feature (2898)..(2898): n is a, c, g, or t
  misc_feature (2900)..(2900): n is a, c, g, or t
  misc_feature (2902)..(2908): n is a, c, g, or t
  misc_feature (2910)..(2910): n is a, c, g, or t
  misc_feature (2912)..(2912): n is a, c, g, or t
  misc_feature (2916)..(2916): n is a, c, g, or t
  misc_feature (2918)..(2921): n is a, c, g, or t
  misc_feature (2924)..(2924): n is a, c, g, or t
  misc_feature (2931)..(2931): n is a, c, g, or t
  misc_feature (2933)..(2934): n is a, c, g, or t
  misc_feature (2937)..(2938): n is a, c, g, or t
  misc_feature (2941)..(2943): n is a, c, g, or t
  misc_feature (2945)..(2945): n is a, c, g, or t
  misc_feature (2948)..(2950): n is a, c, g, or t
  misc_feature (2952)..(2952): n is a, c, g, or t
  misc_feature (2955)..(2955): n is a, c, g, or t
  misc_feature (2958)..(2964): n is a, c, g, or t
  misc_feature (2966)..(2966): n is a, c, g, or t
  misc_feature (2968)..(2973): n is a, c, g, or t
  misc_feature (2975)..(2976): n is a, c, g, or t
  misc_feature (2980)..(2980): n is a, c, g, or t
  misc_feature (2982)..(2985): n is a, c, g, or t
  misc_feature (2989)..(2994): n is a, c, g, or t
  misc_feature (2996)..(2996): n is a, c, g, or t
  misc_feature (2998)..(2998): n is a, c, g, or t
  misc_feature (3000)..(3000): n is a, c, g, or t
  misc_feature (3002)..(3004): n is a, c, g, or t
  misc_feature (3006)..(3008): n is a, c, g, or t
  misc_feature (3010)..(3013): n is a, c, g, or t
  misc_feature (3017)..(3017): n is a, c, g, or t
  misc_feature (3020)..(3020): n is a, c, g, or t
  misc_feature (3023)..(3023): n is a, c, g, or t
  misc_feature (3029)..(3029): n is a, c, g, or t
  misc_feature (3031)..(3033): n is a, c, g, or t
  misc_feature (3035)..(3039): n is a, c, g, or t
  misc_feature (3041)..(3041): n is a, c, g, or t
  misc_feature (3043)..(3044): n is a, c, g, or t
  misc_feature (3046)..(3049): n is a, c, g, or t
  misc_feature (3051)..(3057): n is a, c, g, or t
  misc_feature (3059)..(3062): n is a, c, g, or t
  misc_feature (3064)..(3067): n is a, c, g, or t
  misc_feature (3070)..(3071): n is a, c, g, or t
  misc_feature (3076)..(3076): n is a, c, g, or t
  misc_feature (3078)..(3079): n is a, c, g, or t
  misc_feature (3081)..(3081): n is a, c, g, or t
  misc_feature (3085)..(3088): n is a, c, g, or t
  misc_feature (3090)..(3090): n is a, c, g, or t
  misc_feature (3092)..(3098): n is a, c, g, or t
  misc_feature (3100)..(3101): n is a, c, g, or t
  misc_feature (3103)..(3103): n is a, c, g, or t
  misc_feature (3105)..(3107): n is a, c, g, or t
  misc_feature (3110)..(3112): n is a, c, g, or t
  misc_feature (3114)..(3116): n is a, c, g, or t
  misc_feature (3121)..(3122): n is a, c, g, or t
  misc_feature (3124)..(3126): n is a, c, g, or t
  misc_feature (3128)..(3130): n is a, c, g, or t
  misc_feature (3133)..(3139): n is a, c, g, or t
  misc_feature (3143)..(3143): n is a, c, g, or t
  misc_feature (3145)..(3145): n is a, c, g, or t
  misc_feature (3148)..(3148): n is a, c, g, or t
  misc_feature (3150)..(3151): n is a, c, g, or t
  misc_feature (3153)..(3156): n is a, c, g, or t
  misc_feature (3158)..(3158): n is a, c, g, or t
  misc_feature (3161)..(3162): n is a, c, g, or t
  misc_feature (3164)..(3164): n is a, c, g, or t
  misc_feature (3168)..(3169): n is a, c, g, or t
  misc_feature (3172)..(3178): n is a, c, g, or t
  misc_feature (3180)..(3182): n is a, c, g, or t
  misc_feature (3186)..(3186): n is a, c, g, or t
  misc_feature (3189)..(3190): n is a, c, g, or t
  misc_feature (3193)..(3195): n is a, c, g, or t
  misc_feature (3197)..(3198): n is a, c, g, or t
  misc_feature (3200)..(3202): n is a, c, g, or t
  misc_feature (3204)..(3208): n is a, c, g, or t
  misc_feature (3210)..(3210): n is a, c, g, or t
  misc_feature (3212)..(3216): n is a, c, g, or t
  misc_feature (3218)..(3218): n is a, c, g, or t
  misc_feature (3220)..(3222): n is a, c, g, or t
  misc_feature (3225)..(3226): n is a, c, g, or t
  misc_feature (3228)..(3231): n is a, c, g, or t
  misc_feature (3235)..(3238): n is a, c, g, or t
  misc_feature (3240)..(3240): n is a, c, g, or t
  misc_feature (3243)..(3250): n is a, c, g, or t
  misc_feature (3253)..(3256): n is a, c, g, or t
  misc_feature (3259)..(3260): n is a, c, g, or t
  misc_feature (3262)..(3262): n is a, c, g, or t
  misc_feature (3264)..(3265): n is a, c, g, or t
  misc_feature (3267)..(3268): n is a, c, g, or t
  misc_feature (3270)..(3272): n is a, c, g, or t
  misc_feature (3275)..(3275): n is a, c, g, or t
  misc_feature (3278)..(3279): n is a, c, g, or t
  misc_feature (3281)..(3282): n is a, c, g, or t
  misc_feature (3284)..(3287): n is a, c, g, or t
  misc_feature (3289)..(3289): n is a, c, g, or t
  misc_feature (3291)..(3291): n is a, c, g, or t
  misc_feature (3294)..(3294): n is a, c, g, or t
  misc_feature (3298)..(3299): n is a, c, g, or t
  misc_feature (3303)..(3303): n is a, c, g, or t
  misc_feature (3305)..(3305): n is a, c, g, or t
  misc_feature (3307)..(3307): n is a, c, g, or t
  misc_feature (3309)..(3311): n is a, c, g, or t
  misc_feature (3313)..(3315): n is a, c, g, or t
  misc_feature (3319)..(3321): n is a, c, g, or t
  misc_feature (3323)..(3324): n is a, c, g, or t
  misc_feature (3327)..(3327): n is a, c, g, or t
  misc_feature (3330)..(3330): n is a, c, g, or t
  misc_feature (3332)..(3337): n is a, c, g, or t
  misc_feature (3344)..(3346): n is a, c, g, or t
  misc_feature (3348)..(3350): n is a, c, g, or t
  misc_feature (3352)..(3352): n is a, c, g, or t
  misc_feature (3360)..(3361): n is a, c, g, or t
  misc_feature (3363)..(3363): n is a, c, g, or t
  misc_feature (3367)..(3369): n is a, c, g, or t
  misc_feature (3373)..(3374): n is a, c, g, or t
  misc_feature (3381)..(3381): n is a, c, g, or t
  misc_feature (3385)..(3389): n is a, c, g, or t
  misc_feature (3391)..(3394): n is a, c, g, or t
  misc_feature (3396)..(3396): n is a, c, g, or t
  misc_feature (3400)..(3400): n is a, c, g, or t
  misc_feature (3409)..(3411): n is a, c, g, or t
  misc_feature (3414)..(3414): n is a, c, g, or t
  misc_feature (3418)..(3419): n is a, c, g, or t
  misc_feature (3421)..(3421): n is a, c, g, or t
  misc_feature (3423)..(3423): n is a, c, g, or t
  misc_feature (3426)..(3427): n is a, c, g, or t
  misc_feature (3430)..(3430): n is a, c, g, or t
  misc_feature (3433)..(3433): n is a, c, g, or t
  misc_feature (3435)..(3435): n is a, c, g, or t
  misc_feature (3438)..(3441): n is a, c, g, or t
  misc_feature (3444)..(3445): n is a, c, g, or t
  misc_feature (3450)..(3450): n is a, c, g, or t
  misc_feature (3452)..(3453): n is a, c, g, or t
  misc_feature (3455)..(3459): n is a, c, g, or t
  misc_feature (3462)..(3462): n is a, c, g, or t
  misc_feature (3464)..(3465): n is a, c, g, or t
  misc_feature (3467)..(3468): n is a, c, g, or t
  misc_feature (3471)..(3473): n is a, c, g, or t
  misc_feature (3475)..(3475): n is a, c, g, or t
  misc_feature (3478)..(3478): n is a, c, g, or t
  misc_feature (3482)..(3483): n is a, c, g, or t
  misc_feature (3486)..(3486): n is a, c, g, or t
  misc_feature (3490)..(3492): n is a, c, g, or t
  misc_feature (3494)..(3495): n is a, c, g, or t
  misc_feature (3497)..(3498): n is a, c, g, or t
  misc_feature (3502)..(3502): n is a, c, g, or t
  misc_feature (3506)..(3508): n is a, c, g, or t
  misc_feature (3512)..(3515): n is a, c, g, or t
  misc_feature (3519)..(3519): n is a, c, g, or t
  misc_feature (3521)..(3523): n is a, c, g, or t
  misc_feature (3527)..(3534): n is a, c, g, or t
  misc_feature (3536)..(3537): n is a, c, g, or t
  misc_feature (3539)..(3539): n is a, c, g, or t
  misc_feature (3541)..(3541): n is a, c, g, or t
  misc_feature (3544)..(3544): n is a, c, g, or t
  misc_feature (3548)..(3550): n is a, c, g, or t
  misc_feature (3557)..(3559): n is a, c, g, or t
  misc_feature (3561)..(3563): n is a, c, g, or t
  misc_feature (3565)..(3566): n is a, c, g, or t
  misc_feature (3570)..(3570): n is a, c, g, or t
  misc_feature (3572)..(3572): n is a, c, g, or t
  misc_feature (3574)..(3574): n is a, c, g, or t
  misc_feature (3576)..(3578): n is a, c, g, or t
  misc_feature (3580)..(3582): n is a, c, g, or t
  misc_feature (3586)..(3587): n is a, c, g, or t
  misc_feature (3591)..(3591): n is a, c, g, or t
  misc_feature (3595)..(3598): n is a, c, g, or t
  misc_feature (3600)..(3601): n is a, c, g, or t
  misc_feature (3610)..(3610): n is a, c, g, or t
  misc_feature (3612)..(3615): n is a, c, g, or t
  misc_feature (3619)..(3623): n is a, c, g, or t
  misc_feature (3625)..(3625): n is a, c, g, or t
  misc_feature (3627)..(3627): n is a, c, g, or t
  misc_feature (3629)..(3629): n is a, c, g, or t
  misc_feature (3631)..(3631): n is a, c, g, or t
  misc_feature (3633)..(3633): n is a, c, g, or t
  misc_feature (3637)..(3637): n is a, c, g, or t
  misc_feature (3639)..(3641): n is a, c, g, or t
  misc_feature (3645)..(3645): n is a, c, g, or t
  misc_feature (3648)..(3648): n is a, c, g, or t
  misc_feature (3650)..(3652): n is a, c, g, or t
  misc_feature (3659)..(3659): n is a, c, g, or t
  misc_feature (3665)..(3665): n is a, c, g, or t
  misc_feature (3667)..(3667): n is a, c, g, or t
  misc_feature (3671)..(3671): n is a, c, g, or t
  misc_feature (3678)..(3684): n is a, c, g, or t
  misc_feature (3686)..(3686): n is a, c, g, or t
  misc_feature (3688)..(3688): n is a, c, g, or t
  misc_feature (3690)..(3690): n is a, c, g, or t
  misc_feature (3693)..(3693): n is a, c, g, or t
  misc_feature (3698)..(3698): n is a, c, g, or t
  misc_feature (3701)..(3702): n is a, c, g, or t
  misc_feature (3704)..(3704): n is a, c, g, or t
  misc_feature (3706)..(3710): n is a, c, g, or t
  misc_feature (3715)..(3716): n is a, c, g, or t
  misc_feature (3719)..(3722): n is a, c, g, or t
  misc_feature (3724)..(3724): n is a, c, g, or t
  misc_feature (3726)..(3726): n is a, c, g, or t
  misc_feature (3728)..(3729): n is a, c, g, or t
  misc_feature (3732)..(3732): n is a, c, g, or t
  misc_feature (3735)..(3735): n is a, c, g, or t
  misc_feature (3737)..(3737): n is a, c, g, or t
  misc_feature (3739)..(3740): n is a, c, g, or t
  misc_feature (3742)..(3742): n is a, c, g, or t
  misc_feature (3745)..(3746): n is a, c, g, or t
  misc_feature (3748)..(3748): n is a, c, g, or t
  misc_feature (3751)..(3751): n is a, c, g, or t
  misc_feature (3753)..(3753): n is a, c, g, or t
  misc_feature (3756)..(3756): n is a, c, g, or t
  misc_feature (3758)..(3758): n is a, c, g, or t
  misc_feature (3761)..(3765): n is a, c, g, or t
  misc_feature (3769)..(3770): n is a, c, g, or t
  misc_feature (3772)..(3774): n is a, c, g, or t
  misc_feature (3776)..(3776): n is a, c, g, or t
  misc_feature (3784)..(3785): n is a, c, g, or t
  misc_feature (3788)..(3788): n is a, c, g, or t
  misc_feature (3790)..(3795): n is a, c, g, or t
  misc_feature (3798)..(3798): n is a, c, g, or t
  misc_feature (3800)..(3800): n is a, c, g, or t
  misc_feature (3802)..(3804): n is a, c, g, or t
  misc_feature (3806)..(3806): n is a, c, g, or t
  misc_feature (3808)..(3808): n is a, c, g, or t
  misc_feature (3810)..(3815): n is a, c, g, or t
  misc_feature (3818)..(3818): n is a, c, g, or t
  misc_feature (3820)..(3820): n is a, c, g, or t
  misc_feature (3825)..(3827): n is a, c, g, or t
  misc_feature (3829)..(3829): n is a, c, g, or t
  misc_feature (3834)..(3834): n is a, c, g, or t
  misc_feature (3837)..(3837): n is a, c, g, or t
  misc_feature (3839)..(3839): n is a, c, g, or t
  misc_feature (3841)..(3841): n is a, c, g, or t
  misc_feature (3844)..(3845): n is a, c, g, or t
  misc_feature (3848)..(3848): n is a, c, g, or t
  misc_feature (3850)..(3852): n is a, c, g, or t
  misc_feature (3855)..(3855): n is a, c, g, or t
  misc_feature (3857)..(3857): n is a, c, g, or t
  misc_feature (3859)..(3859): n is a, c, g, or t
  misc_feature (3865)..(3865): n is a, c, g, or t
  misc_feature (3867)..(3867): n is a, c, g, or t
  misc_feature (3869)..(3869): n is a, c, g, or t
  misc_feature (3877)..(3877): n is a, c, g, or t
  misc_feature (3879)..(3880): n is a, c, g, or t
  misc_feature (3886)..(3886): n is a, c, g, or t
  misc_feature (3888)..(3888): n is a, c, g, or t
  misc_feature (3890)..(3890): n is a, c, g, or t
  misc_feature (3892)..(3892): n is a, c, g, or t
  misc_feature (3894)..(3895): n is a, c, g, or t
  misc_feature (3901)..(3901): n is a, c, g, or t
  misc_feature (3904)..(3904): n is a, c, g, or t
  misc_feature (3912)..(3912): n is a, c, g, or t
  misc_feature (3915)..(3916): n is a, c, g, or t
  misc_feature (3919)..(3919): n is a, c, g, or t
  misc_feature (3926)..(3927): n is a, c, g, or t
  misc_feature (3939)..(3942): n is a, c, g, or t
  misc_feature (3945)..(3945): n is a, c, g, or t
  misc_feature (3947)..(3949): n is a, c, g, or t
  misc_feature (3951)..(3951): n is a, c, g, or t
  misc_feature (3954)..(3963): n is a, c, g, or t
  misc_feature (3967)..(3967): n is a, c, g, or t
  misc_feature (3969)..(3971): n is a, c, g, or t
  misc_feature (3977)..(3977): n is a, c, g, or t
  misc_feature (3980)..(3980): n is a, c, g, or t
  misc_feature (3982)..(3982): n is a, c, g, or t
  misc_feature (3985)..(3985): n is a, c, g, or t
  misc_feature (3987)..(3991): n is a, c, g, or t
  misc_feature (3993)..(3993): n is a, c, g, or t
  misc_feature (3995)..(3995): n is a, c, g, or t
  misc_feature (3997)..(4000): n is a, c, g, or t
tcgcagttaagcatgcttatgccattgcactaacctcatgatttccgaccatgattagcataccttcgtgctcctccgttactctttgggaggagaccgccccagtcaaactacccaccacacagtgtcctcgatccggattacggacctgagttagaacctcaaacataccagggtggtatttcaaggatggctccactaagacttgcgtcccagtttcaaagcctcccacctatcctacacaaataggttcaaagttcactgtgaagctatagtaaaggttcacggggtctttccgtctagccgcggatacactgcatcttaacagcgatttcaatttcactgagtctcgggtggagacagtgtggccgtcgttacgccattcgtgcaggtcggaacttacccgacaaggaatttcgctaccttaggaccgttatagttacggccgccgtttaccggggcttcgatcaagagcttcgccgaagctaaccccatcaattaaccttccggcaccgggcaggcgtcacaccgtatacgtccactttcgtgtttgcacagtgctgtgtttttaataaacagtcgcagccacctggtatcttcggccgccaacagcttagggagcaagtcccatcaccatcagcggcgtaccttctcccgaagttacggtaccattttgcctagttccttcacccgagttctctcaagcgccttggtattctctacctgaccacctgtgtcggtttggggtacggtcactcaatacctgatgcttagaagcttttcctggaagnatggcatcaaccacttcagtcctaatggacctcgtcatcacgcctcagccttaagggagtccggatttacctaaactcccagcctacacgcttaaacacggacaaccaacgccgtgctggactagccttctccgtccctccttcgcaatattgagtggtgcaggaatattaacctgcttcccatcgactacgctcttcagcctcgccttaggggccgactcaccctaccctgattagcattggataggaaaccttggtcttccggcgggggagcttttcactccccttatcgttactcatgtcagcattcgcacttctgatacctccaggatgcctctcagctttcccttcaacggcctacagaacgctcctctaccacgcatgcaagcatgcgtccgtagcttcggtggtatgtttgagccccgttatatcttccgcgcaggccgattcgactagtgagctattacgctttctttaaaggatggctgcttctaagccaacctcctagctgtctaaaccttcccacatcgtttcccacttaacatacactttgggaccttagctgacggtctgggttgtttccctttccacgacggacgttagcacccgccgtgtgtctcccgtgattgcactcattggtattcggagtttgcatcgggttggtaagtcgggatgaccccctagccgaaacagtgctctacccccaatggtgagacacgaggcgctacctaaatagctttcgaggagaaccagctatctccgggcttgattagcctttcactccgacccacagctcatccccgcatttttcaacatacgtgggttcggtcctccagttgatgttactcaaccttcaacctggccatgggtagatcgcccggtttcgggtctaatcctagcaactatacgccctattaagactcggtttccctacgcctcccctattcggttaagcttgctactaaaattaagtcgctgacccattatacaaaaggtacgcagtcaccgaataaatcggctcccactgcttgtacgtacacggtttcaggatctatttcactcccctcacaggggttcttttcgcctttccctcacggtactggttcactatcggtcagtcaggagtatttagccttggaggatggtccccccatgttcagtcaagatttctcgtgtcccgacctactcgttttcacctaaaatgccttttcgcgtacggggctatcacccactatggcgtaactttccagctacttccgctaaaacataataaacttaagggctaatccccgttcgctcgccgctactaggggaatctcaattgatttcttttcctcggggtacttagatgtttcagttctcccggttcgcctcttatacctatgtattcagtataagatacccagcttacgctgggtgggtttccccattcggatatctctggatcataggttgtttaccaccttcccaaagcttttcgcaggttaccacgtccttcatcgcctctgactgcctaggcatccaccgtgcacgcttattcacttgaccatataacccaaaagggtcgcagtaattctgacaaattaccttcaatcaaatttacgataaaccctatcactagggccttcggataagtcgctcgataaaacacatatnagttaattagaaantgaataantaantgtntnttanctaaacnttgntncaacgtgatngctanaanangntncaacgnttggtttnaanncnancncnngnnacnangtgnttaaanactnattaacttcatggntnngggncaanncnttaatnganatcacaaatccatttttttnaanagcagnnnnnnnnnangnnnnnnngncnttnaccatnanggnnnanntacnnnngnccncnntcnttnatcaannnantnnttntnancnnntnnnnggtggnnntnnntttnnngangnnatncngncccaggnnnccctnnggcnnccnnnttncnncntnnnnccnnncnnnnannncaaannngtgannnnncncnnnnnggtnannntnnncncntnnnttnnannccnctcnnntnntgnnacnggcngngnnnnnnaggccngngnnnnnnntnancgcnannnnctnattcgcnannacnngcnnntncgnnntnacnaannnnnnntncnnnnnncnntccngnnnncgannnnnntncngngnnngnnncnnnntcgnggnttngcaacncnnngnnnnntncnntnnnncnnnnnnntnnnncnnnncannagggncnngntgannnnangnnnnnnncnncntnnnccnnntnnncaccnncnnncnnnttnnnnnnnccancnttntnngnnnncnaannangacnnggnnnnnnntnnntacnggnnttnnncnnannncnnnnnanannnnntnannncanncnnnnagcnnnngncannnnnnnnccnnnngcnncnanntnncnnnagnaanntnncnnnntntnaanaccnngtangntntnnngnnntgcnnngnnttnaancnnnnnntccaccnnntnnncnggcccccnncnattnnnttgnnttttaancttnnnnncnnnntncccnggcggtctnnntancgcnntngnttnnccnctnanggnnnnagnnccccnanngnnnnnagncnncnnttnnngngtngacnnccngggnnncnnannctgnttgnnncccnnnntttngnnnctcnnnnnnnntnncnanccngggnnncgccttnnncnnngnngttncntncnnnannnacgnntttnaccnnnncnnaggaaattncnnnncccnnnnntntncncnantttncnnntttnggntnnnattcctnggttgngnccanggctttnnnnnnncncntnacnaaccnccnncncnnnnnttacnnccnnnnantncnnttnacncntnnanccnncntantnccncngcnnnnngcanngnnntngccggtgnntcntnnnnnngtnangnnncngngnnnnnntantnaacannntnctttnctncncnctnnaantnnnttncnanccgaangncntcttcacncnngcggcntngntncnncagggnttnccccattntgnnatnttccccnntgctgcctcccnnnngantnnngnccnnnnnnnnnntccngnnnggctgntcntnctntnnnnncngntnnnn

SEQ ID NO: 168 - DNA, 4000 bp, Escherichia coli
  misc_feature (1357)..(1357): n is a, c, g, or t
  misc_feature (2863)..(2864): n is a, c, g, or t
  misc_feature (2867)..(2868): n is a, c, g, or t
  misc_feature (2874)..(2874): n is a, c, g, or t
  misc_feature (2876)..(2877): n is a, c, g, or t
  misc_feature (2883)..(2883): n is a, c, g, or t
  misc_feature (2887)..(2888): n is a, c, g, or t
  misc_feature (2890)..(2894): n is a, c, g, or t
  misc_feature (2896)..(2897): n is a, c, g, or t
  misc_feature (2899)..(2901): n is a, c, g, or t
  misc_feature (2906)..(2908): n is a, c, g, or t
  misc_feature (2910)..(2911): n is a, c, g, or t
  misc_feature (2913)..(2913): n is a, c, g, or t
  misc_feature (2915)..(2922): n is a, c, g, or t
  misc_feature (2929)..(2929): n is a, c, g, or t
  misc_feature (2931)..(2932): n is a, c, g, or t
  misc_feature (2934)..(2937): n is a, c, g, or t
  misc_feature (2939)..(2939): n is a, c, g, or t
  misc_feature (2941)..(2942): n is a, c, g, or t
  misc_feature (2944)..(2947): n is a, c, g, or t
  misc_feature (2949)..(2949): n is a, c, g, or t
  misc_feature (2952)..(2955): n is a, c, g, or t
  misc_feature (2957)..(2957): n is a, c, g, or t
  misc_feature (2959)..(2959): n is a, c, g, or t
  misc_feature (2963)..(2964): n is a, c, g, or t
  misc_feature (2970)..(2970): n is a, c, g, or t
  misc_feature (2975)..(2980): n is a, c, g, or t
  misc_feature (2982)..(2984): n is a, c, g, or t
  misc_feature (2987)..(2988): n is a, c, g, or t
  misc_feature (2990)..(2992): n is a, c, g, or t
  misc_feature (2994)..(2996): n is a, c, g, or t
  misc_feature (2998)..(2998): n is a, c, g, or t
  misc_feature (3001)..(3001): n is a, c, g, or t
  misc_feature (3003)..(3003): n is a, c, g, or t
  misc_feature (3006)..(3009): n is a, c, g, or t
  misc_feature (3016)..(3020): n is a, c, g, or t
  misc_feature (3024)..(3025): n is a, c, g, or t
  misc_feature (3028)..(3031): n is a, c, g, or t
  misc_feature (3034)..(3034): n is a, c, g, or t
  misc_feature (3038)..(3040): n is a, c, g, or t
  misc_feature (3043)..(3047): n is a, c, g, or t
  misc_feature (3049)..(3049): n is a, c, g, or t
  misc_feature (3052)..(3054): n is a, c, g, or t
  misc_feature (3057)..(3057): n is a, c, g, or t
  misc_feature (3059)..(3060): n is a, c, g, or t
  misc_feature (3062)..(3062): n is a, c, g, or t
  misc_feature (3064)..(3064): n is a, c, g, or t
  misc_feature (3067)..(3071): n is a, c, g, or t
  misc_feature (3074)..(3075): n is a, c, g, or t
  misc_feature (3079)..(3080): n is a, c, g, or t
  misc_feature (3083)..(3083): n is a, c, g, or t
  misc_feature (3086)..(3087): n is a, c, g, or t
  misc_feature (3089)..(3090): n is a, c, g, or t
  misc_feature (3093)..(3095): n is a, c, g, or t
  misc_feature (3097)..(3097): n is a, c, g, or t
  misc_feature (3100)..(3102): n is a, c, g, or t
  misc_feature (3106)..(3107): n is a, c, g, or t
  misc_feature (3109)..(3115): n is a, c, g, or t
  misc_feature (3117)..(3121): n is a, c, g, or t
  misc_feature (3123)..(3123): n is a, c, g, or t
  misc_feature (3125)..(3125): n is a, c, g, or t
  misc_feature (3128)..(3131): n is a, c, g, or t
  misc_feature (3135)..(3137): n is a, c, g, or t
  misc_feature (3142)..(3142): n is a, c, g, or t
  misc_feature (3145)..(3146): n is a, c, g, or t
  misc_feature (3150)..(3150): n is a, c, g, or t
  misc_feature (3152)..(3153): n is a, c, g, or t
  misc_feature (3155)..(3156): n is a, c, g, or t
  misc_feature (3158)..(3158): n is a, c, g, or t
  misc_feature (3160)..(3160): n is a, c, g, or t
  misc_feature (3165)..(3166): n is a, c, g, or t
  misc_feature (3168)..(3168): n is a, c, g, or t
  misc_feature (3170)..(3170): n is a, c, g, or t
  misc_feature (3176)..(3179): n is a, c, g, or t
  misc_feature (3182)..(3182): n is a, c, g, or t
agccgccacgacttcgaggggcccgcccgcgacggcttcgccgaatggccgatcacctacgacgaactcgccccgtggtacagccacgtcgagcgcttcgtcgggatcagcgggaaccgcgatggcgtcgagggtctgcccgacggcgagttcctcccggcgtgggagatgaatgacgccgagcgctcgatggccgggcgcatcgaggacgcgttccccggccgccgcgtcgtgcagggccgctgcgcccaccttaccgaggcccgcccggaacacctcgcgcagggccgcggccggtgccagtcccgcaacctctgctaccgcggctgcccgttcggcggctacttctcctccaattcctccaccctgccttgggccgcgcgcaccgggaacctcaccgtccgccccggctccgtcgtcgagtccatcctccacgacgacgccaccggccgcgcgtcgggggtccgggtgatcgacgccgcgaccaaggccgtgaccgagtacttcgcgaaggtgatcttcgtgaacgcggcctgcctcaacacgaacctgattttgctgaactcgaggtcgcgccggtaccccgcgggcctcggcaacgaccacgggctgctcggccgccacgtggccttccacaactaccgcggcagcctcaacgcttcgctcgaaggcttcgccgattcctattactccggccgccggcccacccagccgatgatgcccaacttccgcaacgtcacgcggcaggagacggatttccagcgcggatatatggtgttcttcagcgcgtcccgccgcggctggacccgcggccaaggcgcgcccgggatcggggccgcctacaaggaggagctgactcttcctggcccttggggcatctatatgatgatgcagggcgagaccatcccgcggtacgagaaccacgtgcggctctccaccgaccagcgtgacccgttcggcattccgcaattggtcacctccatcggctacaccgagaatgacgagcggatgatccgcgatttcctcgcgcagggccgcgcgatgcttgaggcggccggcgcccgcgacatccgcgcgaccgatgaccgccgcaacccggggttggatatccacgagatgggtggcgcgaggatgggccgcgacccgcggacctcgctgctcaaccgctggaaccagttccatacctgcccgaacgtgttcgtcaccgatggcgccgcgatggcctcgacgggcgtgcagaatccgtccctcacctttatggcgctcactgcccgggccgcccggcacgccgtcgaggagctgcggaaaggcaccctgtgaaccgtcgcaccctgcttcgccacgccgcccagctcgnggccgccgccgcgctcggctccctgccccaccggggctggtccgcgctgccgcgccccgacggctggagcgcggccgaggaggcgctgctcgacgccatcggcgaaaccattctgcccgccaccccgggttccccgggggcgggttcggtcgcgatcgggcgcttcattttgcggatgaccgccgactgccatccgcccgccgcggcggacgcggtgcggcgactgctgggtgaggtggcgagccgcgctcaagcggcgggggcccgcccgttcccggagctcccagccgccgagcaggagcgcctactcgtggccttggagcgccagccgccgtccgcccgtgccggggtggccccgtggcggcacgtgaaggacctgacgttgctggggtatttcacggccgaggcgggcgcgacccgggccctgcgctacgatccggtgcccggggcctaccgcggctcggttcccctgcgtcccggcgaccgcgcctgggcgacctgaggccgcggctccggcgccaattggtgaataaccggtgaataaggttggactcaacttattcaccgttccgggctgtggagcgaatgcgaggaactcctgctttcatttcggcccggcgcgcgcatgttcgagacgttccttgatagaacagtcgcagtgcaacggcctgaaaaacgccgttgagagcacgactgggatattcccgggcaaccggggaatggatggcggcaactggtgccgccctcccctcggcgcgacgcgagtcgcgcccaggcatatatcaccagttcctctggccggagtcgtgtccggtcagtccacgcacgaatcaggaactgtgcggcgaggcgtgattagaaaccacgcccagccgagtcaggtccgcgggaagtttcgaaccgcggattcacgcagtcaccccagagggtatcggttgctactgcgccgaccagaacgccagcgcctcacccggcgggaccaccccgccagaaggccctgtccccacgcggggaaagggcgcgcaagggaggggcgaaggcggggagcgcacggacccggcaaagtccgtacacctcctccgggagcggggccgcaaaacggcgtcactcccctgcaaacgcgaaacgcaacctgagaggcaagaggtcagacccgtaacacggggccaacggccggctaaaccccggcgccgtccccgtggtcacggtgccgacgtgtagcccttcgcaggcgcgtcagcaccacgtccggcgcgaagcccccggcagggggcgtccgaaccgggcgcagaggcctcactcaacaaatctcggccggagacggccgagacggtcccgccatgagaccgaaattccgcctgccgcggagagtggcgtcgggaaacacaccgcccgcgaaagcgagagcgcccaagcgtgtgtgatcgggaaagagcgcgtggcgaacgcccactcccacataagccccggagaccgaaaggtttccggggctttttgttggccggnnagnncgcccngnnccccgncccnncnnnnncnngnnncgcgnnncnncngnnnnnnnncagcccngnncnnnncnanncnnnngnctnnnngncnatannccctgnctccnnnnnncnnngcnngnnncnnntnccnanctnnnnccttcgnnnnncctnnggnnnnccntcannnttnnnnncnttnnngcncnntncnccnnnnngcnnccgnnggnttnncnnagnnncnccnnngganntnnnnnnnannnnngnanggnnnngccnnncaagngcnnccangnngnngncnagccnncncnccgggnnnnaangcgcggacgggttccgggtggcgtctatggacgccacgcacagctccgatccgccgatcaaccctttaagccttttgcggctcccctccgttgccggagcgattcgtgcggtatgggacccgtatcgcttcgcccggggcggcgcgcccaccttcgctaaagctacggcgggcgggcccccggctacatcgaaccgcggccggtccagtctgccgttcattccggactcaagcggcttggtgtggctggggcgcgtcgccccggtgatggcggacgaatagcatttccgcacagccatccgctctccggatcccgtccccggcgcctatgggcgccacgcccagctccgatccgccgatcgaccctctgagccttttgcggccatcgcctccggtcttttcgaggttttcaggcgaccgcggcggatcgcaccgccgcatccgaaaactggatgctcacccgcgcgccgccggccggggaacgcgcggtccgcaggcgccagccctgcgtctcgcacagccggcgggccagcgcgagtcccagcccgtaaccccgcggccgcacctcctcgccggcatccgggaaacccgggccctcatcgtcgaccgtgagggtggcgtcctccgaccaggccaccgtgaccccgccctcgggcgcgtgctggagggcgttgcccaccaggttatgcaccagcatcaggagaacctcgcgatcggccaggacgcgcgagtccggcggaatcgcgaccgtgaggatccgcgccggatccggccggatggcccgttgatcctcgatcgcctcctccgcaaccgcgcgca

SEQ ID NO: 169 - DNA, 4000 bp, Escherichia coli
  misc_feature (1)..(389): n is a, c, g, or t
  misc_feature (391)..(596): n is a, c, g, or t
  misc_feature (598)..(602): n is a, c, g, or t
  misc_feature (604)..(620): n is a, c, g, or t
  misc_feature (622)..(624): n is a, c, g, or t
  misc_feature (626)..(627): n is a, c, g, or t
  misc_feature (629)..(638): n is a, c, g, or t
  misc_feature (640)..(651): n is a, c, g, or t
  misc_feature (653)..(666): n is a, c, g, or t
  misc_feature (668)..(669): n is a, c, g, or t
  misc_feature (674)..(681): n is a, c, g, or t
  misc_feature (683)..(692): n is a, c, g, or t
  misc_feature (694)..(701): n is a, c, g, or t
  misc_feature (703)..(705): n is a, c, g, or t
  misc_feature (707)..(722): n is a, c, g, or t
  misc_feature (725)..(770): n is a, c, g, or t
  misc_feature (772)..(773): n is a, c, g, or t
  misc_feature (775)..(830): n is a, c, g, or t
  misc_feature (832)..(835): n is a, c, g, or t
  misc_feature (837)..(870): n is a, c, g, or t
  misc_feature (872)..(901): n is a, c, g, or t
  misc_feature (903)..(947): n is a, c, g, or t
  misc_feature (949)..(950): n is a, c, g, or t
  misc_feature (953)..(954): n is a, c, g, or t
  misc_feature (957)..(960): n is a, c, g, or t
  misc_feature (964)..(965): n is a, c, g, or t
  misc_feature (968)..(969): n is a, c, g, or t
  misc_feature (972)..(976): n is a, c, g, or t
  misc_feature (978)..(978): n is a, c, g, or t
  misc_feature (980)..(983): n is a, c, g, or t
  misc_feature (985)..(986): n is a, c, g, or t
  misc_feature (988)..(990): n is a, c, g, or t
  misc_feature (992)..(993): n is a, c, g, or t
  misc_feature (995)..(997): n is a, c, g, or t
  misc_feature (999)..(1005): n is a, c, g, or t
  misc_feature (1007)..(1011): n is a, c, g, or t
  misc_feature (1014)..(1015): n is a, c, g, or t
  misc_feature (1019)..(1019): n is a, c, g, or t
  misc_feature (1021)..(1023): n is a, c, g, or t
  misc_feature (1025)..(1028): n is a, c, g, or t
  misc_feature (1030)..(1030): n is a, c, g, or t
  misc_feature (1033)..(1036): n is a, c, g, or t
  misc_feature (1038)..(1039): n is a, c, g, or t
  misc_feature (1042)..(1042): n is a, c, g, or t
  misc_feature (1044)..(1044): n is a, c, g, or t
  misc_feature (1046)..(1046): n is a, c, g, or t
  misc_feature (1051)..(1052): n is a, c, g, or t
  misc_feature (1057)..(1057): n is a, c, g, or t
  misc_feature (1061)..(1062): n is a, c, g, or t
  misc_feature (1064)..(1064): n is a, c, g, or t
  misc_feature (1068)..(1069): n is a, c, g, or t
  misc_feature (1072)..(1072): n is a, c, g, or t
  misc_feature (1074)..(1074): n is a, c, g, or t
  misc_feature (1076)..(1079): n is a, c, g, or t
  misc_feature (1081)..(1084): n is a, c, g, or t
  misc_feature (1090)..(1092): n is a, c, g, or t
  misc_feature (1095)..(1107): n is a, c, g, or t
  misc_feature (1111)..(1117): n is a, c, g, or t
  misc_feature (1119)..(1120): n is a, c, g, or t
  misc_feature (1122)..(1122): n is a, c, g, or t
  misc_feature (1124)..(1125): n is a, c, g, or t
  misc_feature (1127)..(1127): n is a, c, g, or t
  misc_feature (1129)..(1131): n is a, c, g, or t
  misc_feature (1133)..(1133): n is a, c, g, or t
  misc_feature (1135)..(1144): n is a, c, g, or t
  misc_feature (1146)..(1146): n is a, c, g, or t
  misc_feature (1149)..(1149): n is a, c, g, or t
  misc_feature (1152)..(1153): n is a, c, g, or t
  misc_feature (1155)..(1159): n is a, c, g, or t
  misc_feature (1161)..(1163): n is a, c, g, or t
  misc_feature (1167)..(1170): n is a, c, g, or t
  misc_feature (1175)..(1179): n is a, c, g, or t
  misc_feature (1182)..(1188): n is a, c, g, or t
  misc_feature (1191)..(1194): n is a, c, g, or t
  misc_feature (1198)..(1198): n is a, c, g, or t
  misc_feature (1200)..(1202): n is a, c, g, or t
  misc_feature (1204)..(1205): n is a, c, g, or t
  misc_feature (1207)..(1209): n is a, c, g, or t
  misc_feature (1211)..(1211): n is a, c, g, or t
  misc_feature (1213)..(1220): n is a, c, g, or t
  misc_feature (1223)..(1231): n is a, c, g, or t
  misc_feature (1233)..(1234): n is a, c, g, or t
  misc_feature (1236)..(1238): n is a, c, g, or t
  misc_feature (1240)..(1243): n is a, c, g, or t
  misc_feature (1245)..(1247): n is a, c, g, or t
  misc_feature (1249)..(1250): n is a, c, g, or t
  misc_feature (1252)..(1253): n is a, c, g, or t
  misc_feature (1255)..(1255): n is a, c, g, or t
  misc_feature (1258)..(1258): n is a, c, g, or t
  misc_feature (1260)..(1264): n is a, c, g, or t
  misc_feature (1267)..(1276): n is a, c, g, or t
  misc_feature (1280)..(1280): n is a, c, g, or t
  misc_feature (1282)..(1285): n is a, c, g, or t
  misc_feature (1287)..(1288): n is a, c, g, or t
  misc_feature (1291)..(1296): n is a, c, g, or t
  misc_feature (1304)..(1306): n is a, c, g, or t
  misc_feature (1308)..(1309): n is a, c, g, or t
  misc_feature (1314)..(1314): n is a, c, g, or t
  misc_feature (1317)..(1318): n is a, c, g, or t
  misc_feature (1320)..(1320): n is a, c, g, or t
  misc_feature (1326)..(1329): n is a, c, g, or t
  misc_feature (1334)..(1334): n is a, c, g, or t
  misc_feature (1341)..(1341): n is a, c, g, or t
  misc_feature (1344)..(1345): n is a, c, g, or t
  misc_feature (1348)..(1349): n is a, c, g, or t
  misc_feature (1352)..(1355): n is a, c, g, or t
  misc_feature (1357)..(1357): n is a, c, g, or t
  misc_feature (1359)..(1359): n is a, c, g, or t
  misc_feature (1361)..(1362): n is a, c, g, or t
  misc_feature (1364)..(1366): n is a, c, g, or t
  misc_feature (1368)..(1368): n is a, c, g, or t
  misc_feature (1373)..(1374): n is a, c, g, or t
  misc_feature (1378)..(1378): n is a, c, g, or t
  misc_feature (1380)..(1382): n is a, c, g, or t
  misc_feature (1387)..(1387): n is a, c, g, or t
  misc_feature (1390)..(1391): n is a, c, g, or t
  misc_feature (1395)..(1397): n is a, c, g, or t
  misc_feature (1404)..(1404): n is a, c, g, or t
  misc_feature (1406)..(1406): n is a, c, g, or t
  misc_feature (1408)..(1409): n is a, c, g, or t
  misc_feature (1423)..(1423): n is a, c, g, or t
  misc_feature (1428)..(1429): n is a, c, g, or t
  misc_feature (1435)..(1435): n is a, c, g, or t
  misc_feature (1438)..(1438): n is a, c, g, or t
  misc_feature (1440)..(1441): n is a, c, g, or t
  misc_feature (1443)..(1443): n is a, c, g, or t
  misc_feature (1446)..(1446): n is a, c, g, or t
  misc_feature (1452)..(1452): n is a, c, g, or t
  misc_feature (1455)..(1455): n is a, c, g, or t
  misc_feature (1457)..(1462): n is a, c, g, or t
  misc_feature (1464)..(1464): n is a, c, g, or t
  misc_feature (1468)..(1468): n is a, c, g, or t
  misc_feature (1472)..(1472): n is a, c, g, or t
  misc_feature (1474)..(1475): n is a, c, g, or t
  misc_feature (1478)..(1478): n is a, c, g, or t
  misc_feature (1480)..(1482): n is a, c, g, or t
  misc_feature (1486)..(1489): n is a, c, g, or t
  misc_feature (1492)..(1493): n is a, c, g, or t
  misc_feature (1497)..(1497): n is a, c, g, or t
  misc_feature (1499)..(1499): n is a, c, g, or t
  misc_feature (1502)..(1502): n is a, c, g, or t
  misc_feature (1504)..(1507): n is a, c, g, or t
  misc_feature (1512)..(1512): n is a, c, g, or t
  misc_feature (1514)..(1514): n is a, c, g, or t
  misc_feature (1516)..(1516): n is a, c, g, or t
  misc_feature (1518)..(1518): n is a, c, g, or t
  misc_feature (1520)..(1522): n is a, c, g, or t
  misc_feature (1524)..(1524): n is a, c, g, or t
  misc_feature (1529)..(1529): n is a, c, g, or t
  misc_feature (1532)..(1532): n is a, c, g, or t
  misc_feature (1535)..(1536): n is a, c, g, or t
  misc_feature (1540)..(1541): n is a, c, g, or t
  misc_feature (1544)..(1545): n is a, c, g, or t
  misc_feature (1547)..(1547): n is a, c, g, or t
  misc_feature (1555)..(1556): n is a, c, g, or t
  misc_feature (1559)..(1559): n is a, c, g, or t
  misc_feature (1563)..(1564): n is a, c, g, or t
  misc_feature (1566)..(1571): n is a, c, g, or t
  misc_feature (1573)..(1575): n is a, c, g, or t
  misc_feature (1580)..(1581): n is a, c, g, or t
  misc_feature (1585)..(1585): n is a, c, g, or t
  misc_feature (1587)..(1587): n is a, c, g, or t
  misc_feature (1589)..(1589): n is a, c, g, or t
  misc_feature (1591)..(1591): n is a, c, g, or t
  misc_feature (1593)..(1593): n is a, c, g, or t
  misc_feature (1595)..(1595): n is a, c, g, or t
  misc_feature (1597)..(1597): n is a, c, g, or t
  misc_feature (1599)..(1600): n is a, c, g, or t
  misc_feature (1603)..(1603): n is a, c, g, or t
  misc_feature (1607)..(1607): n is a, c, g, or t
  misc_feature (1611)..(1611): n is a, c, g, or t
  misc_feature (1613)..(1614): n is a, c, g, or t
  misc_feature (1616)..(1616): n is a, c, g, or t
  misc_feature (1622)..(1622): n is a, c, g, or t
  misc_feature (1630)..(1630): n is a, c, g, or t
  misc_feature (1632)..(1632): n is a, c, g, or t
  misc_feature (1635)..(1635): n is a, c, g, or t
  misc_feature (1638)..(1638): n is a, c, g, or t
  misc_feature (1640)..(1640): n is a, c, g, or t
  misc_feature (1644)..(1644): n is a, c, g, or t
  misc_feature (1648)..(1650): n is a, c, g, or t
  misc_feature (1657)..(1658): n is a, c, g, or t
  misc_feature (1660)..(1662): n is a, c, g, or t
  misc_feature (1665)..(1665): n is a, c, g, or t
  misc_feature (1667)..(1667): n is a, c, g, or t
  misc_feature (1675)..(1675): n is a, c, g, or t
  misc_feature (1682)..(1682): n is a, c, g, or t
  misc_feature (1684)..(1684): n is a, c, g, or t
  misc_feature (1687)..(1687): n is a, c, g, or t
  misc_feature (1690)..(1690): n is a, c, g, or t
  misc_feature (1695)..(1695): n is a, c, g, or t
  misc_feature (1697)..(1700): n is a, c, g, or t
  misc_feature (1703)..(1703): n is a, c, g, or t
  misc_feature (1705)..(1705): n is a, c, g, or t
  misc_feature (1708)..(1708): n is a, c, g, or t
  misc_feature (1720)..(1722): n is a, c, g, or t
  misc_feature (1724)..(1724): n is a, c, g, or t
  misc_feature (1726)..(1726): n is a, c, g, or t
  misc_feature (1732)..(1733): n is a, c, g, or t
  misc_feature (1735)..(1738): n is a, c, g, or t
  misc_feature (1742)..(1743): n is a, c, g, or t
  misc_feature (1747)..(1747): n is a, c, g, or t
  misc_feature (1751)..(1751): n is a, c, g, or t
  misc_feature (1754)..(1754): n is a, c, g, or t
  misc_feature (1756)..(1759): n is a, c, g, or t
  misc_feature (1761)..(1763): n is a, c, g, or t
  misc_feature (1768)..(1768): n is a, c, g, or t
  misc_feature (2024)..(2024): n is a, c, g, or t
  misc_feature (3341)..(3341): n is a, c, g, or t
  misc_feature (3413)..(3413): n is a, c, g, or t
  misc_feature (3729)..(3729): n is a, c, g, or t
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncnnnnncnnnnnnnnnnnnnnnnncnnncnncnnnnnnnnnncnnnnnnnnnnnncnnnnnnnnnnnnnncnncaccnnnnnnnncnnnnnnnnnncnnnnnnnncnnncnnnnnnnnnnnnnnnnccnnnnnnnnnnnnnnnnnnnnnnnnnnnnnnnnnnnnnnnnnnnnnncnncnnnnnnnnnnnnnnnnnnnnnnnnnnnnnnnnnnnnnnnnnnnnnnnnnnnnnnnntnnnntnnnnnnnnnnnnnnnnnnnnnnnnnnnnnnnnnncnnnnnnnnnnnnnnnnnnnnnnnnnnnnnncnnnnnnnnnnnnnnnnnnnnnnnnnnnnnnnnnnnnnnnnnnnnnannccnncannnncacnnccnncannnnnancnnnnannannncnncnnnannnnnnncnnnnnccnntttntnnnannnncnttnnnntnnatntntntcttnnctttntctnntntatnnctntncnnnnannnncacccnnnccnnnnnnnnnnnnncccnnnnnnnanncncnncngnnncnannnnnnnnnncnccnccnnannnnncnnncccnnnncccannnnncannnnnnncgnnnncggngnnncnnannngncnnnnnnnnccnnnnnnnnnanntnnncnnnncnnncnncnngnccntnnnnncgnnnnnnnnnnccgncnnnncnnccnnnnnnttgttcannncnncatcnccnntncccttnnnnttttncagctcntcnnccnnttnnnncncncnntnnntntgacnntatncnnnaatcnctnncgcnnnagccggncngnnacccggcaatgccnccagnncggcanaananncngtnttgacnttnannnnnncnaaanagantnncgnannnacgnnnncanngacncnaantnnnnatttntncntnannntnttccnatnacnngttnnatnnantcaaccgnnccngctnnannnnnntnnnacttnnccgnananantncnanannacngtanaacncnncnctattncatataantncanacnanatantaannnaaatacnntnnnatntnaaatattntaaacantnaancgnaactntnnnnacntnatnttcaagaataannncntngttatnntnnnntaanntaancaanaanannnnannngtcancaaaccgacagaaccgacaggcatgtaaaaagcccccgacatcagtcgggggcttcggaatgggtgtttggcggtgacctactttcacatggaagaaccacactatcatcggcgctgagtcgtttcacggtcctgttcgggatgggaaggcgtgggaccaactcgctatggccgccaaacttaaactgttacaaatcggtaaagccttaatcaatatatttggtgatgactgaatcagtcagtaagcttttatctnttgaagttcttcaaatgatagagtcaagcctcacgagcaattagtatgggttagcttcacgcgttaccgcgcttccacaccccacctatcaacgtcctggtctcgaacgactctttagtgtggttaaaccacaagggaagtctcatcttcaggcgagtttcgcgcttagatgctttcagcgcttatctcttccgaacttagctacccggctatgcaactggcgttacaaccggtacaccagaggttcgtccactccggtcctctcgtactaggagcagcccccgtcaaacttccaacgcccactgcagatagggaccaaactgtctcacgacgttttaaacccagctcacgtaccactttaaatggcgaacagccatacccttgggaccgactacagccccaggatgtgatgagccgacatcgaggtgccaaactccgccgtcgatatgaactcttgggcggaatcagcctgttatccccggagtaccttttatccgttgagcgatggcccttccatacagaaccaccggatcactatgtcctgctttcgcacctgctcgacttgtcggtctcgcagttaagctaccttttgccattgcactatcagtccgatttccgaccggacctaggtaaccttcgaactcctccgttactctttgggaggagaccgccccagtcaaactgcctaccatgcacggtccccgacccggattacgggtctgggttagaacctcaaagacaccagggtggtatttcaaggacggctccacagagactggcgtctctgcttcaaagcctcccacctatcctacacaagtgacttcaaagtccaatgcaaagctacagtaaaggttcacggggtctttccgtctagcagcgggtagattgcatcttcacaaccacttcaacttcgctgagtctcgggaggagacagtgtggccatcgttacgccattcgtgcgggtcggaacttacccgacaaggaatttcgctaccttaggaccgttatagttacggccgccgtttactggggcttcgatccgatgcttgcacatcttcaattaaccttccagcaccgggcaggcgtcacaccctatacgtccactttcgtgttagcagagtgctgtgtttttaataaacagtcgcagccacctattctctgcgaccctccagggcttacggagcaagtccttaaccttagagggcataccttctcccgaagttacggtatcaatttgccgagttccttctcccgagttctctcaagcgccttagaattctcatcctgcccacctgtgtcggtttgcggtacggttcnattcaaactgaagcttagtggcttttcctggaagcgtggtatcggttacttcatgtccgtagacactcgtcntcacttctcggtgttaagaagacccggatttgcctaagtcttccacctaccggcttaaacaagctattccaacagcttgctaacctaaccttctccgtccccacatcgcatttgaatcaagtacaggaatattaacctgtttcccatcgactacgcatttctgcctcgccttaggggccgactcaccctacgccgatgaacgttgcgtaggaaaccttgggctttcggcgagcgggcttttcacccgctttatcgctactcatgtcaacattcgcacttctgatacctccagcacactttacaatgcaccttcatnggcctacagaacgctcccctaccatgccagtaaactggcatccgcagcttcggttatagatttgagccccgttacatcttccgcgcaggacgactcgaccagtgagctattacgctttctttaaatgatggctgcttctaagccaacatcctggctgtctgggccttcccacttcgtttaccacttaatctatcatttgggaccttagctggcggtctgggttgtttccctcttgacaacggacgttagcacccgctgtctgtctcccgag

SEQ ID NO: 170 - DNA, 4000 bp, Escherichia coli
  misc_feature (2866)..(2866): n is a, c, g, or t
  misc_feature (2917)..(2917): n is a, c, g, or t
  misc_feature (2962)..(2962): n is a, c, g, or t
  misc_feature (3010)..(3010): n is a, c, g, or t
  misc_feature (3022)..(3022): n is a, c, g, or t
  misc_feature (3036)..(3036): n is a, c, g, or t
  misc_feature (3051)..(3051): n is a, c, g, or t
  misc_feature (3076)..(3076): n is a, c, g, or t
  misc_feature (3091)..(3091): n is a, c, g, or t
  misc_feature (3097)..(3097): n is a, c, g, or t
  misc_feature (3100)..(3100): n is a, c, g, or t
  misc_feature (3109)..(3109): n is a, c, g, or t
  misc_feature (3121)..(3121): n is a, c, g, or t
  misc_feature (3130)..(3130): n is a, c, g, or t
  misc_feature (3138)..(3138): n is a, c, g, or t
  misc_feature (3140)..(3140): n is a, c, g, or t
  misc_feature (3142)..(3142): n is a, c, g, or t
  misc_feature (3149)..(3149): n is a, c, g, or t
  misc_feature (3157)..(3157): n is a, c, g, or t
  misc_feature (3252)..(3252): n is a, c, g, or t
  misc_feature (3268)..(3268): n is a, c, g, or t
  misc_feature (3301)..(3301): n is a, c, g, or t
  misc_feature (3304)..(3304): n is a, c, g, or t
  misc_feature (3328)..(3328): n is a, c, g, or t
  misc_feature (3364)..(3364): n is a, c, g, or t
  misc_feature (3391)..(3391): n is a, c, g, or t
  misc_feature (3418)..(3418): n is a, c, g, or t
  misc_feature (3474)..(3474): n is a, c, g, or t
  misc_feature (3517)..(3517): n is a, c, g, or t
  misc_feature (3607)..(3607): n is a, c, g, or t
  misc_feature (3628)..(3628): n is a, c, g, or t
  misc_feature (3637)..(3637): n is a, c, g, or t
  misc_feature (3640)..(3640): n is a, c, g, or t
  misc_feature (3652)..(3652): n is a, c, g, or t
  misc_feature (3664)..(3664): n is a, c, g, or t
  misc_feature (3670)..(3670): n is a, c, g, or t
  misc_feature (3676)..(3676): n is a, c, g, or t
  misc_feature (3697)..(3697): n is a, c, g, or t
  misc_feature (3705)..(3705): n is a, c, g, or t
  misc_feature (3715)..(3715): n is a, c, g, or t
  misc_feature (3727)..(3727): n is a, c, g, or t
  misc_feature (3729)..(3730): n is a, c, g, or t
  misc_feature (3732)..(3733): n is a, c, g, or t
  misc_feature (3735)..(3737): n is a, c, g, or t
  misc_feature (3739)..(3740): n is a, c, g, or t
  misc_feature (3742)..(3745): n is a, c, g, or t
  misc_feature (3747)..(3747): n is a, c, g, or t
  misc_feature (3749)..(3757): n is a, c, g, or t
  misc_feature (3759)..(3759): n is a, c, g, or t
  misc_feature (3761)..(3765): n is a, c, g, or t
  misc_feature (3768)..(3778): n is a, c, g, or t
  misc_feature (3782)..(3784): n is a, c, g, or t
  misc_feature (3786)..(3797): n is a, c, g, or t
  misc_feature (3800)..(3804): n is a, c, g, or t
  misc_feature (3806)..(3808): n is a, c, g, or t
  misc_feature (3810)..(3811): n is a, c, g, or t
  misc_feature (3814)..(3817): n is a, c, g, or t
  misc_feature (3819)..(3819): n is a, c, g, or t
  misc_feature (3821)..(3821): n is a, c, g, or t
  misc_feature (3823)..(3825): n is a, c, g, or t
  misc_feature (3828)..(3833): n is a, c, g, or t
  misc_feature (3836)..(3846): n is a, c, g, or t
  misc_feature (3848)..(3848): n is a, c, g, or t
  misc_feature (3850)..(3850): n is a, c, g, or t
  misc_feature (3852)..(3857): n is a, c, g, or t
  misc_feature (3859)..(3860): n is a, c, g, or t
  misc_feature (3862)..(3862): n is a, c, g, or t
  misc_feature (3864)..(3872): n is a, c, g, or t
  misc_feature (3874)..(3874): n is a, c, g, or t
  misc_feature (3878)..(3885): n is a, c, g, or t
  misc_feature (3887)..(3904): n is a, c, g, or t
  misc_feature (3906)..(3909): n is a, c, g, or t
  misc_feature (3911)..(3916): n is a, c, g, or t
  misc_feature (3918)..(3920): n is a, c, g, or t
  misc_feature (3922)..(3927): n is a, c, g, or t
  misc_feature (3930)..(3932): n is a, c, g, or t
  misc_feature (3934)..(3941): n is a, c, g, or t
  misc_feature (3943)..(3944): n is a, c, g, or t
  misc_feature (3946)..(3949): n is a, c, g, or t
  misc_feature (3951)..(3955): n is a, c, g, or t
  misc_feature (3957)..(3958): n is a, c, g, or t
  misc_feature (3960)..(3964): n is a, c, g, or t
  misc_feature (3966)..(3973): n is a, c, g, or t
  misc_feature (3975)..(3980): n is a, c, g, or t
  misc_feature (3983)..(3986): n is a, c, g, or t
  misc_feature (3989)..(3992): n is a, c, g, or t
  misc_feature (3995)..(3997): n is a, c, g, or t
  misc_feature (3999)..(4000): n is a, c, g, or t
cgttccacgactaccaccgcgacggacagatgcgcacggacggcaattacggagcgacgatcccctaccagccgaacagctacggcgaatggcaggacagcccgaacctgaaagaaccgcctttggaggtgaacggtgccatctacaattacgacgaacgggaactcgacagcgactatttcacccaaccgggcaagctctggcggctgatgtcggccgaagaccaacgggcgacgtgcgagaacacggcccgcgcgatgggcgacagcgccctcttcatcaaacagcggcacgtgcgcaactgctcctacgccgatcccgaatacggcaaaggcgtggcgaaggcattgggtatcgactatgaggaagccctgaaagcggaggacccggcacacccgacgtgggatccccgcaacaaaaagtgattcgcagcagacgcaccgaaaggaggttcctccatttcgttaagatcgctacaaaatcccggatgaatatgtattcatccgggattttacgcaatacgtcctcttcaccctgtccgaacgccccgcaaaacaaggcccgtccggcacgaacggcccgacgcgaaaagcctcatacgatgggatcgatgacgcctccgcctccgccactctttccggctccgcaggctttctcccctcgacaacgatacttcgaaaaatgccagccgacaccttgctcccggcgacaacatcgacaggccggtccgcacaagcggatcggtttccttgcaagaggcaatcaaggacggtattccagcatcgttccgggacattggacatacctttacggggtcttggccggctccgtaaaatacaatgccggactgcgatcccgcactttcgggagccgcaatccggcgctgcgaatttcaaaaggcactatgcctgcggcgtatcgtcgccgcctttattgcgattacggttgcgatttcggttacgacgacgcccccggtcccggctgccgcgattaccctcgccacgaccttctccgtggcgggactccacattcgcagccgcgacgacaccttctgcaggtaccggaccggcactcttcgcaccgtcgcgtccacggctccgaccacgtcccccgctgcgtccgtttccgccacggcccgacccactgcgtccccggcggccgccatgaccggaaaaagcggcggggttatattcagggcctgcacctacggcttccggcaaggacaatttcggaatctcccgctcgataaactcctcgatacggtggaatttaccctgctcctcctcgttcacgaacgtaacggcccgccccgtagcgctggcccgcgccgtgcggccgatgcgatggatataatcttcgggatcgtgcggcacgtcataattgatgaccatgccgatatcctcgatgtcgataccgcgtgcgacgatgtccgtcgctacgagaatcctcactttattattcttaaaatcgagcatcacctgctcgcgtttctcctgatccagatcggagtgcatgggagccacgtcgagcttcatacgcttgagcgtatgggccaactccttgaccttttgtttggaagaggagaaaatgatcgtcttggactccgaaggccaggagaacatctcgcggacgatccccagcttttggccctcgtaacagatataagcaccctgttcgatcgcctcgttgggcttcgaaatggcgatattgacctcggcgggatcgttcagaatctgcttggccatctgccggatcttgggcggcagcgtcgcggagaacatcagcgtctgccgcgatttgggcatataggaaacgatctgcataatgtcgtcgtaaaaacccatatcgagcatacggtcggcctcgtccagaatcaggtaatccacatgcgaaagatcgacgcggctgttcataaggtgcgaaatcaggcgtccgggcgtggcgatcaccacatcggcacccatttgcaggccgcgcttctgctggtcccagccgcggccgtcgccgccgccgtaaattacggcggtagaaacgggcatatagtaggaaaagccctggaactgcatgtcgatctgctgtgccaactcgcgcgtgggtacgataatgaccgatttcacgacgttcttctcattgccttcgagcagcagccggttcagcagcggcagcgtataggcagccgtcttgcccgtaccggtctgggcgcaggcgataatatcgcgcccgtccagaatgatcggaatggtctgctcctgcacaggagtcatctcctgaaaattcatggcgtcgatgccgtccagcacctcgtcttccagatcgagttcgtcaaatctcatactatgcgttttctttcttttccaattattacacttcaaacgggcgggttctttcgaccaactctccctgcaacgtcgccgacgaggaggcggtcacccgcacccgcacgtaatccccgatccggcactcgccgcgatcgaagaccaccaccttattctgcgacgtacgtccgaaaagctgccggtcgctgcgcttggaagtaccttccaccagaatttcgaactctttgccgacatcgcgggcgttgctttcggccgaaagcgtattctgcaaggcgatgatttcgttcaaacgggccgtcttgaccgaatccggcacatcgtcgggcatgtgacgttgagcgaacgtatcgggccgctcggaatacttgaacatataggcgaattcataccccacctcccgcatcagcgaaagcgtctgccgatgatcctcgtccgtttcgctgcagaatccggcgatcaggtcggtcgtaatcgcgcaatcgggcatatagcggcggatagcggcgatgcggtcgaggtaccattcgcgngtatatttgcggttcatcttctcgagcatccgcgacgatcccgactgggcnggcaggtggatgcagcggcagatgttgggtttcgacgccatcacntcgagcagacggtcgctcatgtccttgggatgcgacgttgcgaaccgnacgcgcaacagnggcgaaatttcggncacaaggcgcatcanctccggaaaatcgaccgctccatancgatacgaattgacnttctgnccnaacagcgtnacctcccggtanccgttctcnaacaggcngngngcttcgntcagaatngtctgcggatcgcggctgcgctccacgccccgcgtataaggcaccacgcagtacgaacaatagttgttgcacccgcgcatgatggcgatataacngctcacgccgttgcgntcgagccgcacgggagcgatttcggcgtaggtntcntcgcgggaaagcaggacattgacnccccggccgccttcgcccgcttcgcgcaccaggcgnggcaggtcgcggtacgcatccggaccngcgacgatatccacggggttctccccntcgagcagccgttcccgcaaacgttcggccatacaaccgataataccgacgagcantcccggccggcggcggcgcagatgagccatctcccgcaaacgnccccaaatgcgctgttcggcattatctcggatcgaacaggtattgatcagaacgacatccgcctcctcgatcttgtcggtatagacatanccctcctgctgcatgatcgcnacgacgatntcngtatcgccgacnttcatctgacanccgtangtttcnacaaaaagtttacggcccgcnccctgcancggacgcaangtatttatcttntnntnntnnntnntnnnnanannnnnnnnncncnnnnnaannnnnnnnnnnaaannngnnnnnnnnnnnncgnnnnncnnntnnccnnnntntntnnnaannnnnntgnnnnnnnnnnncncncnnnnnngnnangnnnnnnnnncnctcnnnnnnnntnnnnnnnnnnnnnnnnnncnnnnannnnnntnnngnnnnnntcnnntnnnnnnnncnntnnnncnnnnncnncnnnnngnnnnnnnncnnnnnnaannnnatnnnnttnnncnn

SEQ ID NO: 171 - DNA, 4000 bp, Escherichia coli
  misc_feature (295)..(295): n is a, c, g, or t
  misc_feature (1247)..(1247): n is a, c, g, or t
  misc_feature (1309)..(1309): n is a, c, g, or t
  misc_feature (1355)..(1355): n is a, c, g, or t
  misc_feature (1520)..(1520): n is a, c, g, or t
  misc_feature (1529)..(1529): n is a, c, g, or t
  misc_feature (1550)..(1550): n is a, c, g, or t
  misc_feature (1574)..(1574): n is a, c, g, or t
  misc_feature (2224)..(2224): n is a, c, g, or t
  misc_feature (2262)..(2262): n is a, c, g, or t
  misc_feature (2322)..(2323): n is a, c, g, or t
  misc_feature (2340)..(2341): n is a, c, g, or t
  misc_feature (2349)..(2349): n is a, c, g, or t
  misc_feature (2352)..(2352): n is a, c, g, or t
  misc_feature (2358)..(2359): n is a, c, g, or t
  misc_feature (2361)..(2361): n is a, c, g, or t
  misc_feature (2364)..(2364): n is a, c, g, or t
  misc_feature (2367)..(2367): n is a, c, g, or t
  misc_feature (2370)..(2371): n is a, c, g, or t
  misc_feature (2373)..(2373): n is a, c, g, or t
  misc_feature (2375)..(2375): n is a, c, g, or t
  misc_feature (2379)..(2379): n is a, c, g, or t
  misc_feature (2382)..(2387): n is a, c, g, or t
  misc_feature (2389)..(2389): n is a, c, g, or t
  misc_feature (2392)..(2393): n is a, c, g, or t
  misc_feature (2395)..(2397): n is a, c, g, or t
  misc_feature (2401)..(2402): n is a, c, g, or t
  misc_feature (2404)..(2406): n is a, c, g, or t
  misc_feature (2408)..(2413): n is a, c, g, or t
  misc_feature (2417)..(2418): n is a, c, g, or t
  misc_feature (2423)..(2426): n is a, c, g, or t
  misc_feature (2429)..(2429): n is a, c, g, or t
  misc_feature (2433)..(2433): n is a, c, g, or t
  misc_feature (2435)..(2435): n is a, c, g, or t
  misc_feature (2439)..(2439): n is a, c, g, or t
  misc_feature (2441)..(2441): n is a, c, g, or t
  misc_feature (2443)..(2447): n is a, c, g, or t
  misc_feature (2449)..(2449): n is a, c, g, or t
  misc_feature (2456)..(2457): n is a, c, g, or t
  misc_feature (2465)..(2466): n is a, c, g, or t
  misc_feature (2468)..(2469): n is a, c, g, or t
  misc_feature (2471)..(2472): n is a, c, g, or t
  misc_feature (2474)..(2475): n is a, c, g, or t
  misc_feature (2477)..(2479): n is a, c, g, or t
  misc_feature (2481)..(2481): n is a, c, g, or t
  misc_feature (2483)..(2484): n is a, c, g, or t
  misc_feature (2486)..(2489): n is a, c, g, or t
  misc_feature (2492)..(2493): n is a, c, g, or t
  misc_feature (2497)..(2498): n is a, c, g, or t
  misc_feature (2501)..(2501): n is a, c, g, or t
  misc_feature (2504)..(2507): n is a, c, g, or t
  misc_feature (2510)..(2510): n is a, c, g, or t
  misc_feature (2512)..(2515): n is a, c, g, or t
  misc_feature (2518)..(2521): n is a, c, g, or t
  misc_feature (2523)..(2523): n is a, c, g, or t
  misc_feature (2527)..(2528): n is a, c, g, or t
  misc_feature (2530)..(2531): n is a, c, g, or t
  misc_feature (2533)..(2534): n is a, c, g, or t
  misc_feature (2536)..(2536): n is a, c, g, or t
  misc_feature (2538)..(2539): n is a, c, g, or t
  misc_feature (2541)..(2543): n is a, c, g, or t
  misc_feature (2545)..(2548): n is a, c, g, or t
  misc_feature (2550)..(2552): n is a, c, g, or t
  misc_feature (2554)..(2554): n is a, c, g, or t
  misc_feature (2556)..(2557): n is a, c, g, or t
  misc_feature (2559)..(2561): n is a, c, g, or t
  misc_feature (2563)..(2573): n is a, c, g, or t
  misc_feature (2575)..(2576): n is a, c, g, or t
  misc_feature (2580)..(2583): n is a, c, g, or t
  misc_feature (2585)..(2590): n is a, c, g, or t
  misc_feature (2597)..(2598): n is a, c, g, or t
  misc_feature (2603)..(2604): n is a, c, g, or t
  misc_feature (2606)..(2607): n is a, c, g, or t
  misc_feature (2609)..(2609): n is a, c, g, or t
  misc_feature (2611)..(2618): n is a, c, g, or t
  misc_feature (2621)..(2627): n is a, c, g, or t
  misc_feature (2629)..(2639): n is a, c, g, or t
  misc_feature (2641)..(2648): n is a, c, g, or t
  misc_feature (2650)..(2651): n is a, c, g, or t
  misc_feature (2653)..(2653): n is a, c, g, or t
  misc_feature (2656)..(2656): n is a, c, g, or t
  misc_feature (2658)..(2662): n is a, c, g, or t
  misc_feature (2667)..(2667): n is a, c, g, or t
  misc_feature (2669)..(2672): n is a, c, g, or t
  misc_feature (2674)..(2680): n is a, c, g, or t
  misc_feature (2682)..(2684): n is a, c, g, or t
  misc_feature (2686)..(2686): n is a, c, g, or t
  misc_feature (2688)..(2693): n is a, c, g, or t
  misc_feature (2695)..(2695): n is a, c, g, or t
  misc_feature (2697)..(2701): n is a, c, g, or t
  misc_feature (2703)..(2709): n is a, c, g, or t
  misc_feature (2711)..(2719): n is a, c, g, or t
  misc_feature (2721)..(2734): n is a, c, g, or t
  misc_feature (2736)..(2741): n is a, c, g, or t
  misc_feature (2743)..(2744): n is a, c, g, or t
  misc_feature (2746)..(2746): n is a, c, g, or t
  misc_feature (2749)..(2754): n is a, c, g, or t
  misc_feature (2757)..(2762): n is a, c, g, or t
  misc_feature (2765)..(2766): n is a, c, g, or t
  misc_feature (2769)..(2769): n is a, c, g, or t
  misc_feature (2771)..(2772): n is a, c, g, or t
  misc_feature (2774)..(2778): n is a, c, g, or t
  misc_feature (2780)..(2780): n is a, c, g, or t
  misc_feature (2782)..(2782): n is a, c, g, or t
  misc_feature (2785)..(2788): n is a, c, g, or t
  misc_feature (2791)..(2796): n is a, c, g, or t
  misc_feature (2798)..(2798): n is a, c, g, or t
  misc_feature (2801)..(2801): n is a, c, g, or t
  misc_feature (2803)..(2805): n is a, c, g, or t
  misc_feature (2807)..(2807): n is a, c, g, or t
  misc_feature (2809)..(2813): n is a, c, g, or t
  misc_feature (2818)..(2822): n is a, c, g, or t
  misc_feature (2825)..(2825): n is a, c, g, or t
  misc_feature (2828)..(2828): n is a, c, g, or t
  misc_feature (2834)..(2835): n is a, c, g, or t
  misc_feature (2838)..(2840): n is a, c, g, or t
  misc_feature (2843)..(2843): n is a, c, g, or t
  misc_feature (2845)..(2846): n is a, c, g, or t
  misc_feature (2848)..(2850): n is a, c, g, or t
  misc_feature (2852)..(2852): n is a, c, g, or t
  misc_feature (2854)..(2854): n is a, c, g, or t
  misc_feature (2856)..(2859): n is a, c, g, or t
  misc_feature (2861)..(2861): n is a, c, g, or t
  misc_feature (2863)..(2865): n is a, c, g, or t
  misc_feature (2868)..(2869): n is a, c, g, or t
  misc_feature (2872)..(2873): n is a, c, g, or t
  misc_feature (2875)..(2877): n is a, c, g, or t
  misc_feature (2882)..(2883): n is a, c, g, or t
  misc_feature (2886)..(2888): n is a, c, g, or t
  misc_feature (2890)..(2892): n is a, c, g, or t
  misc_feature (2895)..(2895): n is a, c, g, or t
  misc_feature (2897)..(2900): n is a, c, g, or t
  misc_feature (2902)..(2905): n is a, c, g, or t
  misc_feature (2909)..(2916): n is a, c, g, or t
  misc_feature (2918)..(2919): n is a, c, g, or t
  misc_feature (2921)..(2925): n is a, c, g, or t
  misc_feature (2927)..(2927): n is a, c, g, or t
  misc_feature (2929)..(2932): n is a, c, g, or t
  misc_feature (2937)..(2937): n is a, c, g, or t
  misc_feature (2939)..(2939): n is a, c, g, or t
  misc_feature (2941)..(2941): n is a, c, g, or t
  misc_feature (2943)..(2943): n is a, c, g, or t
  misc_feature (2945)..(2945): n is a, c, g, or t
  misc_feature (2947)..(2947): n is a, c, g, or t
  misc_feature (2950)..(2952): n is a, c, g, or t
  misc_feature (2954)..(2958): n is a, c, g, or t
  misc_feature (2960)..(2961): n is a, c, g, or t
  misc_feature (2963)..(2963): n is a, c, g, or t
  misc_feature (2965)..(2966): n is a, c, g, or t
  misc_feature (2969)..(2972): n is a, c, g, or t
  misc_feature (2974)..(2978): n is a, c, g, or t
  misc_feature (2981)..(2984): n is a, c, g, or t
  misc_feature (2986)..(2987): n is a, c, g, or t
  misc_feature (2989)..(2990): n is a, c, g, or t
  misc_feature (2992)..(2993): n is a, c, g, or t
  misc_feature (2995)..(2996): n is a, c, g, or t
  misc_feature (2998)..(3004): n is a, c, g, or t
  misc_feature (3007)..(3008): n is a, c, g, or t
  misc_feature (3010)..(3012): n is a, c, g, or t
  misc_feature (3016)..(3016): n is a, c, g, or t
  misc_feature (3018)..(3020): n is a, c, g, or t
  misc_feature (3022)..(3027): n is a, c, g, or t
  misc_feature (3030)..(3030): n is a, c, g, or t
  misc_feature (3032)..(3034): n is a, c, g, or t
  misc_feature (3039)..(3041): n is a, c, g, or t
  misc_feature (3043)..(3043): n is a, c, g, or t
  misc_feature (3045)..(3047): n is a, c, g, or t
  misc_feature (3050)..(3054): n is a, c, g, or t
  misc_feature (3057)..(3063): n is a, c, g, or t
  misc_feature (3065)..(3068): n is a, c, g, or t
  misc_feature (3070)..(3070): n is a, c, g, or t
  misc_feature (3072)..(3082): n is a, c, g, or t
  misc_feature (3086)..(3087): n is a, c, g, or t
  misc_feature (3089)..(3089): n is a, c, g, or t
  misc_feature (3091)..(3093): n is a, c, g, or t
  misc_feature (3096)..(3097): n is a, c, g, or t
  misc_feature (3102)..(3102): n is a, c, g, or t
  misc_feature (3104)..(3105): n is a, c, g, or t
  misc_feature (3107)..(3110): n is a, c, g, or t
  misc_feature (3113)..(3113): n is a, c, g, or t
  misc_feature (3115)..(3115): n is a, c, g, or t
  misc_feature (3117)..(3117): n is a, c, g, or t
  misc_feature (3119)..(3126): n is a, c, g, or t
  misc_feature (3130)..(3132): n is a, c, g, or t
  misc_feature (3134)..(3136): n is a, c, g, or t
  misc_feature (3140)..(3140): n is a, c, g, or t
  misc_feature (3142)..(3144): n is a, c, g, or t
  misc_feature (3146)..(3146): n is a, c, g, or t
  misc_feature (3149)..(3152): n is a, c, g, or t
  misc_feature (3154)..(3162): n is a, c, g, or t
  misc_feature (3164)..(3164): n is a, c, g, or t
  misc_feature (3167)..(3167): n is a, c, g, or t
  misc_feature (3169)..(3171): n is a, c, g, or t
  misc_feature (3173)..(3174): n is a, c, g, or t
  misc_feature (3176)..(3179): n is a, c, g, or t
  misc_feature (3185)..(3189): n is a, c, g, or t
  misc_feature (3191)..(3191): n is a, c, g, or t
  misc_feature (3193)..(3193): n is a, c, g, or t
  misc_feature (3195)..(3196): n is a, c, g, or t
  misc_feature (3200)..(3204): n is a, c, g, or t
  misc_feature (3206)..(3206): n is a, c, g, or t
  misc_feature (3208)..(3208): n is a, c, g, or t
  misc_feature (3210)..(3211): n is a, c, g, or t
  misc_feature (3213)..(3223): n is a, c, g, or t
  misc_feature (3225)..(3228): n is a, c, g, or t
  misc_feature (3230)..(3231): n is a, c, g, or t
  misc_feature (3233)..(3239): n is a, c, g, or t
  misc_feature (3241)..(3241): n is a, c, g, or t
  misc_feature (3243)..(3249): n is a, c, g, or t
  misc_feature (3251)..(3251): n is a, c, g, or t
  misc_feature (3253)..(3254): n is a, c, g, or t
  misc_feature (3256)..(3263): n is a, c, g, or t
  misc_feature (3265)..(3267): n is a, c, g, or t
  misc_feature (3270)..(3270): n is a, c, g, or t
  misc_feature (3272)..(3272): n is a, c, g, or t
  misc_feature (3278)..(3281): n is a, c, g, or t
  misc_feature (3285)..(3289): n is a, c, g, or t
  misc_feature (3291)..(3296): n is a, c, g, or t
  misc_feature (3298)..(3300): n is a, c, g, or t
  misc_feature (3303)..(3305): n is a, c, g, or t
  misc_feature (3308)..(3308): n is a, c, g, or t
  misc_feature (3310)..(3316): n is a, c, g, or t
  misc_feature (3320)..(3320): n is a, c, g, or t
  misc_feature (3322)..(3332): n is a, c, g, or t
  misc_feature (3335)..(3337): n is a, c, g, or t
  misc_feature (3339)..(3340): n is a, c, g, or t
  misc_feature (3344)..(3347): n is a, c, g, or t
  misc_feature (3349)..(3351): n is a, c, g, or t
  misc_feature (3353)..(3355): n is a, c, g, or t
  misc_feature (3357)..(3359): n is a, c, g, or t
  misc_feature (3361)..(3368): n is a, c, g, or t
  misc_feature (3373)..(3390): n is a, c, g, or t
  misc_feature (3393)..(3395): n is a, c, g, or t
  misc_feature (3397)..(3398): n is a, c, g, or t
  misc_feature (3400)..(3404): n is a, c, g, or t
  misc_feature (3406)..(3406): n is a, c, g, or t
  misc_feature (3408)..(3413): n is a, c, g, or t
  misc_feature (3418)..(3419): n is a, c, g, or t
  misc_feature (3421)..(3421): n is a, c, g, or t
  misc_feature (3423)..(3426): n is a, c, g, or t
  misc_feature (3430)..(3431): n is a, c, g, or t
  misc_feature (3433)..(3442): n is a, c, g, or t
  misc_feature (3446)..(3457): n is a, c, g, or t
  misc_feature (3459)..(3460): n is a, c, g, or t
  misc_feature (3462)..(3467): n is a, c, g, or t
  misc_feature (3469)..(3471): n is a, c, g, or t
  misc_feature (3473)..(3478): n is a, c, g, or t
  misc_feature (3480)..(3483): n is a, c, g, or t
  misc_feature (3485)..(3489): n is a, c, g, or t
  misc_feature (3491)..(3491): n is a, c, g, or t
  misc_feature (3493)..(3494): n is a, c, g, or t
  misc_feature (3498)..(3499): n is a, c, g, or t
  misc_feature (3501)..(3501): n is a, c, g, or t
  misc_feature (3504)..(3508): n is a, c, g, or t
  misc_feature (3512)..(3512): n is a, c, g, or t
  misc_feature (3514)..(3518): n is a, c, g, or t
  misc_feature (3520)..(3527): n is a, c, g, or t
  misc_feature (3529)..(3529): n is a, c, g, or t
  misc_feature (3531)..(3531): n is a, c, g, or t
  misc_feature (3533)..(3534): n is a, c, g, or t
  misc_feature (3538)..(3539): n is a, c, g, or t
  misc_feature (3541)..(3541): n is a, c, g, or t
  misc_feature (3543)..(3548): n is a, c, g, or t
  misc_feature (3551)..(3552): n is a, c, g, or t
  misc_feature (3554)..(3554): n is a, c, g, or t
  misc_feature (3557)..(3557): n is a, c, g, or t
  misc_feature (3559)..(3559): n is a, c, g, or t
  misc_feature (3563)..(3567): n is a, c, g, or t
  misc_feature (3570)..(3575): n is a, c, g, or t
  misc_feature (3577)..(3578): n is a, c, g, or t
  misc_feature (3580)..(3584): n is a, c, g, or t
  misc_feature (3587)..(3589): n is a, c, g, or t
  misc_feature (3591)..(3591): n is a, c, g, or t
  misc_feature (3593)..(3599): n is a, c, g, or t
  misc_feature (3601)..(3602): n is a, c, g, or t
  misc_feature (3605)..(3607): n is a, c, g, or t
  misc_feature (3609)..(3614): n is a, c, g, or t
  misc_feature (3616)..(3617): n is a, c, g, or t
  misc_feature (3619)..(3619): n is a, c, g, or t
  misc_feature (3621)..(3625): n is a, c, g, or t
  misc_feature (3627)..(3633): n is a, c, g, or t
  misc_feature (3635)..(3635): n is a, c, g, or t
  misc_feature (3637)..(3637): n is a, c, g, or t
  misc_feature (3639)..(3647): n is a, c, g, or t
  misc_feature (3649)..(3651): n is a, c, g, or t
  misc_feature (3653)..(3655): n is a, c, g, or t
  misc_feature (3657)..(3657): n is a, c, g, or t
  misc_feature (3659)..(3662): n is a, c, g, or t
  misc_feature (3664)..(3668): n is a, c, g, or t
  misc_feature (3670)..(3675): n is a, c, g, or t
  misc_feature (3677)..(3678): n is a, c, g, or t
  misc_feature (3680)..(3680): n is a, c, g, or t
  misc_feature (3682)..(3682): n is a, c, g, or t
  misc_feature (3684)..(3686): n is a, c, g, or t
  misc_feature (3689)..(3694): n is a, c, g, or t
  misc_feature (3696)..(3697): n is a, c, g, or t
  misc_feature (3699)..(3702): n is a, c, g, or t
  misc_feature (3704)..(3705): n is a, c, g, or t
  misc_feature (3707)..(3708): n is a, c, g, or t
  misc_feature (3711)..(3716): n is a, c, g, or t
  misc_feature (3718)..(3719): n is a, c, g, or t
  misc_feature (3721)..(3721): n is a, c, g, or t
  misc_feature (3723)..(3724): n is a, c, g, or t
  misc_feature (3728)..(3731): n is a, c, g, or t
  misc_feature (3733)..(3733): n is a, c, g, or t
  misc_feature (3735)..(3743): n is a, c, g, or t
  misc_feature (3745)..(3745): n is a, c, g, or t
  misc_feature (3747)..(3749): n is a, c, g, or t
  misc_feature (3754)..(3759): n is a, c, g, or t
  misc_feature (3762)..(3763): n is a, c, g, or t
  misc_feature (3765)..(3765): n is a, c, g, or t
  misc_feature (3767)..(3769): n is a, c, g, or t
  misc_feature (3771)..(3772): n is a, c, g, or t
  misc_feature (3774)..(3774): n is a, c, g, or t
  misc_feature (3776)..(3780): n is a, c, g, or t
  misc_feature (3782)..(3785): n is a, c, g, or t
  misc_feature (3787)..(3788): n is a, c, g, or t
  misc_feature (3791)..(3799): n is a, c, g, or t
  misc_feature (3801)..(3804): n is a, c, g, or t
  misc_feature (3806)..(3806): n is a, c, g, or t
  misc_feature (3808)..(3810): n is a, c, g, or t
  misc_feature (3812)..(3812): n is a, c, g, or t
  misc_feature (3816)..(3818): n is a, c, g, or t
  misc_feature (3820)..(3820): n is a, c, g, or t
  misc_feature (3823)..(3826): n is a, c, g, or t
  misc_feature (3830)..(3830): n is a, c, g, or t
  misc_feature (3832)..(3832): n is a, c, g, or t
  misc_feature (3834)..(3838): n is a, c, g, or t
  misc_feature (3840)..(3842): n is a, c, g, or t
  misc_feature (3844)..(3845): n is a, c, g, or t
  misc_feature (3848)..(3850): n is a, c, g, or t
  misc_feature (3855)..(3857): n is a, c, g, or t
  misc_feature (3860)..(3860): n is a, c, g, or t
  misc_feature (3862)..(3862): n is a, c, g, or t
  misc_feature (3865)..(3865): n is a, c, g, or t
  misc_feature (3868)..(3869): n is a, c, g, or t
  misc_feature (3871)..(3878): n is a, c, g, or t
  misc_feature (3880)..(3884): n is a, c, g, or t
  misc_feature (3888)..(3890): n is a, c, g, or t
  misc_feature (3892)..(3892): n is a, c, g, or t
  misc_feature (3894)..(3894): n is a, c, g, or t
  misc_feature (3896)..(3896): n is a, c, g, or t
  misc_feature (3898)..(3898): n is a, c, g, or t
  misc_feature (3900)..(3902): n is a, c, g, or t
  misc_feature (3904)..(3912): n is a, c, g, or t
  misc_feature (3915)..(3923): n is a, c, g, or t
  misc_feature (3925)..(3926): n is a, c, g, or t
  misc_feature (3929)..(3929): n is a, c, g, or t
  misc_feature (3931)..(3932): n is a, c, g, or t
  misc_feature (3934)..(3936): n is a, c, g, or t
  misc_feature (3938)..(3941): n is a, c, g, or t
  misc_feature (3943)..(3943): n is a, c, g, or t
  misc_feature (3945)..(3945): n is a, c, g, or t
  misc_feature (3954)..(3954): n is a, c, g, or t
  misc_feature (3956)..(3957): n is a, c, g, or t
  misc_feature (3960)..(3961): n is a, c, g, or t
  misc_feature (3963)..(3966): n is a, c, g, or t
  misc_feature (3968)..(3979): n is a, c, g, or t
  misc_feature (3981)..(3981): n is a, c, g, or t
  misc_feature (3983)..(3995): n is a, c, g, or t
  misc_feature (3997)..(3997): n is a, c, g, or t
  misc_feature (3999)..(3999): n is a, c, g, or t
cgagttacggacaaaatttatttcatgatggcctgggtttgcggcctggaactgttgctgctcgggtttttcatcacttatcaagttatcgcacgtaaattcctttgggtaatggcgcccgcgaccgatgttatgagtggatatgtattagcgatggctgccacatgggctttttcgtattccctcagatctggatctcacgttcggatagatgtgttgctcccttacatgagtaaaaacatccgagcgattgctgactgggtggccgtattctccgttgcgttcttcgcttacntcacagcgtggaagatgtgggcgaatgttgtggacaactaccaacggggtgtcgttaccaatgactacccactcacgccgctttttatacctaaaatagttgttgctctgggcttcacacttctagtcattaccgcagtgcagatgatgatatcgttgattactgaggcatggctgcccaggttgcacaagaaactgggaggcgacgagatccaatccttagacgtaatgggccaagaagaagcggcgggcgcagcgtagcttgggcccggcctaggttccaaaggatatctgatttagtaaaatcctctgtaactggggattgagagggtattaaaagtggcgttaggtgtagcgtttggcctaatgggggcatttttcatggcgggactgtatgtcgccgccgctctgggatgcctctctctagtcatcatgtggttcttctccgatgctcccctctggaacatcatggcgaacaaagcatgggaatcaaacacaagcttcatcctcgtggctgtccctctgttcatcttaatgggcgagttgatgaaccgcagcggaatgggcgagaaaatgtattccgcaatatctaaatggatcttctttcttccgggaggcctgatccacaccaacattgtatcttgcgccatctttgcagcttgctccggatctagtgttgcaacatcggcaacgatcagtcgtgtatcgctcccgtcgttccggcaacgcggttactccgagcggatggtgattggatccttagctgcaggtgggaccttgggaatcttgattcctcccagtatcagcttgatcatctatggtgttctagtagaagaatcaattgggagactgtatctcgccggattcattcccgggttcatgctcgctggcatcttcatgttaatgattgcggggctggccatcgtgtggaagggtatggcgccgcgagaagnaggggcgggcttcagttcatgggacggctgggtggacaggatagtcagtctagtaggcctantcccaatgatcgtgctgatattcatcgtcttaggcagcatttatgngggttgggcgactcccagtgaggcagccgcgttcggtgtctctggtgctttcgccttggcaattctcatgaattctcagggcatagtcgcaccaatttttgctaaattcctaatgttgaccggattgatcaatatagtctctgatagcttcaaagaagaaatganatctcacangatgccagattgggcggtgtngagggcaacgttaaacactaactncgatatcgttgtaagcgcaatgatatctactatgcgtaccactggaatgatcttcctgataatcctcgccgcctttaccttgagttttgcattcgcccggttgggaatttctgcgcagatcgcggatacgatcaccagttgggatctgtctccaactatgctggtactcgtgctgatcgtgttctacctaatacttggcactttcatggaaagcttcgcgatgatggtcacgaccgtgcccatcctggtacctaccttggagcaggctggtgttgatctggtttggttcggcatcatcatggtgatattggttgaagctgcgttgattagtcctccggaggggattaacctttatgtgctccacggagtacggcaggatgtcgaccgcgagcaagcgcgactcgcaaatgagattgtgaaagagagcactatcgccgacgtatggataggcgtactaccgtttatggcttgtatgggaatcaccgttgtactagttatgctttttccgcagatcgctctatggctgcctgatctggtcaaaggtagccggtaacggtcaaatctcgattcccgggacgattgagaagagcttcgaccccgtgttagaaccgaattgaatatcgcaaggagttcagaaatgctaagattcngattaactgccatgttgctggtcgtggtttcaattatnctggtcggttgcggttcggatccgaccgcagcccccgcagcccccgcagcccccgcagcnnccgcagcggccgcagcnnccgcagcnccngcagcnncngcngcnccnncngntccnacnnnnnnanaannannngaannannngnnnnnnacgnngccgnnnnggncggngnggtngncnnnnnanacctggnngacctggnngnncnngnngnnncngnngnnnnggnngacnncgncgnnnncgncnnnntcnnnncnctcnntnncnncnannannncnnnnannncnannannncnnnnnnnnnnngnngatnnnnannnnnnccaatcnnaccanncnnancnnnnnnnncannnnnnncnnnnnnnnnnncnnnnnnnncnncnggncnnnnngggcntnnnngnnnnnnnannngncnnnnnngncnnnnntnnnnnnncnnnnnnnnngnnnnnnnnnnnnnntnnnnnncnncntcnnnnnnttnnnnnnggnnggncnngnnnnncncnacnnnntcnnnnnngncgnannngncnnnnncgccnnnnncgncgnctacgnnggnnncgngnngnnngncntnnnngncnnnganntcnngnnnctctnngannncnnnganannnngnnnnaagnnnnnnnngnnannnnngngnnnntcgangngntngngncgnnngnnnnngnngngnncgnnnngnnnnnccnnnncnncnncnncnncnnnnnnnacnncnnntacntnnncnnnnnnganannnttgannncntnnnagnnnnnaannnnnnnannnncngnnnnnnnnnnncggnntngnnngannggatngnngnnnnggncncntnnnnnnnnttcnnngnnntctncnnngnctnnnnannnnnnnnncnggncnnngnngnnnntggtgnnnnngntncnnacgnnnnncncngnnannnnnnnnnnnannnnannannnnnnngntnnnnnnntngnncnnnnnnnncnnngtnancaacgnnnncaannnnnannnnnncnnntcnnnccncnnnnnnntccngnnnnnnnnnnncgnnnannccgnnnngnnngnnntnnngnnnnnnnngatcnnnnnnnnnnnnnnnnnnatnnngnncnnnnngnannnnnnggaanncntnnnnttcnnannnnnnnnnnaagnnnnnnnnnnnnanngnnnnnncnnngnnnnnntnnnncnnnnntngnngaanngngtnnnnngcgncnnnnncnnnnnnnncncngnnatcnncnannnnnncanngnccncntcgnnnnnctnnnnnncnnannnnncgnnncngnnnnnnngnngannnannnnnnannangnnnnncnnnnnnncngncnnnnnnnnngnnntnnnanannnngnnnnncnnnnnngnncncngnnnacnnnnnngnncnnnntnntnnggnnnnnngnngngnnggcnnnngngnnnnnnnnncngnnntaccnnnnnnacnncnannncnncnannnnncnnnnannacnnnnnnnnncnnnnangnnntnaagnnnangannnncagnangnnnnncnnngnnctnnncgacnnnatngncgncanngnnnnnnnngnnnnnttcnnngnantntncnnngnnnnnnnnngcnnnnnnnnngnnacngnngnnncnnnngngncctgcgggncnngcnngnnnngnnnnnnnnnnnncnannnnnnnnnnnnncngnt

SEQ ID NO: 172 - DNA, 4000 bp, Escherichia coli
  misc_feature (1)..(6): n is a, c, g, or t
  misc_feature (8)..(15): n is a, c, g, or t
  misc_feature (17)..(29): n is a, c, g, or t
  misc_feature (32)..(52): n is a, c, g, or t
  misc_feature (54)..(62): n is a, c, g, or t
  misc_feature (64)..(75): n is a, c, g, or t
  misc_feature (77)..(117): n is a, c, g, or t
  misc_feature (119)..(120): n is a, c, g, or t
  misc_feature (122)..(127): n is a, c, g, or t
  misc_feature (129)..(182): n is a, c, g, or t
  misc_feature (184)..(211): n is a, c, g, or t
  misc_feature (213)..(236): n is a, c, g, or t
  misc_feature (238)..(240): n is a, c, g, or t
  misc_feature (242)..(292): n is a, c, g, or t
  misc_feature (294)..(299): n is a, c, g, or t
  misc_feature (301)..(304): n is a, c, g, or t
  misc_feature (306)..(349): n is a, c, g, or t
  misc_feature (351)..(352): n is a, c, g, or t
  misc_feature (354)..(357): n is a, c, g, or t
  misc_feature (359)..(362): n is a, c, g, or t
  misc_feature (364)..(419): n is a, c, g, or t
  misc_feature (421)..(436): n is a, c, g, or t
  misc_feature (438)..(469): n is a, c, g, or t
  misc_feature (471)..(477): n is a, c, g, or t
  misc_feature (479)..(495): n is a, c, g, or t
  misc_feature (497)..(497): n is a, c, g, or t
  misc_feature (499)..(528): n is a, c, g, or t
  misc_feature (530)..(540): n is a, c, g, or t
  misc_feature (542)..(547): n is a, c, g, or t
  misc_feature (549)..(660): n is a, c, g, or t
  misc_feature (662)..(686): n is a, c, g, or t
  misc_feature (688)..(709): n is a, c, g, or t
  misc_feature (711)..(751): n is a, c, g, or t
  misc_feature (753)..(763): n is a, c, g, or t
  misc_feature (765)..(796): n is a, c, g, or t
  misc_feature (798)..(807): n is a, c, g, or t
  misc_feature (809)..(818): n is a, c, g, or t
  misc_feature (820)..(901): n is a, c, g, or t
  misc_feature (903)..(929): n is a, c, g, or t
  misc_feature (931)..(1038): n is a, c, g, or t
  misc_feature (1041)..(1044): n is a, c, g, or t
  misc_feature (1046)..(1047): n is a, c, g, or t
  misc_feature (1049)..(1062): n is a, c, g, or t
  misc_feature (1064)..(1077): n is a, c, g, or t
  misc_feature (1079)..(1079): n is a, c, g, or t
  misc_feature (1083)..(1083): n is a, c, g, or t
  misc_feature (1085)..(1117): n is a, c, g, or t
  misc_feature (1119)..(1147): n is a, c, g, or t
  misc_feature (1149)..(1149): n is a, c, g, or t
  misc_feature (1151)..(1153): n is a, c, g, or t
  misc_feature (1155)..(1185): n is a, c, g, or t
  misc_feature (1187)..(1187): n is a, c, g, or t
  misc_feature (1190)..(1195): n is a, c, g, or t
  misc_feature (1197)..(1198): n is a, c, g, or t
  misc_feature (1200)..(1202): n is a, c, g, or t
  misc_feature (1204)..(1219): n is a, c, g, or t
  misc_feature (1221)..(1229): n is a, c, g, or t
  misc_feature (1231)..(1236): n is a, c, g, or t
  misc_feature (1238)..(1241): n is a, c, g, or t
  misc_feature (1243)..(1244): n is a, c, g, or t
  misc_feature (1246)..(1257): n is a, c, g, or t
  misc_feature (1260)..(1260): n is a, c, g, or t
  misc_feature (1264)..(1264): n is a, c, g, or t
  misc_feature (1266)..(1267): n is a, c, g, or t
  misc_feature (1269)..(1275): n is a, c, g, or t
  misc_feature (1277)..(1278): n is a, c, g, or t
  misc_feature (1281)..(1287): n is a, c, g, or t
  misc_feature (1289)..(1289): n is a, c, g, or t
  misc_feature (1291)..(1291): n is a, c, g, or t
  misc_feature (1293)..(1296): n is a, c, g, or t
  misc_feature (1299)..(1300): n is a, c, g, or t
  misc_feature (1302)..(1303): n is a, c, g, or t
  misc_feature (1305)..(1307): n is a, c, g, or t
  misc_feature (1310)..(1313): n is a, c, g, or t
  misc_feature (1984)..(1984): n is a, c, g, or t
  misc_feature (1986)..(1987): n is a, c, g, or t
  misc_feature (1999)..(1999): n is a, c, g, or t
  misc_feature (2322)..(2327): n is a, c, g, or t
  misc_feature (2330)..(2330): n is a, c, g, or t
  misc_feature (2379)..(2379): n is a, c, g, or t
  misc_feature (2394)..(2394): n is a, c, g, or t
  misc_feature (2447)..(2447): n is a, c, g, or t
  misc_feature (2453)..(2453): n is a, c, g, or t
  misc_feature (2457)..(2458): n is a, c, g, or t
  misc_feature (2572)..(2572): n is a, c, g, or t
  misc_feature (2576)..(2576): n is a, c, g, or t
  misc_feature (2578)..(2578): n is a, c, g, or t
  misc_feature (2592)..(2592): n is a, c, g, or t
  misc_feature (2604)..(2604): n is a, c, g, or t
  misc_feature (2609)..(2609): n is a, c, g, or t
  misc_feature (2615)..(2615): n is a, c, g, or t
  misc_feature (2643)..(2643): n is a, c, g, or t
  misc_feature (2653)..(2655): n is a, c, g, or t
  misc_feature (2658)..(2659): n is a, c, g, or t
  misc_feature (2664)..(2670): n is a, c, g, or t
  misc_feature (2681)..(2688): n is a, c, g, or t
  misc_feature (2694)..(2694): n is a, c, g, or t
  misc_feature (2697)..(2698): n is a, c, g, or t
  misc_feature (2700)..(2701): n is a, c, g, or t
  misc_feature (2704)..(2704): n is a, c, g, or t
  misc_feature (2708)..(2708): n is a, c, g, or t
  misc_feature (2710)..(2710): n is a, c, g, or t
  misc_feature (2712)..(2713): n is a, c, g, or t
  misc_feature (2723)..(2723): n is a, c, g, or t
  misc_feature (2725)..(2725): n is a, c, g, or t
  misc_feature (2730)..(2731): n is a, c, g, or t
  misc_feature (2740)..(2740): n is a, c, g, or t
  misc_feature (2743)..(2743): n is a, c, g, or t
  misc_feature (2750)..(2750): n is a, c, g, or t
  misc_feature (2760)..(2761): n is a, c, g, or t
  misc_feature (2764)..(2764): n is a, c, g, or t
  misc_feature (2767)..(2767): n is a, c, g, or t
  misc_feature (2812)..(2812): n is a, c, g, or t
  misc_feature (2824)..(2824): n is a, c, g, or t
  misc_feature (2837)..(2837): n is a, c, g, or t
  misc_feature (2857)..(2857): n is a, c, g, or t
  misc_feature (2931)..(2931): n is a, c, g, or t
  misc_feature (2934)..(2934): n is a, c, g, or t
  misc_feature (2944)..(2944): n is a, c, g, or t
  misc_feature (2948)..(2949): n is a, c, g, or t
  misc_feature (2953)..(2953): n is a, c, g, or t
  misc_feature (2990)..(2997): n is a, c, g, or t
  misc_feature (2999)..(3003): n is a, c, g, or t
  misc_feature (3006)..(3010): n is a, c, g, or t
  misc_feature (3012)..(3022): n is a, c, g, or t
  misc_feature (3025)..(3025): n is a, c, g, or t
  misc_feature (3027)..(3027): n is a, c, g, or t
  misc_feature (3029)..(3029): n is a, c, g, or t
  misc_feature (3031)..(3033): n is a, c, g, or t
  misc_feature (3035)..(3038): n is a, c, g, or t
  misc_feature (3041)..(3042): n is a, c, g, or t
  misc_feature (3044)..(3046): n is a, c, g, or t
  misc_feature (3048)..(3050): n is a, c, g, or t
  misc_feature (3052)..(3056): n is a, c, g, or t
  misc_feature (3058)..(3058): n is a, c, g, or t
  misc_feature (3060)..(3066): n is a, c, g, or t
  misc_feature (3068)..(3068): n is a, c, g, or t
  misc_feature (3070)..(3072): n is a, c, g, or t
  misc_feature (3074)..(3077): n is a, c, g, or t
  misc_feature (3079)..(3079): n is a, c, g, or t
  misc_feature (3081)..(3081): n is a, c, g, or t
  misc_feature (3084)..(3084): n is a, c, g, or t
  misc_feature (3086)..(3087): n is a, c, g, or t
  misc_feature (3089)..(3111): n is a, c, g, or t
  misc_feature (3113)..(3121): n is a, c, g, or t
  misc_feature (3123)..(3123): n is a, c, g, or t
  misc_feature (3125)..(3126): n is a, c, g, or t
  misc_feature (3128)..(3130): n is a, c, g, or t
  misc_feature (3132)..(3132): n is a, c, g, or t
  misc_feature (3134)..(3134): n is a, c, g, or t
  misc_feature (3136)..(3138): n is a, c, g, or t
  misc_feature (3140)..(3142): n is a, c, g, or t
  misc_feature (3145)..(3145): n is a, c, g, or t
  misc_feature (3147)..(3155): n is a, c, g, or t
  misc_feature (3157)..(3157): n is a, c, g, or t
  misc_feature (3162)..(3162): n is a, c, g, or t
  misc_feature (3164)..(3165): n is a, c, g, or t
  misc_feature (3168)..(3178): n is a, c, g, or t
  misc_feature (3180)..(3183): n is a, c, g, or t
  misc_feature (3185)..(3186): n is a, c, g, or t
  misc_feature (3188)..(3188): n is a, c, g, or t
  misc_feature (3190)..(3190): n is a, c, g, or t
  misc_feature (3192)..(3192): n is a, c, g, or t
  misc_feature (3194)..(3195): n is a, c, g, or t
  misc_feature (3197)..(3197): n is a, c, g, or t
  misc_feature (3201)..(3204): n is a, c, g, or t
  misc_feature (3206)..(3217): n is a, c, g, or t
  misc_feature (3219)..(3219): n is a, c, g, or t
  misc_feature (3221)..(3223): n is a, c, g, or t
  misc_feature (3225)..(3225): n is a, c, g, or t
  misc_feature (3227)..(3227): n is a, c, g, or t
  misc_feature (3229)..(3229): n is a, c, g, or t
  misc_feature (3231)..(3237): n is a, c, g, or t
  misc_feature (3239)..(3239): n is a, c, g, or t
  misc_feature (3241)..(3241): n is a, c, g, or t
  misc_feature (3243)..(3245): n is a, c, g, or t
  misc_feature (3250)..(3258): n is a, c, g, or t
  misc_feature (3260)..(3261): n is a, c, g, or t
  misc_feature (3263)..(3263): n is a, c, g, or t
  misc_feature (3265)..(3275): n is a, c, g, or t
  misc_feature (3277)..(3279): n is a, c, g, or t
  misc_feature (3281)..(3282): n is a, c, g, or t
  misc_feature (3284)..(3288): n is a, c, g, or t
  misc_feature (3292)..(3292): n is a, c, g, or t
  misc_feature (3294)..(3308): n is a, c, g, or t
  misc_feature (3311)..(3314): n is a, c, g, or t
  misc_feature (3317)..(3317): n is a, c, g, or t
  misc_feature (3322)..(3325): n is a, c, g, or t
  misc_feature (3327)..(3336): n is a, c, g, or t
  misc_feature (3338)..(3341): n is a, c, g, or t
  misc_feature (3344)..(3346): n is a, c, g, or t
  misc_feature (3348)..(3353): n is a, c, g, or t
  misc_feature (3355)..(3357): n is a, c, g, or t
  misc_feature (3360)..(3360): n is a, c, g, or t
  misc_feature (3362)..(3366): n is a, c, g, or t
  misc_feature (3368)..(3370): n is a, c, g, or t
  misc_feature (3372)..(3372): n is a, c, g, or t
  misc_feature (3374)..(3377): n is a, c, g, or t
  misc_feature (3379)..(3380): n is a, c, g, or t
  misc_feature (3382)..(3391): n is a, c, g, or t
  misc_feature (3394)..(3394): n is a, c, g, or t
  misc_feature (3396)..(3396): n is a, c, g, or t
  misc_feature (3399)..(3402): n is a, c, g, or t
  misc_feature (3404)..(3404): n is a, c, g, or t
  misc_feature (3407)..(3418): n is a, c, g, or t
  misc_feature (3420)..(3420): n is a, c, g, or t
  misc_feature (3422)..(3422): n is a, c, g, or t
  misc_feature (3425)..(3431): n is a, c, g, or t
  misc_feature (3433)..(3446): n is a, c, g, or t
  misc_feature (3448)..(3449): n is a, c, g, or t
  misc_feature (3452)..(3452): n is a, c, g, or t
  misc_feature (3456)..(3462): n is a, c, g, or t
  misc_feature (3464)..(3473): n is a, c, g, or t
  misc_feature (3475)..(3477): n is a, c, g, or t
  misc_feature (3479)..(3482): n is a, c, g, or t
  misc_feature (3484)..(3486): n is a, c, g, or t
  misc_feature (3488)..(3490): n is a, c, g, or t
  misc_feature (3493)..(3497): n is a, c, g, or t
  misc_feature (3499)..(3500): n is a, c, g, or t
  misc_feature (3503)..(3504): n is a, c, g, or t
  misc_feature (3506)..(3508): n is a, c, g, or t
  misc_feature (3511)..(3520): n is a, c, g, or t
  misc_feature (3522)..(3522): n is a, c, g, or t
  misc_feature (3526)..(3526): n is a, c, g, or t
  misc_feature (3528)..(3537): n is a, c, g, or t
  misc_feature (3541)..(3542): n is a, c, g, or t
  misc_feature (3544)..(3545): n is a, c, g, or t
  misc_feature (3547)..(3557): n is a, c, g, or t
  misc_feature (3559)..(3592): n is a, c, g, or t
  misc_feature (3594)..(3600): n is a, c, g, or t
  misc_feature (3602)..(3610): n is a, c, g, or t
  misc_feature (3613)..(3616): n is a, c, g, or t
  misc_feature (3618)..(3618): n is a, c, g, or t
  misc_feature (3620)..(3622): n is a, c, g, or t
  misc_feature (3624)..(3624): n is a, c, g, or t
  misc_feature (3626)..(3626): n is a, c, g, or t
  misc_feature (3629)..(3634): n is a, c, g, or t
  misc_feature (3636)..(3639): n is a, c, g, or t
  misc_feature (3641)..(3646): n is a, c, g, or t
  misc_feature (3648)..(3655): n is a, c, g, or t
  misc_feature (3657)..(3658): n is a, c, g, or t
  misc_feature (3660)..(3663): n is a, c, g, or t
  misc_feature (3665)..(3671): n is a, c, g, or t
  misc_feature (3673)..(3673): n is a, c, g, or t
  misc_feature (3675)..(3675): n is a, c, g, or t
  misc_feature (3677)..(3678): n is a, c, g, or t
  misc_feature (3680)..(3690): n is a, c, g, or t
  misc_feature (3692)..(3694): n is a, c, g, or t
  misc_feature (3696)..(3696): n is a, c, g, or t
  misc_feature (3698)..(3698): n is a, c, g, or t
  misc_feature (3701)..(3705): n is a, c, g, or t
  misc_feature (3708)..(3709): n is a, c, g, or t
  misc_feature (3711)..(3711): n is a, c, g, or t
  misc_feature (3713)..(3726): n is a, c, g, or t
  misc_feature (3728)..(3729): n is a, c, g, or t
  misc_feature (3731)..(3735): n is a, c, g, or t
  misc_feature (3739)..(3743): n is a, c, g, or t
  misc_feature (3746)..(3746): n is a, c, g, or t
  misc_feature (3748)..(3748): n is a, c, g, or t
  misc_feature (3750)..(3758): n is a, c, g, or t
  misc_feature (3760)..(3767): n is a, c, g, or t
  misc_feature (3769)..(3769): n is a, c, g, or t
  misc_feature (3771)..(3773): n is a, c, g, or t
  misc_feature (3775)..(3779): n is a, c, g, or t
  misc_feature (3781)..(3784): n is a, c, g, or t
  misc_feature (3786)..(3787): n is a, c, g, or t
  misc_feature (3789)..(3790): n is a, c, g, or t
  misc_feature (3792)..(3796): n is a, c, g, or t
  misc_feature (3799)..(3799): n is a, c, g, or t
  misc_feature (3801)..(3801): n is a, c, g, or t
  misc_feature (3803)..(3812): n is a, c, g, or t
  misc_feature (3814)..(3816): n is a, c, g, or t
  misc_feature (3818)..(3819): n is a, c, g, or t
  misc_feature (3821)..(3825): n is a, c, g, or t
  misc_feature (3827)..(3827): n is a, c, g, or t
  misc_feature (3829)..(3830): n is a, c, g, or t
  misc_feature (3834)..(3844): n is a, c, g, or t
  misc_feature (3846)..(3850): n is a, c, g, or t
  misc_feature (3852)..(3852): n is a, c, g, or t
  misc_feature (3854)..(3854): n is a, c, g, or t
  misc_feature (3857)..(3857): n is a, c, g, or t
  misc_feature (3859)..(3859): n is a, c, g, or t
  misc_feature (3861)..(3870): n is a, c, g, or t
  misc_feature (3872)..(3882): n is a, c, g, or t
  misc_feature (3884)..(3896): n is a, c, g, or t
  misc_feature (3898)..(3898): n is a, c, g, or t
  misc_feature (3900)..(3900): n is a, c, g, or t
  misc_feature (3902)..(3903): n is a, c, g, or t
  misc_feature (3905)..(3907): n is a, c, g, or t
  misc_feature (3909)..(3919): n is a, c, g, or t
  misc_feature (3922)..(3923): n is a, c, g, or t
  misc_feature (3926)..(3935): n is a, c, g, or t
  misc_feature (3937)..(3940): n is a, c, g, or t
  misc_feature (3943)..(3944): n is a, c, g, or t
  misc_feature (3947)..(3948): n is a, c, g, or t
  misc_feature (3950)..(3957): n is a, c, g, or t
  misc_feature (3960)..(3963): n is a, c, g, or t
  misc_feature (3965)..(3965): n is a, c, g, or t
  misc_feature (3967)..(3967): n is a, c, g, or t
  misc_feature (3969)..(3970): n is a, c, g, or t
  misc_feature (3972)..(3985): n is a, c, g, or t
  misc_feature (3987)..(3988): n is a, c, g, or t
  misc_feature (3993)..(3993): n is a, c, g, or t
  misc_feature (3996)..(3996): n is a, c, g, or t
  misc_feature (3998)..(3999): n is a, c, g, or t
nnnnnnannnnnnnnannnnnnnnnnnnnttnnnnnnnnnnnnnnnnnnnnnannnnnnnnnannnnnnnnnnnntnnnnnnnnnnnnnnnnnnnnnnnnnnnnnnnnnnnnnnnnnannannnnnnannnnnnnnnnnnnnnnnnnnnnnnnnnnnnnnnnnnnnnnnnnnnnnnnnnnnnannnnnnnnnnnnnnnnnnnnnnnnnnnnannnnnnnnnnnnnnnnnnnnnnnnannnannnnnnnnnnnnnnnnnnnnnnnnnnnnnnnnnnnnnnnnnnnnnnnnnnnannnnnnannnnannnnnnnnnnnnnnnnnnnnnnnnnnnnnnnnnnnnnnnnnnnnannannnnannnnannnnnnnnnnnnnnnnnnnnnnnnnnnnnnnnnnnnnnnnnnnnnnnnnnnnnnnnannnnnnnnnnnnnnnnannnnnnnnnnnnnnnnnnnnnnnnnnnnnnnnannnnnnnannnnnnnnnnnnnnnnnanannnnnnnnnnnnnnnnnnnnnnnnnnnnnnannnnnnnnnnnannnnnntnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnannnnnnnnnnnnnnnnnnnnnnnnnannnnnnnnnnnnnnnnnnnnnnannnnnnnnnnnnnnnnnnnnnnnnnnnnnnnnnnnnnnnnnannnnnnnnnnnannnnnnnnnnnnnnnnnnnnnnnnnnnnnnnnannnnnnnnnnannnnnnnnnntnnnnnnnnnnnnnnnnnnnnnnnnnnnnnnnnnnnnnnnnnnnnnnnnnnnnnnnnnnnnnnnnnnnnnnnnnnnnnnnnnnannnnnnnnnnnnnnnnnnnnnnnnnnnannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaannnnannannnnnnnnnnnnnnannnnnnnnnnnnnnanaaanannnnnnnnnnnnnnnnnnnnnnnnnnnnnnnnncnnnnnnnnnnnnnnnnnnnnnnnnnnnnntncnnnannnnnnnnnnnnnnnnnnnnnnnnnnnnnnncnttnnnnnntnntnnntnnnnnnnnnnnnnnnntnnnnnnnnnannnnnnannnntnnannnnnnnnnnnnaanaaanannannnnnnnannaannnnnnntncncnnnnccnngnngnnnggnnnngacgtacataagcttacgggttattagtactactcgactatgacattactgcctttacatctatagcctatcaacgtggtcatcttccacgacccttaaaagaaatctcatcttgtggtgggtttcgcgcttatatgctttcagcgcttatcccttccaaacgtagctactctgcggtgctcctggcggaacaacagatacaccagaggtttgtccaattcggtcctctcgtactagaatcagatccactcaaatttctaacgcccacagtagatagagaccgaactgtctcacgacgttctgaacccagctcgcgtgccactttaatgggcgaacagcccaacccttgggaccttctccagccccaggatgtgacgagccgacatcgaggtgccaaacccccccgtcgatatgagctcttgggggagatcagcctgttatccccggcgtaccttttatcctttgagcgatggcccttccatgcggaaccaccggatcactatgctctactttcgtacctgatcgacctgtatgtctctcagtcaagctcccttatgccattgcactctacgcacggttaccaagcgtgctgagggaacctttagaagcctccgttactcttttggaggcgaccaccccagtcaaactacccaccaagcaatgtcccccgnannacggggttaganctcagataagcaaagggtggtatttcaacaatgactccacaacgcctagcgacgccacttcatagtctcccacctatcctacacatcacttatccaagaccaatactaagctatagtaaaggtgcacagggtcttttcgtcccactgcgggtaatcggcatcttcaccgatactacaatttcaccgagctcatggctgagacagtgtccagatcgttacaccattcgtgcaggtcggaacttacccgacaaggaatttcgctaccttaggaccgttatagttacggccgccgtttactggggcttcaattcaatgcttctccnnnnnnatnacatctcctcttaaccttccagcaccgggcaggtgtcaggccctatacntcatcttacgatttngcagagccctgtgtttttgataaacagtcgcctggaccttttcactgcggccngcattnctgnnggcgacctttctcccgaagttacaggtctattttgcctaattccttagccatgaatctctcgagcaccttaggattctctcctcgactacctgtgtcggtttacggtacgggtncttntnatctaagtttagangtttttcttggnagccnttaggnacactatctctttgtccgaagactccgngtactatcannnttnnccaannnnnnnggatttgcctnnnnnnnntatagntanntnnttnaacnancnnttccgtcagntngcggnnctttcatcnctncgtcacnccatcacaannaanagnagtacgggaatattaacccgttggccatcgactgtccctttcggnttcgccttaggncccgactaacccncagctgattagcatagctgnggaaaccttagtctttcggtgtgcgggtttctcgcccgcattatcgttacttatgcctacattttcttttctanccngtccagcatncctnncganacaccttcaaccctgttagaatgctcccctaccactnnnnnnnntnnnnnaannnnnannnnnnnnnnnatntntntnnncnnnnttnntnnncnnncnnnnncncnnnnnnngngnnntnnnncncnctntnnannnnnnnnnnnnnnnnnnnnnnnannnnnnnnntntnngnnnananannncnnnttntnnnnnnnnnanatatntnnggnnnnnnnnnnngnnnntnngntntntnncnctcnnnnannnnnnnnnnnncncnnncncncncnnnnnnnananannntatannnnnnnnngnntntnnnnnnnnnnngnnngnngnnnnncccncnnnnnnnnnnnnnnnctnnnnctntatannnntnnnnnnnnnncnnnncannnannnnnntnnnggngnnnnngnnntntnnnngnntnnnnnnnnnntcncnccnnnncncannnnnnnnnnnnantnttnnnnnnnannnnnnnnnnnnnncnnctntgtnnnnnnncnnnnnnnnnncnnncnnnngnnnannncannnnntnncgnntnnnacnnnnnnnnnnancgcncnnnnnnnnnnctcnntnncnnnnnnnnnnngnnnnnnnnnnnnnnnnnnnnnnnnnnnnnnnnnncnnnnnnncnnnnnnnnnaannnncncnnncncnccnnnnnngnnnncnnnnnncnnnnnnnngnntnnnntnnnnnnntntntnncnnnnnnnnnnncnnntntnttnnnnnctnncncnnnnnnnnnnnnnncnntnnnnntctnnnnngtntntnnnnnnnnngnnnnnnnncncnnnannnnnannnngnntnncnnnnnccncncnnnnnnnnnnannncnntnnnnntntnntctnnnnnnnnnnngnnnnncncnctntntnnnnnnnnnntnnnnnnnnnnntnnnnnnnnnnnnnanananntnnngnnnnnnnnnnnccnnaannnnnnnnnnannnnttnngtnngnnnnnnnncgnnnncncncnncnnnnnnnnnnnnnncnnttttnttntnnt

SEQ ID NO: 173 - DNA, 4000 bp, Escherichia coli
  misc_feature (40)..(40): n is a, c, g, or t
  misc_feature (82)..(82): n is a, c, g, or t
  misc_feature (885)..(885): n is a, c, g, or t
  misc_feature (894)..(894): n is a, c, g, or t
  misc_feature (1930)..(1931): n is a, c, g, or t
  misc_feature (1933)..(1933): n is a, c, g, or t
  misc_feature (1942)..(1943): n is a, c, g, or t
  misc_feature (1958)..(1958): n is a, c, g, or t
  misc_feature (1963)..(1964): n is a, c, g, or t
  misc_feature (1969)..(1969): n is a, c, g, or t
  misc_feature (1972)..(1972): n is a, c, g, or t
  misc_feature (1984)..(1985): n is a, c, g, or t
  misc_feature (1987)..(1987): n is a, c, g, or t
  misc_feature (1990)..(1990): n is a, c, g, or t
  misc_feature (1996)..(1996): n is a, c, g, or t
  misc_feature (1999)..(1999): n is a, c, g, or t
  misc_feature (2583)..(2583): n is a, c, g, or t
  misc_feature (2612)..(2612): n is a, c, g, or t
  misc_feature (2661)..(2661): n is a, c, g, or t
  misc_feature (2695)..(2695): n is a, c, g, or t
  misc_feature (2697)..(2697): n is a, c, g, or t
  misc_feature (2754)..(2754): n is a, c, g, or t
  misc_feature (2762)..(2762): n is a, c, g, or t
  misc_feature (2779)..(2779): n is a, c, g, or t
  misc_feature (2782)..(2783): n is a, c, g, or t
  misc_feature (2807)..(2807): n is a, c, g, or t
  misc_feature (2810)..(2810): n is a, c, g, or t
  misc_feature (2814)..(2814): n is a, c, g, or t
  misc_feature (2825)..(2825): n is a, c, g, or t
  misc_feature (2828)..(2828): n is a, c, g, or t
  misc_feature (2831)..(2831): n is a, c, g, or t
  misc_feature (2837)..(2837): n is a, c, g, or t
  misc_feature (2847)..(2847): n is a, c, g, or t
  misc_feature (2852)..(2852): n is a, c, g, or t
  misc_feature (2864)..(2864): n is a, c, g, or t
  misc_feature (2871)..(2871): n is a, c, g, or t
  misc_feature (2885)..(2885): n is a, c, g, or t
  misc_feature (2887)..(2888): n is a, c, g, or t
  misc_feature (2900)..(2900): n is a, c, g, or t
  misc_feature (2903)..(2903): n is a, c, g, or t
  misc_feature (2924)..(2925): n is a, c, g, or t
  misc_feature (2927)..(2927): n is a, c, g, or t
  misc_feature (2936)..(2936): n is a, c, g, or t
  misc_feature (2963)..(2963): n is a, c, g, or t
  misc_feature (2993)..(2993): n is a, c, g, or t
  misc_feature (2999)..(2999): n is a, c, g, or t
  misc_feature (3029)..(3029): n is a, c, g, or t
  misc_feature (3047)..(3047): n is a, c, g, or t
  misc_feature (3050)..(3051): n is a, c, g, or t
  misc_feature (3053)..(3053): n is a, c, g, or t
  misc_feature (3074)..(3074): n is a, c, g, or t
  misc_feature (3082)..(3083): n is a, c, g, or t
  misc_feature (3086)..(3086): n is a, c, g, or t
  misc_feature (3103)..(3103): n is a, c, g, or t
  misc_feature (3107)..(3107): n is a, c, g, or t
  misc_feature (3118)..(3118): n is a, c, g, or t
  misc_feature (3125)..(3125): n is a, c, g, or t
  misc_feature (3137)..(3137): n is a, c, g, or t
  misc_feature (3142)..(3143): n is a, c, g, or t
  misc_feature (3146)..(3146): n is a, c, g, or t
  misc_feature (3152)..(3152): n is a, c, g, or t
  misc_feature (3158)..(3158): n is a, c, g, or t
  misc_feature (3161)..(3162): n is a, c, g, or t
  misc_feature (3170)..(3171): n is a, c, g, or t
  misc_feature (3182)..(3182): n is a, c, g, or t
  misc_feature (3191)..(3191): n is a, c, g, or t
  misc_feature (3194)..(3194): n is a, c, g, or t
  misc_feature (3203)..(3203): n is a, c, g, or t
  misc_feature (3208)..(3209): n is a, c, g, or t
  misc_feature (3212)..(3212): n is a, c, g, or t
  misc_feature (3224)..(3224): n is a, c, g, or t
  misc_feature (3227)..(3227): n is a, c, g, or t
  misc_feature (3229)..(3230): n is a, c, g, or t
  misc_feature (3233)..(3234): n is a, c, g, or t
  misc_feature (3236)..(3236): n is a, c, g, or t
  misc_feature (3239)..(3240): n is a, c, g, or t
  misc_feature (3247)..(3247): n is a, c, g, or t
  misc_feature (3249)..(3249): n is a, c, g, or t
  misc_feature (3251)..(3251): n is a, c, g, or t
  misc_feature (3260)..(3260): n is a, c, g, or t
  misc_feature (3263)..(3263): n is a, c, g, or t
  misc_feature (3266)..(3266): n is a, c, g, or t
  misc_feature (3274)..(3275): n is a, c, g, or t
  misc_feature (3281)..(3282): n is a, c, g, or t
  misc_feature (3296)..(3296): n is a, c, g, or t
  misc_feature (3302)..(3302): n is a, c, g, or t
  misc_feature (3305)..(3305): n is a, c, g, or t
  misc_feature (3317)..(3317): n is a, c, g, or t
  misc_feature (3320)..(3320): n is a, c, g, or t
  misc_feature (3326)..(3326): n is a, c, g, or t
  misc_feature (3341)..(3341): n is a, c, g, or t
  misc_feature (3364)..(3365): n is a, c, g, or t
  misc_feature (3368)..(3368): n is a, c, g, or t
  misc_feature (3383)..(3384): n is a, c, g, or t
  misc_feature (3386)..(3386): n is a, c, g, or t
  misc_feature (3395)..(3397): n is a, c, g, or t
  misc_feature (3402)..(3408): n is a, c, g, or t
  misc_feature (3410)..(3410): n is a, c, g, or t
  misc_feature (3413)..(3417): n is a, c, g, or t
  misc_feature (3419)..(3426): n is a, c, g, or t
  misc_feature (3428)..(3431): n is a, c, g, or t
  misc_feature (3433)..(3437): n is a, c, g, or t
  misc_feature (3439)..(3439): n is a, c, g, or t
  misc_feature (3441)..(3441): n is a, c, g, or t
  misc_feature (3443)..(3443): n is a, c, g, or t
  misc_feature (3445)..(3445): n is a, c, g, or t
  misc_feature (3447)..(3448): n is a, c, g, or t
  misc_feature (3450)..(3451): n is a, c, g, or t
  misc_feature (3455)..(3456): n is a, c, g, or t
  misc_feature (3458)..(3459): n is a, c, g, or t
  misc_feature (3462)..(3463): n is a, c, g, or t
  misc_feature (3465)..(3466): n is a, c, g, or t
  misc_feature (3470)..(3470): n is a, c, g, or t
  misc_feature (3473)..(3474): n is a, c, g, or t
  misc_feature (3476)..(3476): n is a, c, g, or t
  misc_feature (3478)..(3478): n is a, c, g, or t
  misc_feature (3480)..(3480): n is a, c, g, or t
  misc_feature (3482)..(3483): n is a, c, g, or t
  misc_feature (3487)..(3487): n is a, c, g, or t
  misc_feature (3489)..(3489): n is a, c, g, or t
  misc_feature (3496)..(3497): n is a, c, g, or t
  misc_feature (3500)..(3500): n is a, c, g, or t
  misc_feature (3504)..(3504): n is a, c, g, or t
  misc_feature (3508)..(3510): n is a, c, g, or t
  misc_feature (3513)..(3513): n is a, c, g, or t
  misc_feature (3515)..(3517): n is a, c, g, or t
  misc_feature (3520)..(3522): n is a, c, g, or t
  misc_feature (3525)..(3526): n is a, c, g, or t
  misc_feature (3531)..(3531): n is a, c, g, or t
  misc_feature (3533)..(3534): n is a, c, g, or t
  misc_feature (3536)..(3536): n is a, c, g, or t
  misc_feature (3539)..(3544): n is a, c, g, or t
  misc_feature (3546)..(3547): n is a, c, g, or t
  misc_feature (3549)..(3549): n is a, c, g, or t
  misc_feature (3555)..(3558): n is a, c, g, or t
  misc_feature (3560)..(3562): n is a, c, g, or t
  misc_feature (3564)..(3564): n is a, c, g, or t
  misc_feature (3568)..(3570): n is a, c, g, or t
  misc_feature (3574)..(3574): n is a, c, g, or t
  misc_feature (3578)..(3580): n is a, c, g, or t
  misc_feature (3582)..(3582): n is a, c, g, or t
  misc_feature (3585)..(3586): n is a, c, g, or t
  misc_feature (3589)..(3590): n is a, c, g, or t
  misc_feature (3593)..(3597): n is a, c, g, or t
  misc_feature (3600)..(3602): n is a, c, g, or t
  misc_feature (3604)..(3604): n is a, c, g, or t
  misc_feature (3606)..(3606): n is a, c, g, or t
  misc_feature (3609)..(3611): n is a, c, g, or t
  misc_feature (3615)..(3615): n is a, c, g, or t
  misc_feature (3617)..(3619): n is a, c, g, or t
  misc_feature (3621)..(3624): n is a, c, g, or t
  misc_feature (3626)..(3626): n is a, c, g, or t
  misc_feature (3630)..(3630): n is a, c, g, or t
  misc_feature (3632)..(3635): n is a, c, g, or t
  misc_feature (3637)..(3637): n is a, c, g, or t
  misc_feature (3641)..(3641): n is a, c, g, or t
  misc_feature (3643)..(3643): n is a, c, g, or t
  misc_feature (3645)..(3646): n is a, c, g, or t
  misc_feature (3651)..(3651): n is a, c, g, or t
  misc_feature (3653)..(3653): n is a, c, g, or t
  misc_feature (3656)..(3668): n is a, c, g, or t
  misc_feature (3670)..(3671): n is a, c, g, or t
  misc_feature (3675)..(3675): n is a, c, g, or t
  misc_feature (3679)..(3679): n is a, c, g, or t
  misc_feature (3682)..(3686): n is a, c, g, or t
  misc_feature (3690)..(3690): n is a, c, g, or t
  misc_feature (3692)..(3693): n is a, c, g, or t
  misc_feature (3696)..(3698): n is a, c, g, or t
  misc_feature (3700)..(3701): n is a, c, g, or t
  misc_feature (3703)..(3704): n is a, c, g, or t
  misc_feature (3707)..(3707): n is a, c, g, or t
  misc_feature (3710)..(3710): n is a, c, g, or t
  misc_feature (3712)..(3721): n is a, c, g, or t
  misc_feature (3723)..(3725): n is a, c, g, or t
  misc_feature (3727)..(3727): n is a, c, g, or t
  misc_feature (3731)..(3731): n is a, c, g, or t
  misc_feature (3735)..(3737): n is a, c, g, or t
  misc_feature (3744)..(3745): n is a, c, g, or t
  misc_feature (3748)..(3748): n is a, c, g, or t
  misc_feature (3752)..(3752): n is a, c, g, or t
  misc_feature (3754)..(3755): n is a, c, g, or t
  misc_feature (3757)..(3759): n is a, c, g, or t
  misc_feature (3763)..(3763): n is a, c, g, or t
  misc_feature (3765)..(3766): n is a, c, g, or t
  misc_feature (3768)..(3768): n is a, c, g, or t
  misc_feature (3771)..(3771): n is a, c, g, or t
  misc_feature (3774)..(3774): n is a, c, g, or t
  misc_feature (3776)..(3776): n is a, c, g, or t
  misc_feature (3778)..(3787): n is a, c, g, or t
  misc_feature (3789)..(3790): n is a, c, g, or t
  misc_feature (3792)..(3792): n is a, c, g, or t
  misc_feature (3796)..(3797): n is a, c, g, or t
  misc_feature (3799)..(3802): n is a, c, g, or t
  misc_feature (3808)..(3808): n is a, c, g, or t
  misc_feature (3813)..(3813): n is a, c, g, or t
  misc_feature (3819)..(3822): n is a, c, g, or t
  misc_feature (3825)..(3827): n is a, c, g, or t
  misc_feature (3832)..(3832): n is a, c, g, or t
  misc_feature (3834)..(3834): n is a, c, g, or t
  misc_feature (3837)..(3839): n is a, c, g, or t
  misc_feature (3841)..(3841): n is a, c, g, or t
  misc_feature (3843)..(3843): n is a, c, g, or t
  misc_feature (3845)..(3846): n is a, c, g, or t
  misc_feature (3848)..(3848): n is a, c, g, or t
  misc_feature (3853)..(3854): n is a, c, g, or t
  misc_feature (3856)..(3856): n is a, c, g, or t
  misc_feature (3858)..(3858): n is a, c, g, or t
  misc_feature (3860)..(3863): n is a, c, g, or t
  misc_feature (3870)..(3871): n is a, c, g, or t
  misc_feature (3874)..(3876): n is a, c, g, or t
  misc_feature (3879)..(3879): n is a, c, g, or t
  misc_feature (3885)..(3885): n is a, c, g, or t
  misc_feature (3888)..(3889): n is a, c, g, or t
  misc_feature (3891)..(3893): n is a, c, g, or t
  misc_feature (3898)..(3898): n is a, c, g, or t
  misc_feature (3903)..(3903): n is a, c, g, or t
  misc_feature (3905)..(3905): n is a, c, g, or t
  misc_feature (3907)..(3907): n is a, c, g, or t
  misc_feature (3909)..(3909): n is a, c, g, or t
  misc_feature (3912)..(3916): n is a, c, g, or t
  misc_feature (3918)..(3918): n is a, c, g, or t
  misc_feature (3920)..(3921): n is a, c, g, or t
  misc_feature (3924)..(3925): n is a, c, g, or t
  misc_feature (3928)..(3928): n is a, c, g, or t
  misc_feature (3931)..(3931): n is a, c, g, or t
  misc_feature (3933)..(3937): n is a, c, g, or t
  misc_feature (3939)..(3939): n is a, c, g, or t
  misc_feature (3944)..(3944): n is a, c, g, or t
  misc_feature (3946)..(3946): n is a, c, g, or t
  misc_feature (3948)..(3949): n is a, c, g, or t
  misc_feature (3953)..(3954): n is a, c, g, or t
  misc_feature (3957)..(3959): n is a, c, g, or t
  misc_feature (3963)..(3966): n is a, c, g, or t
  misc_feature (3968)..(3968): n is a, c, g, or t
  misc_feature (3970)..(3973): n is a, c, g, or t
  misc_feature (3975)..(3978): n is a, c, g, or t
  misc_feature (3982)..(3985): n is a, c, g, or t
  misc_feature (3989)..(3990): n is a, c, g, or t
  misc_feature (3993)..(3994): n is a, c, g, or t
  misc_feature (3996)..(3996): n is a, c, g, or t
  misc_feature (3998)..(3999): n is a, c, g, or t
aaaagccacagaagccgcaaaaaaagccaacgatgcggcngcattggcaaacgaaaaagctgtggcggcagatacggcggcngggcgtgtgaatgccgcaataacgcaagccaataccgctgccacaaacgctcaacaacaagcgtcagccgcaggagaagcggcggcagaagcaacggaaagtgtggctgaaatgaacgccgccctcgcccgtttggaagaattggagcagacaatcacggctaaagaccgtaaacagccaacgggaatggaattagagtttcctaaaaaaataacaaaaggaaacaaagacattctgagagtaatagctaccctatccccggcgggaacgggtaacaatgtccttttcttgggcgatgacaaagcggtttccgttgcccctgacggttttctgaccgtgaacagtgtcggcataagcaaaatacacgtcattccgacagaaaacacaagcatttatcgaaccattgatattgaagtcgttccgcagtctgtcaggctttgcacgaaatcaactttgcgcctaaccgcaaatggcaaattcaggttcaattaaaataatttttcaacaaataaaacttttaaattatggcactatcaacagatgaagaaaacaaagtaagggaaatcattgaagcgttcacaaacggaaaacgattgagtgacttacccaatgtttctgggaataacccattcaatcttttgtgtgaggtcttagaagacggagaaagcaaaaaagcagctctcgcaactatgttgccttatatggaagagcagtgtatgtacggcattgagcgagacaagaccgtttcatcacgtttagtaacccgaattggcaatactgctcttcacaagtcccttcccgtncataaccgnatgaggggctgtcttcttgacgatgacggcaacgtggttgaatatctcaatccacgtgattggacggggcatgtcagagacggttcacggggacaagtcatggtcgagtttggggacttctattgccgttttgaaacaagcgcaaatattgagcgggtcaaattctctctctttcctcttcccggctatcgttatgttcctttgatgtacgtatcggcatacgaagctactgttcagagaagtacgaacaagctatcttctgtggtcaatacaacggctgactaccgaggcggtgcaaatcaggctgactgggacacactctcaaaaacggttctcggaagaccagctacacaaatcagccgcacgaatttcagaacgtatgcccgaaacagaaaagcgggcagcactaagtggaactgtatgacgtatgacgttcaaaagatgctctattggctctttgttgttgaatacgcaacgctcaactctcaggaggctttcaacacccaattgacggctgagggctatcgtcaaggcggtctcggagacggggttacaacacttgacagcggcaaatggaacacgtttaacggttattatccttttatcccttgtggctatacggatgaactcggaaacggaacaggcgaaaaagaatataccatgcccactgaatatgacgcttcttcaaagaaagtcaaagtgtgccgttatcgtggtatcgaaaacccgtttgggcatatttggcagtggactgatggcatcaacgtacgcattaatcccggctcgaacggcttgtcagaagtctttgtttgctctgacccctcaaaattcaatgacagtaactataacggatatagtcatgttgggaatgaagcccgtgccgagggatatgttaaagaaattatttttggagaaagcggcgaaatcattcctgctctcgtaggcggcggttctaccacatatttctgtgactatcactatacaaacatccctgcttcggtggctctccgtggtgtcctgttcggcggtagcgcgnntnacggtgcgnntgcgggtctcgcttntgcgnnttcgnctnacgccccctcgnntncgnctgcgnatntcggttctcgcctttgctttatacccacgtcagcgtaacacgctttgagtgataaccttttccctgcctctttgtggggcagggttcaaataataacagtataaaacgatgattgaagaaatgaacaacataccaaaagaagatgacggaagcctcgctttcctgaatatcccgagagatgaaaacagcaggagtttcaattgtgatgaaacgacacaatcaaaactcgtaaacaccacgttttgggtggttgatttcattgaagaagttccgacaagattcagcaaggctaaaggagtaaaaggtcagacgcttgtaaaaatcaagccatcaaaagacagtttggaatcagatgccaagaaatttttcactggttcatccgacattctttatgttttgaagaaaatcaaagaaatgaataagtttccccgaaaagttactttgaggggtaacggtaacagatattattttgaataagaaaacaatgaaataacaaaataaaaaggtgggtcattcttgtggtgtcctgttcagcggtaacgcgaataacagtgcgaatgcaggtctcgcttatgcgaattcgnataacaccccctcgaatacgaatgcgaanatcggttctcacctatgctttaaaattggttttgacaatatgaaacaanataaaagaatgacagccttgccacttggcaaaananttcaagcaaacctcctaaaagtgttggtaggaacgcctgttgtatgggctaccgaanactctgantaagaaaagcaaagcanaannatgaaaagaataggtaatttatanaanaaantaatctccgtnganaanttgcgngaagctgacnaaaangcacgcaaaggnaaaacanacacatacggagtnanngttcacgacaanaancgtgaagcaaatattcttgcnntncatgaagcnttgctgacaaagacgttcaaaacctcnccttatgatgtcttcacgatttttgaaccnaagganaggcttattttccgtcttccgtactatccngacagaatagtacatcangcnntnatgaatgttcttgaaccgatntgggtcannacnttcacgcacaatacttnttcntgtgtcaaggnacgtggnatagaggggtgngcccnncanataganaaaatnatnnagaagtannaaggcaagccnttatactgnctnaaaattganataannaantattatccctcnatnanncannangtnntaaaaanantngtacgccgnaanatnaaagacanngacctnntgtggcttcttgangaaatnatngacagcgcaganggncttccnatcgggaactatctntcacaatatctcgccaacctgtnnttntgctatttcatgcanngngtgaacgannnattgnnnnnnnangcnnnnnannnnnnnnannnnannnnntntntntntnnannaaannannaanngnnggangcnntnanananntaananaaatganngangatnaacnnnaantnnnaannnaannaaacnannanatnnnnnnannancagccnnnngnnntnacannnacgngcgnnngnttnnttnngtnnnnnacnnntncnacnnnaatnannnannnntnaganannnnanaaanangnntttcngncannnnnnnnnnnnncnnaacngacntannnnnttgntnnacnnnanngnntanaancnnnnnnnnnncnnntngctnggtnnngcaaaanntantganannannnattnannanaancantnannnnnnnnnntnntnatgnnannnntttatnacaancagccnnnnaannnggagncngtnnnanangnnanttacnntnancnnnncaacatnnagnnngtngaaaanccnncnnncgttnaaccnancnanctnnnnncngnngannaanccncnnnnnangaacnangnnaatnngannnagcnnnngngnnnncnnnncttnnnncaannaanntnanng

SEQ ID NO: 174 - DNA, 4000 bp, Escherichia coli
  misc_feature (493)..(493): n is a, c, g, or t
  misc_feature (1985)..(1985): n is a, c, g, or t
  misc_feature (1998)..(1998): n is a, c, g, or t
  misc_feature (2001)..(2001): n is a, c, g, or t
  misc_feature (2398)..(2398): n is a, c, g, or t
  misc_feature (2409)..(2409): n is a, c, g, or t
  misc_feature (3567)..(3567): n is a, c, g, or t
  misc_feature (3577)..(3577): n is a, c, g, or t
  misc_feature (3691)..(3691): n is a, c, g, or t
  misc_feature (3733)..(3733): n is a, c, g, or t
  misc_feature (3741)..(3741): n is a, c, g, or t
  misc_feature (3757)..(3757): n is a, c, g, or t
  misc_feature (3790)..(3790): n is a, c, g, or t
  misc_feature (3835)..(3835): n is a, c, g, or t
  misc_feature (3880)..(3880): n is a, c, g, or t
  misc_feature (3925)..(3925): n is a, c, g, or t
  misc_feature (3931)..(3931): n is a, c, g, or t
  misc_feature (3934)..(3934): n is a, c, g, or t
  misc_feature (3995)..(3995): n is a, c, g, or t
tttacctgatacaacagggccatgatttgctaaaagtacggcagacctttttccagccagaccctttatagcttcgcccatcgctggatcgcctgggacaaaaaaaggtaaaagtttgactttgcccaataacataatcgaataaggagtaaaagaaggtaaaatattatcttcattaacgtcaggcaacatagaaagtgcaacagaatgagttgaatgaagatgcacaactgctccagatttcattcctcttgtttcataaaatgcttgatgtaatggaagttcttttgttggggttgaattacctattaatttgccatccttagttacttttacaatttgattgggatcaagtcgaccaaaagatgaccctgaaggagtaacaagaatgtcgtcattatttaatctaactgaaatgttacctgtagacccatgagtaagccctctatcaaacatagaagatgcaaacatacacattttttctcttaatttnctttcagtcataatttaaacataacctaataattacttttagtacccaaaaagtttaaataaagtacctatggatattcctataacagtatgactccaaattgctaaagaacatgctaataagggagagggtgttttgatagcaagaaaaccttttccaagaattggcatgaaaaaaaaccagggaattacaacgctcaacaaaccgaattttataccatcaaaaaaggatgcaataaagatttcgtatttgattaaaataaaaaaaacaaaagaataaagtatggcaacactataatgaactagccagccaattaataattcttttttaattactggttcgttatctatatctggattgtaaattttacccttagaaattgatagaacaaaccatctacctacaacggcccaatctgaaggattgatcccaaatgaaaacttcaaaaacctttgccataaatccattgcacaacatgaaataacaccaataattataatatgaaacaattccatcactgatcctctaaagatttaattttttctagcaatgcttttactaacaatataaaagataatataggaaaatctattttaaattatacttttagcaaacacactaaatacaaaaacccaaggagaatgatttatggctaattttaatggacaaactgcagttattactggtggtgcacaaggtattggcttagcaactgcaaaaagatttattgaagatggctgtgaagtgatgatttgggacgttgatgaaaagatggggttggaagcatctaaagaattaaaatgtcaatttctaaaagtagatcaaactgaaaatgatttggttgaagaagcaacaaaaaagacaattcaactaatgaaaaaaattgatattttagtgtgtagtgctggaattgcaggtcctacattttctacatgggactacccaattgaagaatggtccaaagtatttaatgttaatgtaaacggtgttttttactgtaacaaacatgtagttaaaacaatgcgcgacaatggttacggcagaataataaatattgcatctattgcaggtaaagaaggaaacccaaacgcatctgcatattcagcatctaaagcagcagttattgctctaaccaagtcacttggtaaagaaacagcagatcatgatattgcagtcaattgtataaccccagcaacagctaaaacaagaattttagatcaagtctctcaagaatttattgattacatgatttccaaaatacctagaaacaggtttgtaaaagttgaagaaattgcttctctaattacatttttagcaagtaaagaaaatagttttactactgcaggtgtttttgatatttcaggtggtagagctacatattagattggtgaggatttttaggagatcctctgcaccttaatttaaaagctaataatcagggaggtaattattagcaggtcatcaaacaaacgggggagttttattcaatatnatcacactactgnttntcaccgaaaatgaatattggtctattcataataaataataattgagttttttgataaaaaattaatcacttaaatcatataattttaagaattgtataaaaattaatcattctatatatctgtgttaagttccataattgcagaaagtataactactgcaaacaaagcaagtcccattcccctatttacccaaacttgtttattagaagctaaagaccatttttttaaacttatacctaaccacaaccagagtatgtgtattggtatccaaatagaatttactattaagaacttagtaagaatttctgtattatatgaacttatccccagtgacaaaacaacaaataaatgaccttgaacaacataggcctttggattaacaaattgtaaaaaaatnccttcatatanctttggtgcctttgaagtttctttaaatcctgttttattatctgaagtagctatcctccaagatagaaaagataaataagacaatgataaaacaagaaaagttaattcaacaccgtcaatttcaaataaaaattgtttaaaacctaaaacaactagtaaagcaactccatttgtacccaagaataaaccaatgagatacataataccgactctccaaccaaagcctgcaccaactccagccagagaaaggacaccagggccaggggttaccatcattaaaaaactaataattatataagaagtcatgaaaatacatagagctaaactctatacctttagatcaattaatgtaatgttttgtagatttactatactaaggattaaatcatagcaatattataaaaataactttccaggattcattattttattaggatcaaatgcatttttaacctttttcattatatccacagcaccaccaagctcttttaacatatactttcttttaccttgcccaacaccgtgttctccagtacaagttccatccattctaatagctctttcagatattctgataagaaaatcatctagtttttttaactcttcatcactctttttatctatcaataaagctacatgaaagtttccatctcctgcatgacttacaataggacctattaattcattttttttcatatcctctattgtttctgtaatacaatcagataatttagaaatgggaacacaaacatcagttgaataaatttctgcttctggtcttacagctttacaagaccaataagcgtcatgtctagctttccataacttatttctatcttcattgttagacgtccattcaaaatcattacccccaaaatctgacgctatttcaccaaataattctgattgctctttaacagatgtctcactgccatgaaattccagcaataatagaggagcttctggtaagtttgttttagaataattatttacagctataacttgagccgtatcaagaaattcaattctagctacaggaattcctgcttgaactgtcatgataacagcatcggttgcatctttgacagatggaaagcttactctaccccctgctaaaacttcaggtataccataaagtttcaaagtaatttcagtggnaatacccaangtaccctcagaaccaaccattaaacgtgttaaatcatatccagctgaactttttcttgctttattagcagtttttatgatttgaccatctggggtgaccacttcaagcgcaatnacattatctttcatagtcccatatcttacggcatttgttccngatgcccnagttgctgtcataccnccaattgaagcattagcacctggatcaattggnaaaaaaagacctgtatctcttaaatgtgtatttaactgttccctngttacccctggttgaactaccactaaaagatcttcctgataaacnttaatgattttattcatattattcatatcaattgaaattcctccntatggngcntttatatgaccttcgaaagaagaacccacgccaaaaggaattattggacatttgtattcantacaa

SEQ ID NO: 175 - DNA, 4000 bp, Escherichia coli
  misc_feature (1)..(144): n is a, c, g, or t
  misc_feature (289)..(289): n is a, c, g, or t
  misc_feature (321)..(321): n is a, c, g, or t
  misc_feature (1942)..(1942): n is a, c, g, or t
  misc_feature (1956)..(1957): n is a, c, g, or t
  misc_feature (1959)..(1960): n is a, c, g, or t
  misc_feature (1962)..(1963): n is a, c, g, or t
  misc_feature (1969)..(1969): n is a, c, g, or t
  misc_feature (1976)..(1977): n is a, c, g, or t
  misc_feature (1980)..(1981): n is a, c, g, or t
  misc_feature (1984)..(1984): n is a, c, g, or t
  misc_feature (1986)..(1987): n is a, c, g, or t
  misc_feature (1992)..(1992): n is a, c, g, or t
  misc_feature (1994)..(1994): n is a, c, g, or t
  misc_feature (1996)..(1996): n is a, c, g, or t
  misc_feature (2003)..(2003): n is a, c, g, or t
  misc_feature (2007)..(2008): n is a, c, g, or t
  misc_feature (2011)..(2012): n is a, c, g, or t
  misc_feature (2017)..(2017): n is a, c, g, or t
  misc_feature (2020)..(2020): n is a, c, g, or t
  misc_feature (2022)..(2023): n is a, c, g, or t
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncgcgacgggagcatatccaggccgcgggcattttgatatttgcccggttgaaacatgccaacgcgggcaggacatcattcagccatcattcaaagcctcggcggagcagttgctcaccgcgccgcatttccggcataaacgcaanacgatgtggagcaaaccaaacgaaaaccgatnttgttgttgaagttatcgggttcgttcctgttgcgatacgaacagcgggcgttgtttcgattgttgttccacgaaccgccgcgcaacacgcgggcctgctcttgaatgagcccttcattacgttcatcccgcagttcaactgcggaatgaacgatcatgacactttcttccagcctcccaacagctttccgatttcggctaccattgtggaggcgtgacgatactggccttccttgatccaatcccatttctggcttaagcgcaaatacaaacggacttttctcaactcggtatcggcgtttttcaatttttccacacgagccaagccgcggtcggcatttgcttcaatcagcagttcctgaaaattcaacgcggcattctgtaatcgtctcgtgatcacaaaccgctggctgcgcggaaaattctccgtgatcggcaaaagccaggagacgaaatcataggtgcgcgtgaaaatgaccatttcctcagtcatacaacagattgaactccttgagcatggattggcgcaggcgaagcgtatctgcgtaacgcacgtgattgatccagccctgcacggaagcgcggacggtttccctgccagcgacttgtgtcaaataccgtaatttgcggcggtaggcaaaacccttgcgttgtttgacgcgccgataatcgggaaagagccgaaaaccaagaaaagggattcccttttcgacagaatgcgggtgcgcgctccccttatgaatcgtcaggcgcaatcgttccaatcgtttgacaatcgcatcgcgccatttcatcatttcagttttgttattgccaaacaaaaggaagtcgtccacgtaacggagatacgcgctacaacccagttcgcggcggataaaatgatcgaagggactcaggtaacaatttgcccataattgggatgtgagattgccaatcggcaggccgcgcggacggttggccgccaggagggtgtcgttgggaaaatataccatatcgtattcgcctgtcaatacgccccgcccgctggcaaggatgcgatctatcagccacaacgcgctttcatcgggcaacatggattccaatgtttctcgcaaaatggcatggtcaatgcttggaaaaaattgggcgatatcgcattgcaaaacgtattgatatttacgcgcatattgctggcaacgatctatggcgcggtgtgtgcctttgccaacgcgattggcgaaactatcagcgatgaacagcctctcgaaatacggcacagtgacgttgcacagcgcatgatgcgccactctgtcgcgaaacggcgcggcggagatcaaacgctttttgggttcgtggatgtaaaagttgctgtattcgccgggcaggtaggttcgctccttcaactcggtttccagttcgagcaagttatccgcaagcaaagattcgaactgcgccgttgccccgcgcccgcgtttgccgcgcgaggcattttcataagccaaacgcagattaacccaatcgcaaacttgttcgtgaaggttcattttttcaaaatcgactcgccttacggcgagaggggattcagagattcagagcgcagagattcagagttcagagacgggaatgatggggagcaaaccanacgaaaaccgaggnngnngnngaagtnatcgggnncgnnccngnngcganangnacagcgngcgnngtnncgatngcngnnccacgaaccgccgcgcaacacgcgggccgaaccgctctgggggcctcgcgggtctaaaacaccatccttgcggtttcgatactcgtcttcgctataccaatccaggcaccattcccagacgttgccgatcatgtcttgcgccttgtatgaacttgcgccatttggatacatgccaacgggggatgtgcccccgatttttttctcggcttcatctgtatttgccttacctgagtcccattcattatcccaggcccataaaaatccttctgcgccgcgcgcggcatgttcccattgcgcttcagttggcaaacgaaattgctttgcagttatgcggcttaaccaattgcaatatgcttccacttcaaaccacgaaacgcccacaacgggcaggttggaaccattccactttgggttgtcccaccaaaatgggcggtcccggcgttctacgggtctttccgccagccattctttccattgtttccgcgtttcttcatcaggcagccatgaaagatccgattcccatgcgcctgtgcgccatttacgcccagtctcactccaccaggttgcctgcgggtcgtaaccgccctgctcccaaaaacagcggtattctgcattggtcaccggatatttgccgatggaatattcagaaagcaggacatcatgcgcgggcttttcatcaccccaactctgcgcctcttgttccttgataattttttcatcttcttcgcttgtccccatgcgaaagacaccagcaggaatggagaccatttcaggaaggataacttttacatctttttcaagcgagatggtaaaacgcgggtcgccaatttcgccgagggccaagccgagacgatatcgcaaatctactcccacggtgggaggattcttctcaagaattcctttcagcatttcaggtaattgctttttctcaaccgcaaacagatttttaacctgttcagttggattcttcaaaatatcagcaagcgcaaccccggcaatcgtcaaagcatagtcatgacgatcaggatcctgggcggtatccatcaaacactgcataagtttcttggctttattatcatttgagtatgccagaaaacccaccgccaggagcaatggctcaatccattgatcgctcttgccatgaacgtgtttttgaagaacagggatccattgctcctccaatttttgcgccatatgatgtccagccagaaattcccggaaacgacgaatgtaaaaatcataactcttgccgtcctggcgaagtaacccacccctgcgcgcaaccaaatcaagaaaatcggatgccttttgctgggcagtctctttttctgcgccgaatcttttccaaaatacttctgcggaaatcaattcgtcggcaaaaattgaatctttctcctcatcgtgcaaaatataagcaattaacgccatgtcatcaaaacgctgatttgccggccgtcctccccataacgtcgcatctgagactgcctgcccctgtttatgcgggtcggtcaggagggcttttactgcctgctcaaatagttcggcgcgctggcttggaaggtcacgactatgataataaaccagcgcgaagatattgatcatcaacggcgtggttgccatctcatttacaaggggattctcgatacgccgcaaaagatccctggctttattatcggcatcggtcaacgtcggataaacagcatcgcaccagagttcgataatgctgacgcgtttctcagaggttataggcaaaacggctgccgtatcgaaatcaatgagctggctggttatttctgcggcagaaggccgcgtagtgaccagataaatatttctggatgaatttctattatccgccacaacgccttcaacagcggcgcgaacatccgggcgatctgcaaattccacttcgtccataccatcaaacatcacaagacagcctttgcgtagaagatggcgaaatagatcatctggaagatt

SEQ ID NO: 176 - DNA, 4000 bp, Escherichia coli
  misc_feature (2482)..(2482): n is a, c, g, or t
  misc_feature (2623)..(2623): n is a, c, g, or t
  misc_feature (2631)..(2631): n is a, c, g, or t
  misc_feature (2641)..(2642): n is a, c, g, or t
  misc_feature (2646)..(2646): n is a, c, g, or t
  misc_feature (2665)..(2665): n is a, c, g, or t
  misc_feature (2676)..(2676): n is a, c, g, or t
  misc_feature (2686)..(2686): n is a, c, g, or t
  misc_feature (2689)..(2689): n is a, c, g, or t
  misc_feature (2698)..(2698): n is a, c, g, or t
  misc_feature (2704)..(2704): n is a, c, g, or t
  misc_feature (2707)..(2707): n is a, c, g, or t
  misc_feature (2720)..(2720): n is a, c, g, or t
  misc_feature (2723)..(2723): n is a, c, g, or t
  misc_feature (2731)..(2731): n is a, c, g, or t
  misc_feature (2758)..(2758): n is a, c, g, or t
  misc_feature (2760)..(2760): n is a, c, g, or t
  misc_feature (2764)..(2764): n is a, c, g, or t
  misc_feature (2776)..(2776): n is a, c, g, or t
  misc_feature (2778)..(2779): n is a, c, g, or t
  misc_feature (2781)..(2785): n is a, c, g, or t
  misc_feature (2788)..(2797): n is a, c, g, or t
  misc_feature (2799)..(2801): n is a, c, g, or t
  misc_feature (2803)..(2807): n is a, c, g, or t
  misc_feature (2809)..(2809): n is a, c, g, or t
  misc_feature (2811)..(2811): n is a, c, g, or t
  misc_feature (2813)..(2814): n is a, c, g, or t
  misc_feature (2816)..(2817): n is a, c, g, or t
  misc_feature (2819)..(2826): n is a, c, g, or t
  misc_feature (2828)..(2833): n is a, c, g, or t
  misc_feature (2835)..(2839): n is a, c, g, or t
  misc_feature (2845)..(2851): n is a, c, g, or t
  misc_feature (2853)..(2854): n is a, c, g, or t
  misc_feature (2857)..(2857): n is a, c, g, or t
  misc_feature (2871)..(2871): n is a, c, g, or t
  misc_feature (2873)..(2874): n is a, c, g, or t
  misc_feature (2876)..(2879): n is a, c, g, or t
  misc_feature (2881)..(2883): n is a, c, g, or t
  misc_feature (2886)..(2886): n is a, c, g, or t
  misc_feature (2888)..(2890): n is a, c, g, or t
  misc_feature (2892)..(2892): n is a, c, g, or t
  misc_feature (2894)..(2895): n is a, c, g, or t
  misc_feature (2897)..(2901): n is a, c, g, or t
  misc_feature (2903)..(2904): n is a, c, g, or t
  misc_feature (2906)..(2907): n is a, c, g, or t
  misc_feature (2909)..(2910): n is a, c, g, or t
  misc_feature (2912)..(2913): n is a, c, g, or t
  misc_feature (2915)..(2918): n is a, c, g, or t
  misc_feature (2920)..(2920): n is a, c, g, or t
  misc_feature (2922)..(2928): n is a, c, g, or t
  misc_feature (2930)..(2930): n is a, c, g, or t
  misc_feature (2932)..(2936): n is a, c, g, or t
  misc_feature (2939)..(2939): n is a, c, g, or t
  misc_feature (2941)..(2941): n is a, c, g, or t
  misc_feature (2943)..(2943): n is a, c, g, or t
  misc_feature (2945)..(2950): n is a, c, g, or t
  misc_feature (2952)..(2952): n is a, c, g, or t
  misc_feature (2954)..(2957): n is a, c, g, or t
  misc_feature (2960)..(2960): n is a, c, g, or t
  misc_feature (2965)..(2969): n is a, c, g, or t
  misc_feature (2971)..(2976): n is a, c, g, or t
  misc_feature (2979)..(2982): n is a, c, g, or t
  misc_feature (2984)..(2985): n is a, c, g, or t
  misc_feature (2990)..(2990): n is a, c, g, or t
  misc_feature (2992)..(2992): n is a, c, g, or t
  misc_feature (2994)..(2995): n is a, c, g, or t
  misc_feature (2997)..(2998): n is a, c, g, or t
  misc_feature (3000)..(3000): n is a, c, g, or t
  misc_feature (3002)..(3016): n is a, c, g, or t
  misc_feature (3019)..(3020): n is a, c, g, or t
  misc_feature (3023)..(3028): n is a, c, g, or t
  misc_feature (3030)..(3032): n is a, c, g, or t
  misc_feature (3034)..(3034): n is a, c, g, or t
  misc_feature (3038)..(3040): n is a, c, g, or t
  misc_feature (3042)..(3042): n is a, c, g, or t
  misc_feature (3044)..(3045): n is a, c, g, or t
  misc_feature (3048)..(3050): n is a, c, g, or t
  misc_feature (3052)..(3056): n is a, c, g, or t
  misc_feature (3058)..(3059): n is a, c, g, or t
  misc_feature (3061)..(3083): n is a, c, g, or t
  misc_feature (3085)..(3091): n is a, c, g, or t
  misc_feature (3094)..(3096): n is a, c, g, or t
  misc_feature (3099)..(3101): n is a, c, g, or t
  misc_feature (3103)..(3106): n is a, c, g, or t
  misc_feature (3108)..(3113): n is a, c, g, or t
  misc_feature (3116)..(3116): n is a, c, g, or t
  misc_feature (3118)..(3119): n is a, c, g, or t
  misc_feature (3121)..(3121): n is a, c, g, or t
  misc_feature (3123)..(3128): n is a, c, g, or t
  misc_feature (3130)..(3130): n is a, c, g, or t
  misc_feature (3132)..(3133): n is a, c, g, or t
  misc_feature (3135)..(3139): n is a, c, g, or t
  misc_feature (3141)..(3144): n is a, c, g, or t
  misc_feature (3147)..(3151): n is a, c, g, or t
  misc_feature (3153)..(3156): n is a, c, g, or t
  misc_feature (3158)..(3162): n is a, c, g, or t
  misc_feature (3165)..(3165): n is a, c, g, or t
  misc_feature (3167)..(3168): n is a, c, g, or t
  misc_feature (3170)..(3172): n is a, c, g, or t
  misc_feature (3174)..(3180): n is a, c, g, or t
  misc_feature (3183)..(3188): n is a, c, g, or t
  misc_feature (3190)..(3198): n is a, c, g, or t
  misc_feature (3200)..(3202): n is a, c, g, or t
  misc_feature (3204)..(3208): n is a, c, g, or t
  misc_feature (3210)..(3210): n is a, c, g, or t
  misc_feature (3216)..(3225): n is a, c, g, or t
  misc_feature (3227)..(3227): n is a, c, g, or t
  misc_feature (3230)..(3237): n is a, c, g, or t
  misc_feature (3239)..(3240): n is a, c, g, or t
  misc_feature (3242)..(3247): n is a, c, g, or t
  misc_feature (3251)..(3251): n is a, c, g, or t
  misc_feature (3253)..(3254): n is a, c, g, or t
  misc_feature (3256)..(3259): n is a, c, g, or t
  misc_feature (3261)..(3263): n is a, c, g, or t
  misc_feature (3266)..(3269): n is a, c, g, or t
  misc_feature (3271)..(3271): n is a, c, g, or t
  misc_feature (3273)..(3274): n is a, c, g, or t
  misc_feature (3278)..(3279): n is a, c, g, or t
  misc_feature (3281)..(3287): n is a, c, g, or t
  misc_feature (3289)..(3291): n is a, c, g, or t
  misc_feature (3293)..(3293): n is a, c, g, or t
  misc_feature (3295)..(3298): n is a, c, g, or t
  misc_feature (3300)..(3301): n is a, c, g, or t
  misc_feature (3303)..(3307): n is a, c, g, or t
  misc_feature (3309)..(3310): n is a, c, g, or t
  misc_feature (3312)..(3316): n is a, c, g, or t
  misc_feature (3318)..(3318): n is a, c, g, or t
  misc_feature (3320)..(3321): n is a, c, g, or t
  misc_feature (3323)..(3324): n is a, c, g, or t
  misc_feature (3326)..(3326): n is a, c, g, or t
  misc_feature (3328)..(3328): n is a, c, g, or t
  misc_feature (3330)..(3331): n is a, c, g, or t
  misc_feature (3334)..(3344): n is a, c, g, or t
  misc_feature (3346)..(3347): n is a, c, g, or t
  misc_feature (3349)..(3349): n is a, c, g, or t
  misc_feature (3351)..(3353): n is a, c, g, or t
  misc_feature (3355)..(3356): n is a, c, g, or t
  misc_feature (3358)..(3359): n is a, c, g, or t
  misc_feature (3361)..(3372): n is a, c, g, or t
  misc_feature (3374)..(3377): n is a, c, g, or t
  misc_feature (3379)..(3381): n is a, c, g, or t
  misc_feature (3383)..(3388): n is a, c, g, or t
  misc_feature (3390)..(3393): n is a, c, g, or t
  misc_feature (3396)..(3399): n is a, c, g, or t
  misc_feature (3401)..(3401): n is a, c, g, or t
  misc_feature (3404)..(3411): n is a, c, g, or t
  misc_feature (3413)..(3413): n is a, c, g, or t
  misc_feature (3415)..(3417): n is a, c, g, or t
  misc_feature (3419)..(3423): n is a, c, g, or t
  misc_feature (3425)..(3425): n is a, c, g, or t
  misc_feature (3427)..(3427): n is a, c, g, or t
  misc_feature (3430)..(3431): n is a, c, g, or t
  misc_feature (3433)..(3450): n is a, c, g, or t
  misc_feature (3452)..(3453): n is a, c, g, or t
  misc_feature (3455)..(3464): n is a, c, g, or t
  misc_feature (3466)..(3466): n is a, c, g, or t
  misc_feature (3468)..(3469): n is a, c, g, or t
  misc_feature (3471)..(3471): n is a, c, g, or t
  misc_feature (3473)..(3484): n is a, c, g, or t
  misc_feature (3486)..(3496): n is a, c, g, or t
  misc_feature (3498)..(3499): n is a, c, g, or t
  misc_feature (3503)..(3504): n is a, c, g, or t
  misc_feature (3506)..(3509): n is a, c, g, or t
  misc_feature (3512)..(3513): n is a, c, g, or t
  misc_feature (3515)..(3522): n is a, c, g, or t
  misc_feature (3524)..(3524): n is a, c, g, or t
  misc_feature (3526)..(3528): n is a, c, g, or t
  misc_feature (3530)..(3532): n is a, c, g, or t
  misc_feature (3534)..(3534): n is a, c, g, or t
  misc_feature (3536)..(3537): n is a, c, g, or t
  misc_feature (3539)..(3544): n is a, c, g, or t
  misc_feature (3546)..(3557): n is a, c, g, or t
  misc_feature (3560)..(3565): n is a, c, g, or t
  misc_feature (3567)..(3567): n is a, c, g, or t
  misc_feature (3570)..(3573): n is a, c, g, or t
  misc_feature (3575)..(3576): n is a, c, g, or t
  misc_feature (3578)..(3579): n is a, c, g, or t
  misc_feature (3582)..(3588): n is a, c, g, or t
  misc_feature (3591)..(3592): n is a, c, g, or t
  misc_feature (3594)..(3594): n is a, c, g, or t
  misc_feature (3596)..(3597): n is a, c, g, or t
  misc_feature (3600)..(3608): n is a, c, g, or t
  misc_feature (3611)..(3612): n is a, c, g, or t
  misc_feature (3614)..(3614): n is a, c, g, or t
  misc_feature (3616)..(3617): n is a, c, g, or t
  misc_feature (3620)..(3621): n is a, c, g, or t
  misc_feature (3624)..(3628): n is a, c, g, or t
  misc_feature (3630)..(3630): n is a, c, g, or t
  misc_feature (3632)..(3633): n is a, c, g, or t
  misc_feature (3635)..(3649): n is a, c, g, or t
  misc_feature (3652)..(3653): n is a, c, g, or t
  misc_feature (3655)..(3655): n is a, c, g, or t
  misc_feature (3657)..(3658): n is a, c, g, or t
  misc_feature (3660)..(3661): n is a, c, g, or t
  misc_feature (3663)..(3667): n is a, c, g, or t
  misc_feature (3669)..(3672): n is a, c, g, or t
  misc_feature (3674)..(3678): n is a, c, g, or t
  misc_feature (3680)..(3681): n is a, c, g, or t
  misc_feature (3683)..(3690): n is a, c, g, or t
  misc_feature (3692)..(3692): n is a, c, g, or t
  misc_feature (3694)..(3694): n is a, c, g, or t
  misc_feature (3696)..(3706): n is a, c, g, or t
  misc_feature (3708)..(3708): n is a, c, g, or t
  misc_feature (3710)..(3712): n is a, c, g, or t
  misc_feature (3714)..(3715): n is a, c, g, or t
  misc_feature (3717)..(3718): n is a, c, g, or t
  misc_feature (3720)..(3722): n is a, c, g, or t
  misc_feature (3724)..(3726): n is a, c, g, or t
  misc_feature (3729)..(3736): n is a, c, g, or t
  misc_feature (3739)..(3742): n is a, c, g, or t
  misc_feature (3744)..(3750): n is a, c, g, or t
  misc_feature (3754)..(3757): n is a, c, g, or t
  misc_feature (3759)..(3763): n is a, c, g, or t
  misc_feature (3765)..(3769): n is a, c, g, or t
  misc_feature (3772)..(3772): n is a, c, g, or t
  misc_feature (3774)..(3781): n is a, c, g, or t
  misc_feature (3783)..(3783): n is a, c, g, or t
  misc_feature (3786)..(3787): n is a, c, g, or t
  misc_feature (3789)..(3792): n is a, c, g, or t
  misc_feature (3794)..(3805): n is a, c, g, or t
  misc_feature (3807)..(3808): n is a, c, g, or t
  misc_feature (3810)..(3812): n is a, c, g, or t
  misc_feature (3814)..(3823): n is a, c, g, or t
  misc_feature (3825)..(3825): n is a, c, g, or t
  misc_feature (3827)..(3829): n is a, c, g, or t
  misc_feature (3831)..(3831): n is a, c, g, or t
  misc_feature (3834)..(3834): n is a, c, g, or t
  misc_feature (3836)..(3836): n is a, c, g, or t
  misc_feature (3839)..(3842): n is a, c, g, or t
  misc_feature (3844)..(3846): n is a, c, g, or t
  misc_feature (3849)..(3849): n is a, c, g, or t
  misc_feature (3851)..(3864): n is a, c, g, or t
  misc_feature (3866)..(3872): n is a, c, g, or t
  misc_feature (3874)..(3883): n is a, c, g, or t
  misc_feature (3885)..(3891): n is a, c, g, or t
  misc_feature (3893)..(3894): n is a, c, g, or t
  misc_feature (3896)..(3902): n is a, c, g, or t
  misc_feature (3904)..(3904): n is a, c, g, or t
  misc_feature (3906)..(3907): n is a, c, g, or t
  misc_feature (3910)..(3912): n is a, c, g, or t
  misc_feature (3914)..(3917): n is a, c, g, or t
  misc_feature (3920)..(3920): n is a, c, g, or t
  misc_feature (3922)..(3926): n is a, c, g, or t
  misc_feature (3932)..(3933): n is a, c, g, or t
  misc_feature (3938)..(3938): n is a, c, g, or t
  misc_feature (3940)..(3941): n is a, c, g, or t
  misc_feature (3943)..(3945): n is a, c, g, or t
  misc_feature (3947)..(3949): n is a, c, g, or t
  misc_feature (3951)..(3951): n is a, c, g, or t
  misc_feature (3956)..(3958): n is a, c, g, or t
  misc_feature (3960)..(3960): n is a, c, g, or t
  misc_feature (3962)..(3965): n is a, c, g, or t
  misc_feature (3972)..(3972): n is a, c, g, or t
  misc_feature (3974)..(3975): n is a, c, g, or t
  misc_feature (3977)..(3977): n is a, c, g, or t
  misc_feature (3980)..(3983): n is a, c, g, or t
  misc_feature (3985)..(3985): n is a, c, g, or t
  misc_feature (3988)..(3991): n is a, c, g, or t
  misc_feature (3993)..(3995): n is a, c, g, or t
  misc_feature (3997)..(3997): n is a, c, g, or t
  misc_feature (3999)..(4000): n is a, c, g, or t
cccggcggggtatccaggtgccgggcggttcatgtcggcggcggatcgttcaaagatgggactgctgcgaaccctgtgggccaagaccaagcccgagaactggatcaataagccctacacccgcggaaccacggcgtggaaggcgcagcaggccgtgaccaaggtcgcgcctgcgctcaagtgggtggggcatgcttctacggcgctcactgcgggtttggctggggctgagcagtatcagaaggactcggccaacccttcaatgggtgaggccgagaagatcacccgtgccagcacacaagctgtcacgcagggtggtggcggctggggcggtgcatggctaggtgctcaggcaggcatgacgataggtgctgtcggaggtccggtgggggtcgccgtaggaggcattgtcggcggagcgcttggaggactggcgggatctacagtcggcaaaatggcgggggacttgataaataagggagtaagtaagttgtttcactggtagtgtcggggtttgaccaggaggtgatttgctgttgtgggcgattgtgtacttcgtgttcgggtcggtcttgatgattcattggggcctggcgatgttcaccgatacggggccgggtgagttcgcgcgggagatcagcgcggagatgggggtcaagaataatctcgcccttacaatgccctcgggtgcattgatgttcctttttggtacggtatttggcttcggggatcccaactccgttttcgagatcgtctgcggctccatatcggcgtttttcttgctggtcatgctggtgagtttcctgccgatcagcctgccagcgtggatgtatccggagtggcacgtggagtggcggcgccggcgtcggcatgagcggctcgcgagggagagctcctggcgtgacatcacccggctaggccccgggggaactgctggtcctgccaccggccacgctgatactcttcccggttcggcactaacgaacttatcctcggactccccaggagaggtcatatgacttcgcgaccaagctcgaacctgcctcagaagttcgcgggtagcgccgccaaggtatgcgcaccagcaggctgggtccaggtggatcctgagaacatccctggtatacccgtaagtgctgccgaggggtatgtggacctggtctgtgctgagcagccggatgcgcctcgcttcgcggagaactgcgtcatcaccgtcgcggaactcgccggcgggtcctcggccgaggactggttccgggactcgaccacgcagctcatgagttccatacccggcttccagctgattgacatgaccgagtgggagccggcggggcacggcctgctgcgcgccggtgtctacatccaggacgccgtctcggtcaccgccctgcaatggacctgggtctccaagacctcgcggcgcgggttcaccgcgaccttctcctgccccacacgtagttgcgccgcggcagtggagcgattcctcgccatgatcacgaccctggaggagatctgatggcacggctcgacaccagcggatacacgccggttataatccttggtgatgctgagtggctgtctctgcgcgccgtggcgatgggcggacgcatcctgaaagaccgcgtcgccaggcggctgcgtcgcagcggagttctggacgatcagggtattacgccgtcggcggctcccgcactgcacggggtcgccggggccgtccggcacctcgacgtggcccgcttcgagccgacccgtcggggataccgtgccgaggcgtggataggtccgcagcgcgcgaccatcgtcaagcatgagccggacgggtaccacgtatacggccttgacgagtgcgaggtgccctcagccttcaccgagctgctcgacgtgcggccgcgccctaacattgacctggggccgcgcctcctcccgcaacaggtgtacagcatcatcgactctggggagccggacgcactcactgatgagttggccggacttgcccgccggcttgatcgcggcggcgagccgggacagctcggcgggcccacgcccctcaccgacggattcgccagcgggcagtgggtgctctcactgatctccacgagcgtcccgcgcgatggagactgggaggtcgtgggctcgatgacgaccctgtctgttcccgaatgcctgtacgagctaatccctaggtccgttgccgatgccctcgagtcaggcgtgcctgacgagttgatggcccagcgggcggcggcagacatgcccgaggagctggtactggagcacataacctcactggagctgtggacgcgggtaagcccctggttcttcaccgtctgatgcggccgaagattacacggcagcacgggtgttgcctgtccacggcgtcgttgcatcgtgctcctcaaccggcatgtgagtggttgagcggggtcctgctctgcgcgcgccggctccgttgcggcgacgactgacctcagaggcgctcctnccgactacctgcctcggtgcgggatgggccccgggaaagccggtcagcggctagccgatcatcgggctggcctcgggcatccgaataacgcggcgccgctcgcgcagggccagggcgctggccgccgtcatggtgcccacncggccgangaacatgagnnccangatgacgtacttggccccntccggcagggngggcgtgatnccngtggacagncccacngtngcgaaggcgctgntgncctcgaanaggatccggtccagggacaggttggtnanctgnagcagcaggagngnngnnnnnccnnnnnnnnnngnnncnnnnnangncnncnncnnnnnnnngnnnnnngnnnnngggggnnnnnnncnnccngaaggcctcgatgncnngnnnncnnnggncnnngncnngnnnnncnngnngnngnncnnnnangnnnnnnncntnnnnnccncngncnnnnnngncnnnnccnccccnnnnnannnnnnggnnnncnnggagnancnngnngncnnnnnnnnnnnnnnnggnnggnnnnnngnnnancccnnngnannggnnntnnnnncnntnnnnnnnnnnnnnnnnnnnnnnncnnnnnnnggnnnggnnncnnnngnnnnnnggntnntncnnnnnnangnngnnnnngnnnnggnnnnngnnnncnnnnnggncnnannngnnnnnnnggnnnnnntnnnnnnnnngnnncnnnnncnggggcnnnnnnnnnngnccnnnnnnnncnngnnnnnngggnanncnnnngnnnccnnnnangnncccnngnnnnnnngnnngncnnnncnncnnnnngnngnnnnngncnncnngncntnnggnnnnnnnnnnnanncngnnntnntnnannnnnnnnnnnncnnnnannncnnnnnncnnnnggnnnngnccnnnnnnnngncnnngnnnnngnanggnngnnnnnnnnnnnnnnnnnngnngnnnnnnnnnncngnngncnnnnnnnnnnnngnnnnnnnnnnncnncccnncnnnnccnngnnnnnnnngntnnncnnngncnncnnnnnncnnnnnnnnnnnnccnnnnnncnggnnnncnncnnggnnnnnnnggnngncnnggnnnnnnnnnccnngncnnccnncgnnnnngncnngnnnnnnnnnnnnnnnccnnangnngnncnnnnngnnnncnnnnncnncnnnnnnnngncngnnnnnnnnnnngncnnngnngnngnnnannnggnnnnnnnnaannnngnnnnnnncccnnnngnnnnngnnnnnggnannnnnnnnanggnngnnnncnnnnnnnnnnnngnngnnnannnnnnnnnngncnnncnggncnggnnnnannnggncnnnnnnnnnnnnnngnnnnnnngnnnnnnnnnncnnnnnnngnngnnnnnnncngnnggnnncnnnnccngnnnnngggggnnggggngnngnnncnnngnggggnnngntnnnnttgccgncnncnggnnnntnctnnnncnnntncnn

SEQ ID NO: 177 - DNA, 4000 bp, Escherichia coli
  misc_feature (418)..(418): n is a, c, g, or t
  misc_feature (421)..(421): n is a, c, g, or t
  misc_feature (433)..(433): n is a, c, g, or t
  misc_feature (436)..(436): n is a, c, g, or t
  misc_feature (449)..(449): n is a, c, g, or t
  misc_feature (472)..(472): n is a, c, g, or t
  misc_feature (475)..(475): n is a, c, g, or t
  misc_feature (1992)..(1992): n is a, c, g, or t
  misc_feature (2571)..(2571): n is a, c, g, or t
  misc_feature (3489)..(3489): n is a, c, g, or t
  misc_feature (3800)..(3800): n is a, c, g, or t
gcctgcagcattgttgatgtcttcgctgataccagtgatcaggttacgaatctggactgagctatcctgttccaggttgttactattaccattgccgttgccgttgttattgccgttaccgttgctggtttcatcgaccaacgtacagtttgcatcagcaatacactcttcaatggtcagatcaggattgctgggtacctggtttgtgctggtagttacattgttgccattattgccaccaccattgctgttgttattaccggaattgccattgccggtgttaccggtatcggtaccagctgtgtcagttccactgttgttaccgttgccgttgttgttgccggaattgccattgccggtgttgccagtatcggtacctgccgtgtcagtgccaccgttgttaccgttgccgttgttnttnccggaattaccnttnccggcagtgtcgntgccaccgctgttgccgttgttnttnccggaattaccgttaccggcagtgtcgttgccaccgctgttgccgttgttatttccggaattaccgttaccggcagtgtcgttgccaccgctgttgccgttgttgttcccggaattaccgttaccggcagtgtcgttgccaccgctattgccattgccgctgttatttccggaattgccgttgtcattgccaccggcattattattacccgccagcgcattcaggctgcgggcattattggccggattgatctggacctggacattggtgctggaattacctgcggttgcagaggtatcagttcctgcatcatcagaattggaagggttacctgtagtcgccgccagggcaactaccaggccaggcgcattatcggcattgccattactattggaacccagtgaagcgttattggcgatctcttcgctgatatcagccagagcctgggccacttcctcgtcgccttcgtcgtcaacaccggcaacatcaccgccatcattgtcatctccctgtgcgacctgggcgccatcttcttcaccttcttcttcattttcaaggttcgggttctgggcgattgcgatattgccgagctgggcgggtatctggttcaaaccctggggagcctggcccagttccgtgcggctgaaatcgaaattgccgccaacaccaaggttaatggcgccctggccgttggatactgttgtacccccgttggcgacacccgtgaacaaggcaccaagagcctggtcaatgacagcctcatgggttgtgccacggacaccaatggatgcgtactgggtatcaacacggtattcactgttctcatcatcgctgatgaaaccgtcgatggtacgaaaaccaccacgtaccagcgacataatggcacggtcactttcaccgccttcgccatcaaaggaatactcattgaactggaactctgtatcttccttgagtgcaataatcgcggagtcaacgagacgaatctgcgcaaaaccggcttcaccggtaacaatcgtctcgctggcaaaaacttctgaacgcctgcgaagcaagcgggtatcaccatccattgtaatcgcggcaacatcacccttagtcatcaggattgtgcctatggcctcttcatcctgggccagaactgatccactcaacaacacaaccagaaacagcattggctgaattagttttcttgtgatggcttcaattttcattttttgacctttttccctggagtgcgtacctggttccgtatttcgtcgtacgccctgacgggatttgattgtgattttttaatattagtatttcttcacttccggtgagcttcgggcttcgtatttatcaccgttgaatgcaatactaatacgactgaattcgcttatatcagctgcttgttcattaactgtgaactaaaacacagcaagttgtaattactgtgacaggtttcacttaatgcccgggcaatttgctttaatgactctatctttcacgctaaaaaatataaatccttattattcagntatttagcataattacttaaagtaatttatcgtagctagtttcgcttgtagaagccatattttgcgagatttacaataaaaagtgaaaaattatcgtacatactcctgtgaattcagtacacaaaaatgtgattaaaatcagtcgctcagcgagctaatttaacgtgagtttgaattctggaaattgcctggtcagcaaaatgtatatctcacactcatgataaccacagtatatcggggatcaccacacacttgttggctggatgaagccccctttaactggtgccagcggccctccggctggtcatttattatgcatatcctcaccagatccgaacaaaaacatggcctgagcctttctatcttgtatcaaaggctttgaaaatggcgctatggtaggggcaaaatctgcttgcgaatacctcctaatctgcgcaaagatcgggttcaggttgcagttttccaggcaaataccaccagcaaatgactatgcgagtgactatgcgagaaaccaacagacaccactcccctgcaatcacacctgctgacccgttgcctgcgtcgacgttgcagcgagtnttgctgcacttttgcccgtgtctggccctggcaattacactaggcacagttttcccggtacaagcacagatggagtcacagcgggtgctctttgaccccgtcccgattccggcaaacgagaatgatgtactgcccctggtgaccattgatgaagcggtctcggggattggaagtattaacaacggtgccatgacgttggcagaacgccgggcacttgagcagcaaataagctcttatgttgagtccatcggggaccaggagtccgaggaagggccctattccacgcagctggtccaggaccttttcagtgccggtaatctctcgcaacaactgggcgaccacgaacaggctatggatttcttccagcgggcccagtcggttatccgtatcaacgaagggctggaaaccttgagccagattccaatcatggaggccatggtggcgagcacttatgcccagggcaaactgcgtgaggcagatgacctccaggacgccctgttttcactcaagcagggcagttacggcgagcgcagcgtatccatggttcccaccatgatcaatttcggacagtggcatatggacgccttcctggaacgctccaatatcctgctcaacgtggatcgcatgaacgtggtcaggttcatgtctgatccaggtaactacatccatgaatacgatccccgcgatacccccctgatgaacctgtatacggcccaggaaacattgctcaatgccattgatatcctggtgagcaagcgtgaatactttcatcctcaaatgctggaagctgaaaggctcctgttgaagagctacctgctcagcatgcatcgggaaaacatcctgtatgaacctgatttctacctgacacgcaaaaaacgcaagacaggttcccggctcaataccaattccatggagctnaatgaatccagggagtacaagctgggacagtcctcgcacaatcgcactgttacctttattcgcaatgacccggatcttgatcccggggaactggcacgagccatgctggaagcagctgactggcacctgctttttgagcgcaaggtaaaggccgccgacgaataccaggcggtttatgactactttgcagacattccgcaactggcagcttccgtgcaggacatcctgtatccatcacggccggtggtgcttcccacttacctgccaccaccaaattccagggaaaaactggacatcggcccgaacgagcntgtggattacttcggttacttcgatgtctcttttcgagtcgacaagtttggaaaagccaaacgcatcaaaatcctggaccagggcggcgatatttccagtaacctggaaatccgcatgaagcaatacctgcgcaaggtcctgtttcgcccctttttcaaagacggtgagccggacacttctacacgtacttaccgctatt

SEQ ID NO: 178 - DNA, 4000 bp, Escherichia coli
  misc_feature (254)..(254): n is a, c, g, or t
  misc_feature (926)..(926): n is a, c, g, or t
  misc_feature (1925)..(1925): n is a, c, g, or t
  misc_feature (1928)..(1928): n is a, c, g, or t
  misc_feature (1933)..(1934): n is a, c, g, or t
  misc_feature (1940)..(1940): n is a, c, g, or t
  misc_feature (1943)..(1943): n is a, c, g, or t
  misc_feature (1951)..(1952): n is a, c, g, or t
  misc_feature (1955)..(1955): n is a, c, g, or t
  misc_feature (1957)..(1958): n is a, c, g, or t
  misc_feature (1963)..(1964): n is a, c, g, or t
  misc_feature (1978)..(1978): n is a, c, g, or t
  misc_feature (1983)..(1983): n is a, c, g, or t
  misc_feature (1987)..(1988): n is a, c, g, or t
  misc_feature (1991)..(1991): n is a, c, g, or t
  misc_feature (1994)..(1994): n is a, c, g, or t
cacttgctttgaaaggcgcgcggcgaccagacccccagcacagctttggccgacttcagggcgtggtcgatcacatcaggaaacgtgtcgccgccgtcgataccgtgaatgtcaaagaaagtcttgagccctaacgcctcgagccggtccttgatcggttcaaccttcgcccgttcgacgcgcggataggaaatgaaaacgtcaaccaagctgctgctccccgtccgtcaacgcataacaaggcgcttagacanagtcaccaaggcgtgcgcttcccgtctggccgcttcagccccagcacggcgttcctaagcttgcgggtctgggcgaaggcggcgtgggcttcccaggatcggatgcgctgcagtgctgcgcccgcatcgagcgtcccagcacgggcctgatccttcagcccacgcaagcggttgcggaagcgcgatacgtttgcttcgggcaggcgcctgagtccaccgggaatgagtacatgaccgagaaattcggcgggctgatctgtggcgattatctccgtctttccaggatgcagcttcaaacgccgaccttcaagaaagcgcgcgatacgaacgcgccatcgctccaactgcattggatcgtcggcaaacaacgcgaaatcatcgacgtaacgcacataaggcgcggccagcacttcggtgcagaaatggtcgagcgggtcgagatagagattggcgaagaactggctggtcaggttgccgatcggcagcccgcgtcgccgcgagaacggcgtgaacaaatcgtcacccgaaaaatgctggttcaccggctcctggtcgtttgagccgtcaatgatgtggtccagcaagttgagcgtgcgcgcgtctgcgatacggcggcgcacatcgcgctttagaatgtcatgatcgatcgccggaaaatagcggaacacgtcncagcgcagaacgtgcgtgctgcgatcgcggtagtgttcgtaggtctcgattgcgcggtgcgtacctttgccggtgcgattggcgaacgtgttgtcgatgaagcccgcttcaaacaacggcgcgatgatcgcacagagcgcatgatgcaccacacggtcgcgaaacggggccgccgagacgatgcgatgcttaggatcaaagacttcgatcttgacgtaggcgccgggcctgtagctgccgtcttgcagcgttcgctccaaacgcagcagctccttttcgagatcggtcatgaaggcggccgcacccggcttggcgcgcttgcccttggccgccttcagcgccgcgcggcgtaggctgcgaaaactggcgatgccatcgaacagcccgtcatgccgcttcggcatgggcgtcatgggtcttgcgcccatgcaacttcgaccacgcgccgatctggcggccgataccatccagttcgcgggcggcatattcgtaacggcgctcatcgaggtagcgaaggtcgaaggcgagacggatcaggtggcggagtttttcgacgccgagattggccgcgcgcaagctgcctgcgcggtcgcggtcatacgtggcttcaagcaaccgttcgagcacgtcgagcgcactggactgaatgcgatcacccaatagaaacttttgcgcgcgcggaaatttctcaaccgccgggatcagccatcgcaagaagccattggtggattctagtgcgggacctatcacgcgctgtggcgtctggcgcttttgattgtgtgtcatgcacacaaacgtttgcagagtcgcccgttgcgccaagcgtgcggtgcgaaaaaacaacgccgctcggcttcgccgagacacaacaacaagagcggcttcgccgcgcttcgcgcctcacggcgctgcgccgtaaaggggcaggattccaggacgcaggatggaaggtgctaaagcgaaacgattttaaacggtcctggcaacacggaaaccgangtngctgnnccggtnggngggattgnnccngnngcggnncgccgaacggaggnactgngggnngtnatnccaagagccgccgcgaagaacgcgggacgaacagccactcgtatcgtaagcagaaccgttcgctggggcgcttggatagggattagcgtaacaatcctgcacccattcccaaacattgccgtgaacatcgtgaagaccaaacgcattaggttcgaatgaacctacggcaatagtcgaattgctgttgaagcgtgcctgagcagcggtaatcgccccgcccgtagaatacgccgtcgtcgtcccggcccgcgccgcgtattcccattctgcttccgtcagcaattggtagccgtggcccgtctcgcgcgagagccacgcagcgtagtcacgcgcgtcctgccatctcacgcaggtcaccgggtgattgtcgtcctgcgcaaacccagggctacgccatgacccatcctgcccagttgttgtatagcaatcatttggcggcgcggcgcggttggtcgcgttcacaaacgctgtccattcaccgcgcgacacttcgtatttgccggcggcaaagcgctgaagaacaaccctgcgctgcgggccttcgtcggccgagcggttcgcttcgctttccgacgatcccatcgtgaatgagccagccggtatcaccaccatttcagggcaggagtcgcaatctcggaacatctggccgtcgcgcagcgtggctgtggagtcaacaatggccgctgtttcgccagtatcgggagtatccggcgcaggcgcgccgtcgttccagggcgaccagattagcacagcgatcaacgccaggagcccgccgccaagcgacagcgcaaaaggcgtgcgctgcccgcgtcgcgcagaggcgccggcgagttcagcttcccgttgttgcgctaggcgaagctcacgctcggcgcgctgacggcgctcttgatcttcatgtgcgaactgctcagcctcggcgcgcgcgcgtcgctcggcctcctcgcgtgttctgcgctcgcgcgcttctcgttcaaggcgtgttagttctgcttcctcgtcgtcacgaacgcgcagcaactcatccacggccatgaacaacggactcgcttcgtgttgcgtaagccacgacctcagggccgccgcgggcgcctgcacgtcgagcgcgccatagctttcaatgtcctcgcgtccacaaagtttaccgacgcgcctgagcacgctcttccagcccgcgtgcgtgtgcgagggcgcggcaagccatgcccgcatgtcttcagcatgagtggcgttgaaaggcgcgggcgggtcgaagccatccgggcctgccgcgtagcacgccgctagcttcttattggtgaagccaatcaacgcctcagccttcacccaatctgacgcacgcgcagctggcgaccaacacacaaggatcgctttcgccgcgcgggcctcccgatcgatctcgtctgaaaaggcttcgcccgcgttcaggctggcgtcgaaccacacatcgatgcctaacaggcgcagttcctgcgccaagcgctcaaccgcttggcgctcttcgcgcttgtagctgatgaatacgtccgccacccagcccccgtttggctcaccgtaagaggtgacgcggcgacccgatacggtgtcgggcgttcgggagctaccctagccgcgccaggaacaagcatagccagtcatgatgcacacacaagggctggacgaacaggaacggctcgaaccgggctctctcaagccgctcgcgcgatcaggccatcgggctggattgggccaataggactaacccgctcgcgcgggacgcagattctgcaagcacttgcgccagtgtcatcgccttctgtctcccgggctgcgcccggatgggccgggtcgagcccagacgggagacccagccatggccgacgcgcctcagattcatcccctgcgccagcgcatgatcgaagacatgacgctgcggggcatcaacagcgcctcgcagaagacctacctccgtgcggtccgcgcgtgctgcacccatctgcggcgcaaccccgctgagctgacagccg

SEQ ID NO: 179 - DNA, 4000 bp, Escherichia coli
  misc_feature (1940)..(1940): n is a, c, g, or t
  misc_feature (1969)..(1969): n is a, c, g, or t
  misc_feature (1988)..(1988): n is a, c, g, or t
  misc_feature (2299)..(2299): n is a, c, g, or t
  misc_feature (2608)..(2608): n is a, c, g, or t
  misc_feature (2612)..(2615): n is a, c, g, or t
  misc_feature (2618)..(2623): n is a, c, g, or t
  misc_feature (2625)..(2627): n is a, c, g, or t
  misc_feature (2630)..(2630): n is a, c, g, or t
  misc_feature (2632)..(2634): n is a, c, g, or t
  misc_feature (2636)..(2636): n is a, c, g, or t
  misc_feature (2639)..(2641): n is a, c, g, or t
  misc_feature (2643)..(2643): n is a, c, g, or t
  misc_feature (2645)..(2646): n is a, c, g, or t
  misc_feature (2649)..(2649): n is a, c, g, or t
  misc_feature (2652)..(2653): n is a, c, g, or t
  misc_feature (2655)..(2658): n is a, c, g, or t
  misc_feature (2660)..(2660): n is a, c, g, or t
  misc_feature (2662)..(2668): n is a, c, g, or t
  misc_feature (2670)..(2670): n is a, c, g, or t
  misc_feature (2674)..(2674): n is a, c, g, or t
  misc_feature (2676)..(2677): n is a, c, g, or t
  misc_feature (2679)..(2679): n is a, c, g, or t
  misc_feature (2682)..(2683): n is a, c, g, or t
  misc_feature (2687)..(2687): n is a, c, g, or t
  misc_feature (2689)..(2691): n is a, c, g, or t
  misc_feature (2693)..(2699): n is a, c, g, or t
  misc_feature (2703)..(2705): n is a, c, g, or t
  misc_feature (2709)..(2713): n is a, c, g, or t
  misc_feature (2715)..(2716): n is a, c, g, or t
  misc_feature (2718)..(2721): n is a, c, g, or t
  misc_feature (2723)..(2727): n is a, c, g, or t
  misc_feature (2729)..(2730): n is a, c, g, or t
  misc_feature (2732)..(2734): n is a, c, g, or t
  misc_feature (2737)..(2737): n is a, c, g, or t
  misc_feature (2740)..(2746): n is a, c, g, or t
  misc_feature (2748)..(2750): n is a, c, g, or t
  misc_feature (2753)..(2753): n is a, c, g, or t
  misc_feature (2756)..(2756): n is a, c, g, or t
  misc_feature (2759)..(2759): n is a, c, g, or t
  misc_feature (2764)..(2765): n is a, c, g, or t
  misc_feature (2769)..(2770): n is a, c, g, or t
  misc_feature (2772)..(2777): n is a, c, g, or t
  misc_feature (2780)..(2780): n is a, c, g, or t
  misc_feature (2782)..(2782): n is a, c, g, or t
  misc_feature (2785)..(2790): n is a, c, g, or t
  misc_feature (2792)..(2794): n is a, c, g, or t
  misc_feature (2797)..(2799): n is a, c, g, or t
  misc_feature (2802)..(2802): n is a, c, g, or t
  misc_feature (2804)..(2805): n is a, c, g, or t
  misc_feature (2809)..(2812): n is a, c, g, or t
  misc_feature (2814)..(2818): n is a, c, g, or t
  misc_feature (2820)..(2834): n is a, c, g, or t
  misc_feature (2836)..(2847): n is a, c, g, or t
  misc_feature (2851)..(2853): n is a, c, g, or t
  misc_feature (2855)..(2859): n is a, c, g, or t
  misc_feature (2861)..(2861): n is a, c, g, or t
  misc_feature (2863)..(2865): n is a, c, g, or t
  misc_feature (2867)..(2867): n is a, c, g, or t
  misc_feature (2870)..(2872): n is a, c, g, or t
  misc_feature (2874)..(2881): n is a, c, g, or t
  misc_feature (2883)..(2883): n is a, c, g, or t
  misc_feature (2885)..(2887): n is a, c, g, or t
  misc_feature (2889)..(2894): n is a, c, g, or t
  misc_feature (2898)..(2899): n is a, c, g, or t
  misc_feature (2901)..(2902): n is a, c, g, or t
  misc_feature (2904)..(2905): n is a, c, g, or t
  misc_feature (2908)..(2914): n is a, c, g, or t
  misc_feature (2916)..(2916): n is a, c, g, or t
  misc_feature (2919)..(2922): n is a, c, g, or t
  misc_feature (2924)..(2924): n is a, c, g, or t
  misc_feature (2926)..(2929): n is a, c, g, or t
  misc_feature (2931)..(2935): n is a, c, g, or t
  misc_feature (2937)..(2937): n is a, c, g, or t
  misc_feature (2940)..(2940): n is a, c, g, or t
  misc_feature (2942)..(2943): n is a, c, g, or t
  misc_feature (2946)..(2953): n is a, c, g, or t
  misc_feature (2955)..(2955): n is a, c, g, or t
  misc_feature (2957)..(2958): n is a, c, g, or t
  misc_feature (2960)..(2960): n is a, c, g, or t
  misc_feature (2962)..(2965): n is a, c, g, or t
  misc_feature (2968)..(2968): n is a, c, g, or t
  misc_feature (2970)..(2973): n is a, c, g, or t
  misc_feature (2976)..(2978): n is a, c, g, or t
  misc_feature (2980)..(2980): n is a, c, g, or t
  misc_feature (2982)..(2985): n is a, c, g, or t
  misc_feature (2987)..(2992): n is a, c, g, or t
  misc_feature (2994)..(2994): n is a, c, g, or t
  misc_feature (2997)..(2998): n is a, c, g, or t
  misc_feature (3000)..(3002): n is a, c, g, or t
  misc_feature (3004)..(3004): n is a, c, g, or t
  misc_feature (3006)..(3007): n is a, c, g, or t
  misc_feature (3009)..(3010): n is a, c, g, or t
  misc_feature (3012)..(3014): n is a, c, g, or t
  misc_feature (3016)..(3019): n is a, c, g, or t
  misc_feature (3024)..(3027): n is a, c, g, or t
  misc_feature (3029)..(3030): n is a, c, g, or t
  misc_feature (3032)..(3035): n is a, c, g, or t
  misc_feature (3040)..(3040): n is a, c, g, or t
  misc_feature (3045)..(3056): n is a, c, g, or t
  misc_feature (3058)..(3058): n is a, c, g, or t
  misc_feature (3060)..(3063): n is a, c, g, or t
  misc_feature (3065)..(3067): n is a, c, g, or t
  misc_feature (3069)..(3071): n is a, c, g, or t
  misc_feature (3076)..(3076): n is a, c, g, or t
  misc_feature (3078)..(3079): n is a, c, g, or t
  misc_feature (3082)..(3092): n is a, c, g, or t
  misc_feature (3094)..(3094): n is a, c, g, or t
  misc_feature (3096)..(3098): n is a, c, g, or t
  misc_feature (3102)..(3104): n is a, c, g, or t
  misc_feature (3108)..(3110): n is a, c, g, or t
  misc_feature (3113)..(3115): n is a, c, g, or t
  misc_feature (3118)..(3122): n is a, c, g, or t
  misc_feature (3124)..(3129): n is a, c, g, or t
  misc_feature (3132)..(3134): n is a, c, g, or t
  misc_feature (3136)..(3138): n is a, c, g, or t
  misc_feature (3140)..(3141): n is a, c, g, or t
  misc_feature (3143)..(3144): n is a, c, g, or t
  misc_feature (3148)..(3149): n is a, c, g, or t
  misc_feature (3151)..(3151): n is a, c, g, or t
  misc_feature (3153)..(3153): n is a, c, g, or t
  misc_feature (3155)..(3155): n is a, c, g, or t
  misc_feature (3157)..(3161): n is a, c, g, or t
  misc_feature (3163)..(3165): n is a, c, g, or t
  misc_feature (3167)..(3170): n is a, c, g, or t
  misc_feature (3172)..(3175): n is a, c, g, or t
  misc_feature (3177)..(3179): n is a, c, g, or t
  misc_feature (3181)..(3182): n is a, c, g, or t
  misc_feature (3184)..(3186): n is a, c, g, or t
  misc_feature (3188)..(3189): n is a, c, g, or t
  misc_feature (3191)..(3192): n is a, c, g, or t
  misc_feature (3194)..(3194): n is a, c, g, or t
  misc_feature (3197)..(3203): n is a, c, g, or t
  misc_feature (3207)..(3207): n is a, c, g, or t
  misc_feature (3209)..(3209): n is a, c, g, or t
  misc_feature (3212)..(3217): n is a, c, g, or t
  misc_feature (3219)..(3224): n is a, c, g, or t
  misc_feature (3229)..(3231): n is a, c, g, or t
  misc_feature (3233)..(3235): n is a, c, g, or t
  misc_feature (3237)..(3240): n is a, c, g, or t
  misc_feature (3242)..(3244): n is a, c, g, or t
  misc_feature (3246)..(3246): n is a, c, g, or t
  misc_feature (3248)..(3249): n is a, c, g, or t
  misc_feature (3251)..(3251): n is a, c, g, or t
  misc_feature (3256)..(3256): n is a, c, g, or t
  misc_feature (3258)..(3261): n is a, c, g, or t
  misc_feature (3263)..(3266): n is a, c, g, or t
  misc_feature (3268)..(3270): n is a, c, g, or t
  misc_feature (3273)..(3273): n is a, c, g, or t
  misc_feature (3275)..(3278): n is a, c, g, or t
  misc_feature (3281)..(3285): n is a, c, g, or t
  misc_feature (3287)..(3290): n is a, c, g, or t
  misc_feature (3292)..(3294): n is a, c, g, or t
  misc_feature (3296)..(3296): n is a, c, g, or t
  misc_feature (3298)..(3298): n is a, c, g, or t
  misc_feature (3300)..(3300): n is a, c, g, or t
  misc_feature (3303)..(3303): n is a, c, g, or t
  misc_feature (3305)..(3305): n is a, c, g, or t
  misc_feature (3307)..(3307): n is a, c, g, or t
  misc_feature (3309)..(3309): n is a, c, g, or t
  misc_feature (3311)..(3311): n is a, c, g, or t
  misc_feature (3313)..(3313): n is a, c, g, or t
  misc_feature (3315)..(3315): n is a, c, g, or t
  misc_feature (3317)..(3318): n is a, c, g, or t
  misc_feature (3320)..(3321): n is a, c, g, or t
  misc_feature (3323)..(3323): n is a, c, g, or t
  misc_feature (3325)..(3325): n is a, c, g, or t
  misc_feature (3327)..(3328): n is a, c, g, or t
  misc_feature (3330)..(3330): n is a, c, g, or t
  misc_feature (3332)..(3336): n is a, c, g, or t
  misc_feature (3340)..(3345): n is a, c, g, or t
  misc_feature (3347)..(3349): n is a, c, g, or t
  misc_feature (3352)..(3359): n is a, c, g, or t
  misc_feature (3361)..(3369): n is a, c, g, or t
  misc_feature (3372)..(3372): n is a, c, g, or t
  misc_feature (3374)..(3382): n is a, c, g, or t
  misc_feature (3385)..(3386): n is a, c, g, or t
  misc_feature (3388)..(3390): n is a, c, g, or t
  misc_feature (3392)..(3394): n is a, c, g, or t
  misc_feature (3400)..(3407): n is a, c, g, or t
  misc_feature (3409)..(3410): n is a, c, g, or t
  misc_feature (3412)..(3412): n is a, c, g, or t
  misc_feature (3415)..(3418): n is a, c, g, or t
  misc_feature (3424)..(3426): n is a, c, g, or t
  misc_feature (3429)..(3433): n is a, c, g, or t
  misc_feature (3436)..(3437): n is a, c, g, or t
  misc_feature (3439)..(3442): n is a, c, g, or t
  misc_feature (3445)..(3445): n is a, c, g, or t
  misc_feature (3450)..(3458): n is a, c, g, or t
  misc_feature (3460)..(3464): n is a, c, g, or t
  misc_feature (3473)..(3473): n is a, c, g, or t
  misc_feature (3476)..(3476): n is a, c, g, or t
  misc_feature (3478)..(3478): n is a, c, g, or t
  misc_feature (3480)..(3480): n is a, c, g, or t
  misc_feature (3482)..(3487): n is a, c, g, or t
  misc_feature (3489)..(3489): n is a, c, g, or t
  misc_feature (3492)..(3499): n is a, c, g, or t
  misc_feature (3501)..(3502): n is a, c, g, or t
  misc_feature (3504)..(3512): n is a, c, g, or t
  misc_feature (3514)..(3518): n is a, c, g, or t
  misc_feature (3520)..(3520): n is a, c, g, or t
  misc_feature (3522)..(3524): n is a, c, g, or t
  misc_feature (3526)..(3531): n is a, c, g, or t
  misc_feature (3535)..(3536): n is a, c, g, or t
  misc_feature (3538)..(3547): n is a, c, g, or t
  misc_feature (3549)..(3555): n is a, c, g, or t
  misc_feature (3557)..(3565): n is a, c, g, or t
  misc_feature (3567)..(3571): n is a, c, g, or t
  misc_feature (3573)..(3573): n is a, c, g, or t
  misc_feature (3575)..(3575): n is a, c, g, or t
  misc_feature (3577)..(3580): n is a, c, g, or t
  misc_feature (3582)..(3584): n is a, c, g, or t
  misc_feature (3586)..(3587): n is a, c, g, or t
  misc_feature (3589)..(3592): n is a, c, g, or t
  misc_feature (3596)..(3597): n is a, c, g, or t
  misc_feature (3599)..(3601): n is a, c, g, or t
  misc_feature (3603)..(3606): n is a, c, g, or t
  misc_feature (3608)..(3611): n is a, c, g, or t
  misc_feature (3613)..(3613): n is a, c, g, or t
  misc_feature (3615)..(3616): n is a, c, g, or t
  misc_feature (3618)..(3624): n is a, c, g, or t
  misc_feature (3627)..(3628): n is a, c, g, or t
  misc_feature (3631)..(3632): n is a, c, g, or t
  misc_feature (3634)..(3636): n is a, c, g, or t
  misc_feature (3638)..(3638): n is a, c, g, or t
  misc_feature (3641)..(3641): n is a, c, g, or t
  misc_feature (3643)..(3645): n is a, c, g, or t
  misc_feature (3648)..(3650): n is a, c, g, or t
  misc_feature (3652)..(3656): n is a, c, g, or t
  misc_feature (3658)..(3662): n is a, c, g, or t
  misc_feature (3665)..(3665): n is a, c, g, or t
  misc_feature (3667)..(3667): n is a, c, g, or t
  misc_feature (3670)..(3672): n is a, c, g, or t
  misc_feature (3674)..(3675): n is a, c, g, or t
  misc_feature (3677)..(3677): n is a, c, g, or t
  misc_feature (3679)..(3680): n is a, c, g, or t
  misc_feature (3682)..(3685): n is a, c, g, or t
  misc_feature (3688)..(3689): n is a, c, g, or t
  misc_feature (3692)..(3692): n is a, c, g, or t
  misc_feature (3694)..(3695): n is a, c, g, or t
  misc_feature (3697)..(3709): n is a, c, g, or t
  misc_feature (3712)..(3713): n is a, c, g, or t
  misc_feature (3718)..(3719): n is a, c, g, or t
  misc_feature (3721)..(3723): n is a, c, g, or t
  misc_feature (3728)..(3729): n is a, c, g, or t
  misc_feature (3732)..(3734): n is a, c, g, or t
  misc_feature (3736)..(3741): n is a, c, g, or t
  misc_feature (3744)..(3747): n is a, c, g, or t
  misc_feature (3749)..(3755): n is a, c, g, or t
  misc_feature (3757)..(3760): n is a, c, g, or t
  misc_feature (3763)..(3763): n is a, c, g, or t
  misc_feature (3765)..(3765): n is a, c, g, or t
  misc_feature (3767)..(3770): n is a, c, g, or t
  misc_feature (3776)..(3777): n is a, c, g, or t
  misc_feature (3779)..(3781): n is a, c, g, or t
  misc_feature (3783)..(3785): n is a, c, g, or t
  misc_feature (3788)..(3795): n is a, c, g, or t
  misc_feature (3800)..(3804): n is a, c, g, or t
  misc_feature (3807)..(3810): n is a, c, g, or t
  misc_feature (3812)..(3812): n is a, c, g, or t
  misc_feature (3817)..(3817): n is a, c, g, or t
  misc_feature (3820)..(3821): n is a, c, g, or t
  misc_feature (3823)..(3824): n is a, c, g, or t
  misc_feature (3826)..(3835): n is a, c, g, or t
  misc_feature (3837)..(3841): n is a, c, g, or t
  misc_feature (3843)..(3844): n is a, c, g, or t
  misc_feature (3846)..(3855): n is a, c, g, or t
  misc_feature (3857)..(3857): n is a, c, g, or t
  misc_feature (3860)..(3870): n is a, c, g, or t
  misc_feature (3872)..(3872): n is a, c, g, or t
  misc_feature (3874)..(3875): n is a, c, g, or t
  misc_feature (3877)..(3877): n is a, c, g, or t
  misc_feature (3879)..(3881): n is a, c, g, or t
  misc_feature (3883)..(3884): n is a, c, g, or t
  misc_feature (3886)..(3886): n is a, c, g, or t
  misc_feature (3889)..(3890): n is a, c, g, or t
  misc_feature (3892)..(3892): n is a, c, g, or t
  misc_feature (3895)..(3896): n is a, c, g, or t
  misc_feature (3898)..(3899): n is a, c, g, or t
  misc_feature (3901)..(3903): n is a, c, g, or t
  misc_feature (3905)..(3907): n is a, c, g, or t
  misc_feature (3909)..(3910): n is a, c, g, or t
  misc_feature (3913)..(3914): n is a, c, g, or t
  misc_feature (3916)..(3917): n is a, c, g, or t
  misc_feature (3919)..(3921): n is a, c, g, or t
  misc_feature (3923)..(3923): n is a, c, g, or t
  misc_feature (3925)..(3925): n is a, c, g, or t
  misc_feature (3927)..(3928): n is a, c, g, or t
  misc_feature (3930)..(3930): n is a, c, g, or t
  misc_feature (3932)..(3932): n is a, c, g, or t
  misc_feature (3935)..(3935): n is a, c, g, or t
  misc_feature (3937)..(3938): n is a, c, g, or t
  misc_feature (3940)..(3940): n is a, c, g, or t
  misc_feature (3942)..(3942): n is a, c, g, or t
  misc_feature (3944)..(3945): n is a, c, g, or t
  misc_feature (3947)..(3948): n is a, c, g, or t
  misc_feature (3951)..(3953): n is a, c, g, or t
  misc_feature (3957)..(3957): n is a, c, g, or t
  misc_feature (3959)..(3959): n is a, c, g, or t
  misc_feature (3962)..(3964): n is a, c, g, or t
  misc_feature (3966)..(3969): n is a, c, g, or t
  misc_feature (3974)..(3977): n is a, c, g, or t
  misc_feature (3980)..(3981): n is a, c, g, or t
  misc_feature (3983)..(3985): n is a, c, g, or t
  misc_feature (3989)..(3992): n is a, c, g, or t
  misc_feature (3995)..(3997): n is a, c, g, or t
  misc_feature (3999)..(4000): n is a, c, g, or t
tcgtcaaccgggctccataagattgctgcggacccagactttcaaaataaggcctgacccagtgcgaatgaagcgcctgctttcatccgagaagggggcaagagcgtagtcaccatgagccttccaaaaggcatgcctagagccgccaaatctgtcccaaacgcccatcctcgttaacaaatctagcggtgtccatacccacgataaaagtcattgacgcttgctactttgcgggtctaaactagatctcggtcttgaaactgaggtgatttgtgtctgattctaaagcctaccgagctccaacgaaattgattcacggtaagcactcaacggagaagtgggattacaactaccatgttgttcccccgaaaaccgcatcgaccacgtttagattggcatcggtgctcagaggtaaagaaggcttcattgacttcggcgccccttggggtcagggggccaccaaaccgacttacatctatgaccgcctgaccgagccctccacaggcatgttggaagaggtctatgtccaggctgaaggcggcgattttgcctgcgcctttacgtgtggtatggcggccatttcggcgtcattgatggcggtatccaaggctggtgacaatatagtcgcccacccaactatgtatggttgtacttacagccttttggttaaccagcttcctaggtttggcattacatcaaaactggtcaattgctcggacttggatgctgttggagccgctttggatgaaaacacgtcggctgtctaccttgagacacctgctaatccaacgttggaatgtattgatattgcagcagttcgcaaggtcatcgacgcgcacaatgccaaggtcgggcctgaacgcaaggtgcgcctgattgttgacaacacctttcatacgttttggggacagcgcccgttacagcttggtgcagacatagttgtatgcagtctgactaagggtgtgggtggctttggggtcgatatgggcgggatgattgttgggcccaaagatctggaccttaccgttcgcttgattcgcaaagactttggtggcgtgctgcctccttcaagtgcctggaacttccaagtttacggcatcccaacgatgccaatcaggctgactcagcaggctgcctcggccatgaagattgcccagtacctggaatccaaccccttggtgggcaaagtgaattatcccggccttgaatcatacccaggcaaagagattgctaaacgtcagatgaccacccctaatggtgattttttcccaggtagcatgatttatttcgagcttgctggggattatgaacaggctagcaagcgttgtcatcaactgataaatcacatagctgacaacgcctacagcattacgctggctgtcagcctagggatgaccaagaccctggttgaagctcctgggctgatgacccactcggctctggaccaatgcgcccaggaaaaggccggcattcacccaggcgccgtccgtctatccattggcctcgaagatgtatccgatctcctagcagacctcgaacgcgcctttagtacagtcgaataattccaggtccaaaacaacgaaccaattacgaatctgagatattagagacgggtttcttctgtttaaacaagtagatacgcaaagggcacccgaaggtgcccccgcgtttagtgaacgattctacgaattattcggtttcgttctcgaagaacatggcggaagcgccaacggaggagcactcaccgtattgggcattgggatcgccatacaggaagcgcttgaaggttgacatctcgccgtcgcagtcaaggtctgcgtgggcccatgctgttgcttgagcctcattcaagtccttaccgttgttctcgaaacgatagacgaaatagtgctcgtcagtcatctggaaggtcagagcagaccactgagcggtgttccatncttcggagtcggagtcgcagcggccgtcnctattgacgtccagcaacncatcgcagcagttgtcacctggggtcaagccctgactggctgggaactggcagtacagcttggagcccacactggtgacacgtggggcggtgtagtacgaagaagcacccttgacgattttgtcgagctcgtcgatagcctcagttgtcttggcacggcgcatgtacttgatgaacgcaggtactgcaatgacagccaagataccgaggatggcaacgacgaccatcaattcgaccagggtgaagcccttgaaaccaattttgcggaaacgagctagcatgtttgacctcctaaaagtgaccttttttccncctggccatccgaccaagtggatagcccataccgggcaggccactaggcgctgcccaacgggcgcttcttagaagcaatcatcgtgccaaagtgaaaatactgtgaataaagggtgttatgggttttgagcccacaatctagggcctgtttttacaaaaaacgcgatggtgagtgacaagaattgtcagtgggcaggaaaaaatgtgaaggaaggtgacagggacagggacagggacagggacggggacagggacggggacagggacagggacagggacagggacagggacagggacggggacagggangggnnnnggnnnnnngnnnggnannngnacnnngncnnggncgnngnnnngncnnnnnnngngtcncnngnggnntagncnnngnnnnnnntggnnntagnnnnntnncnnnncnnnnncnngnnnggngannnnnnntnnnagnttngtngaganngctnntnnnnnngcnantgnnnnnncnnntgnnnttncnngttnnnntnnnnntnnnnnnnnnnnnnnnannnnnnnnnnnnctgnnntnnnnngntnnncnagnnntnnnnnnnngncnnntnnnnnnactnngnntnntannnnnnntnttnnnntngnnnntnnnnngnctncnnttnnnnnnnngntnngntnnnnggntnnnnatnnnantnnnnannnnnntncgnntnnntngnngnntnnntnnnngggtnnnnannannnnttggngcttnnnnnnnnnnnngngnnnncnnnannnccttntnntannnnnnnnnnngngnnnacannnggcnnngcnnnttnnnnnannnnnnttnnngnnncnncnnccanngnancncnnnnngnnncnnnntnnnngnnngnnannntnntnncnacnnnnnnngtgncnccnnnnnnannnnnntctgnnngnnncnnnntnnngncnncnagttncnnnncnnnntnnnaangnnnntcnnnnngnnnntnnntntngnccncnantncntnancnntnncnananncnannnnntgtnnnnnncnnngtnnnnnnnnannnnnnnnnccntnnnnnnnnncannannntnnntgcaannnnnnnngnngnaannnnaggggnnnttnnnnntgnnannnnaanacatnnnnnnnnnannnnngcaatgatnggnantntnnnnnntnaannnnnnnnanntnnnnnnnnnannnnngntnnnannnnnnaaanncnnnnnnnnnngnnnnnnnannnnnnnnnannnnntngnannnncnnngnnannnnctgnngnnngnnnngnnnnantnncnnnnnnnatnncanngnnngngcnannngcnnnannnnnannnnngcnantgnnncnntnanngnnnnaannagngnncnnnnnnnnnnnnnaannccagnngnnnggacnntcnnnannnnnntgnnnngnnnnnnngnnnnggntncnnnnaaggcnngnnntnnngcnnnnnnnntgccnnnnnttnnnncnagggntgnnannannnnnnnnnncnnnnngnngnnnnnnnnnnanatnnnnnnnnnnngngnnancnnnanngncanngnaannanngnnncnnntnncannannannnanangnnanangcnanngncngnncnngannnagancnatnnncnnnnctatnnnnatnncnnnggcnnnngcnnngnn

SEQ ID NO: 180 - DNA, 4000 bp, Escherichia coli
  misc_feature (1981)..(1981): n is a, c, g, or t
atcgatcccgcgagcgccgtgtcggcggtccaggggttcgtgctcgacggctcgccgggtttgcgtgccgcggcgatggcgaataccgcggtgtttacgagcggcttcggcgtcttgcgactcgggttgacgctcgcgggtatcgcgcactcgtggtttctcggaacggtgcgtgaatcgccagaaacacgcgtggcgatgcgcatttagattttttgtcgcgagtgcgacgctcgaacgaccgtgggaggtgatgacagatgacagatacttccgagcgcgcgcaacgcggaccgacaatcgtcggtgcagcgacggccgctccgtgagcgagtatcaaaatattagttttcaatctgatcccggaggtttctgatagttctgagactcgttttttgtgcgttcgacagactgactcgcttttcccgcgcgcacgcaggtcgtcatggcggcgtttggtgtcggaggatacgctctcgtgtgcgcctacttcatcgtcggcagtgcggtgacaaagataaaattgaaggaaaagcaagccgaggggatagcggaggcgcggggagggcttcgtggccccggaagcgtgtgggggagcgggacggcggggattttgtgcgctattgcggcgctttcgggatggacacccgtgtcgttggaactctggcggatcggtttcgtggcgagcttttgcagcaaactcagcgacaccaccgcaagtgagatcggcaaggcgtacggcaagacgacctatatgagcacgccaccgttcaagttagttcccagaggtacggagggcgccgttagcgtcgaaggaaccgtggctggtatcgtcgtatcgggtctgttcgccgggcttgcgttcatcatcggtcaactggatgccgtcggcgtcggtgtatgcgtcctcgctgccttcatcgcgacgaccttcgagagcatgctcggggcggctgtgcagggtagaaaaggatttgattggatgtctaacgacgtggtgaacggaatacagatcacgctcgcggctggggtggccatcgcgttgagaacaatcgtctgagtcgactagattcgaatcatcgtcgcgacgacactcgtagtaaaatttacaaactagatagaatttaacagatggctagttcaggaccccttttctgtcatccggcacggataatgaaaaatctcgttcctcacgacccctccgacgtcgccgccctttgtttatcatcgcaccgcgtcacgaaatcatgaacctcgtcggcaaactttttcggttcttcgaggtacaaccaatgcccacagttttcgaaaatcttcaactccgaatcgggaatcatctcagccaccgctttgatgccatctatgggaaatattttggtttcacgtcccgccaggacgagcgccgggatggtcatgtgtcgacactcgcttcgccagtcttggtgcgtgtggtcgtacatcagctcgcacaacgcctcgggacagcactcgagcgtctcgctcttcaccatggcgagcacgtcgggatcaacgacactgagatcgtgaaagcaagcctcggcgttaccatccgcgaacgtagacatatctcttctcacagccgccgccaacgcctcgtaactcgccgcgtcgtaacaacccaaactccccagctcccaatccgggcgtctattctgcaacggggcctgatccacgagcaccgcgccgatgacgctcacctcggtcgcatcgctcccccctccgacgcgccatcgcgcgccgcacaactgtaagagcgaccaaacgaccgcgcatcccatcgacgcgccgacgagcacgaacccgctcggcgacagtctcgccgccgcctgctccaggacctcccgcaggtccatcgccagccgcgcgacggtgtgcccgcgtcccggacggtcgctcccgccgtgccctcgaagatcgaacgcgatcgtcgcgggaaagtcgtcgcgcgccgcgcgcatcnccggcgaaaaatacgccgccgtcccgctccaaccgtggacgaggacgacgacggggcgatcgcgcgcgggcgtagcgccgccgacgacggcgcggaggcgaacgcggccgccgtcgacggggtccaggtcgagcgcggtccacggcatcgcgcgtcgacgagtgtttgggagcgaggtcgattgcaaagggcggcgtcgctcggttctaaagacgagatttaattttggtgtccaacggaccctgagcgagggtgcgaccctgaatggcgcagttctctaagtaaggacacggttggtacagaccgccgtacttggtggaccaagcgcggagcttggcggcgatcacggcggggccgacggagtcgccccagtggacgacgccgcctcgaaaggcagggaagcccatgcctaagattgccgcggtgtcgatatcgccagccttgacgacgatgccttcggaaagaactctgcacgcttcgttgacgaccgggaaaaagatcatctcagcgatctcttgcggactcaagcccgccggaacgggcgaaccgtcgagcggaagtttggactgcgctcgggacgcggcgatgagcatctcgacaccctcgggatcaggcgtggcccggcgcttattgtcgtacttgtaaaatccagcaccggacttctcgcccaatcttttgttcgcgagcaacgatgggatgaggggcgagcggtagactcgatcggggaaatcgtcgatgaagttctgcccgacgtgaacgccgacatcgtgaccgaccaaatcacccaaacggaacggacccatgggcattccaaacatcattatcgcacgatcgatggcgtacggatcgcacccaatatccacgagcaccgtcgcgctcatggtgtacggaaagaagatacggttgacggcgaatccggtgcagtttcccacgacgacaggcgtcttcttaatttgtttactcaagcccaaggtgtccaccaaaatctgcgccggagtcgcgtcggtacgaataatttcgaacagctgcatgacatgagcaggtgaaaagaaatgagcacccacgatgcgctctgggttcttcattttggcggcgatttttgtaatgtcgatggtactcgtgttcgtgctcaagatgcaatcaggcttgcaaatcctctccaactcacagaagatcttttgcttgagaggtaagttttcaatgacagcctcgatgaccatatcacactgacggaaatcttgatctgtgagtgtaggcttgacgagcgacatcagctggcgcgccttgtcttcagtcatcctgcctttacgaaccatgctcgtcaagtttgattgaatgcgaccgacgcccgcgtccaaaaactcttgcttgatctctttcaacacgacttgaattccagcgagcaagcacgccgtggcgattccactccccatcaaaccgcctccgacgacgccgactgacttcatcggtcgaggcttaaggccgacgtccgtgattcccggaactacgttcgtcgcgcgctgagcgaagaagaagtgaaccaaacctttcgcggcaggcgatgatacagcctttttaaagttttctgcctcgcgcttcagtccctcttcagggccttgggcgagtccgaccgagatggcatcgacgcaaagcgccacgtgcggcatcactgactgcactcgcttggccttcttgctcgcctccttgagaatcatctccgtagacttgggatctggtagtttgtctttacgatacatcgaaagctcccgcttcacggagccactcgcgatcgccttcgccaacgccgacgcctcggcgacgattcttgacgggtccgcaattttgtcaaccaatccaagtttcagcgcctcctccgccttgatcgacttgctcttcagcatcatctccagggacttctccaagcccaccaaccgcggcaggcgttgagtgccaccaaacccaggaatcactcccaactgaagctcaggcaaccccaactgcgccctcggcgtcgccacg

SEQ ID NO: 181 - DNA, 4000 bp, Escherichia coli
  misc_feature (1544)..(1544): n is a, c, g, or t
  misc_feature (1987)..(1988): n is a, c, g, or t
  misc_feature (1997)..(1997): n is a, c, g, or t
  misc_feature (2004)..(2004): n is a, c, g, or t
  misc_feature (2149)..(2151): n is a, c, g, or t
  misc_feature (2203)..(2203): n is a, c, g, or t
  misc_feature (2243)..(2243): n is a, c, g, or t
  misc_feature (2257)..(2258): n is a, c, g, or t
  misc_feature (2261)..(2261): n is a, c, g, or t
  misc_feature (2268)..(2268): n is a, c, g, or t
  misc_feature (2272)..(2272): n is a, c, g, or t
  misc_feature (2274)..(2274): n is a, c, g, or t
  misc_feature (2278)..(2278): n is a, c, g, or t
  misc_feature (2280)..(2280): n is a, c, g, or t
  misc_feature (2287)..(2287): n is a, c, g, or t
  misc_feature (2292)..(2293): n is a, c, g, or t
  misc_feature (2298)..(2300): n is a, c, g, or t
  misc_feature (2306)..(2307): n is a, c, g, or t
  misc_feature (2309)..(2310): n is a, c, g, or t
  misc_feature (2317)..(2317): n is a, c, g, or t
  misc_feature (2319)..(2319): n is a, c, g, or t
  misc_feature (2327)..(2327): n is a, c, g, or t
  misc_feature (2330)..(2330): n is a, c, g, or t
  misc_feature (2336)..(2336): n is a, c, g, or t
  misc_feature (2341)..(2343): n is a, c, g, or t
  misc_feature (2345)..(2345): n is a, c, g, or t
  misc_feature (2348)..(2348): n is a, c, g, or t
  misc_feature (2350)..(2350): n is a, c, g, or t
  misc_feature (2359)..(2360): n is a, c, g, or t
  misc_feature (2365)..(2365): n is a, c, g, or t
  misc_feature (2369)..(2369): n is a, c, g, or t
  misc_feature (2372)..(2373): n is a, c, g, or t
  misc_feature (2375)..(2375): n is a, c, g, or t
  misc_feature (2377)..(2377): n is a, c, g, or t
  misc_feature (2380)..(2380): n is a, c, g, or t
  misc_feature (2384)..(2385): n is a, c, g, or t
  misc_feature (2388)..(2389): n is a, c, g, or t
  misc_feature (2392)..(2392): n is a, c, g, or t
  misc_feature (2399)..(2404): n is a, c, g, or t
  misc_feature (2407)..(2409): n is a, c, g, or t
  misc_feature (2414)..(2415): n is a, c, g, or t
  misc_feature (2422)..(2422): n is a, c, g, or t
  misc_feature (2424)..(2424): n is a, c, g, or t
  misc_feature (2429)..(2432): n is a, c, g, or t
  misc_feature (2435)..(2437): n is a, c, g, or t
  misc_feature (2442)..(2444): n is a, c, g, or t
  misc_feature (2448)..(2448): n is a, c, g, or t
  misc_feature (2452)..(2452): n is a, c, g, or t
  misc_feature (2455)..(2455): n is a, c, g, or t
  misc_feature (2457)..(2457): n is a, c, g, or t
  misc_feature (2460)..(2460): n is a, c, g, or t
  misc_feature (2462)..(2462): n is a, c, g, or t
  misc_feature (2465)..(2466): n is a, c, g, or t
  misc_feature (2471)..(2471): n is a, c, g, or t
  misc_feature (2476)..(2476): n is a, c, g, or t
  misc_feature (2478)..(2478): n is a, c, g, or t
  misc_feature (2483)..(2483): n is a, c, g, or t
  misc_feature (2490)..(2490): n is a, c, g, or t
  misc_feature (2493)..(2496): n is a, c, g, or t
  misc_feature (2498)..(2498): n is a, c, g, or t
  misc_feature (2505)..(2507): n is a, c, g, or t
  misc_feature (2512)..(2512): n is a, c, g, or t
  misc_feature (2515)..(2516): n is a, c, g, or t
  misc_feature (2518)..(2518): n is a, c, g, or t
  misc_feature (2522)..(2522): n is a, c, g, or t
  misc_feature (2531)..(2531): n is a, c, g, or t
  misc_feature (2536)..(2536): n is a, c, g, or t
  misc_feature (2539)..(2539): n is a, c, g, or t
  misc_feature (2541)..(2541): n is a, c, g, or t
  misc_feature (2544)..(2544): n is a, c, g, or t
  misc_feature (2548)..(2549): n is a, c, g, or t
  misc_feature (2554)..(2555): n is a, c, g, or t
  misc_feature (2558)..(2559): n is a, c, g, or t
  misc_feature (2561)..(2561): n is a, c, g, or t
  misc_feature (2563)..(2566): n is a, c, g, or t
  misc_feature (2568)..(2568): n is a, c, g, or t
  misc_feature (2571)..(2572): n is a, c, g, or t
  misc_feature (2575)..(2575): n is a, c, g, or t
  misc_feature (2579)..(2580): n is a, c, g, or t
  misc_feature (2582)..(2583): n is a, c, g, or t
  misc_feature (2587)..(2590): n is a, c, g, or t
  misc_feature (2592)..(2594): n is a, c, g, or t
  misc_feature (2598)..(2598): n is a, c, g, or t
  misc_feature (2606)..(2607): n is a, c, g, or t
  misc_feature (2609)..(2609): n is a, c, g, or t
  misc_feature (2616)..(2617): n is a, c, g, or t
  misc_feature (2619)..(2620): n is a, c, g, or t
  misc_feature (2629)..(2630): n is a, c, g, or t
  misc_feature (2632)..(2633): n is a, c, g, or t
  misc_feature (2635)..(2635): n is a, c, g, or t
  misc_feature (2637)..(2637): n is a, c, g, or t
  misc_feature (2641)..(2641): n is a, c, g, or t
  misc_feature (2646)..(2647): n is a, c, g, or t
  misc_feature (2649)..(2650): n is a, c, g, or t
  misc_feature (2653)..(2653): n is a, c, g, or t
  misc_feature (2657)..(2657): n is a, c, g, or t
  misc_feature (2659)..(2661): n is a, c, g, or t
  misc_feature (2663)..(2664): n is a, c, g, or t
  misc_feature (2672)..(2672): n is a, c, g, or t
  misc_feature (2674)..(2676): n is a, c, g, or t
  misc_feature (2678)..(2678): n is a, c, g, or t
  misc_feature (2685)..(2687): n is a, c, g, or t
  misc_feature (2692)..(2694): n is a, c, g, or t
  misc_feature (2698)..(2701): n is a, c, g, or t
  misc_feature (2704)..(2704): n is a, c, g, or t
  misc_feature (2706)..(2707): n is a, c, g, or t
  misc_feature (2710)..(2711): n is a, c, g, or t
  misc_feature (2713)..(2714): n is a, c, g, or t
  misc_feature (2721)..(2722): n is a, c, g, or t
  misc_feature (2724)..(2724): n is a, c, g, or t
  misc_feature (2726)..(2727): n is a, c, g, or t
  misc_feature (2729)..(2731): n is a, c, g, or t
  misc_feature (2734)..(2738): n is a, c, g, or t
  misc_feature (2745)..(2747): n is a, c, g, or t
  misc_feature (2751)..(2756): n is a, c, g, or t
  misc_feature (2763)..(2763): n is a, c, g, or t
  misc_feature (2765)..(2766): n is a, c, g, or t
  misc_feature (2771)..(2773): n is a, c, g, or t
  misc_feature (2777)..(2778): n is a, c, g, or t
  misc_feature (2780)..(2780): n is a, c, g, or t
  misc_feature (2782)..(2785): n is a, c, g, or t
  misc_feature (2787)..(2787): n is a, c, g, or t
  misc_feature (2789)..(2789): n is a, c, g, or t
  misc_feature (2791)..(2796): n is a, c, g, or t
  misc_feature (2798)..(2798): n is a, c, g, or t
  misc_feature (2800)..(2800): n is a, c, g, or t
  misc_feature (2802)..(2802): n is a, c, g, or t
  misc_feature (2808)..(2808): n is a, c, g, or t
  misc_feature (2813)..(2813): n is a, c, g, or t
  misc_feature (2815)..(2815): n is a, c, g, or t
  misc_feature (2817)..(2821): n is a, c, g, or t
  misc_feature (2825)..(2828): n is a, c, g, or t
  misc_feature (2830)..(2830): n is a, c, g, or t
  misc_feature (2832)..(2833): n is a, c, g, or t
  misc_feature (2835)..(2843): n is a, c, g, or t
  misc_feature (2845)..(2845): n is a, c, g, or t
  misc_feature (2847)..(2850): n is a, c, g, or t
  misc_feature (2852)..(2852): n is a, c, g, or t
  misc_feature (2854)..(2854): n is a, c, g, or t
  misc_feature (2856)..(2857): n is a, c, g, or t
  misc_feature (2859)..(2862): n is a, c, g, or t
  misc_feature (2866)..(2866): n is a, c, g, or t
  misc_feature (2868)..(2870): n is a, c, g, or t
  misc_feature (2872)..(2875): n is a, c, g, or t
  misc_feature (2877)..(2879): n is a, c, g, or t
  misc_feature (2883)..(2883): n is a, c, g, or t
  misc_feature (2885)..(2885): n is a, c, g, or t
  misc_feature (2888)..(2892): n is a, c, g, or t
  misc_feature (2894)..(2896): n is a, c, g, or t
  misc_feature (2899)..(2901): n is a, c, g, or t
  misc_feature (2903)..(2903): n is a, c, g, or t
  misc_feature (2905)..(2908): n is a, c, g, or t
  misc_feature (2910)..(2914): n is a, c, g, or t
  misc_feature (2916)..(2918): n is a, c, g, or t
  misc_feature (2920)..(2931): n is a, c, g, or t
  misc_feature (2933)..(2933): n is a, c, g, or t
  misc_feature (2935)..(2937): n is a, c, g, or t
  misc_feature (2939)..(2939): n is a, c, g, or t
  misc_feature (2941)..(2946): n is a, c, g, or t
  misc_feature (2948)..(2952): n is a, c, g, or t
  misc_feature (2954)..(2957): n is a, c, g, or t
  misc_feature (2961)..(2963): n is a, c, g, or t
  misc_feature (2965)..(2966): n is a, c, g, or t
  misc_feature (2968)..(2978): n is a, c, g, or t
  misc_feature (2980)..(2980): n is a, c, g, or t
  misc_feature (2982)..(2982): n is a, c, g, or t
  misc_feature (2984)..(2990): n is a, c, g, or t
  misc_feature (2994)..(3001): n is a, c, g, or t
  misc_feature (3003)..(3005): n is a, c, g, or t
  misc_feature (3007)..(3011): n is a, c, g, or t
  misc_feature (3013)..(3018): n is a, c, g, or t
  misc_feature (3021)..(3022): n is a, c, g, or t
  misc_feature (3026)..(3031): n is a, c, g, or t
  misc_feature (3034)..(3034): n is a, c, g, or t
  misc_feature (3039)..(3040): n is a, c, g, or t
  misc_feature (3042)..(3043): n is a, c, g, or t
  misc_feature (3045)..(3046): n is a, c, g, or t
  misc_feature (3048)..(3050): n is a, c, g, or t
  misc_feature (3052)..(3057): n is a, c, g, or t
  misc_feature (3060)..(3060): n is a, c, g, or t
  misc_feature (3062)..(3067): n is a, c, g, or t
  misc_feature (3069)..(3069): n is a, c, g, or t
  misc_feature (3071)..(3071): n is a, c, g, or t
  misc_feature (3073)..(3074): n is a, c, g, or t
  misc_feature (3077)..(3077): n is a, c, g, or t
  misc_feature (3079)..(3081): n is a, c, g, or t
  misc_feature (3083)..(3083): n is a, c, g, or t
  misc_feature (3085)..(3087): n is a, c, g, or t
  misc_feature (3089)..(3090): n is a, c, g, or t
  misc_feature (3092)..(3092): n is a, c, g, or t
  misc_feature (3094)..(3094): n is a, c, g, or t
  misc_feature (3097)..(3102): n is a, c, g, or t
  misc_feature (3104)..(3104): n is a, c, g, or t
  misc_feature (3106)..(3110): n is a, c, g, or t
  misc_feature (3112)..(3113): n is a, c, g, or t
  misc_feature (3116)..(3118): n is a, c, g, or t
  misc_feature (3121)..(3135): n is a, c, g, or t
  misc_feature (3137)..(3137): n is a, c, g, or t
  misc_feature (3141)..(3142): n is a, c, g, or t
  misc_feature (3144)..(3145): n is a, c, g, or t
  misc_feature (3147)..(3149): n is a, c, g, or t
  misc_feature (3151)..(3151): n is a, c, g, or t
  misc_feature (3153)..(3154): n is a, c, g, or t
  misc_feature (3159)..(3159): n is a, c, g, or t
  misc_feature (3161)..(3161): n is a, c, g, or t
  misc_feature (3163)..(3163): n is a, c, g, or t
  misc_feature (3165)..(3165): n is a, c, g, or t
  misc_feature (3171)..(3172): n is a, c, g, or t
  misc_feature (3174)..(3175): n is a, c, g, or t
  misc_feature (3177)..(3177): n is a, c, g, or t
  misc_feature (3183)..(3183): n is a, c, g, or t
  misc_feature (3188)..(3188): n is a, c, g, or t
  misc_feature (3190)..(3190): n is a, c, g, or t
  misc_feature (3192)..(3194): n is a, c, g, or t
  misc_feature (3199)..(3200): n is a, c, g, or t
  misc_feature (3203)..(3204): n is a, c, g, or t
  misc_feature (3206)..(3208): n is a, c, g, or t
  misc_feature (3210)..(3211): n is a, c, g, or t
  misc_feature (3213)..(3213): n is a, c, g, or t
  misc_feature (3222)..(3222): n is a, c, g, or t
  misc_feature (3227)..(3227): n is a, c, g, or t
  misc_feature (3230)..(3230): n is a, c, g, or t
  misc_feature (3235)..(3236): n is a, c, g, or t
  misc_feature (3239)..(3240): n is a, c, g, or t
  misc_feature (3245)..(3245): n is a, c, g, or t
  misc_feature (3247)..(3247): n is a, c, g, or t
  misc_feature (3250)..(3251): n is a, c, g, or t
  misc_feature (3256)..(3256): n is a, c, g, or t
  misc_feature (3260)..(3260): n is a, c, g, or t
  misc_feature (3262)..(3262): n is a, c, g, or t
  misc_feature (3265)..(3266): n is a, c, g, or t
  misc_feature (3271)..(3271): n is a, c, g, or t
  misc_feature (3273)..(3273): n is a, c, g, or t
  misc_feature (3275)..(3276): n is a, c, g, or t
  misc_feature (3278)..(3280): n is a, c, g, or t
  misc_feature (3282)..(3284): n is a, c, g, or t
  misc_feature (3293)..(3293): n is a, c, g, or t
  misc_feature (3298)..(3298): n is a, c, g, or t
  misc_feature (3300)..(3300): n is a, c, g, or t
  misc_feature (3302)..(3302): n is a, c, g, or t
  misc_feature (3306)..(3306): n is a, c, g, or t
  misc_feature (3315)..(3318): n is a, c, g, or t
  misc_feature (3320)..(3320): n is a, c, g, or t
  misc_feature (3325)..(3325): n is a, c, g, or t
  misc_feature (3327)..(3327): n is a, c, g, or t
  misc_feature (3329)..(3329): n is a, c, g, or t
  misc_feature (3334)..(3335): n is a, c, g, or t
  misc_feature (3337)..(3337): n is a, c, g, or t
  misc_feature (3339)..(3340): n is a, c, g, or t
  misc_feature (3342)..(3343): n is a, c, g, or t
  misc_feature (3345)..(3348): n is a, c, g, or t
  misc_feature (3351)..(3351): n is a, c, g, or t
  misc_feature (3353)..(3354): n is a, c, g, or t
  misc_feature (3356)..(3357): n is a, c, g, or t
  misc_feature (3360)..(3362): n is a, c, g, or t
  misc_feature (3364)..(3368): n is a, c, g, or t
  misc_feature (3370)..(3371): n is a, c, g, or t
  misc_feature (3373)..(3376): n is a, c, g, or t
  misc_feature (3378)..(3378): n is a, c, g, or t
  misc_feature (3380)..(3380): n is a, c, g, or t
  misc_feature (3385)..(3387): n is a, c, g, or t
  misc_feature (3394)..(3394): n is a, c, g, or t
  misc_feature (3396)..(3396): n is a, c, g, or t
  misc_feature (3398)..(3398): n is a, c, g, or t
  misc_feature (3400)..(3402): n is a, c, g, or t
  misc_feature (3404)..(3406): n is a, c, g, or t
  misc_feature (3408)..(3409): n is a, c, g, or t
  misc_feature (3411)..(3411): n is a, c, g, or t
  misc_feature (3413)..(3415): n is a, c, g, or t
  misc_feature (3417)..(3420): n is a, c, g, or t
  misc_feature (3423)..(3423): n is a, c, g, or t
  misc_feature (3427)..(3427): n is a, c, g, or t
  misc_feature (3431)..(3431): n is a, c, g, or t
  misc_feature (3433)..(3439): n is a, c, g, or t
  misc_feature (3441)..(3441): n is a, c, g, or t
  misc_feature (3445)..(3446): n is a, c, g, or t
  misc_feature (3448)..(3449): n is a, c, g, or t
  misc_feature (3458)..(3459): n is a, c, g, or t
  misc_feature (3461)..(3463): n is a, c, g, or t
  misc_feature (3465)..(3467): n is a, c, g, or t
  misc_feature (3469)..(3471): n is a, c, g, or t
  misc_feature (3474)..(3474): n is a, c, g, or t
  misc_feature (3476)..(3478): n is a, c, g, or t
  misc_feature (3480)..(3481): n is a, c, g, or t
  misc_feature (3483)..(3483): n is a, c, g, or t
  misc_feature (3486)..(3486): n is a, c, g, or t
  misc_feature (3488)..(3490): n is a, c, g, or t
  misc_feature (3492)..(3494): n is a, c, g, or t
  misc_feature (3500)..(3500): n is a, c, g, or t
  misc_feature (3503)..(3504): n is a, c, g, or t
  misc_feature (3510)..(3511): n is a, c, g, or t
  misc_feature (3513)..(3513): n is a, c, g, or t
  misc_feature (3515)..(3515): n is a, c, g, or t
  misc_feature (3519)..(3519): n is a, c, g, or t
  misc_feature (3522)..(3528): n is a, c, g, or t
  misc_feature (3537)..(3537): n is a, c, g, or t
  misc_feature (3540)..(3542): n is a, c, g, or t
  misc_feature (3544)..(3544): n is a, c, g, or t
  misc_feature (3549)..(3549): n is a, c, g, or t
  misc_feature (3562)..(3562): n is a, c, g, or t
  misc_feature (3564)..(3565): n is a, c, g, or t
  misc_feature (3567)..(3568): n is a, c, g, or t
  misc_feature (3570)..(3572): n is a, c, g, or t
  misc_feature (3574)..(3576): n is a, c, g, or t
  misc_feature (3580)..(3580): n is a, c, g, or t
  misc_feature (3582)..(3585): n is a, c, g, or t
  misc_feature (3587)..(3590): n is a, c, g, or t
  misc_feature (3592)..(3592): n is a, c, g, or t
  misc_feature (3594)..(3595): n is a, c, g, or t
  misc_feature (3597)..(3597): n is a, c, g, or t
  misc_feature (3605)..(3605): n is a, c, g, or t
  misc_feature (3608)..(3610): n is a, c, g, or t
  misc_feature (3614)..(3617): n is a, c, g, or t
  misc_feature (3625)..(3626): n is a, c, g, or t
  misc_feature (3629)..(3631): n is a, c, g, or t
  misc_feature (3635)..(3637): n is a, c, g, or t
  misc_feature (3646)..(3647): n is a, c, g, or t
  misc_feature (3652)..(3654): n is a, c, g, or t
  misc_feature (3658)..(3659): n is a, c, g, or t
  misc_feature (3661)..(3662): n is a, c, g, or t
  misc_feature (3664)..(3666): n is a, c, g, or t
  misc_feature (3671)..(3671): n is a, c, g, or t
  misc_feature (3674)..(3674): n is a, c, g, or t
  misc_feature (3678)..(3682): n is a, c, g, or t
  misc_feature (3684)..(3686): n is a, c, g, or t
  misc_feature (3690)..(3691): n is a, c, g, or t
  misc_feature (3693)..(3696): n is a, c, g, or t
  misc_feature (3698)..(3700): n is a, c, g, or t
  misc_feature (3703)..(3704): n is a, c, g, or t
  misc_feature (3706)..(3706): n is a, c, g, or t
  misc_feature (3708)..(3708): n is a, c, g, or t
  misc_feature (3710)..(3711): n is a, c, g, or t
  misc_feature (3713)..(3713): n is a, c, g, or t
  misc_feature (3715)..(3715): n is a, c, g, or t
  misc_feature (3717)..(3718): n is a, c, g, or t
  misc_feature (3723)..(3723): n is a, c, g, or t
  misc_feature (3725)..(3726): n is a, c, g, or t
  misc_feature (3728)..(3728): n is a, c, g, or t
  misc_feature (3732)..(3736): n is a, c, g, or t
  misc_feature (3740)..(3741): n is a, c, g, or t
  misc_feature (3743)..(3743): n is a, c, g, or t
  misc_feature (3746)..(3746): n is a, c, g, or t
  misc_feature (3749)..(3755): n is a, c, g, or t
  misc_feature (3760)..(3761): n is a, c, g, or t
  misc_feature (3763)..(3764): n is a, c, g, or t
  misc_feature (3768)..(3769): n is a, c, g, or t
  misc_feature (3773)..(3773): n is a, c, g, or t
  misc_feature (3775)..(3776): n is a, c, g, or t
  misc_feature (3781)..(3781): n is a, c, g, or t
  misc_feature (3787)..(3788): n is a, c, g, or t
  misc_feature (3790)..(3795): n is a, c, g, or t
  misc_feature (3797)..(3797): n is a, c, g, or t
  misc_feature (3799)..(3800): n is a, c, g, or t
  misc_feature (3802)..(3805): n is a, c, g, or t
  misc_feature (3807)..(3807): n is a, c, g, or t
  misc_feature (3809)..(3809): n is a, c, g, or t
  misc_feature (3817)..(3818): n is a, c, g, or t
  misc_feature (3827)..(3827): n is a, c, g, or t
  misc_feature (3837)..(3837): n is a, c, g, or t
  misc_feature (3839)..(3840): n is a, c, g, or t
  misc_feature (3844)..(3844): n is a, c, g, or t
  misc_feature (3846)..(3847): n is a, c, g, or t
  misc_feature (3851)..(3851): n is a, c, g, or t
  misc_feature (3854)..(3854): n is a, c, g, or t
  misc_feature (3860)..(3860): n is a, c, g, or t
  misc_feature (3862)..(3863): n is a, c, g, or t
  misc_feature (3865)..(3868): n is a, c, g, or t
  misc_feature (3870)..(3871): n is a, c, g, or t
  misc_feature (3873)..(3873): n is a, c, g, or t
  misc_feature (3875)..(3875): n is a, c, g, or t
  misc_feature (3882)..(3883): n is a, c, g, or t
  misc_feature (3885)..(3889): n is a, c, g, or t
  misc_feature (3891)..(3891): n is a, c, g, or t
  misc_feature (3896)..(3898): n is a, c, g, or t
  misc_feature (3900)..(3900): n is a, c, g, or t
  misc_feature (3902)..(3902): n is a, c, g, or t
  misc_feature (3904)..(3904): n is a, c, g, or t
  misc_feature (3906)..(3907): n is a, c, g, or t
  misc_feature (3909)..(3909): n is a, c, g, or t
  misc_feature (3914)..(3915): n is a, c, g, or t
  misc_feature (3918)..(3919): n is a, c, g, or t
  misc_feature (3921)..(3921): n is a, c, g, or t
  misc_feature (3923)..(3924): n is a, c, g, or t
  misc_feature (3926)..(3927): n is a, c, g, or t
  misc_feature (3932)..(3932): n is a, c, g, or t
  misc_feature (3934)..(3937): n is a, c, g, or t
  misc_feature (3940)..(3944): n is a, c, g, or t
  misc_feature (3946)..(3946): n is a, c, g, or t
  misc_feature (3948)..(3948): n is a, c, g, or t
  misc_feature (3950)..(3951): n is a, c, g, or t
  misc_feature (3955)..(3955): n is a, c, g, or t
  misc_feature (3962)..(3964): n is a, c, g, or t
  misc_feature (3966)..(3968): n is a, c, g, or t
  misc_feature (3976)..(3976): n is a, c, g, or t
  misc_feature (3978)..(3978): n is a, c, g, or t
  misc_feature (3980)..(3981): n is a, c, g, or t
  misc_feature (3983)..(3984): n is a, c, g, or t
  misc_feature (3991)..(3993): n is a, c, g, or t
agaatttttaaaatttgattttttcaattgctttttaatttgttcgagatcttctttttttgaattataatcaattataactatatcaaattctattttaggaaaagttattttagcttgatttaaagatgcaattatggaatttaaagatctaaaagtatattcagatttattttgatcaaataatctttttttattttgagtcaacatattaatatttgtacaagatctaaaaattattgttaaagcgttaactttacgtgaaatttttatttcacctaatggcagagtaattgatttttttcctggaatattaagattttcactaagattcttttcttgagtagggacgtaaaaattactttggtctattatttcgtagccaaaaattctgcaaatttttataaatattttcttaaaaaaacttgtttttacttgggttttttgttctttcataggttcttattcaagtgatttaatcatgaagacttattctttttgcataaaagactcttattatccagtacagaacaaagcctaatggtcctgtaaaatataccaagattagcggagcgaatattagactacgcctcatattgtatttaattccatctctagatatccacgatcctaaaaaaagatttaaagctacaaaatgtaaccaaaaaataagtaaaaaactttcagtggcaaataccgcatataggctatctaagcctaaatataatctaaaaacatcaaatattggttcgtccaacaaaatagtttgataaattacgtaaacataggctgtagacaaaataagaggcaagattattgaattgacaaaaaattgagtaactttagaatttggaataataatcaacataatccaaaatggtaaaataccaaagcttgtccacacatatatattttcaaatgttaaatacgcttgaaattggattagcatataatttttaataagcaatatagtatataaaaaacatgaatcctataaaaaataagaaagatctggaaacaacaattgatgatataagaaattttgcctatttgtatttagaaaaatacagttcatcaaaacaacaattaaggacatatttattcaaaaaacttattaaaaaaaaacaaaaaatatctagcaaaaaggaaattttcaatttaatagatactgtaattttctcactagtcgatcaaaaatttttaagtgatgagtattattcagatgcgaaatccaaagcattcttgagaagaggttattcgttaaataaaattagatataatttaattaaaaggggaattgatgaaaagtatattaaggctagcatttctaagattaaagaaaatgagtcggatcctgattttttttctgcaataaaaatatgtaaaagaaggagaataggaccctgtagagaagaaagtaatagaccattattttataaaaaagatatttcaattctggcaagatctggttttagctacgaaatatcgaaaaaagttttagaaatacccataaaagaatttaaaaaattctgtacgatgctctnaattgtaactattttttattatttttagataaataataatctaatcttttttttagtgatttttttacatagaggaaaaataatacaccaaatatagtaaccaatatcactatggtaagtgttgtttttaacattcttaatatgaaatagtctaactcttatgttatgaactgcctagtagacttttattctggttaatatattggaaccattcttttcggctcatccttttgcaataatagtcacgcttcttgcaacctgtattgatttttattttgggtaacaatgattttgcaagagcaggattatcattgagctttcttttgcaataaaaatcatactttctacatctttcactaagtttatttttaggctcgtaagtttgttccaatattttgccaggttcatttttgggcgcataagattgttttatgatgtctccnntaagcgatnctattgngtgttctgctattgtttttccagtactttttttcaccacgtaattagctccagtagtaacacctgtctgtattaatgacgctgtactgaaacctgatgatataggtcctattaaggctaggggtgccataaaacacccagagacnnncacaccaagcactgctattacaaacaatcttttaatcatcgactcccttttntttataagcttatagtttttataaataaaaaaaaagatgnaaattaactaattnntanacaactnaaantngtantnatttttntaaanncaaannncttttnncnnttattgntngatttttntanttttcntttcnnnanagnanttttttttnntcatntgtngtnntntntcntccnncannttntaaaatnnnnnntcnnncagcnntatcccntncccannnnctnnnttttnnngcanaaanatngnctncnccnnctgcnaaaananaaaantttaaanagnnnnanattttannnatttntgnnantttntattttttntaaanatntntantttnntttgnngtnntncnnnngngtnntancccnntnntttnnnngnnntttntttttttnnantttaaanntnntttttttcnntnntnantttnaaaannannacntttncnnnannaaaaaaanannntnttttttnnnggggnnnaaannnnacnannagnngnntttaaannantnntnnnagnnnnntttaaannntatnnnnnncttttcntnntatannntctnntncnnnntntngnnnnnntnancnaaaaanttttntntnnnnntttnnnntntnnannnnnnnnntntnnnnananannannnntatntnnngnnnnannntttntnttnnnnntnnnaannntntnnnnannnnnannncnnnnnnnnnnnngngnnntntnnnnnntnnnnntnnnntttnnncnncnnnnnnnnnnntntntnnnnnnntttnnnnnnnntnnnannnnntnnnnnnganntttnnnnnnatnttttnnanntnnannntnnnnnnttntnnnnnntntntnnaanannntntnnncnntntntannnnnntntnnnnnannttnnnaannnnnnnnnnnnnnntntttnntnncnnntngnntttgncngntnccccanntnntntttttngggtnantnnnaaaanntcnngnnncnnantttaaaaanatttntgnaaaannatnnttttntntannaaaanaaananatnnttttntnannannntnnnaaaaaaaanaaatncntngggntttttaaannnncnaaaanananaaaanngntnntnncnnnntcngnngnngtnnntnnnnntnnannnncngntttannnaaaaaanangntnnnannntnntngnnntnnnnctnaaantttntnnnnnnncnaaanntnnaaaaaaaannannnannntnnngcngnnnannanatntnnnannnaaaaanagnntcccgnnantnaaanatnnnnnnnaaaattttntannntnaaaanagatttaaaaaananntnntnnntnnntttntnnnnannnncntnntnggggaaanacnnntacnnnntgtgaaanntannnaaannntaaaatttnnagacnnntatnntnntnnncgggngtnaaannnnnannntttnntnnnngnnnatnntntnannanantnnaaaananngnaaannnnnaganntntanagnnnnnnntttannannagannaaantnnttttntttttnnannnnnncngnngnnnntnanttttttannatttccctngggggttttnannaaanannaaanacncaaaananntnnnnanntnantttaaanntnnnnnanaaacnnnanancnannanatatnnttnntncnnanngggantnnnnctnnnnnantnannaaanataaacnnnannnttttaaanangnngnnattttgnnnacaaaag

SEQ ID NO: 182 - DNA, 4000 bp, Escherichia coli
  misc_feature (3986)..(3986): n is a, c, g, or t
cggccagtgaggttacccgggtcatgcaaatctgtaacgcctgtcgttattgcgaggggttttgtgccgtgtttccggcgatgacccgtcgtcgttcatttgacgagggtgatgtcggctatcttgccaatctttgccataattgtggcgcctgttatcatgcgtgccaatatgcaccgccgcatgaatttggcgtgaatgtgccgcaggcgctggcggcggcgcggaacgacagctatgccgcctatgcttggcccgcgccaatggccggattgttcaggcgtaacgggctgtttgttacatcggtaatttcgcttggtttggcaatcaccgttggggtgatgctggcgatgattgcgccgcagctattttggggtgtgcatgtcggtgagggcgcattttacaagatcatgccgcatacagtcatggcaggtattccgctggcgatttcagcttttgtgctgatgtcgtttattatgggctggcggcgttactggcgccatacaggcgcgaaatggggcggctttgtcgatctgtttgacgccatcaaggctgcggcgagtttgcgccatcttggcggcgactcgtccagcggcgtgttatcggggccgggctgcccgaccggtgatgaccggtcaagcaatgcgcggcgcatctatcatcaattgacgatgtacggttttttgctgtgttttgccgcaacctcggttggcacaatctatcattacgtgcttggccgtgaggccccctacggctatctggaattgccggtggtacttggcacagttggcggcattatcttgtgtatcggaacggctggcctttttgtcgaaaagcggcgaatgcatccttcggttcgccatgatgaagggcttggcatggattacgcttttatcgtgtcgctgtttttcgtcagctttaccggattgctgctgcttgcagtccgcgagaccagctatatgggcgtgactttggcggtgcatctaggcgttgtttacgggtttttcctgatcctgccattttcaaaatttgtgcatgggctgtatcggtttgcggcgctgatcgccagtgcaggtgaggcgcgtcgcggttaggccaattgcattgccacgaatatcgcgatcgcaaatgccgaattgaccttggggttaatagccaaatgtctgcgagatgattttggccgactcggccagcaaaccgcgccgtgccatcgcttcgtcaaaatcaaagcgctgttttggcccatgaatcgcaagcgcagcgacataacgccggcgcgagtccagcactggcacggcaatcgcaaccatgccatcatggaattcctccaaatcaagcgcaaagccatctttgctgatccgttgcagctcgtcctccagcgtttcggtgctggtatgggtgtgttctgtataggcgcgcaggtccaagctatctagcaaaacgcgccgtttttttggcggcagactggcaagataggttttaccgcttgctgtgcagtgaaacggcacatgcgttccaactggcagcagaacccgaaaaggccaattcgtctcgacgcgatcagcatagatcatccccttgatttctggcctgacgaaattcaccgtttcaccagcctcgcgcgcaatattctgcaaaatctggtggcgcgtggtctgaccggtggcgtgctgggccaaccccgcagcaagagacaaaaggcgtttggtcgggtgaaggcggcgcgcctgtttgaccagatacccttcggcaatcaaggtctggcaaagtcggtgtagactttgtttgggccagtcgagctgttcattgatctcgctcggtgtcagagggcgtccggcatctgcaatcacttcaaatatcttcaaaatccgcaaatttggtggagttgagtcggtcattatggtgccttttttcacgcgcaattcccgcacgaaacaaaaagtgacggcaaaaattccttgaacaagccgtggattcgtgcatgactttattcttaattcaataatagagactaaaagtctcaaaaagtaaataattttttgggggaatggttggagtttgattacgtcatcattggggccgggtcggctggttgtgtgattgccaaccgtctgtccgctgatccgtctgtttccgtggcgcttgtcgaggcgggcggcaaggatagctatccgtggattcacattccggttggttacttcaaaaccatgggtaatccaaaaactgactggtgctatcgtacccagcctgaccccgggttgaacgggcgggcgatcaattggccgcgcggcaaggtgcttggcggtagcagctcgatcaacggacttttatatgttcgtgggcaaccgcaggattatgatcattggcgccagcttggcaatgcgggttggagttggaatgatgtgctgccgttgttccggcgagccgaaaattgggaaggcacgccgtcgcctgaacgcggtgttgatggcccgttaaatgtatctgaaaataaggtcgatcgggacattatcgacgcgtgggttgaggcggcggcaaatgccggttaccggcgcacggacgactataaccgtgaagatcaagagggcgttggcttttttcagatgacgatgaaaaatggtcagcgttgcagtacggccgcggcctatctgaagccggttctagcgcgcaagaatttgcatatcttcacccatacgcatactgaccggatcgagtttgaggacaagcgcgccaaggcggcgttggttcggatcaaaggaaagagccagcggatcagcgcgcgccgtgagatcattttgtcggcaggtgcgatcggatcgccgcaaattctgatgctgtccggcattggcgatcagcatgatcttggcaagcatggtatcgccgcaacgcatcatttaccgggggttgggcgtaatctgcaagaccatctgcaagcccgcccagtttttaaatgcaacgccagcacgatcaatacggaaaccaaaaacccgttacagcttataaaaattgcacttgaatatgcggtgaaccgatctggcccaatggcaatggcggccagccttggcacagcgtttttaaaaacccatccggcgttagaaacccctgatatccagtttcacctacagccgttcagcgccgataatatcgccgatggcagccataatttttcggcctttaccgcctcggttttgcaattgcggccagaaagcacagggcacatcgaactcatgtcatcaaagcccgaggattatccggcgatccatccgaattatctggcaaccaaaaccgattgcgacacgattgttgccggcatcaagattgcccgcgcggtttgccgcaccgatccggccaaatcgctgatcaccgaagaatatgcgccggggccagcggtcgcagataacgatgatgcggcgatccttgaatgggcgcgcaacacgtcgacaacgatctatcatccaactggaacctgtaaaatgggccaggataaaatggcggttgttgatgaaaagctgcgggtttatggcgttcgcggattgcgcgttgcagatgcgtcgatcatgccaaccatcacctcgggtaatacaaatgcgccgaccattatgattggtgaaaaactctcagatttgatcttggagggggcgagatgaatatcagcgggcttgattttacccaatatggtatcgccgaagtaaccgatattgcgcagatcattttcgccgacatcatcttgtcgggcgataatgcgctggtgatcggtatggcggcggcggggttggccgccggacaacgcaaacgtgcgattgcgattggcatggcagtggcggcgatattgcgcattgtgtttgctgttgttgccgcacaattgctggcaatcaagggcattctcttgatcggtggcgggttgcttgcgtgggtctgttaccggttttatcacgacttgaaagaattcaacagcaccgccgcaaacggggcggacggggccgcgncgggggaggctgga

SEQ ID NO: 183 - DNA, 4000 bp, Escherichia coli
  misc_feature (490)..(490): n is a, c, g, or t
  misc_feature (514)..(514): n is a, c, g, or t
  misc_feature (613)..(613): n is a, c, g, or t
  misc_feature (907)..(907): n is a, c, g, or t
  misc_feature (1137)..(1137): n is a, c, g, or t
  misc_feature (1204)..(1204): n is a, c, g, or t
  misc_feature (1336)..(1336): n is a, c, g, or t
  misc_feature (1975)..(1975): n is a, c, g, or t
  misc_feature (1985)..(1986): n is a, c, g, or t
  misc_feature (1991)..(1992): n is a, c, g, or t
  misc_feature (1994)..(1994): n is a, c, g, or t
  misc_feature (2001)..(2001): n is a, c, g, or t
  misc_feature (2003)..(2004): n is a, c, g, or t
  misc_feature (2006)..(2007): n is a, c, g, or t
  misc_feature (2009)..(2010): n is a, c, g, or t
  misc_feature (2030)..(2031): n is a, c, g, or t
  misc_feature (2036)..(2037): n is a, c, g, or t
  misc_feature (2045)..(2046): n is a, c, g, or t
  misc_feature (2048)..(2049): n is a, c, g, or t
  misc_feature (2057)..(2058): n is a, c, g, or t
  misc_feature (2149)..(2149): n is a, c, g, or t
  misc_feature (2238)..(2238): n is a, c, g, or t
  misc_feature (2242)..(2242): n is a, c, g, or t
  misc_feature (2260)..(2260): n is a, c, g, or t
  misc_feature (2269)..(2269): n is a, c, g, or t
  misc_feature (2291)..(2291): n is a, c, g, or t
  misc_feature (2329)..(2329): n is a, c, g, or t
  misc_feature (2365)..(2365): n is a, c, g, or t
  misc_feature (2371)..(2371): n is a, c, g, or t
  misc_feature (2389)..(2389): n is a, c, g, or t
  misc_feature (2395)..(2395): n is a, c, g, or t
  misc_feature (2422)..(2422): n is a, c, g, or t
  misc_feature (2498)..(2498): n is a, c, g, or t
  misc_feature (2594)..(2594): n is a, c, g, or t
  misc_feature (3775)..(3775): n is a, c, g, or t
  misc_feature (3922)..(3922): n is a, c, g, or t
ttgtactgtgttttttatttttacaacttgaaattttccttgaatatagcaagccttccaaaaataatgtagttctgaaaatgctttgcgcctgattccgtatgactgataatgaattaagaaacctaaataagagtttatagacctcacattggcatatatagcttccttgtcacagtttttacatgcttcttctaaataacttacagcattaataaagtttccaacagttcgattcgataagtaagctctacccggcttaattactcctcctaccatttttattccttttttaacttcttgaatatagattttattagggtgcatttgaatatttaaaatatatcgtagttgattcctagaagctcttttgaaataaattgcatcttccttagttttgcacacaaagctaaaatcatctacaaaacgtacatatttggctcctctttcttctgctgctttaatagcccattcatcaaaaaatgacatntaaaaattggcaaataattgactngttaggtttcctattggttcgcctttcatccattcattgtaaaacaggcttttgtttttaggcagtattctccataattttaaatttccttgacgtatncaatcatcttgtggtcgatgtcgtacaattatttctgtaagccatagcactaaatctaaatcttgttcatatatggtccctttccaataattccatttttctttgataaatggtaataagtgttctaataatcgttcgcaatcaattgacataaaaaatcctttaatatcaaattgagcataccaagcctcgtgcgaataattatcagagacttcaattgtattttttgtcaactgatcaatacatgcaaatgttccaaaaccctttcgacagttaaatgatacatttccgtgntcaacaaaacgtgcctcaaacagtggctctaagcgtaggcacaaccaatgttgtacaatacggtcacggaaatttgcagcaaacacttcccgtaatttaggacgggtaactataaaacaagtacttgttgttggtctatatgttcgttcataaacttctctcgctaaatctaatagatcttcatgccaaataagtctatacataacacattgtgaacttgtctttttttnggcacagcaatcatctaacgcatcaaaccatccctcaacatatttatcgttaagtgctgcaaccgcnctcaccatgttactgttgtacttgttgttgttgttgaagttgccattactaaagttcacgttccagctgttgttctgactgttctcactgctactccagtaccggcttgcggttattgcgtgtactatcttnttcttaactaggtctttaacgcttggtaaaggcccagtgacacgcccatttttcaataaagatgtccctgttatcatagtcgtaaccgttcaacaggtctgctgctccaacactttgcttctccagcttttaatatgctttgaaatttcctttaaagattcagcaaaatgtggcatttgcttgttgctaattatgcgtgtatgaggactccgatttgaccactcttttaaggtgtcaatgcaagttttcactgtacgcatttgcaaataaaatgaattaataagttcaagtttggaatcaggatcttcttcatttaaagccaatcctatcactgttaatccatcaagcagagtgtctatgagacgtttgcttaattgacgaattcctacactattaggggttcgttctaccatttctatacagagtaacattaaattttctgtttctctgtaaataggtgcacttcctgcattacgaattgttcttgccataattaaaagattttattcacaatgtgtcttattacatatagtttatttacgaatactttattttttctgtagaggtttacaattatggcatatttatttttgtggagcgtcaaaagacgctccactatactaaaatgctgcaaccgcnctcaccatgnnactgnngnacttgcngnngnngnngaagttgccattactaaagnncacgnnccagctgnngnnctgactgnnctcactgctactccagtaccaagaattagaaaaatcgttcaaaataccggcatctattgctttttgaaaaattgcacctattttatcatcntcataattcactccttgcctagcgtgccaatacatacgcataagttcaccaacagatggtaggtaccaattatgatatttaaatttatntgcnaattcttcgcctgctttnactgtaggntgataagcatagcatttgctgncagcaggataataaaattgttgatatttactaagattntcattgttagcaattatgttatttatatactgggtnaacatngcttgttcagtatataantcagtngcttcaggtatcggcaaattaactccngaatcttctaagattttatttctatgttgaataatttttaaagtttttgctaaaccgacaggaacttcgtcacctnttttataggcacctgataaaatagctaaatccgcagccaattcctcttttcctgtattaattgtacctggagcagcgataccatctccaacagcanctgttttaacatctgaatttacaaatccgtcaattgtattttcatctacataattatcataccttatgtagttaggagaggtattaccttggtcgtcatattctgtaggttgtaagccagtctgtgtaatgttagcaattgaacctatatcatatacactataattaacatcatcttgtaattcaataggataaattgcatattgttcattccactcttccgtttgtcctgtattttgaggataaagcccccatactatacctgaattttcaagatttgataatgctaccatacgtctatcattggcatctgctggatttatgtaaaaacaaattccaactacggtttttccagcagttgtaggaccataagttccatcataaaatacataatctccgagatgagcacgtctggggtataaaccaatatcccatgatgcttcaagcacttcaccatttgtttttgttagataacatcttaaagttgtatgtggagccaatgtatcttcatctcctaattgagatacattgataacgcaataatcttttgacgtattgactatttttgcatacaaattggtatccaatgaccaacgaatgctaaccacatcattcccattagcggtattcggcttacagtaaaaagtgtgttcacctgtagaataaatgtattggcttcctttgatttctatagctgcaataggagttgagtagtaagtaatatgaagattgttgttctcatcatctacatttccccaatgatacaaccaatcaattttattgttaaaattaggtcggttggtagtattgtttattactgctatttttccagatacactactgtctgtaatagaagccaaatagttaatcatataaagagaaacctcggtccagtttatacttgctaactttaaataattcagcggtgcattgcctgtaaagcataaattaaatatggtacgcgaatctgcaatccctgcgccaattgataaactttgcattcggtcagctccttccaatgtgatggttttcaaattaggctgttgatctaaagacaaagatgttaaagtcccaggaagatgaacctcttctaaatattcggtagctggaagaacaacagaagacaacattgttcctactaaattcaacattctaagtttaagcaaaatagataaatctaanccacctactaaactagcgacacgttttaatactagttcttgcaacaaaggggcagtaatagtcataccggtaggacggaattcaacaacatcttttccatccacatgaaaggctgttaggcgagcaccgcttaaattaaatgtttcncctaaacttttgtctgtaaagtcaccaatggaacgcatataatcaataccatttaagaaaatattagtattgccatct

SEQ ID NO: 184 - DNA, 4000 bp, Escherichia coli
  misc_feature (37)..(37): n is a, c, g, or t
  misc_feature (522)..(522): n is a, c, g, or t
  misc_feature (528)..(528): n is a, c, g, or t
  misc_feature (791)..(791): n is a, c, g, or t
  misc_feature (1987)..(1987): n is a, c, g, or t
  misc_feature (1998)..(1998): n is a, c, g, or t
agggcttttaattttaacgcctctgtggattatgcanatttgcatcagatgaatttggtcaaggattctatagctctttttaaaggggatctggacattgacttgaaagggacggatatagacaatgtattgggtgtattggcctttaaaaatacccaatacaaaaatgctaaaaacacttatttttttgaagattttaatgttgctgcagacagcctagtagacggattcaggaccatttctatcaattcaaaagacattatatctggagctattcgtgggcgttataagttgctggaatttggaaagctcctccaaaatgccatgggaagtatttacaccaattacaaaccatttgaggtaaccaagggccaagaaatgacctttgaatttgatatttataatacactagtggagattttcctacccgaggtgcagtttggacccaatacttttattcgtggggcccttcaggccgatgccggtgtttttaaacttgattttaaatcccctcaattctcnttgtanaacaaccttttggatagtgtagttttaaaagtagacactaagaaccctttatttaatacctttttggcccttaaaagtgccaagaccccctattacgacattgaagaccttagactcattaacaacaccctacaagacaccctgtttttcagagcagaattcaagggagggaaggaccgttcagatctttttgggttaaacttttaccacacctttaacgacggtaagcaatctgtaataggattgaaaaagtctaccttggncttcaaaggcgctgattggtttattaatgaggcaggcaacaaggacaataaagtaatctttaataaaaatttagatagtgtttttgtctcttccttggtcatgagttctcctgagcgtgaaaatgttgttttaaatggtcaattggcagacagcacctataaggacataaggttgtctttctctaaagtagcccttagaaaaatttttccaagggtagacagccttgatttggatggaaaggtaaatggagaactcaacatactccaaaaagacaatgtatattttcctaattctaatttagatatagcagactttgaaattaataaaacggtcctaggtaatttagatcttgacttattgggcaatggggatctttcagattttattatcaatgctaaattattaagggataaagaagaaaaattacgcctgttggggaatattttcaaatcagatagcagtgattatcaaattaaattattagccagttttaacgcttttcctttagagccttttagtcccttggggaaaggtgttataggtaatataaggggagggctctggggaaatgcagaaattacaggacctatagttaatcctgattttacaggaacactcaccttgaaccaagccggaataagcgttccttatcttggtgttaattataatttttctcccaatgctaaaataggtctctataatcaagtatttgattttaaagatattacgctaattgatgatacgcataacacccaggctaaattatcaggcaccatagaccaccgatcttttgacgattggaaattagacctcactatagacgcctcttctgaacgcttcttaattttgaatacaccttacgacccagaagccctgtattatggcagtgggtttctaaatggcaatggacgcatttatggccccactaaagcattgaatattgatgtttctggcgctacagcactaggaacatcacttaagatacccttacaagatattgtgaatgttggggactatacttttatagattttgtagaaaagaggacattagatactgaagttactgtaaaagaactaacagactacaggggtttagagcttaattttgatttggcagtaaccccagaagcagaggtagagatagtggtggatcaaaaatctggatcttccttaaaagggaccggtggaggtatcntactcatgganattaacaccaatggaaagtttaaaatgtttggagattttgtagtagctacagggtcttataattataaatttgggggttttatagacaaaacatttaaagtaaatccgggagggagtattatttgggacggagacccaatgggggcccagctcaatatggaagcttcttatggtttgtttgccaatccagcaccacttttagagagtagtggctataccaatagaattccaacagaggtattggtccgtttaaatggtgccttagaaaaccctaatatagattttgacattgctttcccaggaaccaattcagtagtaaaatcagaattacaatacgccctgcaagatcccaccgttcaggatagaaacgcttttttccttctcgctcaaggaacttttgtcaacgacgccacaggaattaaccaacaggcagttactggcaacctgctgcagtctgcctcaggattgttgagtagtatattagaaggaagcaatgacaaactcaactttggattgtcttatgagcaaggaatgctggacagggtctcaaatttgcagacggattcaagaataggggtgagtgtgagtacccagattagtgatcgggtattatttaatggaagattgggcgtgcctgtgggtggtgttacagaaaatgtagtggctggagacgcagaaatacaaatcatcctaaacgatcaagggagcttatctgctaaaattttcaatagagagaatgaaattcagcaatttttagctgacaggcaggggtatacccagggcgtaggactctcttatcaggtagattttaattcttttcaagagttgttgagaaagattttgaataaaaaagaaggggaataaagtaggtatatcacaatattctaagctttttattaacgaaaacgtttgaattttcagttcaaattaaatattctctaaaatagccgtttacatccgtttaagtttgttaattttacgcttttaagagattatgagtacagaaattaaaaaaattggggtatttacatccggtggagattcaccaggaatgaatgctgctattcgttctgtagtgagaacttgtgcctacatgaagattgaatgtatagggatttacaggggttacgaagggatgatagagggtgattttaaacccatggacgctagaagtgtcaataatataatcaataaaggaggtactattttaaagtctgcgaggtctttggagtttagaacccctgagggaagggctaaagcctatgcaaatcttaaaaaagaaggtatagatgcttttgtggttattggaggagacggaagttttaccggagccatgatctttaaccaagaatacaattttccagtcattgggattcctgggactatagacaatgatatttacggcacaacttatacggtaggttttgacactgctttaaatacagttgtagaggtcatagataagataagggacaccgccagttctcataacagacttttctttgtagaagttatgggaagagatgtgggacatatagccttaaacgcaggcgtaggtgcaggagcagaagaaatcttaatccctgaagagaaccttggattagatcgtttgttagagtctttaaaaagatccaaacagtctggaaaatcatccagtattgttgtagttgctgagggtgataaaaccggtaaaaatgtttttgaactcaaagaatacgtagaggagcacattcctatttacgacgtacgtgtttcagtattgggccacatgcagcgtggtggttcgccttcttgctttgatcgtgtacttgccagtagaatgggcgttaaagctgtggaagccctactagaaggcaagagcagtctaatggtgggaatccaagacaataaattaacattaactcctttaattaaagcgattaaagggcacacaaaaatagataaggaactcattagagtgtccgatatcatgtcaacataattattaaaaagaagaaaaatg

SEQ ID NO: 185 - DNA, 4000 bp, Escherichia coli
  misc_feature (1023)..(1023): n is a, c, g, or t
  misc_feature (1485)..(1485): n is a, c, g, or t
  misc_feature (1988)..(1988): n is a, c, g, or t
  misc_feature (1991)..(1991): n is a, c, g, or t
  misc_feature (2224)..(2224): n is a, c, g, or t
  misc_feature (2280)..(2280): n is a, c, g, or t
  misc_feature (2330)..(2330): n is a, c, g, or t
  misc_feature (2592)..(2592): n is a, c, g, or t
  misc_feature (3231)..(3231): n is a, c, g, or t
agccgtgggatcgagagttgggggtttacgagaaagcgggagggtctttagaaaagttgggggagagaattaaagagcttgggttgtttgtgccgagtgtgatcgggctctggggagtgttagcgaacagtgaggaggattttgaaaagaggattggtgagcatcgtaatcggttgcgaatggtgaaggcgatcggggcggcgcatgtccagtgtatcccggactttaagtataaggatgacttcaacctggagtcaggagcggcttgctacgcaaggattagcgaaatcgcacagaaggactatggattgaagaccgggattatctttctcaatgcggtaggtaatctgaaaacggtggcagatgcagtgaagttgggcatgaagtcgggttggaaggatgtgaaaatcatcccggatagctatcataactatcatggtgggactccattaaattcactgcgtatgttgcgtgggagtgcgatcgcaatttatcagttttcggatgcgccaaagggccagaaaaaaaaggattcgtggtgcgacggggagcgagttctaccgggagatgggcagttaccgttggtagaggaactgcaaatcttattagagattgggtatgaggggtgtgtgtcgttggaattgtataatgaggagtatcgaaaaagagagccgaaggagtttctgaaggaggcgcatgcgaagactttaaaggtgatcaaggaagcagtgggctaggcgaaatcgctattaccgtaatcacgaaagttggatgagatgtgcagcccgaaaactgatcttaccggacgggttagaattactagcaattggggactggtctgacgcaacctcctcaacgagagctggtggttcccggtaatggtcgtgggatgaatcaggataaggggtgttttgcattcgaaccccattcgctccgacaagaccatttagcttcaatgagccaagcgataactcgcatcgtactcagtaagttggaatgggagcattcactgaaaaaacactngtacaagcgccgcagtgcatctgctaatttaggtcacagctgaccgtctttggtcagctgtgacctaaatcctgattcgccctctgatttagaaaagagtcagcgaatcagcgattcgtaagtttgattctagtcgtgcttcacgactatacggattcgaccttctctgcgcatgggcctttttggccctggccgatttcaaatttcaccttctgaccttcatcaaggtttgcatatccagaactctcgattgcggagtgatgaacgaaaagatctgccccgccatcgtctggtgtgatgaagccgaaacctttttctggattgaaccatttaactgtacctgtactcatttttgtatttggtttatcggagtgattgctaatctccatgagaagatgctcctgctccggatggacaattcttggagttttgcctgaaagagtcaatggatatcacaaaacngctaggaatttgcttttggcggaagggccttgaagccgcctttgggtctgagcggaggggagaatgttctgaaatcctttgatttctcccatagtaccgtctaatccaatcttttctcaaaccggcatctggcggtgcattgcttcacttagcctggcatctggatgattgtccatggaagcccaaggctcaaggtatgctcggagggagaggcatcttgaagtcgaaaaggtggctcgggataaaggcagaaccgagctctgattcacaatccatgaagtttaaaaaaagaaaggctgaacctcttatcgaccaatcgtgatttcctctgaaaaagattattgaattcggaaaggaaagcactgaatcgggatgaggaattcagaggagggtagacttgaatagctattattacgaaacttgcatgatcgcctagacatcagttggaatcaaaagtaatcggtaaattaatttgaaaaatcaataacctataataatgattnaangtgattattgcatcttggatttgttttgttttgagcctcctctccataattggttcagttgcgatttggaacattaagaagggcgagggctcagaacagagggcccatgccgagaggtttggtattttcgtaggtttatgggcgcctacttttttgggcatcgcaatcttcctcattttgctctctcaaagcagctgagttgtccgatgtttttttcaaaatgcagggtgtcnaagaagccctaaattttaggggagattattgggttcgttcatgatttgagtgtttncactctcaaggagaggactgtgcgactcaactagatcagctttatttggngcggttacgagtagctcgtgtgctctgtttaaatctttccccccgaaagagtctcgagactctcacggcgggtaatgcatcggcatttcatcgtcagggtcaacaggatattaacaccaaagagtaagactctatcggggtgatgtttcagatttcatgttaaaaactatagctgaggccaagtgaccacagagggcctacggcaagggcagtttcattaacacgtcgatacgcgggggttaagattgaagcggaggccctnaaattatcattgatagtgtagatgagtgagggtgtgagacttaggacagtggaacctgtgtagccaatctcatttccttggaacttatctttttcaccgtgggaaagatctaaagaaagcctcaagttgaggttttcagtaattgatcggcttatccctacacggaatgcgtaggcctcagcagggtgaaaacctttggagctttcatagaggggaaaagtgatattagctccagaaaagaaagaccaatcgtcattgagagtagcaaaataaattgcacctaaggcaagttgggttgtgcctgtgccgagttgaaatacagtcggcgctacttctcctagagcggggttatcccgtggtttcccggtcggtaaggtgaatccagcgcttaaccttagccggctccaaatcgaattttcaacagccctcggtaaataggttgcggacatcgtgatgtcccccaggccattcatgttaatatcgggcttatctcgctcacgacgagtggcatccgtgaaagggatctgagtagaaaagagccaagttgaactcatacgataggaagcagtgagtaaaaattgattgaactccgtggaggcgtgagtcgggttttcaacgtgagagtatcggttgaaaagntcatcgttcttccgataacgataatcgaaggcgaagctaaaggcagagccatcggcaactgattcaccgccaactggcggcgcggtaagttttcatccgtctcatccgaaagcagagagagggagaagtaaaaagagagagatttttttaaggattttcatttaaagtctttgatttatatttttttgaaggaaaggcacagctcatggctagagctgagaaacgtcatcaggaatgacggtgaggcctcgatgggaaatctgaggcgtcagagagtccggcgaggcgcagaaggctggtctcaagccgaatgaatcaaagaagatagcagcattggagggcaattcgcctccttaatgaaggtgtcggcaatgagccgggaggccacttgctgaggtcactaacaaccggtgaaagatgtgggagagtgaagtgacagctggtttgtagaagcacttttcccatctcatcgtcaccagtaaatttgagaaataatgtctgggtgagagttagagattttgccttctttaaaaagcaggggcaggagtcaggttcgtcaggtttttcttcctgatcgctttgctcagccaattggcaacaacacgattgatcctgtagtgctaattctttgtcgtgatcagcgtcaaaaaaagtggctgttacacaacagcacatcggatttccgatgagtaatgccatgaaaagagctgtgactttaccaaccattagacactttcagttacctgaaatattctcaagtaacaagatg

SEQ ID NO: 186 - DNA, 4000 bp, Escherichia coli
  misc_feature (1)..(5): n is a, c, g, or t
  misc_feature (7)..(7): n is a, c, g, or t
  misc_feature (10)..(32): n is a, c, g, or t
  misc_feature (35)..(35): n is a, c, g, or t
  misc_feature (38)..(42): n is a, c, g, or t
  misc_feature (44)..(44): n is a, c, g, or t
  misc_feature (46)..(46): n is a, c, g, or t
  misc_feature (48)..(48): n is a, c, g, or t
  misc_feature (50)..(54): n is a, c, g, or t
  misc_feature (56)..(60): n is a, c, g, or t
  misc_feature (62)..(66): n is a, c, g, or t
  misc_feature (68)..(72): n is a, c, g, or t
  misc_feature (75)..(75): n is a, c, g, or t
  misc_feature (77)..(81): n is a, c, g, or t
  misc_feature (83)..(83): n is a, c, g, or t
  misc_feature (85)..(85): n is a, c, g, or t
  misc_feature (87)..(87): n is a, c, g, or t
  misc_feature (89)..(102): n is a, c, g, or t
  misc_feature (104)..(105): n is a, c, g, or t
  misc_feature (107)..(109): n is a, c, g, or t
  misc_feature (111)..(112): n is a, c, g, or t
  misc_feature (114)..(117): n is a, c, g, or t
  misc_feature (120)..(120): n is a, c, g, or t
  misc_feature (122)..(123): n is a, c, g, or t
  misc_feature (125)..(125): n is a, c, g, or t
  misc_feature (128)..(128): n is a, c, g, or t
  misc_feature (132)..(132): n is a, c, g, or t
  misc_feature (134)..(134): n is a, c, g, or t
  misc_feature (137)..(138): n is a, c, g, or t
  misc_feature (140)..(145): n is a, c, g, or t
  misc_feature (147)..(147): n is a, c, g, or t
  misc_feature (149)..(156): n is a, c, g, or t
  misc_feature (158)..(159): n is a, c, g, or t
  misc_feature (165)..(166): n is a, c, g, or t
  misc_feature (168)..(168): n is a, c, g, or t
  misc_feature (170)..(172): n is a, c, g, or t
  misc_feature (174)..(179): n is a, c, g, or t
  misc_feature (181)..(182): n is a, c, g, or t
  misc_feature (184)..(185): n is a, c, g, or t
  misc_feature (187)..(187): n is a, c, g, or t
  misc_feature (190)..(190): n is a, c, g, or t
  misc_feature (192)..(192): n is a, c, g, or t
  misc_feature (195)..(195): n is a, c, g, or t
  misc_feature (197)..(199): n is a, c, g, or t
  misc_feature (202)..(206): n is a, c, g, or t
  misc_feature (208)..(209): n is a, c, g, or t
  misc_feature (212)..(217): n is a, c, g, or t
  misc_feature (219)..(219): n is a, c, g, or t
  misc_feature (223)..(223): n is a, c, g, or t
  misc_feature (225)..(230): n is a, c, g, or t
  misc_feature (232)..(232): n is a, c, g, or t
  misc_feature (236)..(236): n is a, c, g, or t
  misc_feature (238)..(241): n is a, c, g, or t
  misc_feature (243)..(243): n is a, c, g, or t
  misc_feature (245)..(245): n is a, c, g, or t
  misc_feature (248)..(252): n is a, c, g, or t
  misc_feature (254)..(255): n is a, c, g, or t
  misc_feature (258)..(267): n is a, c, g, or t
  misc_feature (269)..(269): n is a, c, g, or t
  misc_feature (271)..(274): n is a, c, g, or t
  misc_feature (276)..(280): n is a, c, g, or t
  misc_feature (282)..(282): n is a, c, g, or t
  misc_feature (285)..(289): n is a, c, g, or t
  misc_feature (291)..(292): n is a, c, g, or t
  misc_feature (294)..(295): n is a, c, g, or t
  misc_feature (297)..(297): n is a, c, g, or t
  misc_feature (301)..(301): n is a, c, g, or t
  misc_feature (304)..(304): n is a, c, g, or t
  misc_feature (307)..(307): n is a, c, g, or t
  misc_feature (309)..(309): n is a, c, g, or t
  misc_feature (312)..(314): n is a, c, g, or t
  misc_feature (316)..(317): n is a, c, g, or t
  misc_feature (319)..(323): n is a, c, g, or t
  misc_feature (325)..(325): n is a, c, g, or t
  misc_feature (327)..(328): n is a, c, g, or t
  misc_feature (330)..(330): n is a, c, g, or t
  misc_feature (332)..(333): n is a, c, g, or t
  misc_feature (335)..(338): n is a, c, g, or t
  misc_feature (340)..(341): n is a, c, g, or t
  misc_feature (343)..(343): n is a, c, g, or t
  misc_feature (345)..(347): n is a, c, g, or t
  misc_feature (349)..(350): n is a, c, g, or t
  misc_feature (352)..(358): n is a, c, g, or t
  misc_feature (360)..(360): n is a, c, g, or t
  misc_feature (362)..(363): n is a, c, g, or t
  misc_feature (366)..(373): n is a, c, g, or t
  misc_feature (375)..(376): n is a, c, g, or t
  misc_feature (380)..(380): n is a, c, g, or t
  misc_feature (382)..(383): n is a, c, g, or t
  misc_feature (385)..(388): n is a, c, g, or t
  misc_feature (392)..(397): n is a, c, g, or t
  misc_feature (399)..(404): n is a, c, g, or t
  misc_feature (406)..(407): n is a, c, g, or t
  misc_feature (409)..(415): n is a, c, g, or t
  misc_feature (417)..(417): n is a, c, g, or t
  misc_feature (419)..(421): n is a, c, g, or t
  misc_feature (423)..(426): n is a, c, g, or t
  misc_feature (428)..(430): n is a, c, g, or t
  misc_feature (432)..(432): n is a, c, g, or t
  misc_feature (434)..(438): n is a, c, g, or t
  misc_feature (442)..(449): n is a, c, g, or t
  misc_feature (451)..(452): n is a, c, g, or t
  misc_feature (455)..(460): n is a, c, g, or t
  misc_feature (462)..(462): n is a, c, g, or t
  misc_feature (464)..(465): n is a, c, g, or t
  misc_feature (468)..(469): n is a, c, g, or t
  misc_feature (472)..(472): n is a, c, g, or t
  misc_feature (475)..(488): n is a, c, g, or t
  misc_feature (490)..(490): n is a, c, g, or t
  misc_feature (492)..(495): n is a, c, g, or t
  misc_feature (497)..(497): n is a, c, g, or t
  misc_feature (499)..(503): n is a, c, g, or t
  misc_feature (505)..(508): n is a, c, g, or t
  misc_feature (510)..(516): n is a, c, g, or t
  misc_feature (518)..(525): n is a, c, g, or t
  misc_feature (527)..(534): n is a, c, g, or t
  misc_feature (537)..(538): n is a, c, g, or t
  misc_feature (540)..(545): n is a, c, g, or t
  misc_feature (547)..(552): n is a, c, g, or t
  misc_feature (554)..(555): n is a, c, g, or t
  misc_feature (558)..(559): n is a, c, g, or t
  misc_feature (561)..(562): n is a, c, g, or t
  misc_feature (564)..(566): n is a, c, g, or t
  misc_feature (568)..(572): n is a, c, g, or t
  misc_feature (574)..(584): n is a, c, g, or t
  misc_feature (587)..(594): n is a, c, g, or t
  misc_feature (597)..(599): n is a, c, g, or t
  misc_feature (601)..(601): n is a, c, g, or t
  misc_feature (603)..(606): n is a, c, g, or t
  misc_feature (608)..(619): n is a, c, g, or t
  misc_feature (621)..(623): n is a, c, g, or t
  misc_feature (625)..(632): n is a, c, g, or t
  misc_feature (634)..(634): n is a, c, g, or t
  misc_feature (637)..(638): n is a, c, g, or t
  misc_feature (640)..(641): n is a, c, g, or t
  misc_feature (643)..(647): n is a, c, g, or t
  misc_feature (649)..(654): n is a, c, g, or t
  misc_feature (656)..(658): n is a, c, g, or t
  misc_feature (660)..(662): n is a, c, g, or t
  misc_feature (665)..(665): n is a, c, g, or t
  misc_feature (667)..(668): n is a, c, g, or t
  misc_feature (670)..(671): n is a, c, g, or t
  misc_feature (673)..(680): n is a, c, g, or t
  misc_feature (682)..(696): n is a, c, g, or t
  misc_feature (698)..(704): n is a, c, g, or t
  misc_feature (707)..(716): n is a, c, g, or t
  misc_feature (718)..(718): n is a, c, g, or t
  misc_feature (720)..(720): n is a, c, g, or t
  misc_feature (722)..(722): n is a, c, g, or t
  misc_feature (726)..(733): n is a, c, g, or t
  misc_feature (735)..(737): n is a, c, g, or t
  misc_feature (739)..(744): n is a, c, g, or t
  misc_feature (746)..(746): n is a, c, g, or t
  misc_feature (748)..(749): n is a, c, g, or t
  misc_feature (751)..(753): n is a, c, g, or t
  misc_feature (756)..(757): n is a, c, g, or t
  misc_feature (759)..(761): n is a, c, g, or t
  misc_feature (763)..(779): n is a, c, g, or t
  misc_feature (781)..(784): n is a, c, g, or t
  misc_feature (786)..(786): n is a, c, g, or t
  misc_feature (793)..(795): n is a, c, g, or t
  misc_feature (797)..(800): n is a, c, g, or t
  misc_feature (802)..(803): n is a, c, g, or t
  misc_feature (805)..(806): n is a, c, g, or t
  misc_feature (810)..(814): n is a, c, g, or t
  misc_feature (816)..(823): n is a, c, g, or t
  misc_feature (825)..(827): n is a, c, g, or t
  misc_feature (829)..(829): n is a, c, g, or t
  misc_feature (831)..(841): n is a, c, g, or t
  misc_feature (843)..(845): n is a, c, g, or t
  misc_feature (847)..(853): n is a, c, g, or t
  misc_feature (855)..(862): n is a, c, g, or t
  misc_feature (864)..(870): n is a, c, g, or t
  misc_feature (873)..(873): n is a, c, g, or t
  misc_feature (876)..(877): n is a, c, g, or t
  misc_feature (879)..(882): n is a, c, g, or t
  misc_feature (884)..(887): n is a, c, g, or t
  misc_feature (889)..(890): n is a, c, g, or t
  misc_feature (892)..(895): n is a, c, g, or t
  misc_feature (897)..(900): n is a, c, g, or t
  misc_feature (902)..(904): n is a, c, g, or t
  misc_feature (906)..(914): n is a, c, g, or t
  misc_feature (916)..(919): n is a, c, g, or t
  misc_feature (921)..(924): n is a, c, g, or t
  misc_feature (926)..(929): n is a, c, g, or t
  misc_feature (932)..(932): n is a, c, g, or t
  misc_feature (934)..(936): n is a, c, g, or t
  misc_feature (938)..(940): n is a, c, g, or t
  misc_feature (944)..(944): n is a, c, g, or t
  misc_feature (946)..(946): n is a, c, g, or t
  misc_feature (948)..(948): n is a, c, g, or t
  misc_feature (950)..(955): n is a, c, g, or t
  misc_feature (958)..(958): n is a, c, g, or t
  misc_feature (960)..(968): n is a, c, g, or t
  misc_feature (970)..(978): n is a, c, g, or t
  misc_feature (980)..(988): n is a, c, g, or t
  misc_feature (990)..(992): n is a, c, g, or t
  misc_feature (994)..(994): n is a, c, g, or t
  misc_feature (996)..(997): n is a, c, g, or t
  misc_feature (999)..(1007): n is a, c, g, or t
  misc_feature (1009)..(1011): n is a, c, g, or t
  misc_feature (1013)..(1017): n is a, c, g, or t
  misc_feature (1019)..(1020): n is a, c, g, or t
  misc_feature (1024)..(1024): n is a, c, g, or t
  misc_feature (1026)..(1026): n is a, c, g, or t
  misc_feature (1029)..(1030): n is a, c, g, or t
  misc_feature (1032)..(1034): n is a, c, g, or t
  misc_feature (1036)..(1042): n is a, c, g, or t
  misc_feature (1044)..(1047): n is a, c, g, or t
  misc_feature (1049)..(1051): n is a, c, g, or t
  misc_feature (1054)..(1054): n is a, c, g, or t
  misc_feature (1056)..(1065): n is a, c, g, or t
  misc_feature (1067)..(1068): n is a, c, g, or t
  misc_feature (1070)..(1071): n is a, c, g, or t
  misc_feature (1073)..(1076): n is a, c, g, or t
  misc_feature (1078)..(1081): n is a, c, g, or t
  misc_feature (1083)..(1089): n is a, c, g, or t
  misc_feature (1091)..(1093): n is a, c, g, or t
  misc_feature (1096)..(1097): n is a, c, g, or t
  misc_feature (1099)..(1105): n is a, c, g, or t
  misc_feature (1107)..(1116): n is a, c, g, or t
  misc_feature (1119)..(1121): n is a, c, g, or t
  misc_feature (1123)..(1124): n is a, c, g, or t
  misc_feature (1127)..(1128): n is a, c, g, or t
  misc_feature (1130)..(1130): n is a, c, g, or t
  misc_feature (1133)..(1135): n is a, c, g, or t
  misc_feature (1137)..(1138): n is a, c, g, or t
  misc_feature (1140)..(1153): n is a, c, g, or t
  misc_feature (1155)..(1160): n is a, c, g, or t
  misc_feature (1162)..(1162): n is a, c, g, or t
  misc_feature (1164)..(1164): n is a, c, g, or t
  misc_feature (1167)..(1168): n is a, c, g, or t
  misc_feature (1170)..(1178): n is a, c, g, or t
  misc_feature (1180)..(1181): n is a, c, g, or t
  misc_feature (1184)..(1186): n is a, c, g, or t
  misc_feature (1188)..(1189): n is a, c, g, or t
  misc_feature (1191)..(1197): n is a, c, g, or t
  misc_feature (1199)..(1199): n is a, c, g, or t
  misc_feature (1201)..(1205): n is a, c, g, or t
  misc_feature (1207)..(1209): n is a, c, g, or t
  misc_feature (1211)..(1215): n is a, c, g, or t
  misc_feature (1219)..(1221): n is a, c, g, or t
  misc_feature (1223)..(1227): n is a, c, g, or t
  misc_feature (1230)..(1230): n is a, c, g, or t
  misc_feature (1232)..(1232): n is a, c, g, or t
  misc_feature (1234)..(1239): n is a, c, g, or t
  misc_feature (1241)..(1243): n is a, c, g, or t
  misc_feature (1246)..(1247): n is a, c, g, or t
  misc_feature (1250)..(1251): n is a, c, g, or t
  misc_feature (1253)..(1257): n is a, c, g, or t
  misc_feature (1259)..(1261): n is a, c, g, or t
  misc_feature (1264)..(1265): n is a, c, g, or t
  misc_feature (1267)..(1268): n is a, c, g, or t
  misc_feature (1270)..(1271): n is a, c, g, or t
  misc_feature (1273)..(1273): n is a, c, g, or t
  misc_feature (1275)..(1276): n is a, c, g, or t
  misc_feature (1278)..(1278): n is a, c, g, or t
  misc_feature (1281)..(1282): n is a, c, g, or t
  misc_feature (1284)..(1286): n is a, c, g, or t
  misc_feature (1288)..(1288): n is a, c, g, or t
  misc_feature (1291)..(1291): n is a, c, g, or t
  misc_feature (1293)..(1294): n is a, c, g, or t
  misc_feature (1297)..(1297): n is a, c, g, or t
  misc_feature (1405)..(1405): n is a, c, g, or t
  misc_feature (1933)..(1933): n is a, c, g, or t
  misc_feature (1936)..(1937): n is a, c, g, or t
  misc_feature (1945)..(1945): n is a, c, g, or t
  misc_feature (1952)..(1952): n is a, c, g, or t
  misc_feature (1957)..(1958): n is a, c, g, or t
  misc_feature (1966)..(1967): n is a, c, g, or t
  misc_feature (1972)..(1973): n is a, c, g, or t
  misc_feature (1976)..(1976): n is a, c, g, or t
  misc_feature (1981)..(1981): n is a, c, g, or t
  misc_feature (1988)..(1988): n is a, c, g, or t
  misc_feature (1990)..(1990): n is a, c, g, or t
  misc_feature (1996)..(1997): n is a, c, g, or t
  misc_feature (2392)..(2392): n is a, c, g, or t
  misc_feature (2395)..(2395): n is a, c, g, or t
  misc_feature (2472)..(2472): n is a, c, g, or t
  misc_feature (2551)..(2551): n is a, c, g, or t
  misc_feature (2566)..(2567): n is a, c, g, or t
  misc_feature (2585)..(2585): n is a, c, g, or t
  misc_feature (2587)..(2587): n is a, c, g, or t
  misc_feature (2590)..(2590): n is a, c, g, or t
  misc_feature (2602)..(2602): n is a, c, g, or t
  misc_feature (2605)..(2605): n is a, c, g, or t
  misc_feature (2612)..(2612): n is a, c, g, or t
  misc_feature (2623)..(2623): n is a, c, g, or t
  misc_feature (2628)..(2628): n is a, c, g, or t
  misc_feature (2641)..(2643): n is a, c, g, or t
  misc_feature (2646)..(2648): n is a, c, g, or t
  misc_feature (2652)..(2652): n is a, c, g, or t
  misc_feature (2657)..(2657): n is a, c, g, or t
  misc_feature (2663)..(2663): n is a, c, g, or t
  misc_feature (2665)..(2665): n is a, c, g, or t
  misc_feature (2671)..(2671): n is a, c, g, or t
  misc_feature (2682)..(2682): n is a, c, g, or t
  misc_feature (2690)..(2690): n is a, c, g, or t
  misc_feature (2777)..(2777): n is a, c, g, or t
  misc_feature (2783)..(2783): n is a, c, g, or t
  misc_feature (2798)..(2798): n is a, c, g, or t
  misc_feature (2801)..(2801): n is a, c, g, or t
  misc_feature (2804)..(2804): n is a, c, g, or t
  misc_feature (2813)..(2813): n is a, c, g, or t
  misc_feature (2825)..(2825): n is a, c, g, or t
  misc_feature (2852)..(2852): n is a, c, g, or t
  misc_feature (2858)..(2858): n is a, c, g, or t
  misc_feature (2866)..(2866): n is a, c, g, or t
  misc_feature (2873)..(2873): n is a, c, g, or t
  misc_feature (2876)..(2876): n is a, c, g, or t
  misc_feature (2894)..(2894): n is a, c, g, or t
  misc_feature (2969)..(2969): n is a, c, g, or t
  misc_feature (2989)..(2989): n is a, c, g, or t
  misc_feature (3022)..(3022): n is a, c, g, or t
  misc_feature (3253)..(3253): n is a, c, g, or t
  misc_feature (3258)..(3258): n is a, c, g, or t
  misc_feature (3265)..(3265): n is a, c, g, or t
  misc_feature (3291)..(3291): n is a, c, g, or t
  misc_feature (3333)..(3333): n is a, c, g, or t
  misc_feature (3385)..(3385): n is a, c, g, or t
  misc_feature (3396)..(3396): n is a, c, g, or t
  misc_feature (3399)..(3399): n is a, c, g, or t
  misc_feature (3405)..(3405): n is a, c, g, or t
  misc_feature (3408)..(3408): n is a, c, g, or t
  misc_feature (3417)..(3417): n is a, c, g, or t
  misc_feature (3426)..(3426): n is a, c, g, or t
  misc_feature (3435)..(3435): n is a, c, g, or t
  misc_feature (3537)..(3537): n is a, c, g, or t
  misc_feature (3544)..(3544): n is a, c, g, or t
  misc_feature (3546)..(3546): n is a, c, g, or t
  misc_feature (3555)..(3555): n is a, c, g, or t
  misc_feature (3653)..(3654): n is a, c, g, or t
  misc_feature (3663)..(3663): n is a, c, g, or t
  misc_feature (3665)..(3666): n is a, c, g, or t
  misc_feature (3684)..(3684): n is a, c, g, or t
  misc_feature (3696)..(3696): n is a, c, g, or t
  misc_feature (3708)..(3708): n is a, c, g, or t
  misc_feature (3720)..(3720): n is a, c, g, or t
  misc_feature (3726)..(3726): n is a, c, g, or t
  misc_feature (3730)..(3730): n is a, c, g, or t
  misc_feature (3735)..(3735): n is a, c, g, or t
  misc_feature (3762)..(3762): n is a, c, g, or t
  misc_feature (3765)..(3765): n is a, c, g, or t
  misc_feature (3770)..(3770): n is a, c, g, or t
  misc_feature (3774)..(3774): n is a, c, g, or t
  misc_feature (3804)..(3804): n is a, c, g, or t
  misc_feature (3808)..(3808): n is a, c, g, or t
  misc_feature (3820)..(3820): n is a, c, g, or t
  misc_feature (3822)..(3822): n is a, c, g, or t
  misc_feature (3837)..(3837): n is a, c, g, or t
  misc_feature (3841)..(3842): n is a, c, g, or t
  misc_feature (3846)..(3846): n is a, c, g, or t
  misc_feature (3855)..(3855): n is a, c, g, or t
  misc_feature (3876)..(3876): n is a, c, g, or t
  misc_feature (3879)..(3879): n is a, c, g, or t
  misc_feature (3885)..(3885): n is a, c, g, or t
nnnnntnccnnnnnnnnnnnnnnnnnnnnnnnccnttnnnnncntngngnnnnngnnnnntnnnnnannnnntangnnnnntnanangnnnnnnnnnnnnnngnngnnncnngnnnnaantnntntcntaantncanngnnnnnngngnnnnnnnnanntatttnnangnnntnnnnnncnntnngngananatncnnnaannnnngnngannnnnncngcanannnnnnanattncnnnncngnatnnnnngnntannnnnnnnnngnannnncnnnnncnccnnnnngnncnncntttntancantnccnnnannannnnngngnncntnnannnncnncnannngnngnnnnnnntntnntcnnnnnnnntnntaananncnnnncccnnnnnngnnnnnncnngnnnnnnntntnnncnnnnannntnannnnnaaannnnnnnnannaannnnnntnannacnngcncannnnnnnnnnnnnnantnnnnanannnnngnnnntnnnnnnncnnnnnnnngnnnnnnnnggnngnnnnnnannnnnnannacnntnngnnntnnnnntnnnnnnnnnnncgnnnnnnnnttnnnanannnncnnnnnnnnnnnngnnnannnnnnnncntcnncnntnnnnnannnnnntnnngnnnacntnntnnannnnnnnntnnnnnnnnnnnnnnnannnnnnngcnnnnnnnnnncncntnaccnnnnnnnngnnntnnnnnncncnnannngcnngnnnannnnnnnnnnnnnnnnnannnnanttgacannncnnnntnntnnagtnnnnnannnnnnnntnnnanannnnnnnnnnnannngnnnnnnnannnnnnnntnnnnnnntgnttnncnnnntnnnngnntnnnnannnncnnngnnnnnnnnngnnnnannnncnnnnatnannnannntgtntnangnnnnnnatnannnnnnnnnannnnnnnnngnnnnnnnnncnnnananntnnnnnnnnngnnntnnnnnanncaancntcnncnnngnnnnnnncnnnnannnacncnnnnnnnnnncnntnnannnngnnnncnnnnnnngnnnttnntnnnnnnncnnnnnnnnnnaannntnncannanttnnncnnannnnnnnnnnnnnntnnnnnnananganncnnnnnnnnntnnttnnntnntnnnnnnnangnnnnncnnntnnnnnacgnnnannnnnaananannnnnntnnntgnnatnnannnnnannncannanncnnancnnangannannncnacnannctnaacagcgcgacgggcagcgtgctcggacttgccgaacttatcggaataagccacggtaaaatgcgcactcttatcggccacctatgcgccgcaggactgataacgagngaatcatcgaacaaaggaacggcatttcgacttactgaccgcggcgaacaggtattgaatttcacatcggcagacgtcgacgatttttcgaccattctgtcggttatccaacggcctttcggcatagctattttacatattattaaacaactaacgcacaacgcactatgaaaaacaacatcgaaaatgggatttacatccccgaggaacagcgcaaccttatccccgtcgacgaatgggtgaagcgcgaagatccgaccacagcgcagaccgttgtacttgtaaccgatttcggaatgctcgaaatcgccaaagaagacctaccgggcggattcaatttcgagggcgcacagaaagctgccgccgaataccgcaagggcttccgctgcccgacccggcatgaagcaattgaaatgtacgacgcccggttccgtggcctcgacgaagcgttcaagaagatcggcggcgaacccgcaacgactatcggctggacgagcgaagccgaccccgacccggagtacaattccnacnncgcgttcntctacancggcnncacgggcnncgtgnncancaacngcaagtntnacacgnncgccgtgcgtccggtttccgctttcaagaaatagtttcacagttcaatcattcccgcgccctttacggggcgcggggttaaccccaaagaccaaacagaaatgaaaaaaggcacgatcatcaaacgcaccgactacgtggcgacgatgctcgctattcccgtcggagaagaacacgaattcacgctgacggggcgcgactacgcatcgtatatgaacgccgtcagccgtttcaacaagaacggcaaggcgaaattcgaagcccgcaccgcttccgcatccaccatcgtaattaaacgcctttcgtaatatgtcgctccccgaattatacgaattacagcattgcctcgtccacgtcgccgatgtcgttgcttgcgcaatcatcaagcgccagcanccngccgccgacctcgtaacgaaacgcgcgctgtatcgggaattcggtcggggctgggtcgataagcatatcgccccgcntgggaagatcgagggcaagcgattcggaacggccccgaattcaccgatcaaatacagccgcacggaattcgtcgccctnctcgaagccgaacgnntgcaacgcgcagaaatcntnggnaaatacggacancangagcagncaaaataagcngtttngcagcctttaccnnnccnnncgancgaanacacgncnacagcncgaaagtcganaaaacagnaaattcgataaaaataacatgcaagcactcaaatacacatcaagggaggtaaaccggaatttccgcatcaaggtttcgggcctcggnatccangaactcaaaggcttnacnggnttcgtcggnttggtggggagngaactcgcaaacaacctgcttgaccgngcattncgaagcanggcgganaangtagaatgcaaactgcgncgcggcttgaaaataaccttttactacaagtagacatgaaaaccaaaattttagctatcccgtggtggctgtcgntggtcgcgctcggcggagcnatggatgcagacccgatttcatgggtcgccgtngccgtaacattcgccgcgttcgtaacactttccgcagccataatcagagaacaaaggaaaaccgcataataaccaatcatcacaaaacgcacgatgctatgaacatcaagatcaaatcaattaccctgcgcaatttcaaaggactgcgcgacgtatcgttcgatttcgacggccgtaacgccacgatcataggcgacaacggtacgggaaagacaaccattttcgacgccntgacntgggtantgttcggcaaggattcgcacaacagnaccgacatcgacatcaagacaatagacgccacgggcgaaccnatgcaccgcgccgagcatttcgtcgaggtggcattggacgtggacggctccncacagacgctncgncgcacntancgcgagatntggagcaanccgcgcggntcgtccgacctgcgattcgtcggacacgaaagtgcgtttgccgtcaatggcgtggaggtcggaaccaaggcggcatacgacaaaatcatttcggaatggatnaacgacnangtattccgnatgctgaccgacccgatgtatttcaatactcgcgtcgattggaaaggccgtcgcgctgcccttttagccctcgtcggggataacatcgaccgcacggnnatacaggcncnntttgccgacctgctcgcngaaatgaacggngaacccctcgcngatttcaaagcncggctngcgnccganaagcgcaagaacaaaaaggaactcganacnttcgncccnaagatcgaagcatatcaaaacacgatgccnccgncggaagactacncngcgctggaacagganatcnngcancgcgaatcngtggccgcaaacgagatcgcngcntaccancggcaaatcgacgcactcgacacgcagatcgccgacgcatcgaaaatagacgaggaaacgcaggccgcccacgaccgaagactgaaaaaggtgctcgacatcaaaaagtcgttgt

SEQ ID NO: 187 - DNA, 4000 bp, Escherichia coli
aggcctgccgctagcgttcatcctgagccaggatcaaactctccattgtataaaatgttttgttttaaatctttagctctaatctcaaaggtattgtttgaaattcactctctcgcgagagtggaaaacttttagctgctcaaatacttcaaagaacgctgttcaaatatattgctataaagaacaatttctttctttttgccgggtctgtccttgcggcttttcccgttgttccgaccgctgatttttcagcggaaagtggtgcaaagataagtcatctttttgaaaccaccaaatcttttcgaaagattttttcagaaattttcagaaccttttttcttatcgtttcgaaccgtatttcttattcgaagcgggtgcaaaggtaagtcatttttccgaatctccaaaagattttggaacttttttcaaaatttttcagaacctgttttttccgccccggagcagtatttctctctcgaagcggatgcaaagataagggcattccggagttatttccaaataattccgggactttttttcgacaatttcaccaccttttttacacacggctatcggtcagcgagttagttgtgaaaaatttttaatatatttgcaaaaacgaacagcggagactatgaaacaggctttaatatatataggtatgcttctgctggccatttcctgcggccaaaaccgcgatcgcctgcacacgggcgacctgctcttccaggccggaaaaaacacggagatgaccggggcgatcacggcggcgacgggcgaagaagggccgctgaatttctcccacgtggggatcgccgtcacaggcaacggggcggattcggtgctcgaagccacgaccgacggcggcgtccggctcacgctattggaggaatttctcggacgctccgcaaaaatcggcggccggccggcagtagttgccatgcggttgaaggacacggccggcatcgcggctgccgtccgccgtgcgcgcagcttcctcggagtcccctacgattattcgttccggcccggaagggagaaactctattgcagcgaactggtgtgggaaagctaccgcgccgaaaacggcaccccgcttttcacggcgcggccgatgaacttccgcgccgcggacggaaccctgccgcaattctgggccgacctgttcgaccaactgggcgagcaggttcccgaagggctgcccggcacgaaccccaacgacatggcacgcgaggagctcctcgaagaagtgcaccgttatttctgaccgatgggcaccggcacacaccaccatgacacggcgttctcgatcgtcaaggccctcggcatcgtagcggtggtgatttcacacgccgcgatcctgacaccgctggaaaccttcacctactatttcaacacggccgtcttctttttcgtcgcgggctatttcttcgacgacggacagaccgccgccccggggcgtttcataggccgcaagctccgacgcctctacctgccctacgtcgtcctgggcacgctcttcgtgctgctgcacaaccgatttctcgagtggcacctgatcgcctatgacttctccgcccgggaggccatcctgccctacgacaccccggagctgctccggacgctgggccgggtattcctgttcctgcaccacgagcagatgcaggcgcccttctggtttctgcaagggctgttcctcgggctgatgctctttttctgcatcacgctggcaacccgcaaactcgccccgacgccgaccgtggcggaacggctgcgcgggggctccatcctgttcctgtttacggtcgccatgctgctcgcccgccatccgtcgggcattccgggcgagtggatcgccgtccggacattcgccatcacggggataatctacctcggaaaactcttccgcatcttccgcgcgcggctcccgctggacgggcgcatcgcaacgctctgcctggtcatcctgctcgcggcggcagccgcaggctgccgcatcaaccttggcgggagacttttcggcaacccggtgctcttcgtcgtgctggtgtgcacaggatgctacatgctcgtcaccgccgcaagccgcctcgcggcaaccggcaacaggctgacacggatgctggactatacgggacggcacaccatggcgatcatgctgtggcacatccccgcattcaaactggtgatactctttcaaatgtgggtttgcgactacccgccccgctacctggcctgccacccggtcatccccacagggtcgccctggtggtggataccctacaccgtggtcggaatcaccctgccgctgggcttctgcctgctgtacgaccggctcatacgatccgttcgatggtaatgtcgggattctcacgcagcaggtcgacatagcggtcttcatccgtattccccttggcacggatgaccagggtggcccggtagacgatgccgtcggcgctgcgctgtgcctcgacctcataggagatcacggcatattcgcggctctgcaactcgttgaacatctcgtcgaccgcagcacgcttcgtagccgaaaagaccaccatcgtcctgcggcgccccaacccgccaaagaccagcgtaagcacttcgagcgcgaagagcgtcagcaccgtagccgctgcagccacgacatacatatgcgccccggccgcaaggccgatgccggccgtcgcccagaggcttgccgccgtcgtaagcccgcgcaccaactggcggtggatgatgatcgtaccggcgccgatgaagccgatgccgctcaccacctgtgcagcgatacggctggggtcgagccccacgcctgtatgcatcaggatatcggcgaagccgtactgcgacacgatcattatcagcgcactgcccagcgcaaccaggaaatgggtgcggaaacccgcatccttgacccggtattcgcggtcgaggccgatcaccgtgccgcaaaggcctgccacgcacaagcgtatgataaaatcccactccatctccatcgtcctgcggtttttgatttacctattcaaatatacggaaaattatcgggatcagcaaaccgacctggggcacaggcggcggacagcccccggcgtttccctgcaataattgcgcaacgggaataaaaagagggagatttttcagccccgcgattgcggtatgccgaatttttgttatctttgcaggctaagtttaactaattaactatttacgacaatgccgaaaatgaaaaccaatgccgctgcgaagaagcgttttaccttcaccggcacaggaaagatcaagcgcaaacacgcttatcacagtcacatcctgaccaaaaagacgactaaacagaaacgtaacctctgctactcgggtacggtttctgcggtcgacgaggccaaaatcaagaacctgctggtcaagtaatcgacctgcggaagttattaaccggagcgaatcagccccaaagaacgcgggagaaccgcgtcgctgacagctcttcaaaaactttacaagtatgccacgttcagtcaacgccgttgcatcacgcgcacgtagaaaaaaagttttgaaacttgccaaaggtaactttggttcaaggggaaatgtttggaccgttgcgaaaaacacggtcgaaaagggtttgcagtatgcatatgcacaccgccagctcaaaaagcggacattccgctcgctgtggatcatgcgtatcaacgcagcagtccgcgcacagggaatgacctattcacaatttatcggcaaactcaacgccaagggcatcgcactgaaccgcaaggttttggccgacctggcgatgaacgagccaaaagcattcgaggcaatagttaaagcagttaaataaaccctttcacggaagggtttgcagcggcggacacctcggtgtccgccttttttggcatcaccgcgaaacaagcatggaaaactggaaaaagacattcgggatcatctggagcgggcagctcgcctcgatcctcagcagctcggtcgt

SEQ ID NO: 188 - DNA, 4000 bp, Escherichia coli
  misc_feature (164)..(164): n is a, c, g, or t
  misc_feature (197)..(197): n is a, c, g, or t
  misc_feature (361)..(361): n is a, c, g, or t
  misc_feature (725)..(725): n is a, c, g, or t
  misc_feature (880)..(880): n is a, c, g, or t
  misc_feature (920)..(920): n is a, c, g, or t
  misc_feature (932)..(932): n is a, c, g, or t
  misc_feature (992)..(992): n is a, c, g, or t
  misc_feature (1255)..(1255): n is a, c, g, or t
  misc_feature (3159)..(3159): n is a, c, g, or t
  misc_feature (3305)..(3305): n is a, c, g, or t
  misc_feature (3471)..(3471): n is a, c, g, or t
  misc_feature (3519)..(3519): n is a, c, g, or t
atacgcatgaaggacggagcctcggtcagcatttcccgccaacggcgaaactatgtgatggaagtattaaaacaattataaaccaagccatctaaataactgctcattccttatatttcaaatcgaaacggccttccgtaatgcgtcctccctcgaaagtgccnctgaacacgccgtccgacatacgggagatgtanaccttgccatcttccatattttgattttcaaaagagagattcacataaggaagcgtttctccctccttggggtcggcaatcgtaaaacggatatacgaaccgagaccgacctgcgccgaaaccgtcacgctggaaccctcttcccgctccaaatattccgcagnaggcatcccccaccggccgcttgtatacacccagccgtcaaccaagcaaccaaatgtattcgccccggtcgtagtagcttcgggcatgatcgtcggatcgaccgattcgttctcttcacaggccacacaaaacagcaacaaacagataaataacagatgtctcataaccgtatctgattaaaagtgtaaattcataccgaacaataaggataattgggagaaacatcctccgccaccactcaattcaggagattcgacctgccatttctgaccgtgatacctgaccgaatagctctcagaggaggtaacgatccaattcaattttgcagaaatccccaccagcggagaaagacgatactcgccncccgccgacagattataggccagtttattcattgacacatcccgcggcttgccgtacacaaaacttttatctttataatgctgatatcccaccccagtcgataaagacagattgtatttctgcttcaccataaacaaggcaagctgaggcgcganataatgcatcaggatcttgtcggaactttcgtcatgagtntttttataacgnccaccctgatagataagtccgggagcgagtttaaacgaaccgaagatatatttgtctccnaagaaataataattggcatcccaggcgatcccattccgcaaatcattccgataagcatcggagttgttcgtgatcccgatcattttccccaaataccaggaaggccctgcatgaacggagaatatcgacttcccgacagacgtctcctgggccaaaaccgacacagcttgtatcaacagccctaacaaaagtacatactttttcatatcatttcttttagacttataatcataaatataagatgctcaaaaccagtcaaacgntgcacaggctgttacgacaagatcgtattgtttctcctatcctatcttcaaagcatcgcatggttcagataatggataaattcaggatcatcgggtgcaatgataaagttaccacggcgggaagtcgtaatcagaatacggttatcagaacgccgggcaaaaacttttacacgtccgatagcagtagaagaaaaatatccgagatcaccaaacaaccaaccgacaccaaatgaacggatcattattcctaaatccagccggtcgacctcgcgaaccgaaaggatttcctctatgtttatatacgtcttccgaaaatacgcatctatcaccagtttttctccatccacaataaaacggtttggcataaatcctcgagtaagcatacaaaggatcgaactgacggcaaacaaacctaacaaaacagacagattgccatcccaagccggaaatatacagataccatataaaagcagaagcatgacagacgtttttattttattggcattgtccatcgaagaagaagatatccgggtttccatactcttattcctttagtattacttagatattccaagactcacaaatataacaaaaatcccgtacaaactattatctttgcaaaagaaacaaagacaattaggacaatgactttcaattacgatgtgatcgtggtaggtgccggccatgcaggctgtgaagccgcagcggcggccgccaatatgggttcgaagacgcttctcattacaatggacatgaacaagattgcgcagatgagttgcaatccggctgtcggaggcatagccaaaggacagattgtccgcgaaatcgacgctttaggcggatatatgggaatcgtgacggaccggacagccatccagttccgtatgctgaaccaaagcaagggaccggcgatgtggagcccgcgctcccagagcgaccgcgcccgtttcatcgaatgctggcggggaatactggaaaacctgccgaacctgtatatctggcaggataccgtacgcgaactgttgctcgacgggaataccgtatgcggcgtaaaaacggatatgggagtcgagttccatgcgaaaagcgtggttctgacaaacgggactttcctgaacgggcttatgcatatcggacggacacagatcagaggcggtcgtatagccgagccggctgcaaccggactgaccgaacaactggtctcattaggcatcaaatccgaacggatgaagaccggaacgcctgtgcgtatcgatgcacggagcgtacacttcgatgaaatggcggaacagcccggagaaaacgacttccataagttttcttatatggacacctcgcaccgcgttctgaaacagctaagctgttggacaacgttcaccaacgaagcctgccatgcagtcctgcgcgaaggcctccccgactccccgttgtataacggacagatccagagcatcggcccgcgctactgtccgagcatcgagacgaaaatcgtgacgtttgcggacaagccacaacaccaactcttcctggaaccggaaggtgaaacgacacaggaatactacctgaacggcttctcctcctcccttccgttggatatccagctacgtgccttgcaacagataccggcattccgggacatacagatctatcgtccgggatatgctattgaatatgatttcttcgatccgacgcagctccaccataatttggaaacaaaacaaatccgcaacctcttctttgccggacagatcaacgggacgaccggatatgaggaagccggcggacaaggattggtagccggcataaacgcacatatcaattgccacggcggagatccgttcgttttaggacgcgacgaagcctatatcggcgtactgatcgacgatcttgtcacaaaaggcgtngacgagccttaccgtatgtttacctcacgtgcagaatatcgcattctgctccgccaggatgatgcggacatgcgtttgacggaaaagtcgtatcatctcggtttggcaaagcaggaccgctacgatttgttgaaagagaaaaaggnaagccgggatgcgattatttctttcgcagaaaactactccatcaaaccgcaatatataaacagtggcctggaggcgttgggcactaccccgctcgcacacggatgcaagttgatcgaactgattccacgtcctcagatcaccttggagaatatcgcggaactggtnccggcattccggacagagctggacaaggtccctgtttcacgaaaagangagatcatcgaagcggcagaaatattaatcaagtatagcggctacatccgccgcgagcagatcatcgccgacaagataaaccgcctggaaaatatccatatcaaaggcaagtttgactacaatgcgatccagtctttgtctacggaagcccgccagaaactgacacggatagacccagacacgatagcccaggcaagccgtattccgggtatctccccaagcgacatcaatatcctcctggtgatgctgggacgctaaacgtggaatgttccacgtgaaacatttactttaacaacaatagcgtaaaagactgaaaataggatagaaacagatgcaaaagaaatgagcacaaccgaggaacatataaaaaacatcctttccgtcataccggaatcgccaggctgctaccaatactttgacgagaagggaacgatcatctatgtaggcaaagcaaagaacctgaagcgtcgcgtttcctcct

SEQ ID NO: 189 - DNA, 4000 bp, Escherichia coli
  misc_feature (1155)..(1155): n is a, c, g, or t
  misc_feature (1244)..(1244): n is a, c, g, or t
  misc_feature (1253)..(1253): n is a, c, g, or t
  misc_feature (1265)..(1265): n is a, c, g, or t
  misc_feature (1271)..(1271): n is a, c, g, or t
  misc_feature (1296)..(1296): n is a, c, g, or t
  misc_feature (2887)..(2888): n is a, c, g, or t
  misc_feature (2991)..(2991): n is a, c, g, or t
  misc_feature (3059)..(3059): n is a, c, g, or t
  misc_feature (3081)..(3082): n is a, c, g, or t
  misc_feature (3163)..(3163): n is a, c, g, or t
  misc_feature (3184)..(3184): n is a, c, g, or t
  misc_feature (3207)..(3207): n is a, c, g, or t
  misc_feature (3220)..(3221): n is a, c, g, or t
  misc_feature (3224)..(3224): n is a, c, g, or t
  misc_feature (3226)..(3226): n is a, c, g, or t
  misc_feature (3228)..(3242): n is a, c, g, or t
  misc_feature (3244)..(3245): n is a, c, g, or t
  misc_feature (3247)..(3247): n is a, c, g, or t
  misc_feature (3249)..(3251): n is a, c, g, or t
  misc_feature (3255)..(3257): n is a, c, g, or t
  misc_feature (3259)..(3260): n is a, c, g, or t
  misc_feature (3264)..(3264): n is a, c, g, or t
  misc_feature (3266)..(3272): n is a, c, g, or t
  misc_feature (3275)..(3277): n is a, c, g, or t
  misc_feature (3279)..(3280): n is a, c, g, or t
  misc_feature (3282)..(3283): n is a, c, g, or t
  misc_feature (3285)..(3288): n is a, c, g, or t
  misc_feature (3291)..(3299): n is a, c, g, or t
  misc_feature (3301)..(3306): n is a, c, g, or t
  misc_feature (3308)..(3308): n is a, c, g, or t
  misc_feature (3310)..(3310): n is a, c, g, or t
  misc_feature (3314)..(3316): n is a, c, g, or t
  misc_feature (3318)..(3322): n is a, c, g, or t
  misc_feature (3324)..(3325): n is a, c, g, or t
  misc_feature (3328)..(3330): n is a, c, g, or t
  misc_feature (3332)..(3334): n is a, c, g, or t
  misc_feature (3336)..(3338): n is a, c, g, or t
  misc_feature (3342)..(3344): n is a, c, g, or t
  misc_feature (3346)..(3348): n is a, c, g, or t
  misc_feature (3350)..(3357): n is a, c, g, or t
  misc_feature (3359)..(3360): n is a, c, g, or t
  misc_feature (3363)..(3367): n is a, c, g, or t
  misc_feature (3370)..(3373): n is a, c, g, or t
  misc_feature (3376)..(3380): n is a, c, g, or t
  misc_feature (3382)..(3383): n is a, c, g, or t
  misc_feature (3385)..(3385): n is a, c, g, or t
  misc_feature (3387)..(3390): n is a, c, g, or t
  misc_feature (3393)..(3393): n is a, c, g, or t
  misc_feature (3397)..(3397): n is a, c, g, or t
  misc_feature (3400)..(3400): n is a, c, g, or t
  misc_feature (3402)..(3405): n is a, c, g, or t
  misc_feature (3411)..(3411): n is a, c, g, or t
  misc_feature (3413)..(3413): n is a, c, g, or t
  misc_feature (3416)..(3417): n is a, c, g, or t
  misc_feature (3419)..(3419): n is a, c, g, or t
  misc_feature (3421)..(3428): n is a, c, g, or t
  misc_feature (3430)..(3432): n is a, c, g, or t
  misc_feature (3434)..(3434): n is a, c, g, or t
  misc_feature (3437)..(3437): n is a, c, g, or t
  misc_feature (3439)..(3442): n is a, c, g, or t
  misc_feature (3444)..(3446): n is a, c, g, or t
  misc_feature (3449)..(3449): n is a, c, g, or t
  misc_feature (3452)..(3456): n is a, c, g, or t
  misc_feature (3459)..(3461): n is a, c, g, or t
  misc_feature (3463)..(3464): n is a, c, g, or t
  misc_feature (3466)..(3473): n is a, c, g, or t
  misc_feature (3475)..(3478): n is a, c, g, or t
  misc_feature (3483)..(3485): n is a, c, g, or t
  misc_feature (3487)..(3487): n is a, c, g, or t
  misc_feature (3489)..(3490): n is a, c, g, or t
  misc_feature (3492)..(3492): n is a, c, g, or t
  misc_feature (3494)..(3496): n is a, c, g, or t
  misc_feature (3498)..(3510): n is a, c, g, or t
  misc_feature (3512)..(3517): n is a, c, g, or t
  misc_feature (3519)..(3522): n is a, c, g, or t
  misc_feature (3525)..(3538): n is a, c, g, or t
  misc_feature (3540)..(3541): n is a, c, g, or t
  misc_feature (3543)..(3546): n is a, c, g, or t
  misc_feature (3548)..(3549): n is a, c, g, or t
  misc_feature (3551)..(3562): n is a, c, g, or t
  misc_feature (3564)..(3565): n is a, c, g, or t
  misc_feature (3570)..(3570): n is a, c, g, or t
  misc_feature (3572)..(3572): n is a, c, g, or t
  misc_feature (3574)..(3575): n is a, c, g, or t
  misc_feature (3577)..(3578): n is a, c, g, or t
  misc_feature (3580)..(3581): n is a, c, g, or t
  misc_feature (3583)..(3585): n is a, c, g, or t
  misc_feature (3587)..(3587): n is a, c, g, or t
  misc_feature (3589)..(3589): n is a, c, g, or t
  misc_feature (3592)..(3592): n is a, c, g, or t
  misc_feature (3594)..(3596): n is a, c, g, or t
  misc_feature (3600)..(3601): n is a, c, g, or t
  misc_feature (3603)..(3603): n is a, c, g, or t
  misc_feature (3605)..(3605): n is a, c, g, or t
  misc_feature (3607)..(3607): n is a, c, g, or t
  misc_feature (3609)..(3612): n is a, c, g, or t
  misc_feature (3616)..(3616): n is a, c, g, or t
  misc_feature (3621)..(3622): n is a, c, g, or t
  misc_feature (3625)..(3626): n is a, c, g, or t
  misc_feature (3628)..(3630): n is a, c, g, or t
  misc_feature (3634)..(3636): n is a, c, g, or t
  misc_feature (3638)..(3639): n is a, c, g, or t
  misc_feature (3641)..(3647): n is a, c, g, or t
  misc_feature (3649)..(3651): n is a, c, g, or t
  misc_feature (3653)..(3653): n is a, c, g, or t
  misc_feature (3655)..(3656): n is a, c, g, or t
  misc_feature (3658)..(3659): n is a, c, g, or t
  misc_feature (3667)..(3668): n is a, c, g, or t
  misc_feature (3670)..(3670): n is a, c, g, or t
  misc_feature (3675)..(3676): n is a, c, g, or t
  misc_feature (3678)..(3678): n is a, c, g, or t
  misc_feature (3681)..(3682): n is a, c, g, or t
  misc_feature (3684)..(3684): n is a, c, g, or t
  misc_feature (3686)..(3687): n is a, c, g, or t
  misc_feature (3689)..(3693): n is a, c, g, or t
  misc_feature (3696)..(3698): n is a, c, g, or t
  misc_feature (3700)..(3700): n is a, c, g, or t
  misc_feature (3702)..(3702): n is a, c, g, or t
  misc_feature (3704)..(3707): n is a, c, g, or t
  misc_feature (3712)..(3712): n is a, c, g, or t
  misc_feature (3714)..(3715): n is a, c, g, or t
  misc_feature (3719)..(3721): n is a, c, g, or t
  misc_feature (3725)..(3726): n is a, c, g, or t
  misc_feature (3731)..(3737): n is a, c, g, or t
  misc_feature (3739)..(3740): n is a, c, g, or t
  misc_feature (3746)..(3754): n is a, c, g, or t
  misc_feature (3756)..(3757): n is a, c, g, or t
  misc_feature (3760)..(3760): n is a, c, g, or t
  misc_feature (3767)..(3769): n is a, c, g, or t
  misc_feature (3771)..(3771): n is a, c, g, or t
  misc_feature (3774)..(3776): n is a, c, g, or t
  misc_feature (3785)..(3785): n is a, c, g, or t
  misc_feature (3787)..(3788): n is a, c, g, or t
  misc_feature (3791)..(3794): n is a, c, g, or t
  misc_feature (3797)..(3797): n is a, c, g, or t
  misc_feature (3800)..(3800): n is a, c, g, or t
  misc_feature (3802)..(3802): n is a, c, g, or t
  misc_feature (3807)..(3808): n is a, c, g, or t
  misc_feature (3810)..(3812): n is a, c, g, or t
  misc_feature (3814)..(3815): n is a, c, g, or t
  misc_feature (3818)..(3821): n is a, c, g, or t
  misc_feature (3823)..(3824): n is a, c, g, or t
  misc_feature (3826)..(3831): n is a, c, g, or t
  misc_feature (3834)..(3835): n is a, c, g, or t
  misc_feature (3840)..(3840): n is a, c, g, or t
  misc_feature (3844)..(3844): n is a, c, g, or t
  misc_feature (3846)..(3849): n is a, c, g, or t
  misc_feature (3851)..(3851): n is a, c, g, or t
  misc_feature (3854)..(3856): n is a, c, g, or t
  misc_feature (3858)..(3858): n is a, c, g, or t
  misc_feature (3860)..(3860): n is a, c, g, or t
  misc_feature (3862)..(3862): n is a, c, g, or t
  misc_feature (3865)..(3865): n is a, c, g, or t
  misc_feature (3867)..(3868): n is a, c, g, or t
  misc_feature (3870)..(3872): n is a, c, g, or t
  misc_feature (3875)..(3876): n is a, c, g, or t
  misc_feature (3878)..(3878): n is a, c, g, or t
  misc_feature (3882)..(3885): n is a, c, g, or t
  misc_feature (3887)..(3888): n is a, c, g, or t
  misc_feature (3892)..(3892): n is a, c, g, or t
  misc_feature (3894)..(3894): n is a, c, g, or t
  misc_feature (3898)..(3899): n is a, c, g, or t
  misc_feature (3901)..(3901): n is a, c, g, or t
  misc_feature (3903)..(3903): n is a, c, g, or t
  misc_feature (3905)..(3907): n is a, c, g, or t
  misc_feature (3910)..(3910): n is a, c, g, or t
  misc_feature (3912)..(3913): n is a, c, g, or t
  misc_feature (3915)..(3915): n is a, c, g, or t
  misc_feature (3920)..(3923): n is a, c, g, or t
  misc_feature (3927)..(3927): n is a, c, g, or t
  misc_feature (3931)..(3931): n is a, c, g, or t
  misc_feature (3933)..(3933): n is a, c, g, or t
  misc_feature (3935)..(3936): n is a, c, g, or t
  misc_feature (3938)..(3938): n is a, c, g, or t
  misc_feature (3941)..(3943): n is a, c, g, or t
  misc_feature (3945)..(3945): n is a, c, g, or t
  misc_feature (3949)..(3952): n is a, c, g, or t
  misc_feature (3954)..(3954): n is a, c, g, or t
  misc_feature (3956)..(3958): n is a, c, g, or t
  misc_feature (3962)..(3968): n is a, c, g, or t
  misc_feature (3970)..(3970): n is a, c, g, or t
  misc_feature (3972)..(3972): n is a, c, g, or t
  misc_feature (3977)..(3977): n is a, c, g, or t
  misc_feature (3984)..(3985): n is a, c, g, or t
  misc_feature (3988)..(3989): n is a, c, g, or t
  misc_feature (3993)..(3994): n is a, c, g, or t
  misc_feature (3997)..(3998): n is a, c, g, or t
  misc_feature (4000)..(4000): n is a, c, g, or t
ccaatgggagcgtgatacgaaggtcatgatcgtcgatcttcctgccatattggcagcggagatgacggcgattccgttcgattccgttcattgggcgacggtttctgaacgtctctgtctggcccatagcacggtccatcttctctcttccggactgcgtgctcctcccgttttcgtgtaacgacgcatgaaaaagtgcagtgcctgcgtgtactgtgtttttcctgcaacaggccggttgcccgatttgcaaccggattgcaagaatggaatattatttttgcatcatgtttacacaatcaacggaaaatcaaatgaaattcaagtatttagcagtattagtcttttttgttgcatcggcattcggcgcggctcgggctcagaatgtcaaaggtgtcgtatatggagccgacacggacgagccgctgatcggtgcatcggtgtactgggccggaacgacggtgggaaccggtgccgatgccgaaggaaattataccatacaccgggttaagggatacgatatgctggtcgccggcttcgtcggatataccagcgatacgattcgcgtcgagagcggcgtggagcgggtcgattttcgtctgtcgaacgacggggtggaactcgaggaggtcgtggtgaacagtacgctgggcggtaactacgtgaagcgggacggcattctcaaaggggagatgatctccttcgcgggcctctgcaagatggcttgttgcaacctggccgagagtttcgagaactccgcttcggtgacagtcggttacagcgacgccatttcgggtgcgcgtcagatcaagatgctcggtttggccggcacttacacgcaaatattggacgaaaaccgtccgatcatgcgcggtttgagtgctccctacggcctgagctatacgccgggcatgtggctcaattcgatccaggtgtcgaagggtatttcgtccgtgactgccggacatgaggccatcaccggacagatcaacctcgagcaccgcaaaccgaccgacgacgagcggctgttcatcaacttctaccttgacgacgaactgcgtcccgagctgaacctttcgacggcgcttcctgtaaccaaggataagaaattatcgacgatcctcctgttgcacggatcgttggatactcatttgntgggcgacatggacgacaacggcgacggatttatggatctgccgaaaacccgcctgggagcggttgcaaaccgctggctttatacggcngacaacggngcgcaggtgcgntggggnttcaagtatctggcggaaaatcgcntgagcggtcagaagcactacaaggcttcgatgcgtgaagagatggataccgactgggacaagggggccatgtacggctcgcagatcaagaaccgcgagctgaacgcctacttcaaattcggtatgccggtcggtcccggtgtctatgacgaggaccagcaggacgagcttcgttcgaacatcgctttcgtggccgattacgaccgcttccgcgaacgggcctacttcgggctcaacgattacgacggtacggacaacatggtttcgctgaacatgatgtacaaccactatttctccttccgtcattcgctgatcgtcggcgtgcagtcgcatctgcaattccttgacgagtcgctgctcaacccgacgccgtggctggatgccgccggagcctggaatctcgaccgtcaggagaacgaggtaggcgcctatgccgaatatacctacacgatcaaggacaagctctccgtagttgcgggcatacgcggggactacaacggttattacgataagttctacgttactccgcgcggtcatatcaagtggaacatcaccccgacgacgatcctgcgcggttcggccgggctgggttatcgttcgaccaacgtcatcaccgataatatcggcgttttggctacgggacggcatattacgttcgaaagaccgacggctctttcggcgggagccgccgctgtgcgcggacctctcaatcccggctctgcttacgggggatatacgacctggatggtcgcagacggcggtgcgggcaatttcaaagcgctcaaccggatggagaaagccctcaccgcaggcggtagcctgacgcagattttcacgctcgtgaaagaggaggacgcgacgttgagtttcgactacttccgcacgcaattttataattcggtgattgccgatcaggagtattcgccgaacgacatttatatttacagctcggacaaacgctcctttaccgatacttatcaggtcgatttttcgtggactccggtggagcggttcgatattttcgctacgtaccgctatacgaacagccgtatgacgatcgatcgtccggacggcagtacggcgctcgtggagcgtccgctggtaagccgttacaaggcgctgctcaacttgcagtattcgacccgctacaaccgctgggtgttcgatgtgacggctcagctcaacggtccttcgcgcctgccgacccagacgggcgacctggccgattccgagatgtcgccgacgtatccgatgttcttcgcgcaggtgacccgcaaagtcggcaagttcgatatttacgtgggctgcgagaacattctcgattataagcagaagcacccgattctgaatgcggacgatcctttctcggcgggtttcaactcgtcggtgatctggggacctctgatggggcgcaagttttatgcgggattgcgtatcaatttttattgattgaaagaacgaattaaattagttatacgacgatgaaaaaaatgattttgtgctgcctcgtggcagtattgggatgcggggtgttcgccgtggaagcgaagacgccgcagaagaagggcgagatcgttactacggtgttcacnntcgatatcgattgcgaaagctgtgcggcccgcattatgaacaacgtgccggtaatcggcaaggggatcaaggatattcaggtcgatgttccctcgaaagaggngaccgtgacctatgacagtgccaagacctcgcccgaggagctgatcaaaggattcggaaagatccggntcaaggcggaagaaaaacctgnnaaatagttatatatgggttagttaatttggatggagagccggggttccgaaaggaatcccggcttttttcgatcggcgaangtcccctcagggaagaggtanccgatcggagcaaaacggacggnatgcatccgtaannaangnannnnnnnnnnnnnnncnntngnnntttnnnanntttncnnnnnnnttnnngnngnnannnnccnnnnnnnnntnnnnnntngnaaannntnnnnnannttnnngnnncnnncccnnngnnngnnnnnnnntnnttnnnnnaannnnttnnnnnanncntnnnnagnaaanttngnnnnttttangnaannangnnnnnnnnannnanacncnnnncnnngtntannnnnatnnntnntnnnnnnnntnnnntattnnntntnngntnnngnnnnnnnnnnnnngnnnnnngnnnnatnnnnnnnnnnnnnnanncnnnngnntnnnnnnnnnnnntnnaatcngnanntnncnntnnnanantcnannntatnntntnanannnnagcnaatgnnaanncnnnctannntnngnnnnnnnannntncnntnnctatcatnncntgggnntnttnntntnngnnnnntannngntncnnnnacctnannccannnatcnnataannnnnnngnntcttcnnnnnnnnngnntanaatttcnnngngtnnnagggctgantnnagnnnnttnttntnatttnntnnnannagnnnngnnannnnnncannaaatntaantnnnncnacnnnangnantgngnntnnnttnntntttnnnntnnatgntnttgnntntntnnntangnntnggttnnnngatngtancnannanttnnnanatannnntngnnntatnnnnnnnancntgaantccaaanngtnncatnngtnncn

SEQ ID NO: 190 - DNA, 4000 bp, Escherichia coli
  misc_feature (2434)..(2434): n is a, c, g, or t
cggtatataaaggatctgaagccttctaatctaatggatatatcggccatgatcgccctgtaccggccgggccctatggagaacatagacgacttcatcgacgcgaaattcgggcgtaaagccgtcacctatccagaccccagcatgaaagaattgctggatgagacctacggcatcatcgtctatcaagatcaagttctgttgattttgcagcaattcgctggatacacgctgggcgaagccgatatcgtccgcaaagccatgggaaagaagattgcttcgttgatggctgaggaaagggaaaagtttgtggctggggctgcggcaaaagggtttgaagaaagcctggcaaccagtgtattcgacctgatagagcctttcgccggctatgcattcaacaaggcccacagcgttagctacgccctgatttcctattggacgggttatttcaaaacccactatcccttggagtatatggcggcggtgctgaattcccggctggaccatcccgaaaaaatcgtaagctcgatcaacgagtgtttccggttgggactacccgtgctgttgccggatatcaaccagtccgaggagttctttaccattgaccaggatagcggaccaacagccggcatccgtgttggtttggccgccgttaaaaccgtgggagaagctgccgtgcgtcccttggtggaagaacgtgaggccaacggcccctatgagtccatcgacgatttctgtcaccgggccggttccagggggctcaataggcgcaccttggagagtctaaccaaggcgggggctttcgacagtttggctacccgcggggccatgctggactccctagaccaaattgtcgcctttgcccaactggaggccaaaagccgaagttccggccaatctagccttttcgacggatcttccaacgatgatggagccggccttctgccaggcatcgaactgggagattccgacgttccccctgaggaaaaagccacttgggaaagggagttgttgggggtttccttgtcctacaatccgatgtggcaactggctggcctgaatgccggagacgcttttaactccttcgaccaacttgacgacgacatgcagggacaatctgtgtctttgctgggccatatctcagccgtcaacgaacggttcaccaaagaacagaaaagattcgtcgtggtaaccctggacctcctgggcggcgccgtggaagtagtggtctggccgaacgtattggagcgtacccaacaggtatggaccgagggtaagatattaagagtcacagggaaattgcggctccgcggggaccaactttccctggcctgtgatcaggctcaggagcacatgtctaatcaggcgccatcgaccggcggtaacggaaacggtattatcaatgggaatggaaccggcaacgggaaacacagcggaaatggaaactctaacgggtcgtctaatggacaccctcaaaccgcgcctgccagccgcccaaatccggagctcgccgccgcgaacgggggttcctatcggactttgtctctggccgtgacagaatcggacaacgccgttaacgacgcccacatgctacgggaagtcattggagttttgctggagtattccggccaagaccgggttaatctggacattcatacgctcaccgggcgagttatcatggacctgacgccggtcaacaccggttattgcgatgagctgagtgagcggctatcaagtttgcttggcgccggttcagtccgaatcaacggctcccaggatacggagtccgaatagacgcaaagttgtctccattggatctccttcctttccatttgcatcagatggcctgttcccctatttagcagacacctctcccatcggcacctcggatagccaactacctgccaacgcgcgcccggcttagtgagccgtggctattgcgcaaatgctgcctaggtgattccccacgcaacttacatcgtaatttttttaggcgatgttctacgatttactctgccatagccatacttttgcagatttaatccggatttcacaactggctgtgtgatttgactcaaagaccacgtagaaatgtatgaagaacgccaaaagttgaatttgacgggtaccggacgtgctgctaaactcgcccgagttaacgccaggttttacgccggtatagccaaccggcgggccactttcaattaaaaggtcttccccgaatctgacgttgacgttatcgttatgagagtatcttgtgtagagacgaagccagctttatccatgaaaacggtcttaactgaccggggactcccgtgctgcccgtctcttgaaaacaagtccggccgtctactcagatgttccctcccccgcgagccctagttacttcccttccgggtccgtcacgtaatcctgggcgcaattctgtgagctncctatccctttattccgcacggcagtttccatggattctttttatggcatccaaatcgggactacctgagacctcggcgctcacaactaagaaaacattggtgaaataacaaacatgaaggaccaatccagttcattggtggacctagacgcggagttcgtcaatgagttagctcggaatttttggtactcggcaatcttgcgagccgccataaaactcgacgtcttttccctgctggaaggggtcagtttgacttcccaggaggtggcttcgggcatcgatgcgtcgcccaggtacacccagtcattcctggattgttgcgtggtcttggaattgttggatagcgatgacgctaagtacaccaactcatccctcacctctaggttcctggtaaaaaataaacctgcatacgtgggggaccacgcccttcaccataccaatacttgggcctcgtggggcaggcttgacgagatagttcgggagggcaagacccttctgccttatgagactgggttcgttgacgcagacacctactggtccgactacatgattggccagcacaatcgggcgacttcgggtcaggcgcattatctggtggagagcctcgaccttagagataagcgtaagctccttgacctggggggtggagctgccagctacagcatagccctctgtgcgggcaatccccagttgaaggcagtggtggctgaccaaaaagagccccttgccattgccaaacccctggtcaaggaaagcaacctggaagaccgtatcaccctgctggaaggagattttttccagaccgatcttggtagcggttacgatgtcgtcctcatatctggggtcgtcctgataaagccggaagaagattctcgccaactgatcaagttggcatacgatctgatggaaccgggaggtctgatcgttatccaagactacatgaggatagatcacgactcacagcggaatcgtttggataccctggaagacctatacgttcttgtagctttcgatccaggcgccggcgaccgtgaaggggaagaagtagcggattggcttcaaaaggagggattccaaaatactgaattgattggattacccacccaactgggcgtggtcaccggggaaaaacccgcgtaggatcgtttcgatagattgtcaccggtacaagcttattaagattaacttgactgatttgggagattaatctcagacaggaagaggtggtataccatgattttggacaacaaactttcgcccttcgaacggctcaagtcgctacgggagtgcatcgaccgcaagggtttcgcccgcattatggaagctcacagcggcctgagcggcatcattgcggaaaatgtccgggtcgagaagaacggtcaagttttggaattcgacggtctttgggagagtagcctgacggactcagcctccaagggcctgcccgacgcgtctatcgtcggcaacgattcccgcgtccacaccatcaatgagatactgactgtcacgtcgaagcccctcatagtggatggcgacactggcggcgaacctgcccagttcgagtac

SEQ ID NO: 191 - DNA, 4000 bp, Escherichia coli
  misc_feature (1962)..(1963): n is a, c, g, or t
  misc_feature (1965)..(1966): n is a, c, g, or t
  misc_feature (1968)..(1969): n is a, c, g, or t
  misc_feature (1978)..(1978): n is a, c, g, or t
  misc_feature (1984)..(1984): n is a, c, g, or t
  misc_feature (1992)..(1993): n is a, c, g, or t
  misc_feature (1999)..(1999): n is a, c, g, or t
  misc_feature (2013)..(2014): n is a, c, g, or t
  misc_feature (2016)..(2017): n is a, c, g, or t
  misc_feature (2023)..(2023): n is a, c, g, or t
  misc_feature (2025)..(2026): n is a, c, g, or t
  misc_feature (2029)..(2029): n is a, c, g, or t
  misc_feature (3924)..(3924): n is a, c, g, or t
agagaaaaagcccgtctgggatggggatgtaattgaatttgggcgcggcgcggcgcaattgactttctgtgcgggggagaaaaagtaacgcctccctcattgtgctgatattactcgcccggctccaggtgacattcgttgtcacagggagccgggcttttgtatatttgcctggcttcgtagccagacgggaagcgccgggactcgcttttctcggcacgcgcgccgcatccgtgaacgcggtgtatcctggccgggaaacactatgaaagcggtagaacgcaccgaaagccaacgttgttgttggaattcgtaggattgttcctgttgcggttggcggagcggacgttgttctcattgttgttccacgagccgccgcgcagcacgttctccggcgtccccacatcatgaaaatgatgttatcaagtttgcggcagggttttcatccagccgcctaatagtttgccgatttccgtcaatgcttcggcggcaaaaagatattgcgcatgatcggtcagttttcggttgtgcgccagccgaaggtacaggcgcagcttatccagttccaggtcggcggccagcaaaatatgttttttattgccagatttcaccgcctgaatcaggtcttcgtaaaagtcgaacgcggcgtcctcgatgcgtttggccagccggaaacgttcgctcttgggatatttctctgtatgctgcaacagccagagcaaaaagttggatgttttcgtaaaaatcggggattgttgtttgtcattcatacttcacctgcatcatgaaagatcgcccggcgaagcccccaggtatcgccgtgacggatatgttcggcccatgcctgcgctcgaatgagcacatcttcccgctcaagcgctccgacgcgataatcagccgccaaatggcgcaaacggcggcggaaggcgtaacccttggcaggtttgaggcggcggtgatccggaaagacgatgaaaccaagaaatgtaatcccattcgcgcagggacgcggctgggcgctattctcgtggatggtcaggcgcagacccgctaggaattggataatttctgcacgccattgccgtaattcggtcttgttgttggaaaacagcaggaagtcatccacgtaacgcaaataggcgtgcaccttcaaccggcgtttcaagaactggtcgagttcgttcaagtagacattggcccaaaactggctggtgagattgccaattggcaggccgcgcggccggttggctgaaaaaagcgtatcacccggaaaatagaccatctcatattcttccgtcaaaatgccatctccgctggccaggattcggtcaatcaaccgcatcactttttcatctccaatggtgcgcgccaggatattatgcaaaattgcatggtcaatggatggaaaaaattgcttcacatcgcacggcagaacatatttgtaccgccgcatgaaatgggtacagcggtccagggcgcggtgtgtgcctttccccatttggttggcataactatcgaatatgaatttgcgttccaggggcggtccaataacattaaccaacgcatgatgaacgacccgatcccgaaacggggcggcagaaatctttcgccgtttgggttcatgaaccataaaactgcaatagccgcccggatggtaggtttcctcccgcaattcatcccgcagggaaatcagttccgcttcgaggttgtattcgaagtgcgccacccccggctggctgcgccgcccggcagaggcttttttgaaagcctgccaaaggttgaacaggtcatagatttggggataggcagcatcacattgttttgccatactcaaaatctcaaaaaatcgattcggggggcgcattgcgccccccgaacccccggcgcgagtcagaaaatcagaaaaccagaaaacaggattccagaaccattacggcgagagaacgcaccgaaagccaacgnngnngnnggaattcgnaggatngtccccgnngcggtnggcggagcggacgnngnncacatngnngtnccacgagccgccgcgcagcacgcgaacctccccggaagccggtccggttgggttcgatgatggcgattggctgtaataggtctcgccgtaccagtccgccacccactcccagacgttcccggccatatccaatgctccatacgggctggctccggagggatatgacccaaccggtgccgtgaattcatacccgtcattcacgtttttatctgcccaatccacattgagattgacatcggcaaaattcagcaggtttccggcaggactctgattgccccaaggataggtgcgcccatctgtgccgcgcgccgctttctcccattccgcctcgctgggcaggcgcgcccccgcccacccgcaataggcttcggcgtcattccacgacacatgcaccagcgggtgatcattcaagccggccagacccgaagagggtccctgcgggtgctgccaatccgctccggagacatcgttccagttagcgccatcgaaaacatatgaactacctttaccctctgcgtcggtctggtagcctgttcgttcaacaaacagggaaaacatggcgttggtcacttcggtctggtctatccagaaagcatccaaatacaccgtatgaacaggttgttcgtctgaactgccatcattgctgcccatcgtgaagttcccttccggcacgtaaaccatcagcatcccgtccgccgggcgcgtccaggtggagccgatgccgagggctggaggttgggttgccactggcgcttcagtttcaacaggcgcttccgtagcaaccggggcttctgtgacaatgggaggcgcgggagcaactggaaccacgccgccgccagccagcgcgaagatcagggcgattgccaacccgcctataattatcaaaccacctgccagtgcaatcggccagtagcgaagcaggccagatgaactggatggcgcaaccgtctgtatggagggcgcgcgcggcgcgggtttgtctttggcggtcacatcatcccattggttgatggtcgcctgtgtatccagcgtgcgttcgcgcgggcgcgcgggttgcggcttcgctggcgcggcaactccgctgagaatggattccagcgcgatagcaaggtcgctcatgctctggtagcggtcgcccggcttcttcgccagcgctttgagcaatatctgctcgacgcggtcgggcaaatccggcacaaactgcttcgggcgcggcaaaggctcgctggcctgtttgatgatcacccccagcggagtatctgcctcgaagggacgccgcccggtcagcatttcatagaaaacgatgcccagggcgtaaatatcggcgcggttatcggcggttttggcggaggcctgttcgggagccatgtactccggcgtgcccaccgccatggccgtgccggtcaagtccactgtggcctcctcttcgatgactttggccacaccgaagtcggtcagcatatattcgccggactgggtgatgagaatgttggagggcttcacgtcgcggtggatgacaccctggctgtgggcatactccagggcatgcgccaaggggatgagggtgcgagccgcttcctgccagttcaaccgtccgcgctctttgagcagtcctttcaggttgccgcccggcaagaagggcataaccaggtagggacggccttcgtactcgccgtagtcggtcaccttgacgatgttggggtgggtcagccgcgccagggccttggcttcacgctcgaagcgtttcagggcgcgcgccagcacctccggggtgaacttctcggtgcggataaccttgaccgccacgtcggtttcgaggcgggtatcaaaggctttatagaccaccgccatcccgccctcgccgagcggctcgaggatgtggtagcgaccgaggnattgaccgatgaggttggtcataatattctcctgctgttgcggatggtttcggttgggaggtggatgatgtgtatg

SEQ ID NO: 192 - DNA, 4000 bp, Escherichia coli
  misc_feature (127)..(127): n is a, c, g, or t
  misc_feature (133)..(133): n is a, c, g, or t
  misc_feature (145)..(145): n is a, c, g, or t
  misc_feature (166)..(166): n is a, c, g, or t
  misc_feature (169)..(169): n is a, c, g, or t
  misc_feature (175)..(175): n is a, c, g, or t
  misc_feature (178)..(178): n is a, c, g, or t
  misc_feature (216)..(216): n is a, c, g, or t
  misc_feature (385)..(385): n is a, c, g, or t
  misc_feature (498)..(499): n is a, c, g, or t
  misc_feature (513)..(513): n is a, c, g, or t
  misc_feature (517)..(517): n is a, c, g, or t
  misc_feature (559)..(559): n is a, c, g, or t
  misc_feature (622)..(622): n is a, c, g, or t
  misc_feature (634)..(634): n is a, c, g, or t
  misc_feature (637)..(637): n is a, c, g, or t
  misc_feature (666)..(666): n is a, c, g, or t
  misc_feature (685)..(685): n is a, c, g, or t
  misc_feature (706)..(706): n is a, c, g, or t
  misc_feature (709)..(709): n is a, c, g, or t
  misc_feature (711)..(712): n is a, c, g, or t
  misc_feature (721)..(721): n is a, c, g, or t
  misc_feature (736)..(736): n is a, c, g, or t
  misc_feature (742)..(742): n is a, c, g, or t
  misc_feature (745)..(745): n is a, c, g, or t
  misc_feature (760)..(760): n is a, c, g, or t
  misc_feature (775)..(775): n is a, c, g, or t
  misc_feature (780)..(780): n is a, c, g, or t
  misc_feature (790)..(790): n is a, c, g, or t
  misc_feature (796)..(796): n is a, c, g, or t
  misc_feature (802)..(802): n is a, c, g, or t
  misc_feature (823)..(823): n is a, c, g, or t
  misc_feature (825)..(825): n is a, c, g, or t
  misc_feature (829)..(829): n is a, c, g, or t
  misc_feature (832)..(832): n is a, c, g, or t
  misc_feature (835)..(835): n is a, c, g, or t
  misc_feature (838)..(838): n is a, c, g, or t
  misc_feature (844)..(844): n is a, c, g, or t
  misc_feature (853)..(853): n is a, c, g, or t
  misc_feature (880)..(880): n is a, c, g, or t
  misc_feature (883)..(883): n is a, c, g, or t
  misc_feature (888)..(889): n is a, c, g, or t
  misc_feature (904)..(904): n is a, c, g, or t
  misc_feature (907)..(907): n is a, c, g, or t
  misc_feature (919)..(919): n is a, c, g, or t
  misc_feature (934)..(934): n is a, c, g, or t
  misc_feature (940)..(940): n is a, c, g, or t
  misc_feature (955)..(955): n is a, c, g, or t
  misc_feature (1018)..(1018): n is a, c, g, or t
  misc_feature (1036)..(1036): n is a, c, g, or t
  misc_feature (1048)..(1048): n is a, c, g, or t
  misc_feature (1060)..(1060): n is a, c, g, or t
  misc_feature (1063)..(1063): n is a, c, g, or t
  misc_feature (1066)..(1066): n is a, c, g, or t
  misc_feature (1078)..(1078): n is a, c, g, or t
  misc_feature (1114)..(1114): n is a, c, g, or t
  misc_feature (1117)..(1117): n is a, c, g, or t
  misc_feature (1171)..(1171): n is a, c, g, or t
  misc_feature (1174)..(1174): n is a, c, g, or t
  misc_feature (1184)..(1184): n is a, c, g, or t
  misc_feature (1262)..(1262): n is a, c, g, or t
  misc_feature (1294)..(1294): n is a, c, g, or t
  misc_feature (1326)..(1326): n is a, c, g, or t
  misc_feature (1339)..(1339): n is a, c, g, or t
  misc_feature (1363)..(1363): n is a, c, g, or t
  misc_feature (1383)..(1383): n is a, c, g, or t
  misc_feature (1449)..(1449): n is a, c, g, or t
  misc_feature (1468)..(1469): n is a, c, g, or t
  misc_feature (1471)..(1471): n is a, c, g, or t
  misc_feature (1473)..(1475): n is a, c, g, or t
  misc_feature (1477)..(1481): n is a, c, g, or t
  misc_feature (1483)..(1483): n is a, c, g, or t
  misc_feature (1488)..(1489): n is a, c, g, or t
  misc_feature (1491)..(1491): n is a, c, g, or t
  misc_feature (1494)..(1495): n is a, c, g, or t
  misc_feature (1497)..(1498): n is a, c, g, or t
  misc_feature (1500)..(1500): n is a, c, g, or t
  misc_feature (1508)..(1508): n is a, c, g, or t
  misc_feature (1645)..(1645): n is a, c, g, or t
  misc_feature (1933)..(1933): n is a, c, g, or t
  misc_feature (1945)..(1945): n is a, c, g, or t
  misc_feature (1948)..(1948): n is a, c, g, or t
  misc_feature (1954)..(1954): n is a, c, g, or t
  misc_feature (1974)..(1975): n is a, c, g, or t
  misc_feature (1984)..(1984): n is a, c, g, or t
  misc_feature (1986)..(1986): n is a, c, g, or t
  misc_feature (1992)..(1993): n is a, c, g, or t
  misc_feature (3239)..(3239): n is a, c, g, or t
  misc_feature (3750)..(3750): n is a, c, g, or t
tctgcataaatccctttgtacataatcaccgatattttaatcgggatcggttatcttataaaagcatttaccccggtcaccgattggttgtttaataatctttgccgaacagggttcatccaacacnacatcnttcaactgtttnataagagcctccgaaccggtnaangtgatntgntccacccaatccatttttggagaaccgtcatcatcagngagcaaagctccggtcttgtcctttacctgctcgtagatgtcatactggatgatcaggcattcacccttgtacttggaggcttttatctcgaagcctttcaggtggatttccctgttcaaaatgtcatcaatgtggtacttatctcccgtgagattaccactgctgttngttacttcactgaatgttttcatattgagagtttttaataaataaatactattgcaatgctgcatgaaccccaaccggctggatgcctttatccggatctcctcatcgctcannccacgttttcgtantttngccacctcccggcagaggtttttcttgttctgcttgcgggcnaggcaataatcatggaacgtcacgtatcccacgtaattgacacccctgctctctaccgggaanacctgataattnggntttatactcaaagcacgttcattattcangtagtggttgataaacacnagggttccgtggagtttctcnttntnnccatccagnaggacaatatcatcngcaaancgntaatagtaccggatncccatttcttctttnatganatgatccagntcgganaaatanaggttagcaaagaattgggananatanttnccnatnggcacnccgttctcngccgagtccacgataccgtcaagcaangcnagcanncgggcatctttcagnttncggcggattacntgtttcatgatctcntggtcnatactcggataaaanttgcgcacatcgattttcaggcagtaccgggttccctccggatccgctttcaaatcacggcgnagcttgtataaaagaggntgaataccacgnccacggatacangantangtatcacgggtnaaattggagagccatatcggttcaatcacctgcatnatngcccaatgaacgacacgatcacggaatggcagtttgaatatcttccgctctttnggntcgtaaatgntaaaagtcttgtactcggaggtgcggtaagtaccggtgataagttcacgctggagctgtaataggttcgcctccaaangggagccgtactctattacttcgcttcggcgngttttgtgacgggcggcgttgtgaaacgcctnttcgagattgccntattcgacaactcgttcaaacaantttccataccttttcatggnctgtttctgcggttctgagtgtctgagtgtctgctttgccttactcggaagcgttcgaaccgttancggcctaccagcgtccttnngngnnntnnnnntnttttnncnagnngnnangtctttcnccccatctaaccgtttcctaactgcaaagtataggggagcggacacattcgcattcgaattcgaggctgcattgttcgtattcgtagcaaacgcccctgcattcgtgccattgttagcgttagcaccggagaggcgnacacgaagcctgcgtcacactaagggtaaaacaacctgttaaacttggtttaacgatgcaaagataagccttttaaatacatttacccaaaaccggcaaaaaaatcacaaaaatcgactcgccttacggcgagttctgaaacccgccgaacagcttttccaaaactctcaatacaaaatttcaaagaacgttcttttcctctttccgttttccgttttcgttttaagccgacatcaccggatccgcatcgaaaaagcagaggggagcggacacattcgcattcgaatncgaggccgcatngtncgtatncgtagcaaacgcccccgcanncgtgccatngntagcgnnagcaccggagaggcggacacgaagccctttggatgatgctgaattctcccaaaaatagtcacagaaataagtcgaggcggtcgctccgatttcggtcggcatggcgcaaagcaagtagtaacttttctgtttgatataaccgctggttctcggaacctcgcaaaccttgataaggccggaaatcgaattgtcatcataaccggcataaagggacggggcaacatagacctcagatttctcatcacccacgttatcgataagcccccggacaatcttccaaatatgaccgaaaggatgtttcaggccgaagaacaccggaacctttgctgcataatgcaacgagccgtcctcctttagcacgttaaacgtggtttcaccgcaaccgtcacccagctcgataccggcagaggtcggaacaaccgggtaataaccccactgatcccaattcggcatattggtggttccggatccgaggccaccctgatacaaaccgttgctgtccttttcagcaatcacggcctcctgcatattgcgggttccgaatatgatcatgaaaagaatttcaaccaccgcctgagccacgtaccagttggcatcccaaccctcgccacgcttgcgggcataagttgaaaaattacggtactgcatattggttgcaaccatccccaactgcgtgcggtaagtcccgtcccggcttgcatcattgtttccaccacgatattgggcggcatcactcacaaccgaacaaaggatattgttcgtcctgtccatcacgccaccaccgagggcggaaaggccaccggcgggaatatacacgcactgtttgcctttgatgggagaaagggaaacggcataatatttcaaattacccactttccactcggcaaaataaaaaccaatattccaacaccacatatactgtcccatcgtgccgtccagcttcgccggtgtaccgtcctcgaaacggtagtggttcgtgggatccagcttgcgccgggtacggtcatcctgaacgaggtaacaaccaagtcccaacagctctggcagcttgcggagcatatcgaggctgccgtgataaccggcagcccggtacgtggaattcgattcattccaataacgtccacaaacggcgtttgcggcggtggtaaccgcctcggacaaattcataactttggactctccgtccgtgtccagcacctcgatgcgcatatcgctcacgctgccggaggcagtatcgagttcgctnatcttctttccggcttcaaaagccgaaagcatcgctaacacacgggtttcctgatcgcttgtcatatttatcaagtttttaagttaaacgtattctgcctttactgtcaatccggattttaccgcctccggtaaggcggacggacggagcctgaaccgtcacgtttatggtcttgtacaagtgggtggcctgtgtcgggatcacgtgaatccggctcgttccgattttcaacggggttacaacaccggcgggatccacgctcacggccacgtcatcacccaagaacaaaacattctgcagggagtacgaggggaacatcttggcaacgatacgctgaacgtaaggattacgctgggtgatgcgtttcgtgtaggtcagttccatcctcgtaggagccaatgaagctgcacccgatatggattcctgcagctgcttcatcttctcgatttcggcctctgctgtggtggccgtactactcgcacgggcggcagcggcaagggcttccgatttngccgcatttacagagctggcctccttattcgccgtatcagctgcggaggacgctttcgtggcggcatttgtggcattggaggcagctccgttggccgattccgtggctttctttgccgcttcggtagctgctccggcagtaccggcggcatcattggcacttttggcagcattattggccgctgtggttgccttatccgcattacctgcagacgtgttggcttttgctgcggcttcattggcggctttcg

SEQ ID NO: 193 - DNA, 4000 bp, Escherichia coli
  misc_feature (1989)..(1991): n is a, c, g, or t
cggcgttgaacccatggttaggtaacctttggaaggtgatgcgggaagcgtgccctttgcctatagacttgaaagatccaacggaccaggaaattgcaaatgctccgctgccagattctcgattcatggttgacattgttgaacctccaagcagtacatctgagcgaccacgttatgaacgcctcactgaagcgcagcaagcgctacgactggcagtcgcagcagctgatgctagcgacgcaggaacgtcgttctcattagaagattacaacttaaaacagcgctgtagaggatgtgtctacgacggaattgtggtggagaataagagtttgacaagtcaagacgcagtgaaagaggtgcgtcatttggaatttaaaccgcaagaagcttgtgaattagcatatgaggctggcgatattttgggaatcataccactcgcggtagacgtcgattgtcctaaacttctatcgctcatcggacgtttggggatggaccccgagggatgggtacgtgtgtatccatcttccacacctgaaatgaaacactcggtgccgtctgttcaagtgaaatatctcatagcaggcgcaattgatattgattcagcgtcaccaagacgttatttctttgaagtcatgagtcactttgcgggttcgtcactcgagcaagagcgtcttcagtattttgcttccgcggagggtgcggtggacttgtacaagtacaatcaacgtgagcgtagaacagtgtttgaattttttgatgatttcccatctttgagcccgtctatggcatggtttttgcaagttgcgccaagtttaaatccacggtattattctatatcatcatcaccgttcgatacagcgagcacaggtgctgtgcacatcaccgtcgcttcggtggcttggacaacgccgatgaaacgtcaacgtaaaggcctgtgctcagcatggttggcttcattacgcgtgggtgataaagtacagtatacgatcgaaaaaggatcaatcactttgccgccacaagatgttccattaatattggttggtcctggtacaggaatcgctccatttcgatcatttactcgagagcgactgcgacaaatagaagtcactcgttctatagagggccatgaaaaatctacgtgggcaccgacgctgattgttttcggttgccgagatgcccatcgcgattacttgtacaagaatgagtggaagtcggtaggaggtgatttagcgctcactggtgcgagcggtttgggtggtgtcgtcgttgcgttttctagaatgcaggataaaaaatattacgtgcaagattgcatcaaggatgaatctaaacgtatatgggcattgcttgaatcaggcgcgaaggtgtatgtcgctgggtctgcggaaaagatgccagcagcagtgtatgatgcgtttcgtaacgtcgtgcagactcaaggttcactgagcgacgatgaaagcgcgcgatacatgattcgtttaggaacaagtggaagatatttcgtggatgcatggtagaatcttttgtagaacgtaaaacaaaacatttagacgagttgcggtacgtcgcaattgtgatcgtagtatcttgtgatcaatcaacgaagcgattgaagaaaaatctcatcgactcatcgaggatacgtgcagccttcttgtttaacttttttcagcacagatgtatcgattccgagagattgcgcagcggatcggatttcatctgcgtctgcaagtggattacgatggaataaccacaatcctcccgatggttcgcacgaaccgtcagatttaagcttcgtcaatggaccgccgctaatgatcgcccaagagtatccctgtgcttcaaattctggagtgccgggtattgtatctgttgccacgacccaataaggtccgtaaagacgttttggtagaaattttgggccaacgagaagtttcgcgggatttgaagggtcttcaacaatgccacgaagtttcatgtagcctnnngcattccgcggcgttccattgacactgtcccgtacggcggtgttccaaacttcaatttcgtcgtcgtcaacaagcgtgtagtttgcacgcacgcaaaacaaatcgcgttcaggttgataccaggttgttttttgttcgagcacgtaccattccgcgctcacgtacgagttcaaatcgaatggtgacacgggtttcacattcaagcaatatccccgttgtctcgcaggctgagcgttggcgtcatcggcgtcggcgtcggcttgcgcgcacgccatcgcggtcgacgctaacaagatcaaaagtgcacgagtgagaatgaagtgctgcatgtgggtgcgtcgttgatgtgatttctgtggattcttgcgtgcttcgcaccaccgtcgtcgcgttcgagtatgaagcgaaacgtcacatgggaccgacaaaaaaccagcggtctggcggtggggtggtttgtgtcgttgtgacttgcaaacgacgacgacggcggggcgcgcgacagagtgcgacgacgagaacgaggactatgatgacgatgacaacgcacgcgagagtgacgacgcacgcgatgatggcggcgcggaggtacgtatcatacgcacacgtacctggcgataacgacgagctgacagcgattgggaccgatggattgtgcccgacgcgcgttggcctaacctttcgtatttattcgtcgtcatcacacagtttaaagacgaagcggacgcagatgactgcgaatggtgatcgcgtgggtgttagagttcgcgcgagcgcgaacgcctcctctgagcccgtggtgatttccctcaaggtggatggcatgatgtgcgacggatgcgctgagagtgtggagacgtgtttgaagaaagcagaaggtgtgagtgtgtcggcggttgatgtaaatttagacacgaagatagtcaaagtgagcgtggactgcgcgagtgtcgtcgaagggttgacaaagcttcccgcgcttgtcgaagccgtccgagcgggtggatttgaggctgaacccgaatttgattaatacacttgaatataatacattatcataccgcaatgtcacacactagactgatcgtcgtcactgcagagattctggaatgcgttgatgagggctggagagggcgatgcccgtactaatcgggacggagttgacgaaagttctctctcttggtctttggattcaggctgctgctgctgctgttgctgctgctgcgttaaaatgttagcgaaactctgctgcagcaaatcttccattttttgtgacaaactcgccaccgatgcgttcaagtgtgagagtatccgactttccatgtctgcgagcgcgcgctgcaacgcgtcgtcgccactttttgtaagcggtggtgatatcgagggtgaatcctcttctccgtctcgatcgtcgtatgtttcgtgtcgcccacaaatacgataattatcatcatcttcctcatcgactttgaggttcggtaaaagtgtctggagtaacaccttccctgacagcgagcgcgattgcgaaggacaaccatcgccgtcgtcgttgccaacagctctcttcgtcgtcctcatcggcgttgtcgtcgccgaggataacccagctagaatatgcaaaagcggcgaatcacaaatctcggatgtaatcggtggcgtcatttgacgcgtgccaccgccgccacactccggtgatgttttccacggagttgactgatgtggcggtggcgtgctcggcggtggtggcgccgtggctccgacgaatcgcggtggtgtcgccacgtccatcatatcgcacccgctgtgcgtggcaataatattttaaattcgtcgtgtcgtggcgcgtcagtcgcggcgggttctcaccacacacgcacacccccgcttggagccgagacgaaaacgctcgcaccgacgtgcgcgttacgcctgtacgcgtcgcgacaagatcgctcggacgatgcgcgtccgtcgaatatcgatattaagtattttgtatgctacaaagg

SEQ ID NO: 194 - DNA, 4000 bp, Escherichia coli
  misc_feature (1939)..(1940): n is a, c, g, or t
  misc_feature (1945)..(1946): n is a, c, g, or t
  misc_feature (1948)..(1949): n is a, c, g, or t
  misc_feature (1957)..(1958): n is a, c, g, or t
  misc_feature (1973)..(1973): n is a, c, g, or t
  misc_feature (1978)..(1979): n is a, c, g, or t
  misc_feature (1984)..(1985): n is a, c, g, or t
  misc_feature (1987)..(1987): n is a, c, g, or t
  misc_feature (1999)..(2000): n is a, c, g, or t
  misc_feature (2005)..(2006): n is a, c, g, or t
  misc_feature (2011)..(2011): n is a, c, g, or t
  misc_feature (2014)..(2014): n is a, c, g, or t
cgtaatttactgagtaaatacggctatttgtccgtagaaatgcaaaatgccatcaccaatgactacgagggtgacgaaacttcacagcgtgaaatattgaccgacaattacgcaaacaaacagttgattgatgcggaagatgtgagctttgaaagcgtgtcaagcgagcaacaagcggaaactattgaccccggatattgatagcgtatgaaactgatagttcttggttcaagtagtagtggcaactgttacattttggataacggtaatgaagctctgattatagaggctggaatccgtttccaagaagtcaagaaagcgttggatttcaatctgagaaaggttgtagggtgtgtggtaacgcacgcccacaacgaccacgccaaatatattaaggcaatggtggatagtggatttcacacgttggcattacgggaggtatggactgcaaagggcgtttgggattcccgttctttggtggttaaagagggcaaaggctataagatgggtaattttaaggtacttccttttcctgcttgccatgatgtgccatgtgtcggctatctgatagaccaccccgatatgggaaagatggtatttcttaccgatagctgtatgtgcgaatatcagttcaaggggcttaaccatgtgctgatagagtgcaattactctgataagaagctcattgaggcgattacagccgggcgcacgttgccctcacagcgtgaacgtctgcttacctcacacatggagcttactacgtgcaagggttttttggaagcaaacgacttatcccatgtttcggaaatcgtgcttttacacctttccgagaataatagcgatgagccttatttcatatcggaggtagaaaggcatacggggaaagtggtttatgcggcaaagccgggtttaacgattgatttagacagaacataaggatatggctaaactccaagtagaaaagagaaacgggttatttgatttgaagcctctatacgaatggatgcgtaacgctttggatggtatttataggatagaggttaagaaagtcagaaagccacgttctttagaccaaaacgggtggttgttcgggtgtatttaccctatccttttagacgctcttttggaagctggttgggagttcgtttcagtagaacaagtgcatgagttttttaaggctcaaatgacggctgacaaagtggtaaataagcacacgggggagattatagagttcccgtgttctacagccactatggacacggtgacattctccacctattgcgaaaaactgagggagtacgccaaagagtttctgaatgtggatattcccgacccggataaatattggagaagccatgaaaagaatacctaacagcgtggtatctgagctgatacgcttagtgcccattttgatagcaaatattccacccggacaaagtacgagagtggataacgcaataagattaacaaagaagattatcaacaaattaaaaacattgaaagatgaaagtagaaattgaagaaagcaagttgcaaacagcttatgcaaatgcttgtgatggagttaaggattttatggaaagcctgtttggaaagaaggtgtttgaggctgcaaagcccacgttggacgattacaagactatccgcacgtatgaggatgcttgtgtggcgttaaaacaagatgcaataagagtggatagtgtgaatagagatactaccacagttttaaccaatggaggtgatagggtaaatatgccatcccatattgttgctcttatgaaattagaaactattagtcgagctttgtggggtagagatttccagccaaagccggatggagagggaagcaaagtgtattggtatccgtggtttgctttgtatactaagaaagaaattaatgatatgtatcccgaacaaagaggtgcccttttgtctgctnntgcgnntnntggtgcgnntgcgggtttcggttntctgnntgcgnntnatcgttcctcgnntgcgnntgcgnacnttgggttccgcttgtgccaagaaacagaagaaaaggctaagtatttcgggcagcaattcattgaactttgggctgaatatttgaaattcaactttaccgttggaaatcgcttgaaataaaagtgtgtttattaaacatattattaactaaaaacaaggtgaaatgaaagacatcatgttagccgataccccggtggaacaaagggcacagattctacgtgatagctgcgaccaaattgtagagcgtagctacacacgcaaattcgaccaagaagaaatcaacgaaaggagggcagacctcgctaacgtggcgattcaaaaggcggatttggaacaatcattagcggaaatcagagccgattacaaaggcaaaatcaagcctttggaggaacgcatagttaaacttcgtgacgaactgaaagctgggggcgattggattaagggcgactgtttcaagtttgtagatgaggaagaaaaaatggttggcttctacagcccggagggttatttgctggaacaacgccccatgacacaagacgaaaggcagcgtaacgtgttccgtgctatccgtgcggataaaacgggtacagacgattaagtattaataattaaaacatttcaaaatggaaaatcaagaaaaaggattaaccgtgaacatcggtgagtacaagggtgaaaaacctatcgaagtagtgtacagaattggtaatgctcctaaagcattggacgaattgcccattaagcaaccggaaagtatttctgtatcaggtgttatcagaactccgttagattggttggaaaagcgtattgacaccatcgaccaaaagcgtgcgaatattaaggtaaaccgtgagaaaatgagtatcacgcttaccgtgaatgaggatgattattacaccaaaaacacctttgtaggtacggtggaattatcggaagtcttttcaaagttcggtatcaatgacggagaatgtggctggattccggctaaactggggcagttcctgcgtttgaatcgtggcgtattcatgcaaaaagaggattgtatgaagctcgtttcggtattaaagaacttcacggctaacgccaagacagaaattcagaaacagcgtgacccgtccggctctatggctgaggtgtaccgttcacaagtagaaagtaatttgcccaagagtttcacgattaacatcgccattttcaagggaactgcaaaaacacctattgaagttgagttcgaccactatctttctaatggtgatgtgttgttgcaacttgtttcgcccggtgctaacgaactggcagaggactatagagataagtgtattgacgaggtgttagacggcattcgtgccattgccccggacattgctattcttgaaatctaaatactatatcgtgggggagaaatcccccacttataacagctcataatatggctaataaaaaaatcataccgcctatgcctttcgatgccaccgcttggttatccaacaatgcggctatgaggttgtcatttgcttgtaagggcttgtggctggatatgctttgctgtatgtgggtgagtatagagcgtggggttatgatgaaacctattggcggtgcgtacacggttgatgaattagaagccctctacggaagtggaacaaaggagctgatagaatcattgattaacgctgaattattgtctgtaaggaatgatggggctttgtacaacgctgatatggttaagatggaatcaatacgggtaaaacggtctgaggctgggaaaaaaggtggtgtaactatgggtaaacggatattagccaaagttgatgcgcttgtggaaacgccaccgacagaaatgccacatacaccttccccaacggctgaaacgcaacacggggcgcaagcagacctatttcccgatgatttgccggagaatccaccgccactgactgatgaacaacagcggaagattgcaaaagccaagaagtacaattatgctgattac

SEQ ID NO: 195 - DNA, 4000 bp, Escherichia coli
  misc_feature (773)..(773): n is a, c, g, or t
  misc_feature (1623)..(1623): n is a, c, g, or t
  misc_feature (1672)..(1672): n is a, c, g, or t
  misc_feature (1942)..(1942): n is a, c, g, or t
  misc_feature (1952)..(1958): n is a, c, g, or t
  misc_feature (1960)..(1962): n is a, c, g, or t
  misc_feature (1964)..(1965): n is a, c, g, or t
  misc_feature (1967)..(1967): n is a, c, g, or t
  misc_feature (1969)..(1970): n is a, c, g, or t
  misc_feature (1972)..(1975): n is a, c, g, or t
  misc_feature (1977)..(1989): n is a, c, g, or t
  misc_feature (1994)..(1995): n is a, c, g, or t
  misc_feature (1997)..(2002): n is a, c, g, or t
  misc_feature (2005)..(2009): n is a, c, g, or t
  misc_feature (2011)..(2012): n is a, c, g, or t
  misc_feature (2014)..(2019): n is a, c, g, or t
  misc_feature (2021)..(2025): n is a, c, g, or t
  misc_feature (2029)..(2029): n is a, c, g, or t
  misc_feature (2031)..(2033): n is a, c, g, or t
  misc_feature (2035)..(2036): n is a, c, g, or t
  misc_feature (2038)..(2038): n is a, c, g, or t
  misc_feature (2040)..(2042): n is a, c, g, or t
  misc_feature (2044)..(2048): n is a, c, g, or t
  misc_feature (2361)..(2361): n is a, c, g, or t
  misc_feature (2529)..(2529): n is a, c, g, or t
agcggcgtcgtggccgcgtggtcgaggtagacgctcacgcctgggagcgcgcctcctcgatgatcgccagggcggccgggaccacctcggtgacgtcgccgaccacgccgaagtccgcgatctcgaagatcggggcgtccgggtcgtcacacacggcgacgatgtgggcggcggactgcatgcccaccgtgtggtggatcgcgccggagacgcccaggccgatgtacaggttcggggtgacggtcagaccggtctggccgatctgctcggatcgcggggcccagccctcgtcgcaggccacgcgggtcgcgcccacggcgccacccagggcgtcagccagggagcggaccagctcaaagtcgccgtcgacgccacggccgccgcacacgacggtggaggcgtcggtcagggacacgccgtcctcctcgtctgccacgaaggacacgacctcaaccgccgctgcttccgcgctcagctcgacggccaacggctcgggggtcagggaggcgggcgaggccaccggggcctcgtcaatgacgccggaggaaatacccacgatgggggtctggccctccaggacgatgcccatcgaccaggagccacccagggcggtcttgccgacctggaggacgccaccgtcgaaggacacggaggaggcaccggagatgacgccggcctcggtcagggcggcgacgcgaccggcaatctcgcggccacggtagtccgagcacagcagcacgaggccgtaggagtcggtgcccagcgcggcgatnaccgcgtcggaggcggccacggaggcgtgaccggccggacccaggtcggcgtgcagcacgcgggtcgcgcccagctcggacagggctgccacgtccggcgtgggggccacagacagggcgacgacgtcggcggaggtcagggaggcggccagcgtgaccgcctggcgggccagggacgtcaggtgcgtcccggactggtcggccaggacaaggatcggggaactcatctgctgcgtcatgtcacttcaccaccgaaagaatgtagtcggccagcgcacgcccgccctcgccggcgtcctggatgatcgtgcccgaaccgtcgcgcacgttctcctcgctgaaggtcacggaggtcagcgcgcggcgcatcaccagggtttcgccgccgggaacctcgacgaggtcgtcgatgccccactggtccaggggcttcttgcgcgcggccttcatcgccgcgaaggccgggtagcgcggctcgttgatctggtcggtcacggagacgacggcgggcagggccgcgcgcagcgtctcggtaaagccgtcaacggagcgttcgatcgtggcgacgccgtcctcgacgctcagcgtgcgggccaggcccagcaacggcatgtgggccttggcggccagggcgccgggcagcatggaggtcatcgcgtcgagggacgccatgccggtgacaaccaggtcgacggggccgcactcgtcggagatcttcgcgatcgcgacggagagcacggaggccgtcgtaataacgtcggagccctcgaggaactcgtcagaaaccaggaaggcgcggtccgcgcccatttgcagggcgcgcatgagcgcgtcctcggcgtcctcgggncccatggtcagggcgatgacctcggcctcgcggccagcgtcctcttcgntttccttgagctggaccgcagcctcgatggcgttctcatccagttcgttgagcacatcgtcctcaccgcgcaccaggcggccgccctcaaaacggcgttcggactgcatgtctgggacatgcttcacacacacgacaattctcatggcttctagcgtgccacattcctggcccctcgcccatatgagggtcacctcaccggcgcacaccacagtccgcgcgcggggcaccctcctgtgtgtgcgcacgttctatgcgccttcccataggnctttttcccnnnnnnncnnncnncntnntnnnngnnnnnnnnnnnnnggggnnannnnnnttnnnnngnnannnnnncnnnnngggntnnncnngnannngnnnnnttttatgtccgagcgatccggctcgtcccctgctcccacacggcgcgtcaccgaacctaacccgcagcccacccgcctgggcgtctacccgtcgggcgacgggctcgacgtcgcggtgatcgcgcgcaacgcctcgggggtggacatgtgcatcttcgacgaggccggggctgagacgcgcttcgctctgctgggtccgaagaccggcgtgtggcacgggcacattccgggctacggtgcgggcacacgctatggattccgcgcgcacggcacctgggacccggacggcggcaagttctttaactcccacaanctcctgctggacccctacgggcgcggcgtggacggattcgtggacatgaagcccgccgtgtacgcccacagcgtggacgaggatctgtacccgtcggaatacccgatgcgtcgctcccccatcgattccgctccctacatgccgcgctcggtcgtggtcgagccctcnttcccgatcatcccccagcccgacatcccctgggagacctcggtcatctacgagatccacgtcaagggattcaccaagaacatgcccggcgtgcccgagcctctgcgcggcacctacgcgggcctggcccacccggcgtccgtgtcctacctcaaggacctgggagttacggccgtggagctgctgccgatccacgccaagtgcgatgagcctttcctcaccgagcgtggcctgacgaactactggggctactcgacgctgtccttcttcgcgcccgaaccctcctacgcgaccgccgactcgcgggcccgcggtgcccaggccgtcgtcgacgagttccgcggaatggtctccctcctgcacaaggcaggcattgaggtcatcctcgacgtcgtctacaaccacacctgcgaaggcggagacgcaggcccctccctgtcgtggcgcggcctggactccgacatgtactaccgtcacacgaactcgcgcccggttcagagcatcgacgtgaccggcaccggcaacacgatgaacatggacaatccccggactatccagatggtcctcgactcgctgcgctactgggtgcgcgacatgggagtggacggcttccgcttcgacctggctgcgacgctggggcgttttgccaccggctttagcccgatgcacccgctcctcatcgcgatggccacggacgacatcctggcccgcaccaagctcattgccgagccttgggacgtcggccccggcggctggcaaaccggcaactttcccgttccattctccgagtggaacgaccactaccgtggtgccttgcgtaacttctggctggcggatgtgcgcgcccaggcctcgggccacatcgtgttcggccccaacgacctggcgacccgcttgtccggatcccgggacgtctttgatcatgggctgggtcggctgcgcggaccgcgcgcctccattaacttcgtgaccgcgcacgatggcttcaccctggcggacatgaccgcctacgaccacaagcacaacaaggacaatctcgagaacaaccgcgacggctcagacgataaccgctcgtggaaccacggcctcgagggaacgctcgcgtcgggcgcgacccaccctgattccgcgacgccctaccgaatcctggccaacatgccgatcgcgcagctgcgcgcgcgctcgcagcgcaacatcctggccaccatgttcgtctcctcgggaacgcccatgctcacgggcggcgacgagttcggacgcacccagtacggcaacaacaacgcctactgccaagacggcccgatctcctgggtcgactgggacctggccgagggccagcaggcccagatcgacgccgtctcctggctgatcgccctgcgcaaggcgcacccggtgctgcgccccgactccttcgcgaccgggcgacccttcggcggggactccatcgccgacctgtcgtggtacaccgccc

SEQ ID NO: 196 - DNA, 4000 bp, Escherichia coli
  misc_feature (1950)..(1950): n is a, c, g, or t
  misc_feature (1956)..(1956): n is a, c, g, or t
  misc_feature (1962)..(1962): n is a, c, g, or t
  misc_feature (1968)..(1968): n is a, c, g, or t
  misc_feature (1974)..(1974): n is a, c, g, or t
  misc_feature (1980)..(1980): n is a, c, g, or t
  misc_feature (1986)..(1986): n is a, c, g, or t
  misc_feature (1990)..(1990): n is a, c, g, or t
  misc_feature (1992)..(1992): n is a, c, g, or t
  misc_feature (1998)..(1998): n is a, c, g, or t
  misc_feature (2008)..(2008): n is a, c, g, or t
  misc_feature (2010)..(2010): n is a, c, g, or t
  misc_feature (2014)..(2014): n is a, c, g, or t
  misc_feature (2016)..(2016): n is a, c, g, or t
  misc_feature (2025)..(2025): n is a, c, g, or t
  misc_feature (2028)..(2028): n is a, c, g, or t
  misc_feature (2031)..(2031): n is a, c, g, or t
gcttgcgcatatcgcctcgtggcgggaggcatttcggggcttcggggcgaagccacagcgcacgcgcaactgtctcgaagccctcacccgccgcgccgagaaaggtctaccgcgggtgaacgcgcttactgacgtctacaacgcgatctcggtgctgcaccagattcccctcggcggcgaggaccttcatcgctacaacggcccggcacgtctgatccgtgccacgggacaagaatcgttcgacacgaccgcgaacggagaggccgtgatcgagcaccctgaaatcggtgaggtcatctggtgcgacgacgccggggtgacgtgccggcggtggaattggcggcagggtcgacgcaccggcctcaccgataccactcggacggcgttgttcatcctcgacgccctcgccccagttaccgacgaggaactgcacgccaccagcgacgcactcattgaggcgctggcgaacctaggcgaaaacgtgcagaccacaacacggctgataggcgcgcaacccagcgggaactgacgacgaaatcacgatcatcacactcactgtgctcgattcgaccggccaccatgcctatcacctgggcgaacatacccacattgcagagctgaccgtcgagcatacgagatcaacactcacgtccaccggcatcaaaggcctgcgcagctcacgcgtcctcacccgtgtgagatacgtcgcaagtaggctccatcagtatcgctgactggatgcttatcaccacgttcaaagtacgcgcatgtaattcgtacacctatgcaataaaagcagccgtgtgggttttagtgtgattatttttgttcgtgtcggtaatcgacatatgcgaaaaaggcgagctgtcttagtggtagcatttcagcttgttaaccgcaggttagctatcaccaagtttccaacccctaggagaaacgatgcgtcgaacaagaatcactgtggcagctgtgacagcaactgccttaatcggctcactatcagctatcacccccctccccgcgaatgctgcttctaacgggaacagctccataacccagtcagctgccttcagcccccgcgccacgacaaagatcagcgaggactgccgcaaagccatcatcaacgacctgaaactgcgcggcgcgatcgtcggagcactcgtcaaggctggactcagcgcagccgacgcagccgccctggccccccgtatcgccgccgaaatggcagcagagggtacccttaccatcaaccatcaccgactgaaggtcctcgtcgcttcccagctgggcctcgtagcagacgctgcggtccaacacgcagctgcagccatcgacctcagcttcaaggccatcctaggcgcgtcgatcatccccaacgcactaggatcagccgcgttcaagaacgcggtcatcgcaaacctcgtcgctgctggtatcgacaagcacctggcacgagccaccgccgtggcgatcgtcgccaccgcactgaaccccgccctcgggcccatcgcgaagttcgaactcatcaaagctgagatcgccgcccaagcagctcttctcatccgaaggggcgtccatctccagaaggcagccatcgagcacgtcatcggccgcgccttcgacgccgctgtcgcgaccgcgattatcagctctccgatcctgagtgcacgcatcgtcactcacctggtcagggctggaatagacaagtccattgccatcagccttgcaccgcatatcgtcaagcgcctggccaaggagccgctactggcgttcaacaccgccaagctcgtcaaggacatcgcccggcaaatcgtcgacatccgcaacacccaggaagccatagcagtctacaagcaactcaaggctgaactaccaaccctggacggactcgtgcagaaggcctgcacccccgagccgactcctacgccgaccccgactcctacgccgacnccgacnccgacnccgacnccgacnccgacnccgacnccgncnccgacnccgacaccgncnccgncnccgacaccnacnccnactccgacaccgacaccaacgcccactccaacaccgaccccaaccccaacccacggggccacaaccaccacgccgatcagccggacaacggaccgccacaacctcgggtctcatcacacccgcatcgcggcccccgcactgatccacgcgaaggccctcccagcaacaggaacgggagcctgacagcctcaggaaacaacgcaaggttcctctcacaactaacaatggtcgtggtcccacaagcctgtggaccacgaccatttacattcccccaagcaaatgactcgcatacgggtgttctccaggaacaaccacagcaaaatcaccaacctaccgagaaacaatgcttggatccagctccacatccttcggatagactatctccaaggggtaatcaaacgctcgtctgccaagcggaaaatataccaacgctgtaacaacaaggcccacgagccacgagatgtccgctccacccatcgctgcggcgaccggccccacataaaaggcctgagagatgaacggaatctgcacaaccacgcctagcaaataaacaacaatggtcggccagtggagcttgccataacggcccctcggagtgtacagcgcaggaatgtcaatacagccacgacatataaggtaatagttcagcaagttgatcgccgaccatggcaggaaaaacatcagcagagtcaagatgaaagacttgaaaacttgcagaaaatccgacgacgccgcgagcgccgtcaggacaaccacaacattgaaaccaatcacgaaaccgaaacgagtcttcggagagacactactcttaccggtgaaacccgaaagagctgtcgacaacgccatgactccgccatacgcattcaaggtgttgatggtcagcttgccaatcacaatggagatgaaaaccaagatcgccaaaacacgattctgggcaaggttccccataaacccaacctgatcgccaatgaaagcttgaccaccagcagcagcaatgaacacacccagcgtcatcgaaatcgtagctccaagtactgatcccgcgaagggaccgaaccacgcactcccaaacttcgtgtcacggggaagatagcgtgagtaatcactggcatacggtgcgtaagtcaactgccatcctgccgctaaagcaatcgacaggaggaaaggcaccaccgagaagtgcacatcggtcagctgcggcccaaaggaactcacttggaacagacgaaccgcgacataaagcagccccaggaggccaattgtcgatgacaccttccccagcttgtggattaggtcatacccaaacatggcaataattgccgtcagagctgcaaaaaccagtattccgatccacctggactggacaccaaatgcattgttgatagcttgtccagccaagacagttccagtagcagcgaagccaaagtagagaagcagtacgagaaacagcggaagcgcagcaccataaacgccaaactgtgcccgcgaactgatcatttgtgggagccccagcgcgggcccctgagcggaatggagcgccataacagcgccgccgatgacttgcccaataaaaaggccaattatcgcccatacaacatcggccccgaaaacaatcgccaaagcaccattcacgacagccgtaatctgcatattcactccgaaccacagtgtgaactgactcttcggagtgccgtgcctttcgccgtcaggaaccatatcaatcgttcgcttctcaacaccgcgaccagccccagaagcggttggagccgtatttccatgacgaatttcatcctgagcactatttggcgcggacaccacaattcctcctaccgagcgacggccatgtcgctttacagtcgcccacaaggacttcatccttctctgaacgagatacccattgcacctgcgggatagtgccattcaagcgagcctggcgcagcaaccgccagacaagtgccacactccagac

SEQ ID NO: 197 - DNA, 4000 bp, Escherichia coli
  misc_feature (1960)..(1961): n is a, c, g, or t
  misc_feature (1963)..(1968): n is a, c, g, or t
  misc_feature (1970)..(1977): n is a, c, g, or t
  misc_feature (1979)..(1979): n is a, c, g, or t
  misc_feature (1981)..(1986): n is a, c, g, or t
  misc_feature (1988)..(1989): n is a, c, g, or t
  misc_feature (2036)..(2044): n is a, c, g, or t
  misc_feature (2046)..(2046): n is a, c, g, or t
  misc_feature (2048)..(2065): n is a, c, g, or t
  misc_feature (2113)..(2118): n is a, c, g, or t
  misc_feature (2120)..(2120): n is a, c, g, or t
  misc_feature (2122)..(2126): n is a, c, g, or t
  misc_feature (2129)..(2137): n is a, c, g, or t
  misc_feature (2139)..(2141): n is a, c, g, or t
  misc_feature (2188)..(2190): n is a, c, g, or t
  misc_feature (2192)..(2192): n is a, c, g, or t
  misc_feature (2194)..(2197): n is a, c, g, or t
  misc_feature (2199)..(2200): n is a, c, g, or t
  misc_feature (2202)..(2208): n is a, c, g, or t
  misc_feature (2210)..(2211): n is a, c, g, or t
  misc_feature (2213)..(2217): n is a, c, g, or t
  misc_feature (2264)..(2286): n is a, c, g, or t
  misc_feature (2288)..(2299): n is a, c, g, or t
  misc_feature (2303)..(2304): n is a, c, g, or t
  misc_feature (2306)..(2306): n is a, c, g, or t
  misc_feature (2310)..(2313): n is a, c, g, or t
  misc_feature (2315)..(2315): n is a, c, g, or t
  misc_feature (2320)..(2321): n is a, c, g, or t
  misc_feature (2323)..(2324): n is a, c, g, or t
  misc_feature (2327)..(2329): n is a, c, g, or t
  misc_feature (2331)..(2331): n is a, c, g, or t
  misc_feature (2333)..(2334): n is a, c, g, or t
  misc_feature (2336)..(2336): n is a, c, g, or t
  misc_feature (2338)..(2342): n is a, c, g, or t
  misc_feature (2344)..(2347): n is a, c, g, or t
  misc_feature (2349)..(2353): n is a, c, g, or t
  misc_feature (2355)..(2357): n is a, c, g, or t
  misc_feature (2359)..(2360): n is a, c, g, or t
  misc_feature (2362)..(2365): n is a, c, g, or t
  misc_feature (2367)..(2375): n is a, c, g, or t
  misc_feature (2378)..(2380): n is a, c, g, or t
  misc_feature (2382)..(2382): n is a, c, g, or t
  misc_feature (2385)..(2389): n is a, c, g, or t
  misc_feature (2391)..(2391): n is a, c, g, or t
  misc_feature (2396)..(2397): n is a, c, g, or t
  misc_feature (2399)..(2400): n is a, c, g, or t
  misc_feature (2403)..(2405): n is a, c, g, or t
  misc_feature (2407)..(2407): n is a, c, g, or t
  misc_feature (2409)..(2410): n is a, c, g, or t
  misc_feature (2412)..(2412): n is a, c, g, or t
  misc_feature (2414)..(2414): n is a, c, g, or t
  misc_feature (2416)..(2426): n is a, c, g, or t
  misc_feature (2429)..(2431): n is a, c, g, or t
  misc_feature (2433)..(2434): n is a, c, g, or t
  misc_feature (2436)..(2440): n is a, c, g, or t
  misc_feature (2444)..(2451): n is a, c, g, or t
  misc_feature (2454)..(2456): n is a, c, g, or t
  misc_feature (2458)..(2458): n is a, c, g, or t
  misc_feature (2461)..(2465): n is a, c, g, or t
  misc_feature (2467)..(2467): n is a, c, g, or t
  misc_feature (2472)..(2473): n is a, c, g, or t
  misc_feature (2475)..(2476): n is a, c, g, or t
  misc_feature (2479)..(2481): n is a, c, g, or t
  misc_feature (2483)..(2483): n is a, c, g, or t
  misc_feature (2485)..(2486): n is a, c, g, or t
  misc_feature (2488)..(2488): n is a, c, g, or t
  misc_feature (2492)..(2500): n is a, c, g, or t
  misc_feature (2502)..(2503): n is a, c, g, or t
  misc_feature (2505)..(2505): n is a, c, g, or t
  misc_feature (2510)..(2522): n is a, c, g, or t
  misc_feature (2524)..(2526): n is a, c, g, or t
  misc_feature (2530)..(2531): n is a, c, g, or t
  misc_feature (2534)..(2534): n is a, c, g, or t
  misc_feature (2537)..(2538): n is a, c, g, or t
  misc_feature (2540)..(2541): n is a, c, g, or t
  misc_feature (2543)..(2543): n is a, c, g, or t
  misc_feature (2548)..(2549): n is a, c, g, or t
  misc_feature (2551)..(2552): n is a, c, g, or t
  misc_feature (2556)..(2557): n is a, c, g, or t
  misc_feature (2559)..(2559): n is a, c, g, or t
  misc_feature (2561)..(2562): n is a, c, g, or t
  misc_feature (2564)..(2564): n is a, c, g, or t
  misc_feature (2567)..(2580): n is a, c, g, or t
  misc_feature (2582)..(2588): n is a, c, g, or t
  misc_feature (2590)..(2590): n is a, c, g, or t
  misc_feature (2592)..(2594): n is a, c, g, or t
  misc_feature (2597)..(2602): n is a, c, g, or t
  misc_feature (2606)..(2607): n is a, c, g, or t
  misc_feature (2609)..(2609): n is a, c, g, or t
  misc_feature (2613)..(2616): n is a, c, g, or t
  misc_feature (2618)..(2618): n is a, c, g, or t
  misc_feature (2624)..(2624): n is a, c, g, or t
  misc_feature (2626)..(2627): n is a, c, g, or t
  misc_feature (2631)..(2632): n is a, c, g, or t
  misc_feature (2634)..(2634): n is a, c, g, or t
  misc_feature (2636)..(2637): n is a, c, g, or t
  misc_feature (2642)..(2647): n is a, c, g, or t
  misc_feature (2649)..(2649): n is a, c, g, or t
  misc_feature (2651)..(2653): n is a, c, g, or t
  misc_feature (2658)..(2660): n is a, c, g, or t
  misc_feature (2665)..(2665): n is a, c, g, or t
  misc_feature (2667)..(2674): n is a, c, g, or t
  misc_feature (2676)..(2677): n is a, c, g, or t
  misc_feature (2680)..(2680): n is a, c, g, or t
  misc_feature (2682)..(2682): n is a, c, g, or t
  misc_feature (2684)..(2684): n is a, c, g, or t
  misc_feature (2687)..(2687): n is a, c, g, or t
  misc_feature (2689)..(2693): n is a, c, g, or t
  misc_feature (2699)..(2699): n is a, c, g, or t
  misc_feature (2701)..(2702): n is a, c, g, or t
  misc_feature (2706)..(2707): n is a, c, g, or t
  misc_feature (2709)..(2709): n is a, c, g, or t
  misc_feature (2711)..(2713): n is a, c, g, or t
  misc_feature (2716)..(2722): n is a, c, g, or t
  misc_feature (2724)..(2727): n is a, c, g, or t
  misc_feature (2729)..(2730): n is a, c, g, or t
  misc_feature (2732)..(2733): n is a, c, g, or t
  misc_feature (2735)..(2735): n is a, c, g, or t
  misc_feature (2737)..(2739): n is a, c, g, or t
  misc_feature (2741)..(2741): n is a, c, g, or t
  misc_feature (2744)..(2751): n is a, c, g, or t
  misc_feature (2753)..(2753): n is a, c, g, or t
  misc_feature (2757)..(2757): n is a, c, g, or t
  misc_feature (2760)..(2760): n is a, c, g, or t
  misc_feature (2764)..(2764): n is a, c, g, or t
  misc_feature (2766)..(2767): n is a, c, g, or t
  misc_feature (2769)..(2769): n is a, c, g, or t
  misc_feature (2775)..(2775): n is a, c, g, or t
  misc_feature (2777)..(2778): n is a, c, g, or t
  misc_feature (2782)..(2783): n is a, c, g, or t
  misc_feature (2785)..(2785): n is a, c, g, or t
  misc_feature (2787)..(2788): n is a, c, g, or t
  misc_feature (2790)..(2790): n is a, c, g, or t
  misc_feature (2792)..(2795): n is a, c, g, or t
  misc_feature (2797)..(2797): n is a, c, g, or t
  misc_feature (2802)..(2805): n is a, c, g, or t
  misc_feature (2807)..(2808): n is a, c, g, or t
  misc_feature (2811)..(2815): n is a, c, g, or t
  misc_feature (2820)..(2829): n is a, c, g, or t
  misc_feature (2834)..(2834): n is a, c, g, or t
  misc_feature (2839)..(2844): n is a, c, g, or t
  misc_feature (2850)..(2851): n is a, c, g, or t
  misc_feature (2853)..(2854): n is a, c, g, or t
  misc_feature (2857)..(2859): n is a, c, g, or t
  misc_feature (2863)..(2865): n is a, c, g, or t
  misc_feature (2868)..(2868): n is a, c, g, or t
  misc_feature (2870)..(2875): n is a, c, g, or t
  misc_feature (2878)..(2881): n is a, c, g, or t
  misc_feature (2883)..(2883): n is a, c, g, or t
  misc_feature (2888)..(2889): n is a, c, g, or t
  misc_feature (2892)..(2893): n is a, c, g, or t
  misc_feature (2895)..(2905): n is a, c, g, or t
  misc_feature (2908)..(2910): n is a, c, g, or t
  misc_feature (2912)..(2912): n is a, c, g, or t
  misc_feature (2915)..(2919): n is a, c, g, or t
  misc_feature (2921)..(2921): n is a, c, g, or t
  misc_feature (2926)..(2927): n is a, c, g, or t
  misc_feature (2929)..(2930): n is a, c, g, or t
  misc_feature (2933)..(2935): n is a, c, g, or t
  misc_feature (2939)..(2940): n is a, c, g, or t
  misc_feature (2945)..(2948): n is a, c, g, or t
  misc_feature (2950)..(2956): n is a, c, g, or t
  misc_feature (2958)..(2962): n is a, c, g, or t
  misc_feature (2965)..(2980): n is a, c, g, or t
  misc_feature (2985)..(2986): n is a, c, g, or t
  misc_feature (2991)..(2995): n is a, c, g, or t
  misc_feature (2997)..(2997): n is a, c, g, or t
  misc_feature (3002)..(3003): n is a, c, g, or t
  misc_feature (3005)..(3006): n is a, c, g, or t
  misc_feature (3009)..(3011): n is a, c, g, or t
  misc_feature (3015)..(3017): n is a, c, g, or t
  misc_feature (3020)..(3025): n is a, c, g, or t
  misc_feature (3027)..(3030): n is a, c, g, or t
  misc_feature (3032)..(3037): n is a, c, g, or t
  misc_feature (3039)..(3056): n is a, c, g, or t
  misc_feature (3059)..(3061): n is a, c, g, or t
  misc_feature (3063)..(3063): n is a, c, g, or t
  misc_feature (3066)..(3072): n is a, c, g, or t
  misc_feature (3077)..(3078): n is a, c, g, or t
  misc_feature (3080)..(3081): n is a, c, g, or t
  misc_feature (3084)..(3086): n is a, c, g, or t
  misc_feature (3088)..(3088): n is a, c, g, or t
  misc_feature (3090)..(3092): n is a, c, g, or t
  misc_feature (3095)..(3101): n is a, c, g, or t
  misc_feature (3103)..(3107): n is a, c, g, or t
  misc_feature (3109)..(3110): n is a, c, g, or t
  misc_feature (3112)..(3119): n is a, c, g, or t
  misc_feature (3121)..(3131): n is a, c, g, or t
  misc_feature (3134)..(3138): n is a, c, g, or t
  misc_feature (3141)..(3147): n is a, c, g, or t
  misc_feature (3153)..(3157): n is a, c, g, or t
  misc_feature (3160)..(3161): n is a, c, g, or t
  misc_feature (3163)..(3168): n is a, c, g, or t
  misc_feature (3170)..(3173): n is a, c, g, or t
  misc_feature (3175)..(3177): n is a, c, g, or t
  misc_feature (3180)..(3181): n is a, c, g, or t
  misc_feature (3183)..(3184): n is a, c, g, or t
  misc_feature (3186)..(3188): n is a, c, g, or t
  misc_feature (3190)..(3196): n is a, c, g, or t
  misc_feature (3198)..(3203): n is a, c, g, or t
  misc_feature (3205)..(3207): n is a, c, g, or t
  misc_feature (3210)..(3211): n is a, c, g, or t
  misc_feature (3218)..(3223): n is a, c, g, or t
  misc_feature (3229)..(3229): n is a, c, g, or t
  misc_feature (3231)..(3232): n is a, c, g, or t
  misc_feature (3236)..(3237): n is a, c, g, or t
  misc_feature (3239)..(3239): n is a, c, g, or t
  misc_feature (3241)..(3244): n is a, c, g, or t
  misc_feature (3246)..(3249): n is a, c, g, or t
  misc_feature (3251)..(3251): n is a, c, g, or t
  misc_feature (3254)..(3257): n is a, c, g, or t
  misc_feature (3259)..(3259): n is a, c, g, or t
  misc_feature (3261)..(3269): n is a, c, g, or t
  misc_feature (3271)..(3274): n is a, c, g, or t
  misc_feature (3276)..(3276): n is a, c, g, or t
  misc_feature (3278)..(3283): n is a, c, g, or t
  misc_feature (3286)..(3287): n is a, c, g, or t
  misc_feature (3290)..(3290): n is a, c, g, or t
  misc_feature (3293)..(3293): n is a, c, g, or t
  misc_feature (3295)..(3298): n is a, c, g, or t
  misc_feature (3304)..(3308): n is a, c, g, or t
  misc_feature (3311)..(3313): n is a, c, g, or t
  misc_feature (3316)..(3319): n is a, c, g, or t
  misc_feature (3322)..(3324): n is a, c, g, or t
  misc_feature (3326)..(3327): n is a, c, g, or t
  misc_feature (3329)..(3331): n is a, c, g, or t
  misc_feature (3333)..(3337): n is a, c, g, or t
  misc_feature (3339)..(3339): n is a, c, g, or t
  misc_feature (3342)..(3355): n is a, c, g, or t
  misc_feature (3357)..(3359): n is a, c, g, or t
  misc_feature (3362)..(3364): n is a, c, g, or t
  misc_feature (3366)..(3366): n is a, c, g, or t
  misc_feature (3369)..(3373): n is a, c, g, or t
  misc_feature (3375)..(3375): n is a, c, g, or t
  misc_feature (3380)..(3381): n is a, c, g, or t
  misc_feature (3383)..(3384): n is a, c, g, or t
  misc_feature (3387)..(3389): n is a, c, g, or t
  misc_feature (3393)..(3394): n is a, c, g, or t
  misc_feature (3398)..(3401): n is a, c, g, or t
  misc_feature (3403)..(3404): n is a, c, g, or t
  misc_feature (3406)..(3409): n is a, c, g, or t
  misc_feature (3411)..(3413): n is a, c, g, or t
  misc_feature (3415)..(3416): n is a, c, g, or t
  misc_feature (3418)..(3418): n is a, c, g, or t
  misc_feature (3420)..(3420): n is a, c, g, or t
  misc_feature (3422)..(3431): n is a, c, g, or t
  misc_feature (3433)..(3434): n is a, c, g, or t
  misc_feature (3438)..(3440): n is a, c, g, or t
  misc_feature (3442)..(3442): n is a, c, g, or t
  misc_feature (3445)..(3449): n is a, c, g, or t
  misc_feature (3451)..(3451): n is a, c, g, or t
  misc_feature (3456)..(3457): n is a, c, g, or t
  misc_feature (3459)..(3460): n is a, c, g, or t
  misc_feature (3463)..(3465): n is a, c, g, or t
  misc_feature (3469)..(3470): n is a, c, g, or t
  misc_feature (3475)..(3479): n is a, c, g, or t
  misc_feature (3481)..(3485): n is a, c, g, or t
  misc_feature (3487)..(3487): n is a, c, g, or t
  misc_feature (3489)..(3489): n is a, c, g, or t
  misc_feature (3491)..(3495): n is a, c, g, or t
  misc_feature (3497)..(3504): n is a, c, g, or t
  misc_feature (3506)..(3508): n is a, c, g, or t
  misc_feature (3510)..(3510): n is a, c, g, or t
  misc_feature (3515)..(3518): n is a, c, g, or t
  misc_feature (3521)..(3526): n is a, c, g, or t
  misc_feature (3532)..(3536): n is a, c, g, or t
  misc_feature (3539)..(3541): n is a, c, g, or t
  misc_feature (3544)..(3547): n is a, c, g, or t
  misc_feature (3550)..(3554): n is a, c, g, or t
  misc_feature (3556)..(3561): n is a, c, g, or t
  misc_feature (3563)..(3563): n is a, c, g, or t
  misc_feature (3565)..(3565): n is a, c, g, or t
  misc_feature (3567)..(3567): n is a, c, g, or t
  misc_feature (3570)..(3570): n is a, c, g, or t
  misc_feature (3572)..(3577): n is a, c, g, or t
  misc_feature (3579)..(3587): n is a, c, g, or t
  misc_feature (3590)..(3592): n is a, c, g, or t
  misc_feature (3594)..(3594): n is a, c, g, or t
  misc_feature (3597)..(3597): n is a, c, g, or t
  misc_feature (3599)..(3602): n is a, c, g, or t
  misc_feature (3608)..(3612): n is a, c, g, or t
  misc_feature (3615)..(3617): n is a, c, g, or t
  misc_feature (3620)..(3623): n is a, c, g, or t
  misc_feature (3626)..(3626): n is a, c, g, or t
  misc_feature (3628)..(3631): n is a, c, g, or t
  misc_feature (3633)..(3640): n is a, c, g, or t
  misc_feature (3644)..(3647): n is a, c, g, or t
  misc_feature (3649)..(3649): n is a, c, g, or t
  misc_feature (3651)..(3653): n is a, c, g, or t
  misc_feature (3655)..(3662): n is a, c, g, or t
  misc_feature (3667)..(3668): n is a, c, g, or t
  misc_feature (3671)..(3671): n is a, c, g, or t
  misc_feature (3673)..(3678): n is a, c, g, or t
  misc_feature (3684)..(3688): n is a, c, g, or t
  misc_feature (3692)..(3698): n is a, c, g, or t
  misc_feature (3701)..(3701): n is a, c, g, or t
  misc_feature (3703)..(3706): n is a, c, g, or t
  misc_feature (3708)..(3719): n is a, c, g, or t
  misc_feature (3721)..(3725): n is a, c, g, or t
  misc_feature (3727)..(3733): n is a, c, g, or t
  misc_feature (3735)..(3739): n is a, c, g, or t
  misc_feature (3742)..(3743): n is a, c, g, or t
  misc_feature (3745)..(3746): n is a, c, g, or t
  misc_feature (3749)..(3753): n is a, c, g, or t
  misc_feature (3755)..(3755): n is a, c, g, or t
  misc_feature (3760)..(3764): n is a, c, g, or t
  misc_feature (3768)..(3770): n is a, c, g, or t
  misc_feature (3773)..(3773): n is a, c, g, or t
  misc_feature (3776)..(3776): n is a, c, g, or t
  misc_feature (3778)..(3782): n is a, c, g, or t
  misc_feature (3785)..(3785): n is a, c, g, or t
  misc_feature (3787)..(3793): n is a, c, g, or t
  misc_feature (3796)..(3803): n is a, c, g, or t
  misc_feature (3805)..(3806): n is a, c, g, or t
  misc_feature (3808)..(3815): n is a, c, g, or t
  misc_feature (3817)..(3819): n is a, c, g, or t
  misc_feature (3822)..(3822): n is a, c, g, or t
  misc_feature (3824)..(3829): n is a, c, g, or t
  misc_feature (3831)..(3831): n is a, c, g, or t
  misc_feature (3835)..(3838): n is a, c, g, or t
  misc_feature (3844)..(3846): n is a, c, g, or t
  misc_feature (3848)..(3848): n is a, c, g, or t
  misc_feature (3850)..(3850): n is a, c, g, or t
  misc_feature (3853)..(3857): n is a, c, g, or t
  misc_feature (3859)..(3863): n is a, c, g, or t
  misc_feature (3865)..(3871): n is a, c, g, or t
  misc_feature (3873)..(3881): n is a, c, g, or t
  misc_feature (3883)..(3884): n is a, c, g, or t
  misc_feature (3886)..(3889): n is a, c, g, or t
  misc_feature (3891)..(3891): n is a, c, g, or t
  misc_feature (3894)..(3895): n is a, c, g, or t
  misc_feature (3897)..(3898): n is a, c, g, or t
  misc_feature (3900)..(3904): n is a, c, g, or t
  misc_feature (3910)..(3914): n is a, c, g, or t
  misc_feature (3916)..(3917): n is a, c, g, or t
  misc_feature (3920)..(3925): n is a, c, g, or t
  misc_feature (3927)..(3931): n is a, c, g, or t
  misc_feature (3933)..(3933): n is a, c, g, or t
  misc_feature (3936)..(3942): n is a, c, g, or t
  misc_feature (3945)..(3958): n is a, c, g, or t
  misc_feature (3960)..(3961): n is a, c, g, or t
  misc_feature (3963)..(3964): n is a, c, g, or t
  misc_feature (3969)..(3971): n is a, c, g, or t
  misc_feature (3974)..(3974): n is a, c, g, or t
  misc_feature (3976)..(3979): n is a, c, g, or t
  misc_feature (3981)..(3981): n is a, c, g, or t
  misc_feature (3985)..(3990): n is a, c, g, or t
  misc_feature (3993)..(3993): n is a, c, g, or t
  misc_feature (3997)..(3998): n is a, c, g, or t
ctttgaagaaacaattgtggcaacaaactgtaatggccaaaatcgtcaatcaggccaacctgctggggcaataccggattgccaacaagcgactcattaatctggtaactcaggtgaagagtggcgacagtgataattgcgaagcccaggctgccagctattattggaaaaacattttccccattttcccagactttagaaggcatagggaaggagcaccgcccaataatctgctcaactacggctatgctattttacgtgcggtagtagccagaaatcttgtcggtagtggcttgttgcccacgttgggtatctttcaccgaaaccaatacaatgcctattgtctggcagatgatatgatggagccgtatcgtccttatgtggataaagtagtgtatgatatcgtaaggaacaatggaaactttttagagttgacaccgacaatgaagcaacagctattgagtattccggtgatagatgtgatgatagatgatgaaaaaagtccgttgatgaatgctgtgcaacgtactacggccagtttggccaaatgttttgaaggaaataccagaaaactgctgtttcctgttttatctgcttcaatgtaactgagatgaattttgaacgtttaaatgcttatcgtgttatgtgggtacttgtaatgttcgacctgccaaccaccaccaaggccgagataaagcgttatgcaaaatttaggaagcaaatcttagatgatggttttagtatgtttcagtttagtatgtacattcggcattgtatgagtcgggaaaatgcaaccgttcatatacaaagagtaaagaaaattttaccatccaaaggtcatgtaggtattatgtgtattaccgataaacaatttgggcaaatggaaatattttatggaaaggaaactgccgacagtcccattccggcacaacaattagaactattttaatgatgagaagatcacaatttattcgtggaattattggtgttttaggcgtttcggctctacctagtaaaatggtaaaacagtaccaaagaatttatttactacagagttttgtacgagggtttagattttatgaagggccaaaattactggatcagatgcaggaaggggatctgttgcaactaaagcgggaaccggataataaattcgatgaccatgctatcgctctttttttcaataatcgtaaaattggttttcttccacaggaagacaatgaaatcctcagtaagctgatggacgccgaggtagtagatttgcaggcgggcattacgcatttagaaaaagcagcccaggcttgggagaatgtacatgtagccgtatttgtactcaaggagctgaaggatccgctacctgaaaccgcaaaatatttaacagttttggaaactcctcattatcacagcctgaaattatcagaagacagcgtagtaaatatttattatggagatgacgaggaggaagaactattggatgtagatgatttttttgaggaattgggaaaaagcacaaacggtaaagcagtgaaagacaaaatgcggcaaggattatctcccgaaatggaatgggaacagatgatttatgaaggtcgtctggtggttaataaaaacaaattgccggccgacttgaaggggaaagatattacccatgccctaaaagaaggtgaaatattgctgaaccacttatttgatgaggaaggctttttagtagccaatgtaaatgaggtagctcggttgagcactaggatagacaaagtggtagaggcggttgatagtactggaaggttattttatgagattcgatttgtataaaaaaatgagccaatagaaataaaaaaacgagctattcggctcgtttttttatgctaatgacatcctgtaatcctttgctgttgtggctttggtcgaattgagatgtcaaagaccaaagatcataaaaacttgaaagcaattcacaacnnannnnnnannnnnnnnantnnnnnntnngatgtcaaagaccaaagatcataaaaacttgaaagcaattcacaacnnnnnnnnnangnnnnnnnnnnnnnnnnnngatgtcaaagaccaaagatcataaaaacttgaaagcaattcacaactnnnnnntnannnnngannnnnnnnntnnngatgtcaaagaccaaagatcataaaaacttgaaagcaattcacaacnnnanannnntnngnnnnnnntnnannnnngatgtcaaagaccaaagatcataaaaacttgaaagcaattcacaacnnnnnnnnnnnnnnnnnnnnnnnannnnnnnnnnnnaaanncnaaannnnanaaaanntnnaannnantnnanannnnnannnnannnnngnnncnntnnnntnnnnnnnnnaannncnaannnnnanaaaanntnnaannnantnnanancnnnnnnnnnnnttnnncnncnnnnncctnnnnnnnnaannncnaannnnnanaaaanntnnaannnantnnanaacnnnnnnnnncnntnaaaannnnnnnnnnnnntnnnaaannacnaannannanaaaanntnnaaannantnnanaannnnnnnnnnnnnncnnnnnnntngnnntgnnnnnnaaanncnaaannnnanaaaaantnnaaannantnnaaaannnnnnantnnnattannnttccntnnnnnnnntnnaanancnaanannnnnaaaaantnnaaannantnnnaannnnnnngnnnnannannantnnngnggnnnnnnnntnaaanacnaaanannanaaaaantnnaaannantnnanannnnanaaaannnntnnccnnnnnattgnnnnnnnnnnaaaancaaannnnnnaaaaanntnnaannnattnnnaanannnnnnttnnnnanttaannaannannnnnnnnnnnaannncnaannnnnanaaaanntnnaannnattnnaaaannnngnnnnnnntnnnnnaannnnnnnnnnnnnnnnaaaanncaaannnnnanaaaanntnnaannnattnnnaannnnnnannnntnnnnnnannnnnnnnnnnnnnnnnnaannncnaannnnnnnaaaanntnnaannnantnnnaannnnnnnannnnntnnannnnnnnnannnnnnnnnnnaannnnnaannnnnnnaaaaannnnnaannannnnnnannnntnnnagnntnncnnnannnnnnnannnnnngnnnaannacaaaannnnnnaaaaantnnaaannantnnnnannnntnaannnnantnnnnnnnnntnnnnanannnnnnaannccnaanannnnaaaaannnnnaannnatnnnnaannngnnannncnnnnnanaannnnnnnnnnnnnntnnnaannncnaannnnnanaaaanntnnaannnattnnaaannnntnnannnntnnnannantnannnnnnnnnntnnaaannncnaannnnnanaaaanntnnaannnattnnaaaannnnnannnnnantnannnnntnnnnnnnnannntnaaaannnnaannnnnnaaaaannnnnaannnatnnnnaannnnnannnnnntntnanaantnnnnnnannnnnnnnnaannncnaanannnnaaaaannnnnaannnatnnnnaanannnnannnnnnnntaannnnanannncnnnnnnnnaaaannaanannnnnnaaaaannnnnaaannnnnnnaanannnnannnnnnnnnnnnannnnntnnnnnnngnnnnnaannannaannnnnanaaaannnnnaaannnatnaanannnnngancnnnnnnnaannnnnnnngnnannnnnnnnannnaanannnnnnanaaannnnagaaannnananaannnnnannnnnannnnnnnannnnnnnnngnngnnnnanaannannannnnnaaaaannnnnannaannnnnnannnnngntannnnnnnacnnnnnnnnnnnnnnanntnnaagannnaanannnnanaaannnnnnagnaatnnac

SEQ ID NO: 198 - DNA, 4000 bp, Escherichia coli
  misc_feature (439)..(439): n is a, c, g, or t
  misc_feature (1146)..(1146): n is a, c, g, or t
  misc_feature (1878)..(1878): n is a, c, g, or t
  misc_feature (2433)..(2433): n is a, c, g, or t
  misc_feature (2476)..(2476): n is a, c, g, or t
ttgtaatgataaatttcatagttgatatcacatactattttatcgacccaagaatcaggcttaaggaagaggcaagctaggaatgttaaacaaaactttcaataaaatttacgataccgatatagggtatagcttttttaattcaaaaattgcaatgatctcttccgctgttttgtttattatttttctttgttcaatttttgctggtgtggtttcgccctataacccttttgacccagcttcagtctcattaatggatgcatttactccgccttcgtggtcagaaggaggaagccctagctttatccttggaacagatcaacaaggtagagatatgttctcaactattatctatggctcaaggatttcattaattgtgggctttgcatcaatcctttttgcaatgatacttggcgtattccttggcgttactgctggntatataggcggtagatacgagataattgtcatgcgagttacagatgtccagctcacaattccaagcatcctcatggcactactcgttaacggtatcgcgaaatcagttatttcacaatcgatgcatagtgaaatggcaatttatgtgttaatttttgcaattggtatctcagagtggcctcaatttgctcgtgtttctagagcatccaccttggttgaaaaaaataaagaatatgtctcggcatcaagaattataggactatcaaacgtcctgattatgtttaaacatatcttaccaaacatactcaggcctctattagtgattgctacaataggattggctcttgcaatcataaccgagtctacgctcagttttttaggtgtaggagttccacccaccactccttcactaggcacattaattagatttggaaatagttttttattttcaggtgaatggtggattacattttttccagctatctttttaatcgttttagctttgtctattaacctactaggagattggatgagagacgccttaaatccaaaattaaaaataagatgagtctgctaaaggttaaaaatttaaacattagttatccaactagaaaagaaactattgttgctagcaaggatgttgaatttacgctggagaggggtgaaatattaggaatagttggtgaatcaggctctggaaaatctacnattgcaaacgccatcatcaatttaattgacccgccaggtgaaataacaagcggatcaattaaaattgataatgatgaattaagagataacgaagagcttatccaagaaatcagaggaaagaaaattggatttgtttttcaagatccacaaacatcccttaatccactatttaaaataaaagatcaattaattgaaaccatccaaacacatcttaatttagactatcaagatgcattaaaaaaatctattcagctcttagaagaagtaggcattgataatgctgaaaaaagaattgaagattatcctcatcaatttagcggaggcatgcgccaaagggttgttattgctttagcgattagctgtgaaccagatttgattatagccgatgaaccaacaactgctttagatgtaagcattcaacatcaaatacttgaattactaaaggatctgactaaaaaaagaaatttaggggtaatgattatcacccatgatatgggcgttattgctgaaacaacagacaaagttattgtcatgagacacgggcttattgttgaacaaggtgatacaaaggagttattaacgaatcctaaatctaatgaagctcgaagcttagttatttcagtgccgccaacaaataaaaaaattgatagattcaaacttatcagccctgatggaaaagaaattacatctgactctaaaaatttaacaaaaaatattattaaaacctggggngctagagaaaatacaaatcaaaagttattagagctttcaggagttactaaaatttttgatgataagtccttagtgagtaatttttcatttgggtcaaaaaatgaaaccgctgctaaagtggtaaaggcagttgataatgtttcttttgaactgtttgagggagaaactctaggcttagttggtgagtctggctctggtaaatcaacaatagcaaaaattattacagggctcgttagaccaactaatggggaaatcttttataacaatctctcgctttataattcaaaaagaaaataccaaattgataagagcagaggacaggttcagatgatatttcaagacccctactcatctttaaacccaagatttaaagtaagggacataatatctgagccaataaggctttttcaaaaaaatattagctctagtgagcttacaaaaaatctttatgacttaatagatattgttgggatgtcaagacaatcactggatcgctatcctcatgaattttcaggtggacaaagacaaagaatatcaattgctagagctttagcnactcgtcctcgcttgttaatttgtgatgaacctacatctgcgntggatgtaagcatacaagcacaagttctaaaccttttaaaagatattcaagatgagctccatctggccatgctgtttattagtcatgatcttcctgtgattagacaaatgtgtaatagaattgtagtgctgaaaaatggcattgtttgtgagacaaaagaaagcgaagagttatttaataatccagaacatccttacacccaagaacttattaggctcatgccgaaaattgaatctataatttaatttatttataaatttattagaaaaacatatgcaactaaaaataaactctgtgcgcaatcgcatgaaggataacaatgttgatttaattgctcttggtcctggcactcatatgaaatggttgttaggcttcaatccctcgcctgatgaaagaccttgtatgttattgatgggattggaaaatgatgccttccttatgccatcagtgaatgcagaggatgcaatgaagcgctctgatattaaaatgtttagctggaaagatgaaaatggccctgatgaagcactagatgaggctctttcttatactggctcatcaaatgcaaaacatattgcaatagatgaggcaatgcgctctcactttgcattattacttatcgacgcattaccaaaaccgacctatgagtttactaactctacgattggtgcactcagaatgcgcaaagatgataatgagtactctaatcttaaagagaatgcgctgatcgatgatagagcaatgcaagctggctttgcagcaatcaaagaaggtgtgacagagcttgaaattggtgaggcaataaacaaacactttatttctgaaggggcgaaacctcaattttgtattgtaggatctggcccaaatggtgctttcccgcatcatcatactggaaatagaaaagtagaaaatggtgacgtagtactgattgatatcggtggtcgaaaaggaaccttcccaagtgacatgacacgcatgtctgtagtaggagaaccgccaaaagattatcttgaggttcatgcgattgtagaacgtgcagtgcaagcagcaatggcggcagcaaaaccaggagttatggccaaagatgtagatgctgcagcaaggggtgttattactgaggccggctatggagaattttttgttcataggacaggacacggtcttggcattgatattcacgagccaccctatatcactgcaacttctgaagttgtcctagatgagggaatggtgttctcaatcgaaccaggaatttatcttcagggtaggtttggtgttcgcctagaagagattgttattttaagggctgatgggcccgaaattctttcggaactcactcgaaaaacgaactttataacgtagtcaaaaagcgccaaaaaaacatctgcaacatattgaaaaatgtgtattattttgcattctgtttaatggttattagtagctatgaaaaaagaatttagttttggaacacaggttagaaaatctccatattttgatgcgactgtgcgttggggagcaaagggattt

SEQ ID NO: 199 - DNA, 4000 bp, Escherichia coli
  misc_feature (22)..(22): n is a, c, g, or t
  misc_feature (25)..(26): n is a, c, g, or t
  misc_feature (33)..(34): n is a, c, g, or t
  misc_feature (36)..(36): n is a, c, g, or t
  misc_feature (39)..(39): n is a, c, g, or t
  misc_feature (56)..(56): n is a, c, g, or t
  misc_feature (66)..(66): n is a, c, g, or t
  misc_feature (68)..(69): n is a, c, g, or t
  misc_feature (74)..(75): n is a, c, g, or t
  misc_feature (77)..(78): n is a, c, g, or t
  misc_feature (81)..(81): n is a, c, g, or t
  misc_feature (84)..(86): n is a, c, g, or t
  misc_feature (88)..(91): n is a, c, g, or t
  misc_feature (93)..(94): n is a, c, g, or t
  misc_feature (96)..(96): n is a, c, g, or t
  misc_feature (102)..(102): n is a, c, g, or t
  misc_feature (104)..(105): n is a, c, g, or t
  misc_feature (110)..(111): n is a, c, g, or t
  misc_feature (117)..(117): n is a, c, g, or t
  misc_feature (131)..(131): n is a, c, g, or t
  misc_feature (138)..(138): n is a, c, g, or t
  misc_feature (141)..(141): n is a, c, g, or t
  misc_feature (147)..(147): n is a, c, g, or t
  misc_feature (156)..(156): n is a, c, g, or t
  misc_feature (162)..(162): n is a, c, g, or t
  misc_feature (165)..(165): n is a, c, g, or t
  misc_feature (168)..(168): n is a, c, g, or t
  misc_feature (179)..(179): n is a, c, g, or t
  misc_feature (183)..(183): n is a, c, g, or t
  misc_feature (186)..(186): n is a, c, g, or t
  misc_feature (190)..(190): n is a, c, g, or t
  misc_feature (197)..(197): n is a, c, g, or t
  misc_feature (204)..(204): n is a, c, g, or t
  misc_feature (207)..(207): n is a, c, g, or t
  misc_feature (209)..(210): n is a, c, g, or t
  misc_feature (216)..(216): n is a, c, g, or t
  misc_feature (218)..(218): n is a, c, g, or t
  misc_feature (222)..(223): n is a, c, g, or t
  misc_feature (228)..(228): n is a, c, g, or t
  misc_feature (237)..(237): n is a, c, g, or t
  misc_feature (240)..(240): n is a, c, g, or t
  misc_feature (242)..(242): n is a, c, g, or t
  misc_feature (249)..(249): n is a, c, g, or t
  misc_feature (273)..(273): n is a, c, g, or t
  misc_feature (276)..(276): n is a, c, g, or t
  misc_feature (288)..(288): n is a, c, g, or t
  misc_feature (290)..(294): n is a, c, g, or t
  misc_feature (300)..(301): n is a, c, g, or t
  misc_feature (303)..(303): n is a, c, g, or t
  misc_feature (309)..(309): n is a, c, g, or t
  misc_feature (333)..(333): n is a, c, g, or t
  misc_feature (335)..(335): n is a, c, g, or t
  misc_feature (372)..(372): n is a, c, g, or t
  misc_feature (383)..(383): n is a, c, g, or t
  misc_feature (407)..(407): n is a, c, g, or t
  misc_feature (411)..(411): n is a, c, g, or t
  misc_feature (428)..(428): n is a, c, g, or t
  misc_feature (435)..(435): n is a, c, g, or t
  misc_feature (438)..(438): n is a, c, g, or t
  misc_feature (444)..(444): n is a, c, g, or t
  misc_feature (447)..(447): n is a, c, g, or t
  misc_feature (456)..(456): n is a, c, g, or t
  misc_feature (458)..(459): n is a, c, g, or t
  misc_feature (468)..(468): n is a, c, g, or t
  misc_feature (470)..(470): n is a, c, g, or t
  misc_feature (474)..(474): n is a, c, g, or t
  misc_feature (485)..(485): n is a, c, g, or t
  misc_feature (489)..(489): n is a, c, g, or t
  misc_feature (498)..(498): n is a, c, g, or t
  misc_feature (501)..(501): n is a, c, g, or t
  misc_feature (506)..(506): n is a, c, g, or t
  misc_feature (513)..(513): n is a, c, g, or t
  misc_feature (1959)..(1959): n is a, c, g, or t
  misc_feature (1962)..(1963): n is a, c, g, or t
  misc_feature (1972)..(1972): n is a, c, g, or t
  misc_feature (1983)..(1984): n is a, c, g, or t
  misc_feature (1986)..(1986): n is a, c, g, or t
  misc_feature (1993)..(1993): n is a, c, g, or t
  misc_feature (2012)..(2012): n is a, c, g, or t
  misc_feature (2023)..(2023): n is a, c, g, or t
  misc_feature (2025)..(2025): n is a, c, g, or t
  misc_feature (2032)..(2032): n is a, c, g, or t
  misc_feature (3560)..(3560): n is a, c, g, or t
  misc_feature (3596)..(3596): n is a, c, g, or t
ttctgtatattgcatcaacttnttnnttctagnncntcntctaaatctagttgatnaagtatttcntnntctanntnnccnatnnntnnnntnntnagattntnnctgtnncaatgntttaatattcctanataactntgnacactngcatttatntcattnatntcnacctcctcttnatantantttntctgtanatatttnagncnncttttnantttnnttttngtgcttttnctnanttttctntatggtggataagtaacatatccncanaaatctattccntnnnnnatattnncnacagtngttttgttgttaagttctaatttnanataatcagcaagaaatatttctatctcctgtctgatngtatgtaattnattttttgattttcctaaaataanaaantcatccatatatctaanataatgnttngctttnagngtatgcttnannaatttatcnanaaantctaaataaanattngcaaacatntgnctggntagattnccaataggtattccaattcctttaattttgccttcttcaaaatggtgatctcccaggtgaatgccaaactcaccatcatcgcttttaattattctccagagtaatcttagtgtatctttgcaatctatctttcttttaataagttcaaaaagaactcgatgatctattctataaaagtattttgctacatcagctttcagaaaataagtttcgcctggttgtctgtcgagctttctcatccagtgtcttaattgatctgcagcataatgagtgccttttccaactctacaagcacagctatgctcataaaatatattgtcgaagataggaaatacttgtcggtaaatagcccattgaactacccggtccctaaaaggaagagccataaccagtctttgctttggttcatatacataaaactgatgatatttgccctgttcataagttttgtgtatcaattcattctgcagctggataagattgctttctaactgcctggtaaactttaaaacttcatttttaaatctttttttctttcttgcttctatataagctaaatataaattctcaaaatcgtatatttttggatataaatttctaaatttttttggaatgttatcaccactttctctgtattcaggtgaaaagaaaaacccgctcttatttagagcaggttttaaggtgccggccgtgacaactttctatatttcaatacttgctgcctaactgacaatttaaattttttcctggagggacaaatttgtttctcaggatggaagtaggcccctttatttatgttgctggcactggataacaacccagtaggttgctaacttctggcctaaaaatataaatagagcggagcggaagccaatgttgttgttcgagttcgaacgctcgttgttcaggttcaactgaaagacaccggctgtcgagccgttgttccagttgccaccacggatcggcaaacgcatcggcctactaccgaaaatttataaaattttattgtttcttttctattgttttcatccagccgccgatcaacttacctacttcatcaagtttttcggaccagatgccatactttttaaaaggaagaaattctaaatctttggctaatcttatataagtagttatcaattctaattgagtatccatttctcttaatgtagtttttttataatattttttattagttatgataattaattttaaaagctttatcattgcctcttttatctctgcagcaaaagtatgcttttcgctgcgaggaaattgttttaatgcctggtaaccatactggatcatgtcataagtcttttgatatactattagattttccaaattatcatccttcaagtaatgtaggggaaggctatcgcccacccctaacagattttagagttcagatttatagagaaacaaaagcggagcggaagccaatgntgnngttcgagtncgaacgctcgnngntcaggtncaaccgaaagacaccggcngtcgagccgcngntccagcngccaccacggatcggcaaacgctcaccgtagtttctaacataaatataatctccgttatatcctgtgccttccgggaatacagccaaatattttagtctttcaggaactgtaaagccagtatcagcggtcatattctcaaaaatatgagagatatattcgctacttgcttcgtccattacattgtcaattacactatcaagctgtaatgtagtgccgtctacatccatataagctccgagatctaaccagcctgtattatctccagcagcattaccagtctgaaaatcattttcatcatgaacccaaattttaccgtcaactagctttaagccatcgacccattcatgaacatttccatttaaatcaaatatgcctgctagagttccatcgtgagaccatgaagcaggtccagatccggttgctaccctatatgttttgtaagggtctccaccaccataagtttctacacctttttcatgcggagcacttatatcctgaccatagtcattgttacctctgggctcataaccatttttcctgcaccagagtgcaatagcagcccattctgcattggtcataagatgccagccagttcccttagcaaatgatgcagctctcgctgtatcaaaattaattgatgttgctgggtcctgattagggattgaataagcccggctgttcttgataatattttgatattttgaaatgaaaatttcatccttaaccacaccgttaacaatgaaagctggatgcggttcgtttggccaggtgtctacaacatcatctaaattaaacttaggcagcctatacataacagaaggatttccctgatcatcatatagaactgtgtttcttcctccggtttgagcttcaacagctgctctgtaactatcttttatactaaatacaaaaggttccattaattaatcacttcctctttttgattttgtttaagaatataattaggtagagcccataaatcgagcactacttcgtctacattaaaaggttttttgaccttttcgtaaactgtttttccatcttcgtccacttctccagtgccctgcatttcatattcagctgcaggaatagttatgtttgctacataccatttatcgataccttccaccagattacctgttttatttgtgcaaatatcgacagttttcttttcatcatcctgcattacctctaaatcaaggccaatgcttttatctaaaacactcaaaactaaaaaattcccatttagggaatagtcagctttttctccagtattcaattcgttaattatcatctattgctgcacctccttatttgacatcaaagttaattaaagtccatttgatagtcgcttcatcttcactaccggtaaaactaactttaaatccatttgatgtcttgtcataaacctttatgtcaccaacaaagccagggtcaccagatacaagctcagtaactacttgataatcaggtgcatcatactgcacaaaaccatctaaagctacagctgtataattatcagcagtnacagtcacttctccctgcattattttttgctttttnattttctcaaattcctggttaagtttctgaacaaactgcagagtctggaaagcaagtatcccggatggtcctaaagctgtttgaacaccggattcaattctttccattttctttttacttataactgtaccctgctgtataacattaccatctgcatccactacatgatctatccactcgagtggagtataattttcatcatatatcatttattatttacacctcctggatatcaaaatcaaaagcgatcaataaaccttttaaatctcctttttctatctgatctggtttatcagcaaaaatacttccttcatcatcaatgagctcaaaattggttaggtccccaactccctcggcttcatttaaatagagaaagattctaagtttgctgccatctattttaa

SEQ ID NO: 200 - DNA, 4000 bp, Escherichia coli
  misc_feature (86)..(86): n is a, c, g, or t
  misc_feature (200)..(200): n is a, c, g, or t
  misc_feature (221)..(221): n is a, c, g, or t
  misc_feature (227)..(227): n is a, c, g, or t
  misc_feature (344)..(344): n is a, c, g, or t
  misc_feature (431)..(431): n is a, c, g, or t
  misc_feature (952)..(952): n is a, c, g, or t
  misc_feature (973)..(973): n is a, c, g, or t
  misc_feature (1321)..(1321): n is a, c, g, or t
  misc_feature (1333)..(1333): n is a, c, g, or t
  misc_feature (1627)..(1627): n is a, c, g, or t
  misc_feature (1985)..(1985): n is a, c, g, or t
  misc_feature (1995)..(1995): n is a, c, g, or t
  misc_feature (2015)..(2015): n is a, c, g, or t
  misc_feature (2136)..(2136): n is a, c, g, or t
  misc_feature (2667)..(2667): n is a, c, g, or t
  misc_feature (3251)..(3251): n is a, c, g, or t
  misc_feature (3254)..(3254): n is a, c, g, or t
  misc_feature (3263)..(3263): n is a, c, g, or t
  misc_feature (3274)..(3274): n is a, c, g, or t
  misc_feature (3284)..(3284): n is a, c, g, or t
  misc_feature (3369)..(3369): n is a, c, g, or t
  misc_feature (3429)..(3429): n is a, c, g, or t
cctattaaccgttaaaaactctatccatactgataccacgttcaccagctatcgtataggcatcacgcatttgagctaatgctgcnattgtcgcctttacaaggttgtgaggatttgaagacccctttgactttgcaatcacgtcagaaacaccagcactttcaagcactgcacgcatagcaccaccggcctttagaccngtaccagctgctgctggcttnagtagnacttgagcaccaccaaaagaaacttcaatttcatgaggaacagttccttttaatacaggaactttcacgagattcttttttgcagactcaacacccttagagattgctgttgtcacntcaccagccttaccaaggccccagccgacaacacctttgccatcacctacaacgacgatagcagcgaatgtgaatgtacgaccaccntttgtaaccttggttacacggttgatagcaaccagacgatctttcagttctacgtcactatttactttaactttattcattgccataatcgtttagaatttaagtccaccttcacgagctgcatctgcgagagcctgtacacggccatgatacaagtaaccgttacggtcgaacactactgactctatgccggcagcctttgctttttctgcaacaagtgcaccaactttctttgcctgttctatctttgccaacttttcaaggcctaatgaacttgcagaagcaagcgtcttgccagtcaaatcattaataacctgagcgtaaatctgcttattagagcggaaaacacttagacgtggacgctcagctgttccgttaacactcttacgaatgcggaactttatcttaattcgtctttctactttctttgttgtcataatcgtaaaatcaattaaaattacttagctgcagcggtcttaccagactttctacgaataacttcacccttgaacaggataccnttacccttataaggctcaggnttacggaaagaacgaatttttgcacagatgagaccaagcaactgcttgtcacatgactcgagtgtaagaattgggttctggtttctttctgatttagactcaaccttgatttcttttggaagttccatgaaaatagggtgagtataacccaaagagaattcaatgagattaccttgattagaaacacgataacctacacctacaagttcaagtactttctgatagccttcgcttacaccaacaaccatgttgttaacaagtgaacgatagagaccatggaaagattgtttctgcttaatatctacagggctattctcatctacgctgaaagtgatatgaccatcagcnatttccatcttnatagaaggatctacatactgagagagttcgcctttaggacctttaactgtaactacatttgtcttctcatcgaagtttactgtaactcctgctggaatactaattggcaatttacctattcttgacatattaaaatcctccaattaataaatgtagcaaagaacttcaccaccgatctttaaatcggaagcttccttgtctgtcattacaccttgggatgtagataagatagcaatacctaatccgttaattactctcggcatgtctttataaccggtatacttacgcaaaccnggtgtagacacacgcttcaaactcttgatagcgctctgctttgttgatggatcgtacttcagtgcgaccttaattgaaccctgaggaccatcttcaatgaacttgtagttcaagatgtatcccttctcgaagaggatcttggtgatctctttcttcaagttagacgcaggaacttcaactacacggtgatgagccatgattgcgtttctgagtcttgtcagataatctgctattggatctgtcataaaatataaatgtttaattaatcgggacaaccccgacaatattaaaaaaatccgtttaagaacgattagaagtaaagtgactgatgttcgtctgtaaagcaagccgagtagantaactttccnattccaaagaaatcatcgtntaaaagctatcaaattgtagcacattatgacgcttattaccaaatgaaatattaggaattataaagctaatcaaaaggagcttaattacagatgcttaaacatcattcactttgctattcngaattaccagcttgctttcttcacaccaggaatcaaaccagctgatgccatctcacggaactgaatacgagacaaaccgaactggcggatataacctttaggacggcctgtaatcttgcaacggttgtgtagacggataggattagcattcttggggatagcctgaagtttgcgtgcagcttcataagcttcagcaacatcttcagacgtagcgataatctttttcagagctgcgcgcttttcagcgtaacgagcaacaagctttgcacgcttaacctcgcgagctttcattgattcttttgccatattccttaatcgtttttagcgttcttgaatggaagtccgaatgccttgagaagagcaaaaccttcttcatcagttgctgctgaagtaacgaaagtgatgttcataccctggatacggtctatctcatcgatattaatctctgggaagataatctgttcggtaatacctaaagtgtagttaccgcgaccatcaaactttgttgtgatacccttgaagtcacgaatncgtggaagagaaacacggataagtctttctaagaactcatacatgcgctgaccacgaagtgttaccatgacgccgattggcatcttcttacgcagtttgaagtttgcaatatccttcttagaataggttgcaacagccttctgaccagtgatagcggtaatctcattaactgcaacatcgacaatcttcttgtcttgtgttgcatcaccgagaccctgattaatcacaatcttcttcaaaacaggaacctgcattgctgaagaatagttgaactgcttctgaagttcaggagctatagtctccttatatactttctttaactgtgctgtatccattatttaatttcctcccctgactttttagcgatacgaatcacattcttgccttcatgcttgatggcaactcgagtagctttaccactcttgggatcgatcagactcagatttgatacatgaataggagcctccatctttacaatgcccccctgaggattctttgctgaaggcttagtgctctttgatacaaggttacgtccctctacgatagcacaattcttgctaactaacaccttgagcactttaccngtnttgcccttntctcttccggnaagaacaacnaccttatcgtcttttcttatatgtaacttactcattacttacttgttttatgattaattaaagaacctcaggtgctaaagaaacnaccttcatattcaccgcacggagttcacgagcaactggaccaaagatacggctaccacgnagttctcctgcattgttaagcaatacacaagcgttatcgtcgaaacggatataagaaccatctgcacgacggatttccttctttgtgcgaacgatcaaagcttttgatactgcaccctttttcaaatcacttgatgggatgacgttctggacagctaccacaataacgtcacctacgctggcataacgacggccggtaccaccgaggacacggatacattttgcttcacgtgcgccgctgttatcacatactgtaagtcttgattctgcctgtatcataattacttagctttttctacaatttgtactaatctccatctcttagtctttgacagaggacgagtttccataatctgaactgtatcgcctacatttgcttcattcttctcgtcatgagcgtggtatttctttgtcttttgaacaaacttaccataaatagggtgcttctctttgaacttagaggctataacaatggttttatccatcttgttgctgacaacaacaccctgtcttacttttcttaaatttcttgtttccatctggaccattattatttattaagttctctctga

SEQ ID NO: 201 - DNA, 4000 bp, Escherichia coli
  misc_feature (1954)..(1955): n is a, c, g, or t
  misc_feature (1960)..(1961): n is a, c, g, or t
  misc_feature (1967)..(1967): n is a, c, g, or t
  misc_feature (1978)..(1979): n is a, c, g, or t
  misc_feature (1982)..(1982): n is a, c, g, or t
  misc_feature (1987)..(1988): n is a, c, g, or t
  misc_feature (1993)..(1993): n is a, c, g, or t
  misc_feature (2008)..(2009): n is a, c, g, or t
  misc_feature (2018)..(2018): n is a, c, g, or t
  misc_feature (2021)..(2021): n is a, c, g, or t
  misc_feature (2026)..(2027): n is a, c, g, or t
attcttcggtttcgtcccggcgggaacgcaaaacggcctttacgcatttgtcgtaatccggccggccccatacttccaccgtgtcgtaatcgtacgccttccttgcggccggtacctggtcgccttctgcttcggccataggttccggcgttacttccacttcggtaatattgtagttgtaatgccaactgccgttgcccaagtcctgcaaaatgggcggtctatcgtttgaatttgatttcatacttcgatgttttagaaagtttcttaatcaagtgtttgctatcgcaagacttcgcccaaccccaccaagggcaaatagcctgcttaaagtccttttcggataatggccttttccgtttgttcagcttcgccaaccgccggcaaaaagtctttttaatgccctttcgcattcgggtatgcgtgtggaaaaatacatatcctacgaagtcgataccgcgagccgctacggggaaaacttgccaattccctttaacctctaatttcaaatcccccaaatacgccctaatttcgcccattaaggaatgaaggtaggatttatccgaagcaagtattacaatatcgtccgcgtagcggaagtagtgctttacccgcttctgttcctttatccaatggtcgaagtaggttaaatagaggttagcgaaatattggcttaggtagtttccgataggtacgccgtccgccgaatctataatttcgtcaagtaggcgaagtagccttttatccttcaacttgcggcgcagaatggattttagcacgtcgtggttaatcgaagggtagaacttgcgaatatccaatttcaaacaaaacgtagtaccttccgggtcttcccgtagggcctgttttaccttcttcgcggccgcatgaatcccccggttcttaatgcagctataagtgtccgccgtgaaggtcgaaacccaaataggctctaagacgttcattatagcgtggtgcaaaatacggtcgggaaagtaaggcaagcggtatatttcccgttctttgggttcgtaaatagtgaatacgtcgtacttcgatgtatggaaagtaccgtttagcaaggtttcgcgcaacttcaataggttcacttcccgttttttatcgtgttcgataactccgtacgtgcgtaacttacccttacgggccttttcgtccgcaagctgcaagttctcgatagaacaaaccttctcgtacaagttacctattcgcttcatcgcactacttatttgctgattccttagggaatgttcgggaagtcctactaataccccttaaatagttgttgttttttgccaagtggcaaggtttttaccccgttaaaatctgcatagctgggagctgacattcgcattcgtattcgaagccgtgttattcgtattcgcgtacgaaaagccggcattcgcgctgttattcgcattaccgccgaaaagcacgccccaagggtaaaccgcctttattttcactcgaaataataccttgttcccgaagcccgcatagttactttacgcgggaaggcgttacgctccttaatcttcccaaggatatatttaatttcttgcgaattggtaaagaacttccgcgcgtctttatccgggtcttctttattgaacttaatcttaaccaagaagcgaccggttccgaacttcgttttaacgtcgtccaagaagtcaataacccaaaaagaaaggttaattaacttctgctgggttatttccgaacaattgaagtgcttgttattcgcgtccggctcaatctgcaagaaagctaaacttccgtcgtcctgcctgttgttttccatttttgcgaaaaattgaacggcgggcattcgtcctaatttgagctacttcgaaagcccgccgtagttaaacttctttgttaaatgcgttccgttacgtgtcgtttcaagcgggtaaaaagcaaagccgggagccgacanncgcanncgtatncgaagccgcgnnatncgtanncgcgnacgaaaagccggcanncgcgccgtnatncgcannaccgccgaaaagcacgcccctttgtccggtattgcttactacgttcgtatagaagtaatcggcgaagtaagtagtagaacttgcgcctactgctgtcggcatattttcgccgtactcgccaatcatcataattttaacgtaaccttcattgcggggtagctcgccgcgcttctcgtaatcggtatagtcgttactttgaaacttggccgggtcggtacatacgaaaaactcactaacgccgcccgcgtccgcactttgaatattgcacttgcatccgtccgtccaactccatacgtgcccgaaaggattttccaaacctcggtagctgggtacgctaagggtttggccgtcggttccgtcgcttttcttgtatgtgtagtttactacgcctgtcttatttcccaacgggttggtaaccccgcaaggaaccatagggttataactgttatagccgtcccaatcgctcatattggtaacgccttggcttaatccgccctgcttatatccttcgcttgtaggttccgcgttataggcaagttggcaattaaagttagcgtattcgacggcgtaaagccaccagcaagttttttgtacttcgtaaacgtcgcaattccaaccggccccgttcttgccggcattcccccggttccgggcatacttccgaaagttggtaaggctgatagatgtagccggcatacctaaaaggcttctatatgttccgtcccaaccggccgtattgttaccgccacggaaagccgtagaagtatttacgacgcttgcaagtttcggcgtagccgatacggtgcggtctacggccgcttcgtaagccgaacgataggcaagctgcaccaaatggaaccccggtagcgcgtgttcggaaagaaggcaccggaatttagtaccgtctacttcaaatttgcggtagtgggctggtatttctaccattacttgcccgtcggtgccgtcaagtttggcggcggctcccgtatcgcgcttggtgctgtcgttcgcgtgaaggtaataagctaccgttccgttgtcgcgcaagacacaacggcgcattttactttgaataggcagcgaaacgtgaagttccgggcgaccaattcgggtacaagccgaagaagctacgttagaatcccattctataccgtagtagtaatcgtagggaaacgtcggcttcgtgtttcctactccaatcaataaacccatagccgtataagatttagtacccccaaacaagggtagcgttaatactcgtttgcttaatctcgcggactatttcggggttccaacctatttcgaagcgcgtagctacgaacttgcccggctccatgccccaaaggtttacttcaagaacgacggcggtttctccgtcgttcttaatgttaaacggcgtatcttccattttgaagttacccgtacttagcccttcaatggggccgattgttccaatttgggcggaaaccgtttcgccccctcttgttgtactcattttgtcgaaatattaagttacacaaaaataccccgttgcgtattattataatacgcttgttggtaaaaaattaaaaactaactttctgccttcgtagaatagcgagtatggtttcgtaaaatccaagttccataaatattcacaaactccattaactcaccgggagataataccccaacttgggtataggaagattttgtaccctttacgaccgtacagggatatgatgatgaattatataacgcacaattatacccgttatggtcttcgttggcctccattaaaaccccgaattgtgctccggcggtcaaggccatgtagcaattttcggaaactgccaacaccgtagtaaattgcgaaggcgggcagttggtttttgtatatatcgttttatacgacccgctcgtttcaaagtaattggaaacgcatcgtccgtccttatatactcggaacttggcccggttgccctccattgcag

SEQ ID NO: 202 - DNA, 4000 bp, Escherichia coli
  misc_feature (161)..(161): n is a, c, g, or t
  misc_feature (216)..(216): n is a, c, g, or t
  misc_feature (239)..(239): n is a, c, g, or t
  misc_feature (246)..(246): n is a, c, g, or t
  misc_feature (275)..(275): n is a, c, g, or t
  misc_feature (437)..(437): n is a, c, g, or t
  misc_feature (1571)..(1571): n is a, c, g, or t
  misc_feature (1598)..(1598): n is a, c, g, or t
ccatcgcaggggtgcctcgaatcgagcgctgagattataccctcataacctgaccggataataccggtaggggagcaaggcatggaaaggatgttttccatgattccaggccgcactgcgtcatttagtaattaaaaactcaaacgacgatgcgcaagacntctttattctttattctttttggatgcccgtgtatcctcttctcccaagcgaagnccccggaggattcaccgcaactntcagaanttcaagtggattccatcttgaaaacggtngaattgttgccagcaacgattgcagccattcaaaacccggaaagagctccgtttccaagacaaaccattgatgcggttgcattagccaagcgcgatggttccatggacatgccttttttacttcgctttaccccttcattggtggtgacttcggatgcgggnggcggtgtaggttacacatcgatgcgcatccgaggatcggaccagacccacatcaacgtgacgttgaacggtgttgcgctgaatgatgctgaatcccatcaagtgtactgggttgatttgccagacttatcaagcagcgtggacgagttgaacattcagcgaggagtcggaagttcatcgaacggaccgggcgcgtttggagccacggtgggcatgcaaaccatgcaatttgatcggaatccaggcggaaaattgctggttgcaggaggatcatttggaacgcaaagaagcatgcttaaatggtccaccggcgagttgggtgctggtttctacatggagggaaggacctcgcggattttgtccgatggatacatggaccggtcgggaagcaagctgaccagcatgcaattgggattgggctaccaatggcaatcgggtcagatgtcctacaccgcgatgttggggcacgaacgcacgcagcaagcttggtatggcgtgcctcaggtgtcgcttaacggaacgcccgaagaaatttgggactgggctgccaactcttacgaatatggatacggtgcggatagcacccgaatattggatttgatctcccgaggtcgccagcataattattaccggtatgtggatcaagtggacgattaccgtcaagaccatcatcagatccatgcgagtcaacgatggggagcatgggattttggagcgaccgttcattatacagcaggaggcgggtattatgaacagtaccgggaggcggatgatttgagcctgtacggtgcaggcgatttgggactggcggataccaccatttcttctggggatgttattcgccgaaggtggttgggcaatgacttttacggcgcgttgatccagggcacaagaaaatggtcatcgacagccttgcagttcggtgccggttcttttcgttacgtgggcgaccattttggccaacccatttggatgcaatatggagcgtcccagctttcgccgcagcaccgatactacgataaccgaggtgaaaagacggatcgttacggattcgtaggcttggatcgggatgttttcggaggcgatgtccgcgtgcgtgtggaagcacaatggcggcaggtcggctatcaggtncacggcacagacaacgaccttcgcgtnctcgatgtggatacggtgatggcttttttgaatcctaaagtgggagcagattggttgattaatgaccaaaatcgtgcgttcatttccgttgcacaggcgagccgagagccagtcagaaccgactacattgaccgagccaccagcgcctatccgcttccggagcacttgaccgatgtcgaactgggatgggaacattcaacgtcgacctggagcattcaggccgtggctttttacatgcggtatgccaaccaattggtgctgacgggagccctcaatgacacgggctctcccattcgccaaaatgtcgaccgcagttacagagcaggccttgaatggacccaagagtggaggccattcaatgggtttaaatggtacggaacgaccacgctggccctcaatcgaatcgaggcatttgatgaggtcttatttgattatgccgagggatttgaccccgtcgtctcggtggcgcatgagggcaccgctatcagtttctcgcccggcttcacagcctctagcgtggcttcttgggagttctggaaccggatttcatccgaaggtttgggatcgaccgcttcggtagaatggtcctttcggcatgtcgcacgtcagtttcttgacaatacctcatcggaaagccgttctctgccagcttatgctgttcacgatgcgcgcttgcgttggatgaagcaccgatcgaatgcggggcacataggcgtttctttgtttcttaggaatctcctgaatgcccaatacagcgcgaatggttggacatacagttatttgtatggaggcctagatgccatgtcaaccgaggtatacgtttaccctcaagcgggtcgcaatggactcgtctcagtggaactcaccttctgaaatcagagctcgttcatccggtttggcgcgctatcttttggtagtttttggggtcgggcagccaagacaaatcttgcgggcgctgctctatggcctggccgacaacgaccaagtctgctcctgcatgccaagcggcatggattcctgcggcatcttggatgccaccgccgatgatcaagggcgtggacgtgctcttacggactgctgaaatggccgatacaggaacgggttgtcctgcaccgctgcctgcatccaggaaagtcagtttgagacccaacatttcccccgcgacagccgttgcagcgacgatttgaggtttatggagggggatcggtgttgtttggctgatgtacgccgctgtgctcaatggaccgtcaccgactaatatgtaacccgttgggacgacctccatgcccatctgtttaattcgcatggccgattctacgtggcgaccaattaaaaagtcggggtttcgtccggaaatcagggagagaaaaagaacgctgtccgcaccgggtgttacttgttcaggagagccaggaaaaatggtcaacctaccttgaaagcgagcccgcaatggatgaagcacatctttgacttggcgcctgttgagcaagctacctccgatgaaaacatccgtgacgggggacgctgccaatgcgtcaatgaatcgcacccaatctcttccgacgggcaagtcatccgggtcgagcaaagcggcaagccgcttagtgccttccatctgatcttgtacgagagtactcagccaattcatgaacggaatatacgttgaaaggtgggatcaagcacctcttccctcagcattccatgtcctgagggtatggaatgaaagtgaatatgcggttgttttctcgttagccttttaaggcggtttgcattggatgcgggaatgattttatcgcggtctccaaaggctaagtcgattcggttgctctcgagaaacgcgcgactcaacgctcggtgtgttggccagcacaaccgatgtgcacgccaaccgtgccagaccatcatgcgcatttcgtgtgattcgatatgaaattcactgaaggcatacaggtgttttgacaacaagccaacggcatgcaatcgggcgttcaatctgcggataagcgcggcatttcggtcaatgaaaaaccaagcccatcggccaaggcgagtgtgaactgttaggcgatagaaaggcgattttttcaatccgtcaggtgccatcaaaagggtgtgcgaccatttttggggggtatcgtggataagggccagagccacgcgtccaccgatgctgtagccgaataatttgcgttgcttggcctgcggtgcttctcgttgagctatggcttcgagcactttgttcatttcagatggcgagatggggtgatcccatggaatagaatccgatcgcggttggctttgtccgtggtgcaataggtgcactccaatgaagcaatcagtgggagcccagcgtttcgcaacgggcagtaaatcttccagcggccttgcaaatccgtggaaac

SEQ ID NO: 203 - DNA, 4000 bp, Escherichia coli
  misc_feature (1)..(10): n is a, c, g, or t
  misc_feature (12)..(15): n is a, c, g, or t
  misc_feature (17)..(18): n is a, c, g, or t
  misc_feature (20)..(20): n is a, c, g, or t
  misc_feature (22)..(25): n is a, c, g, or t
  misc_feature (28)..(28): n is a, c, g, or t
  misc_feature (30)..(30): n is a, c, g, or t
  misc_feature (32)..(32): n is a, c, g, or t
  misc_feature (34)..(35): n is a, c, g, or t
  misc_feature (38)..(39): n is a, c, g, or t
  misc_feature (41)..(41): n is a, c, g, or t
  misc_feature (44)..(47): n is a, c, g, or t
  misc_feature (49)..(59): n is a, c, g, or t
  misc_feature (61)..(64): n is a, c, g, or t
  misc_feature (66)..(67): n is a, c, g, or t
  misc_feature (69)..(76): n is a, c, g, or t
  misc_feature (78)..(81): n is a, c, g, or t
  misc_feature (83)..(84): n is a, c, g, or t
  misc_feature (87)..(88): n is a, c, g, or t
  misc_feature (90)..(93): n is a, c, g, or t
  misc_feature (95)..(100): n is a, c, g, or t
  misc_feature (102)..(104): n is a, c, g, or t
  misc_feature (106)..(106): n is a, c, g, or t
  misc_feature (109)..(112): n is a, c, g, or t
  misc_feature (114)..(115): n is a, c, g, or t
  misc_feature (117)..(120): n is a, c, g, or t
  misc_feature (123)..(123): n is a, c, g, or t
  misc_feature (125)..(131): n is a, c, g, or t
  misc_feature (133)..(135): n is a, c, g, or t
  misc_feature (137)..(138): n is a, c, g, or t
  misc_feature (140)..(142): n is a, c, g, or t
  misc_feature (144)..(150): n is a, c, g, or t
  misc_feature (152)..(153): n is a, c, g, or t
  misc_feature (156)..(157): n is a, c, g, or t
  misc_feature (159)..(160): n is a, c, g, or t
  misc_feature (163)..(166): n is a, c, g, or t
  misc_feature (168)..(168): n is a, c, g, or t
  misc_feature (171)..(177): n is a, c, g, or t
  misc_feature (179)..(179): n is a, c, g, or t
  misc_feature (181)..(181): n is a, c, g, or t
  misc_feature (184)..(186): n is a, c, g, or t
  misc_feature (188)..(191): n is a, c, g, or t
  misc_feature (193)..(199): n is a, c, g, or t
  misc_feature (201)..(205): n is a, c, g, or t
  misc_feature (207)..(208): n is a, c, g, or t
  misc_feature (212)..(213): n is a, c, g, or t
  misc_feature (215)..(218): n is a, c, g, or t
  misc_feature (220)..(223): n is a, c, g, or t
  misc_feature (225)..(225): n is a, c, g, or t
  misc_feature (227)..(228): n is a, c, g, or t
  misc_feature (231)..(233): n is a, c, g, or t
  misc_feature (235)..(235): n is a, c, g, or t
  misc_feature (237)..(240): n is a, c, g, or t
  misc_feature (242)..(245): n is a, c, g, or t
  misc_feature (247)..(252): n is a, c, g, or t
  misc_feature (254)..(261): n is a, c, g, or t
  misc_feature (263)..(264): n is a, c, g, or t
  misc_feature (266)..(267): n is a, c, g, or t
  misc_feature (269)..(269): n is a, c, g, or t
  misc_feature (272)..(276): n is a, c, g, or t
  misc_feature (278)..(278): n is a, c, g, or t
  misc_feature (281)..(281): n is a, c, g, or t
  misc_feature (283)..(287): n is a, c, g, or t
  misc_feature (290)..(297): n is a, c, g, or t
  misc_feature (299)..(306): n is a, c, g, or t
  misc_feature (308)..(315): n is a, c, g, or t
  misc_feature (317)..(318): n is a, c, g, or t
  misc_feature (320)..(325): n is a, c, g, or t
  misc_feature (327)..(330): n is a, c, g, or t
  misc_feature (335)..(345): n is a, c, g, or t
  misc_feature (347)..(352): n is a, c, g, or t
  misc_feature (355)..(356): n is a, c, g, or t
  misc_feature (358)..(361): n is a, c, g, or t
  misc_feature (363)..(363): n is a, c, g, or t
  misc_feature (365)..(373): n is a, c, g, or t
  misc_feature (376)..(379): n is a, c, g, or t
  misc_feature (381)..(383): n is a, c, g, or t
  misc_feature (385)..(401): n is a, c, g, or t
  misc_feature (404)..(404): n is a, c, g, or t
  misc_feature (406)..(407): n is a, c, g, or t
  misc_feature (409)..(409): n is a, c, g, or t
  misc_feature (1220)..(1220): n is a, c, g, or t
  misc_feature (1229)..(1229): n is a, c, g, or t
  misc_feature (1250)..(1250): n is a, c, g, or t
  misc_feature (1253)..(1253): n is a, c, g, or t
  misc_feature (1257)..(1257): n is a, c, g, or t
  misc_feature (1259)..(1259): n is a, c, g, or t
  misc_feature (1268)..(1268): n is a, c, g, or t
  misc_feature (1559)..(1559): n is a, c, g, or t
  misc_feature (1580)..(1580): n is a, c, g, or t
  misc_feature (1992)..(1992): n is a, c, g, or t
  misc_feature (2074)..(2074): n is a, c, g, or t
  misc_feature (2146)..(2146): n is a, c, g, or t
  misc_feature (2525)..(2525): n is a, c, g, or t
  misc_feature (3434)..(3434): n is a, c, g, or t
  misc_feature (3611)..(3611): n is a, c, g, or t
  misc_feature (3878)..(3878): n is a, c, g, or t
  misc_feature (3884)..(3884): n is a, c, g, or t
  misc_feature (3929)..(3929): n is a, c, g, or t
nnnnnnnnnncnnnntnntngnnnnggnantnannccnncnaannnngnnnnnnnnnnncnnnngnncnnnnnnnncnnnntnnggnngnnnncnnnnnncnnncnggnnnngnngnnnnccntnnnnnnngnnncnncnnngnnnnnnncnnccnncnnggnnnnanccnnnnnnntnanggnnntnnnngnnnnnnngnnnnngnntttnnannnncnnnngncnnccnnnancnnnnannnngnnnnnntnnnnnnnngnngnntnccnnnnngnccngnnnnnggnnnnnnnncnnnnnnnncnnnnnnnnanntnnnnnncnnnnaaaannnnnnnnnnngnnnnnnccnncnnnngntnnnnnnnnnttnnnngnnnannnnnnnnnnnnnnnnnccngnngnacgtaggagggattcatggctgacgtacacgcagacaagaaccaggacgagtggaacgaggagaccgtctacggtccctccaccgtgatcgccgccctcgaccagatcgaagacctcgtcgagtcctcccgcgcgtttcccctgtcagcttccatcatgatcaacaaggccgaaatcctcgacctgctggatcaggcgcgcgaagccctgcccgaggacctcgtcgccgctgacgccgtcgtcgccgacgcggacgccgtcctgggacgtgccgattccgccgctgagacgcgcatcgccgaggccaactcgcgtgcctcctccaccctcgaccaggccaatgagcgtgccgcccagatccgctctgacgccgaagaagaggctgagcgcacgcacgcacgtgccgacgccgaggctaccgccctgatctcccaggcgcgcgctgacgccgaagccaccattgccgacgcgaacgcgcaggccgagcgcatcgtctccaccgagaacattgtgcgcatggccgaagaccgtgcccgcgaaatcgtctccgaagccaagcgttcggcgacccagctgcgcgagggtgccgacgactacgtcgccacctcccttgacgaactcgcgcgccttatttccgacgtgtcacgccgcaccgaggccggtcgccgagcgatcgccgaacgccgcggcgtcgacgtcaccgatgtggacctgagtgatgaatgacaagaccttgaccctatccctggcgcgcctaccgcgcgcgctgggatccacgctccacgaagacatcgtgtggagcaccccagangacctgggnaccccctccatggcggttgcnccnggcncncccctggangtgtccgttgacctgaccagcgtcgaggacggcgtccttgttcaggtcgcgacgtccgtggacctggtgggggagtgcgtgcgctgcctcgacgaggtacgcgaccaccacgacgtgtccagtgcggaggtctacttcgaacccggcgctcctgccttgacgtcctccgatgaggaggacgaggaagccgacgacctttttgtgatcggtgaacgcgacacgatcaatatcgacacgcagctgcgcgatgccatcattaccctcgtcgacccgcttcccctgtgcagcccngactgcgcgggcctatgcgangtgtgcggagacaagtgggctgacctgcccgccgatcacgagcactttgtcgtcgatccgcgtctggcctccctggcgtccctgctggacgagcacaccgagccggggcgatcctgatggcccgctcaaagcaccttcccgtcccgccgcgcaccgacaccgacgcgctcgtggaggcgtggggcacgcgcattgatgctcccttgttgcagctcgcgctcgtgcaccgctcctacgcgaacgaggccggcggaatcgcgaacaatgaacgcctggaattcctgggcgactcggtgctctcgatcatcattgcgcagaagctctacgagcagtatccggacgtggccgagtcggacctgtcgcgcatgcgtgcggctaccgtctcccagcagcccctcgcggcggccgcccnccgcatcggcttgggcgacttcgtgttcctgggcaagggtgaatccatgcatgggggacgcgagaaggactcgatcctgtcngacaccttcgaggcactcatcggtgcgacctacctgaccagcggattggaggaggcgcgtcgagtcgttctngagcgcctgcgtttcctgctggtggacgctccctcgcgcggccatcaccaggactggaagacccttctcgtagagtactcacagtctgagggcctgggtgaagtcacctatgcggtggagggcgagggtcccgatcatcagcgcgtgtttaccgcccatgccttcgtcgccgagcgctccgacgcggtcggatcggggcaggcctcgtcgaagaagcacgcggagaatgcggccgcgcaggacgcaatgaatcggctgtccccagaagaagaataggtacccgagggcgtccgccctcctaacagttagtatgaactcgtgagtgaaaatacttccgcgcgcacgcgcgttatgatcgtcgacgatcacgagatcgtcnggcgtggtattgccgaaatcgtcgaccgcgacgagtctttggaggttgtcgccgaggccggttcggtcgcagacgcggtgcgtcgggccgacctagtacgccccgacgtcatcctcgtcgacctgcagttgcccgacggcaccggcatcgacattatgaacagtctgcgcgccacccacccgcagatcctccccgtcgtcctgacttcctttgacgacgacgaggccttggctgagtccctggaggcgggtgcccgcgcgtacatcctcaagaccgtgcgcggcgctgagatcaccgacgttatcaaggcggtcgcggacggccgcgtcctgctcgacgagcgcacactgacacgccgccgcgtcgatcacgaggatccgaccgccgacctgacgccgtcggaacgcaaggtcctggaccttatcggcgatggcctgtccaaccgcgagatcggagagaagcttggcgtcgcggaaaagaccgtgaagaatcacatcacctctcttctgtcgaagatgggtctgcagcgacgcacgcaggtggcggcgtgggtggccgggcagagggcagccgcgtggcgtaactgaacccaggcctcgtcccctgcggggatgagcacgacgggaagcgggtcggatcaaccggcccgcttcgctgtacccgatgccgacagtcaagaatcatacgagcgtgtcagtttcgctctcatcatggattctactggttgtggggaagctccaatcaaaatggtttgcggataagttacatgaggtaacgttcacctcatcctcatcgacgaggacgggcaatgcagtccactacccctgtgaaaggacacaccgtgaacctcaagcgaacgcttgccggttgtgtggccgccgcgacacagccgcccgtcatcgccgcagnccccgcctcgacgtccacgaccgagggagaggtcgcgagcttcatggtcgtcgcctccggtcgcacgctcgccaccatccagtggcgccgcatgcccaaggacggaacagaggccacgatgatcgagggaccccgatgcctcgtactcgctggaaacgatgctggccgctgacggtncccagttctacgcggtggcgacgaacgctctactccaagggcgcgatccaacgtagcagcgtgccaaccccgccctcgccgggtcccgcgtcgaagctacctcggtggcgacgggcacgctcggtcatgttcgctatgcctgagttgcgcgtgcgattcggatcgataccccggccgtcgtcggtgatgaggatacgcacgcgaccgcacttgccctgcccggacacgtcgacgttgacggtcgccgccgtcgcgtgggcgtggcgngcaatnttggacaggccctcgcgcacgatagcgacgacgtcgtcggataantcagggtcgacgcggccattgaactcgtcgatgacgaccagttcgttgtccaggtcagagttgatcgcctc

SEQ ID NO: 204 - DNA, 4000 bp, Escherichia coli
  misc_feature (38)..(38): n is a, c, g, or t
  misc_feature (132)..(132): n is a, c, g, or t
  misc_feature (143)..(144): n is a, c, g, or t
  misc_feature (150)..(150): n is a, c, g, or t
  misc_feature (940)..(940): n is a, c, g, or t
  misc_feature (1830)..(1830): n is a, c, g, or t
  misc_feature (1876)..(1876): n is a, c, g, or t
  misc_feature (1989)..(1989): n is a, c, g, or t
  misc_feature (3150)..(3150): n is a, c, g, or t
  misc_feature (3986)..(3987): n is a, c, g, or t
gacttcggatgccaggaaggccgcgagctcggccgagncgaagggggcagtcgagccgctgtcgccgccataccccgccgtgtccgcatcggccttgagcatggccgcggtgtaggtgaaggtcgcgattanctcgctggtcnngtcgangaaggtcagggtgaaaccgcccgccgtcagatcatcggccggcgggcccgcactgccgctcgagagctcgaacgcggcatcgtaaagcacgcggggcagggtggcattcaggacgccatagggccacatccccacgtcgagaggagtcgagcccacgccccagctcgtgacactccatgtagtgccctcgggagtgaacgaagccgcgttcgtttggtcgtccggtccctcgcccgaggtcagaacgtagaaagcaacgtcaggattaccgcccgagtcatcggacatccggatcggggagttggcttcgaccaccgtcttaagccgcgtttgaatggtggatggcaccccgtcgccgtcggaaaggtccgagatgtcaagggtaaaccggccctcggtctgcacgtaggtgtcatcttttttgacttcgacgtacaggagctcagtcaccgaaagcgcgaacgcgaagtagtcgtattgggcagcacccgacggctggccgcagtagcacgtgagggccggaaagcgcccggtcaagaagtcgtcatggatgacggacagatcccccgtgtagttgttgagccaattgaggttgccccaattgttgatgacgaacgagaccgcttgctcgacattggcgaagggtagccaagtcgtcaccggcgggcttccagactgccccgctgccacccatgccgccgtcccgtcgcggctcaccacgatggagcccgcgggccggtagcttggcggcgaggtcccgttgtcgatggcttcaaaagccttgtagctngtcgggggaatgccggcgggcccgttgaccacgggagctccgcaaggaatgccggtcgagggtgatccgctgcccatggggagaactccaccgagttgaacgtctgcgctcatgtggcggccgcttggctaggggtttgcgtgaaaacgatcaaggtgctgcaccccggaaggctttggggcaccaagcccgacttcgtccacgcttgaaccgcggggtgaccgtcgagaaaatcggtgaacgagtcgtagcccgtccaatggataaacttcgttgcgccgctggtcgggtctgcgatcgtgcccgcgttgatcgcctcggccacggcgagatcatcctcgtgtatctcgcgcccaaagggtcgaccgtcgccatcgcccgccgtgctgtagcgccggcccgcctgcgttcccagcgtgcccgggttgacggtgatcgctttttcgatactccacccgtgcgcggccgcatcgttctttaggacccactggatcgcggccttctccgtctggctcgctcccgcgtgctcgctcgcgctcacgcgcgacatgcccacagcatcggccgtgacgtcactccggcccgtggccgcgttgacctgggccacgaggtcagagagcgactcttgcagcgacccgtccgcgtttagatgcgaggtcgtgagctgctttccacgaccaaggaaggcccgcacgacttggatcggatcatcgcccatgaaaaaccaccatgctaagaggagtagcacaccaagccagaagaccagatgcgaggttttcaaggctcatgcccccaccgggtagattatgtcgaacgtgctggggatcgtggctctgacgagggccaccacatgatcggccagcccatcgcagcccatgaccacgttcgcncggagctcgagcgctaggcaaaggttccaggcgggcaactcctctngcgtggcatatgccggattcaaggagtaggacaccaccaagcggataccgtcgccgccgtctgtgatctcgcagccgtcccctaggccgttgccgaaggtcccaccgttcagnaagatcgcggagttgatttgccccaaaacatgggtcaccccttggttgtcccgtcggatagcgaaggccgcgagcccacaggcccacccttccccctcggttccgttgtaggcaccaaggggatcgtaccccgggaaattcgcgagccactccgcccggcgaaagaaggccgaggctaccaggcacatgcgccggtcaaggccccagatgtcgatcgtcgcctgacccgtggttgcggtcgggttgcggtacgcgtcgccgtccaaaggattgtggaccgaggcaatcacgagctcgagcccgcgatcctgccccagcgggacacgcgcttgcccgctcgagaggtcccacactagggagaatttgcccatggtcggagcttaggacgcgctgtcgctgtagtcgtcactcccatacgaacccatgccggtatcagaagacccggagctgcccaacagactcgcgacgctgcccgcggcgccggcgctggcggttatgagcgagctagctcccgcaagcgtgctgccggttccggtgaggaccacaggggtggacgttccgcccggcatgctcgcacccgtcgcatacgctcccgtggtggccaccacggcgggcttacgcaggatgacgaaatacacaaccacgatgccgactcccaagaggactagtgtgctggttttcatgtgctgagctccgtttcagagaagactcgccgcaacgccggcgaattgcagagactgcgcgaggctaggggccccgctcgaaagattcatccccttgccctgcgtccacacggacgaaccacccgggccggatttggtctgcccgaagccaagcgtcttggcttgagtcgatgtcatgtcgtcaaaatcgacgtacccgtacaagtcgagctccgcttgccacgcgttcagctgggccgaatactcgagcgtgccgggcacgagaggatccgtgattaccgaggtcccacccactcccccgccccaatacccgccttgcatgagttgcttgaaccattcgacgctcaagaactcgtagccctgcccgatcatggtcgcgtcgatgttgtcgatggggacgccggcgaacaggcccaccgtctgaccgttgaacgcgtccgcgccaagggtggcaaactggctcgcggtcaggctgttnaggttttgcaggttgcccttttgagccgcagcgagaatgcccgcgatcgtgggatcgctcgagccccctcccgctgcctgaacagcgtccgcggccgcatcgtaggccgttacctgcgcttgcgtgtagacggtgcccgccgtggctgcgccctggctaggcccgggcgtggcattgcccgggccggcgctcgagctggccgcggccgcggtgctagagtggtggagcaagagcaccacgaccagcaccacgacgcctagtagcagatatgtcgatcggctcgacatggccgcgagctaggaccgggccgggtgaggcgagacctggggactaggggacagctgcgaaccgggcagggcggcgagtgccttgccaaggctggcttgcaagtcgcggaaagacgaggtcacgaaagcgtgctgagtgctgggcagcgtgttgtaggtgaagttgacgggcagctggaagttgccgcgcggcttgagggtggaacgaaggtccatcccaaggcccggctgcttcaggaacaggaattttatgtcggccgggttgatgccgctgaccgtgtccggcccgccgctgacaacatcggcatagttcccgttttggtcgagcccgacgggggaagccccatagcgctgggcgtcgaggcgagccttgatgaacgcgggcacgttctgcatcttgttaatgcccagcttcgggcagtcgatctctgtgatgttgtccatggtcgtgttgccgccaaggcccaccaaggaggacagcagcgcgatcgaaaacacgtagtccttgggattcgagccgctggcgttcgtctcgttgaaccggcgcanngtgatctgcgagc

SEQ ID NO: 205 - DNA, 4000 bp, Escherichia coli
  misc_feature (127)..(127): n is a, c, g, or t
  misc_feature (415)..(415): n is a, c, g, or t
  misc_feature (1985)..(1986): n is a, c, g, or t
  misc_feature (2034)..(2034): n is a, c, g, or t
  misc_feature (2553)..(2553): n is a, c, g, or t
  misc_feature (2685)..(2685): n is a, c, g, or t
  misc_feature (2721)..(2721): n is a, c, g, or t
  misc_feature (2897)..(2897): n is a, c, g, or t
  misc_feature (2900)..(2900): n is a, c, g, or t
  misc_feature (3058)..(3058): n is a, c, g, or t
  misc_feature (3385)..(3385): n is a, c, g, or t
  misc_feature (3409)..(3409): n is a, c, g, or t
  misc_feature (3454)..(3454): n is a, c, g, or t
  misc_feature (3704)..(3704): n is a, c, g, or t
  misc_feature (3741)..(3741): n is a, c, g, or t
  misc_feature (3795)..(3795): n is a, c, g, or t
  misc_feature (3879)..(3879): n is a, c, g, or t
cagccctgccgctcgcgcaccgcgacgtacagctgtgcggtgaacaccgccgcgaccaccgacgacgccgtcgtcaccaccgcgccggcggcggcggcggcgaaggtcgccgcggcgatcccctccnggccgacgatcaggcggacgacgacgccgaccaccgcctgcaccgccagcgtcgggatcagcacgaccagcgagaacagcagcagcaccgcgatcagcttgcccgtcagcccctgcgtcagctcgatcgagcgcgggatcgcgcgcagcccgcggcgctcgttgaggatcaccgggttgagcagcacgatccgcgccgacagccacagcgcgaacgccatcagcaccagcccgtagaggaagatgaaccccgccgcgccgcccgacatctgcgcggcggtatcgggcntggtgaaatcgacgccggcgcggatcagcgcgacgatgatcggcaaaaaggcgagcgtcaggatcgcgcccagcaccagcacgacgcccagcgccggcagcagccgcgcactcgcctgcgcctgcgcgtcggcgcggccggtcgccgggtcggtcgcgatcgcgatgatcgccagcgtgccccagatcgtcgcgaccaccgacgccagcgcgaccgccgccccggcgagcgcgctgcccggcgaggtcggggtgaagctcgtcacgccggcgctcagcacgttgggcagcaggatcgcgagcgcggcgatcggcgtgatgatccccgcccgcccgcgcagcacgtcgaccgtgcgatcccagacgttgcccatgctcaccatgtcgttcgttccccgttgtcgtacccggtcactcttgcacgcctcgccgcgcgcggccagatgccgcgggtgaccgtcgcccccctcccctcgcccgaatggcgcgtctcgccggggctgacgccctatgccgacgcactcgccgagatggagtcgcgcgccgccgcggtcggggcgggcgaggcggcggaactcgcctggctgctcgagcatccgccgatctacactgccggcaccagcgcgcagccgaccgacctggtcgatccgcgcttccccgtcgtgccggcggggcgcggcggcaagtatacctatcacggtcccggccagcgggtcggctacctcgtcctcgacctcggccggcgcggccgcgacgtgcgctgcttcgtccacgcgctcgagggatgggtgatcgccgcgctcgccgaactgggggtggagagcttccgcgcgcccggccgggtcggcatctggacgatcgacggcgacggccgcgaggcgaagatcggcgcgatcggagtgcgcgtgcggcgctgggtgacgatgcacggcttctcggtcaacgtcgcgcccgacctgtcgcacttcggcggcatcgtgccgtgcgggttgcccgagttccccgtcaccagcctcgccgcgctgggcgtggaggccgacatggcaaccttggacgcagcactggcgttgtgtttcccgcgcttcctccaaactctttcttgtgcctcgcaaaacgaggcttgaggggtcgcgggtaaccgtctacacgtccacgtcgatttgggcgaaaacagggcaatcgatggcccgccaaatcctctatctagggagcttccacatgcgttcgatcttttccaaggttctgaccggttcgatgattgccggtgcggcgctggccgtgtcggcttgcggtccgaagaccgagaccaccaccgacaacacgatggtcaccgacatgaacaccaccgagggcatggacaccatgaccgacaacatgaccgccgtcgacggcagcatgaacggtggcatgatggccaacgacacgatgatgtcgaacgacaccatgatggcgaacgacaccatgtcgaacgccggcatgaccaacaacatgatgtaattgcttcggcaattaccgtgttggaggggccgtccgggcgaccgggcggccctttctcgttgcggcgagtgcgnngcgccaacgggatcgttccggctgcgaccagcggttggtcgcaaccangccaccgccagccgtcgaaactggttaattcccgctatgctcgcgcgcgaaatgcgatagattccagcgacaaggttcggtggagtagcaggcgtcatgaaggttttcggtttcgcggtcgcgatcgcagcggcgatggccggaacggcggcgacgcccgcttccgcgcaattctactatcagaattacgattacaacggcgcgccggtgcggggcgacgagccggggatcggccagccgctgccgggtgccaatcccgtcgaggtgaccgcaggcttggtctggacgctccgcgccgcgctcaacgtcgccgcgctgcaatgtcagttcgaaccgacgctgctgaccgtcggcaactacaacgccatcctgctcgaccacaaggacgagctgaaggcgtcgtgggacgtgctcggcaagtatttcaagcgcaccaccaagaccccgcgcgaggcgcagaacgcgctcgaccagttcggcacccgcacctattcgagcttcgcgacggtgacctcgcanttcaccttctgccgcaccgccaattcgatcggccgcgatgcgctgttccagtcgcgcggcagcctcgcggcgctggcgcagacgcggatgcgcgagctgcgcaacagcctcaagcccttcggcgagcagcgnttctcgcgcggcctgcgcttcgacaccgccagcgtnccgcggatggacccgatctgctggaacaagaagggcgagtggcaggtcaagaagtgcggcgccttcgcctggcccgccgcgacgccgccgatcgcccccctcgccgcagcggtccccgccacgacggtcgccaacgcgcagtaacgccgatcctcccccgccagggggaggattcngangtcagcgcagcccgagcagcttgtgcgtctgcaacgacaaccgccaccgcggccgcgccagcaccatctccacgcacgcctcgcgattggcgtcggccgccggatcgtcgagcggctggagcagatgatgcgcgaagtcccagcgctccaccgcgtcnagctcgatccccgcctgcggccagaccagcttcagctcgtcgcccgatcgctggaccacctcgctccccgccttggggctgatgcacacccagtcgatccccggatgcacgggcaacgtcccgttgctctcgatcgcgatgcggaagccggcggcgtggagcgcgtcgacgaaggcgtcgtcgacctggagcatcggctcgccgccggtgaccacgaccagccgccgctcggttcccgcgccccaatgcccctcgaccgccgcgaccagcgcggcggcgtcggcgaacttgccgccgcccaggccgtcggtgccgacgaagtcggtntcgcagaagcggcacaccgcggtngcgcgatcctgctcgcgccccgaccacaggttgcaccccgcgaancgcacgaacaccgcgcgcgcgcccgcgttcacgccctcgccctggagcgtcaggaacatctccttgaccgcgtagctcatgcgtcggcgggccgcaccgcgtagcgcgtcggatcggcgacgcccgcttcctcgaaccccttcgcgcgcagccggcagctgtcgcagcgcccgcagtggaggtcgccatccccgctcgagaccggatcgtagcacgaccagctcagccccaggtcgagcccgaggcgcantccctcgcgcacgatgtccgccttggtcatgtgctgnagcggcgcgcggatgcggaaacgctcgccctccgcccccgccttggtcgccagntcggcgaggtcctcgaaggcggcgatgaactcgggccggcagtcggggtatcccgaatagtcgagcgcgttgacgccgatgtanaggtcgcgcgcgcccgccgcctccgcccagccgagcgcgaggctgaggaagatcgtgttgcgcgcgggcacgtaggtcaccgggatgccgggctgcacgccgtccttgggcacgtcgatgt

SEQ ID NO: 206 - DNA, 4000 bp, Escherichia coli
  misc_feature (1998)..(1998): n is a, c, g, or t
atcacagataataacgccttttccggcagcaagaccgtctgctttgacaacacatgccccaagggtacgggcaaagtcgcacgctggcgctgtttgggtgaaatactcccactgtggctgggcaatatcatgtctggcacaaaaagctcgggcaaatcgctttgagccctcaagttgggcggccgctgcacgcggaccacacaccgcaataccagttgcttctagcttgtcagcaaggccatcaacaagtggtgcttctgggccaataatcacaaggtcgcaggcctcatctcgtgccaaagcaacaagaccatccagatcatctaaggatgccggaatacaatgcccgcgcccatcaatcaaatcagcaatgccaggattgcctggggcaaccagcacaagctcacataaaggggaggctgaaacagcccaggcaagggcatgttcacgcccaccgcttccaatgataagtaccttcacgttcgtcctgcctttatattttatcaagaatgaattcttacaagttctagcgtaatctgagcagatgcgccatagtatctgccatgattgatgataatgattataccctatctaatgctgcgacgaatgatgctgggcttagtaataatgcttatttgtcggttggcgagctgagtgcagcggttaagcgcacaatcgagggcacgtttgattatgttcgcgtacgcggcgagatatcacagccccgcacgccagcgtccggacatgtctattttacgttaaaagacgaaaaaaatgctcttgccgctgttatctggcgcggcgttgcctctggcttgcaggtgcgccctgaagatgggcttgatgttatctgcaccggtaaaatgacgacctttggcgggcagtcaaaataccaattaattgtgaatgaaattgaagtagctggcgaaggcgctctgctgaaacagcttgaagataggcgccgtaaacttgcctcagaggggctgtttgataatgcacgcaagaaaccaatccctgctatgccgtcggttattggtgttgttacaagcccgactggcgcggttattcgcgatattctgcaccgtgtacgtgaccggtttggggttcatgttcttgtctggggtgtgaatgtacaaggggtgggagccgctgagcaaatcactgccgccattgaaggatttaacgctctgccagagggcggtgcggtgccgcgtcctgacctgctgattgtagcgcgcggcggtggctcacttgaagatttatggtgttttaatgaagaaaatgtcgtgcgggctgcggctggctcacagattccgctgatttcggctgtcgggcatgaaacagacacaactctgattgactatgcttctgacatgcgagcgccgacaccgagcgcagctgcagaaatggcaacgcctgttgccgccgagcttgctgcgcggttaagtgaaattgatgcccgtctgcgccgcgcaattacccgccagcttgataatgctgagcagatggtacgcgctattatgcgcggcctgctacatcctgcagaacagattgcacgccagacccaaagccttgatatagcgcttgctgggcttgatgccggcatgatgcgcttggttgaggttaatgacaggaaattagcaaaactgtctgacagaattgtctctcctgaacagcggcttgccgtcgtgacccagcgtcttggtgtgatgcaagaacggcttgatagtctgatgatgcggcggcaggagcgcgcccaagagacgctgtcgcaggcctctcgtctgctgtctgcaaattcttatgagcgcgttcttgagcgtggttttgcgcttgttacggatgagacgggacaggccattaagcggagcgatgaggctgcaataggcgctaaggtagagattaaatttgcagataaaaaacgcgccgcccagctggacccggataccgcctcgtccgttaatccaaaagcagggccagtaaaatcggcagtaaaancggcagtaaaaccggcagcaaaacctacatcccaagaagagctattctagctcatcatccttaaccacagacttaccccatctgcgatggggccagagccattgttccggggctgctgaaatccagtcttcgaatgtttcatttatctgtttggcaatcagcattgttgctctgtcatcatcaccttctggcattatcagagggtcggagattgtgacagtcagcctatcatctttggtccgcacgccatgcgccataaaaatgggctttcccattttgcgcgcaactttgatataggaaatagcggttgtcgctggatggccaaaaaacggcacaaattcgccttcgcgcagttgctggtctacaaccatcatcatgaagccgccttttttgacggtgcgtaccatgcccatcgcagcttcgcgtcccttgatgtagctatccgccccagtgaattgaactctgtttttgaaaatccagtttgcatagggattattcaactcacgatagataaggccggtcttaatattcgccgcaatgctgagaagcccaacagcctcccaattactgagatgggcactaataataaatccgccatcatagggggttaatttttccagaccggtaaagctaatgcgccccgatggcagcattgtttttatatggggatattcaccaatacagcggccaatattattccacataccatgcgcgatatgctggcgttcaggtaatgagaggtggggcagtgcaaatttcatattcgcaagagctcgtttatgccacggcgtgagcggcccaagactttgaaaaagccggcccatagtggcactagcaaccgaagccggaaggcaccgcaagatgccaacagcaagaaagagcagggctgcttcgcacggccagatgataaagcggtaaagggctgttaggacaggacccctataggacattgacactgaatgttcctctcagattaacagcgacgcgctataaagagcgcttcatcgcaacaatatcatctaccatattcatgaccagctcttcggcctctgtctcaaacgacatgcttacctgtagaacacttacacggtcgcgccattcagggggcaggcgcatccagtctttcagtgtcgtgacaagctcagcgccgttctgaacagcatccagatgaagccgtgttaagtctgcatcgctataggggtgatgatcagcaaaagcaagcgtttgaacaaggtcggcgccgcaggctgcaaccgttttgaaaaagcgggacggacgaccaatgccggcaaaggcaagaaagcgttttcccttaatgtctgctgcactgtcagggtcgggaacaaggctgccggtgataacctgaacgctatcagcaagccgtgcggtaaggcctgtctcatcctcaccatttatgacggcaagagagagttgtgcaactccggatgaaaagctctggcgtaacgggcctgctggtaaaatccagccattgccgcacccagcactaccatcaaaaacaccgatgacaatatcctttgccagccacggattttgcatgccatcatccatgatgataatatcagcttcggttgagcgttggataaaataagcgcctttcagccggtcaggactaacaataacaagctcattcagcgccagcataagaggctcatcgcctacatcatctgtgccatgcaggctggcatcaacaataagaggccctttttcagaaccaccatatccgcgtgtcaggacagccggattataccctcttgccctcagcaactgacacagactagctgtgagcggtgttttgccagtgcctccgatgctgatattaccaacacagataacaggcaaggataccgtgccggctgttgccattttctgccgcagaaacgttcccaaccgccaaatccaggatacggggatcagcatggccgctagcgcatttttctggtcccagaatgacggtgttttcaacatattattgattattacc

SEQ ID NO: 207 - DNA, 4000 bp, Escherichia coli
  misc_feature (191)..(191): n is a, c, g, or t
  misc_feature (210)..(210): n is a, c, g, or t
  misc_feature (273)..(273): n is a, c, g, or t
  misc_feature (294)..(294): n is a, c, g, or t
  misc_feature (580)..(580): n is a, c, g, or t
  misc_feature (620)..(620): n is a, c, g, or t
  misc_feature (648)..(648): n is a, c, g, or t
  misc_feature (671)..(671): n is a, c, g, or t
  misc_feature (725)..(725): n is a, c, g, or t
  misc_feature (1052)..(1052): n is a, c, g, or t
  misc_feature (1102)..(1102): n is a, c, g, or t
  misc_feature (1161)..(1161): n is a, c, g, or t
  misc_feature (1168)..(1168): n is a, c, g, or t
  misc_feature (1231)..(1231): n is a, c, g, or t
  misc_feature (1397)..(1397): n is a, c, g, or t
  misc_feature (1628)..(1628): n is a, c, g, or t
  misc_feature (1774)..(1774): n is a, c, g, or t
  misc_feature (1991)..(1991): n is a, c, g, or t
  misc_feature (2285)..(2285): n is a, c, g, or t
  misc_feature (2424)..(2424): n is a, c, g, or t
  misc_feature (2603)..(2603): n is a, c, g, or t
  misc_feature (3141)..(3141): n is a, c, g, or t
  misc_feature (3745)..(3745): n is a, c, g, or t
  misc_feature (3808)..(3808): n is a, c, g, or t
  misc_feature (3951)..(3951): n is a, c, g, or t
  misc_feature (3954)..(3954): n is a, c, g, or t
  misc_feature (3976)..(3976): n is a, c, g, or t
  misc_feature (3987)..(3987): n is a, c, g, or t
tcctcctcttcctcttcgccttcgtgccgcgcctccgggcggtagaccatcgcgtagcgcgcgatctgaaagccgcacgcctcccagaagcgcaggccgcggacgttgcccgccactaccgcggcgtagacctcgcccgcgccctgcgcccggagaaactcgatcaccgcttcggccaggcgtcggcccangccctcgcggcggtactcngggtagatgaagaactcggcgaccatcccctgggagcgcccgtcgaccatgccgcgctgcagngtggcgacggcgaatccgacnttgcggctctgatccaccgcccaccagatgtgccgcgtcttgccctggtctttgaagaggactttcagatactggtccagccagtcgtccggcggcgcctcaccgttgatttcctcgcggtagtggcgcatccagtcacgaaacttcttgtcgccgggatcgacgtgctcgagcttcatcggctgcccaactccaatgctcgctttcgatgggtaatgttttgtcttgctggaggatcactgaagaggttacggcgcctggttggactgctcctgcctcggtgggnggcgggcggcgacagtgccaggggcgcgcgccgccgctanccgatgatgccgtattcgtaaggactgnggatcaaggctccgtccgcgaancgcgacgggcggaacacgccgatgtcgatgctgctccgctcgccgaggacggtntgggccatgacctcaccgatcgccgggctgagcttgaacccgtggccgctgaatcccgcggcgacgaacagcccgtcgatgccgtccgccgggccgagcaccggctgccagtccggggtgacatcgtagaggctggcgaagccgccgcgcacctcgccgtctcgcgacccggggtatcgccagacgagcttgcgcacgatccgctccgcgaaatcgaaatccagcccctcgtcaaagcgatccgcggacacctcttcctcatccgtctcctcgatcgaccccagcagcacctggccgccgacgtcgggacggaggtaaaaccccttnagcagatcaccgcagactcgttcgatggccacggcgcgcaggtggaccancgcgacctggatgcgcatcgtccggatcgggaggtggacccgtagcggatccagcagangggacgnccacggtccggcggccaccaaaacgcgcggcgcgtggatcatgccggcggaggtctccacccnctgcacgaccccgcgctccacgacgatccgcgtggcggtggcgccgggtgtgacctcgacgccgtgccggcgggcggcggcggcgaacgcggtgctggtggcatacccgtcggcatagccggagtccggttcgtaagcggccgcggccacgtcatccagattcatngccggatccaggtcggccagtgcgcgcggactcaacacggaggtgcgcacgccgagggaggactgcaggcgagcgttggcttccaggtgggcccggtcggccgcccccgccagcagcagaaaccccgtcgtgcggaagtccgcggtgccgccgaccatgtcggcgaaatgctggaagatctccaggctgcgccgggccagccggatgagtggctccagtgagtagtgcatncggatgatgccgctggagcggccggtgggcccgccccccacctggcctttctccaggaggacgcagcgcacgccgcggcggcccagttgaaaggccgtgctcgtgccggtgcagccgcccccgatcaccacgacgtcggcggtcgncacgttagagcgggatgttgccgtgcttgcgcttcgggttggtctggcgcttggtctgcaggagttcgagagcggcgatcagccggggtcgggtctcgcggggctcgatcacgtcatcgatgtagccgcgcccggcggcgatgtagggattggcgaactgcgcgcggtaggcctcgacgagttcgcggcggcgggcctccgcatcttcggcctccgncagttccttgcggaagatgatgtcgatggccccctccggccccatcacggcgatctccgcggtcggccaggccaggttgaggtcgccgcggatgtgctggctgctcatgacgtcgtaggcgccgccgtaggccttccgcgtgatcacggtcagtttgggcacggtcgcttcgcagtacgcgtagaggagtttggcgccgtgccggatgatcccgccggactcctgcgccgtgccgggcatgaatcccgggacgtccacgaaggtcaccagcgggatgttgaaggcgtcgcagangcggacgaagcgggcgcccttgtccgcggagtcgatgtccagcaccccggccagcacggcgggctgctgggcgacgatgcccacgggccggccgttcaggcgggcgaagcccaccagcagattgggggcgaactcgcgntgcacctcgaggaactcgccgtgatcgacaatgcggtggatgacctcgtgcatgtcatagggcttcgtcggttcctcggggaccagcgggttcagcgcgtcgtccatccgcgcggggtcgtcggtgggctctctgcgcgggggatcgtccacgttgttctgcggcaggtaggcgagcanacggcggaccagcccgagggcgtcctcgtcgtcttcggcgacaaagtgggcgacgccgctcttcgcggcatgcacgtcggcgccgccgagttcctcgtggctgacatcctcgcgcgtgaccgccttcaccacctgcgggccggtgacgtacatgtaggacgtcccccgcaccatgatgatgaagtcggtcatcgccggcgaatagacggccccgccggcgcagggacccatgatcacggagatctgcggcacgacgcccgaggtcatcacgttgcggaagaagatctcggcgtacccgccgagtgccgtcacgccctcctggatgcgcgccccgccggagtcgttgagcccgatcacggggatgccgctggaaagggccaggtccatgatcttgacgatcttctcggcgtgcccttcgcccagcgagccgcccagcaccgtgaaatcctgcgagaacaccgccacgggccggccgtcgatcgtcccgtggccggtgacgacgccatcggccggggcctcgatcttgtctaggccgaantcgcggccgcggtgcgtgacgaagcgatcgagttcgacaaacgacccgggatcgagcaggaggtcgagccgttcgcgcgcggtgagtttgccggcctcgtgctgtcggcggatgcgctcctccccgcccatgcccaagaccgtctcggcgcggcggcggaggtcgtccagccggtccacgactctttgctcctgcgggtcgccggtcccgccggttcccaggccccgttaggcctggacgggaacttcgtgcgcgagagcggagcgaggacggatcgagatgatggcgtgcttgaagactaattcctcaatgccccgcgcttccacgagcaggctgtaggtgccgaagtccttgaccaccgcttcggggatctcgtagccgtcgcggcagcggatgtggacgacgacgccgctttggatcagccggcggtagaagtcgtcttccagccctccccgcccggcggcgcggccgctctcggcgcggtagggctcctcgcgtgtggacatcactgcacctccctcagcttccggacgaatctcctgcacgccggcgataacatcctctctcggcgagaccgcgacgggcgccgcgctcatcgacggcncgccgggcgacgcgggcgggctcacctcgagcggcatgttgacctggggcgtgacgcggggcncggcctcggccccgtcgcccgccggaccttccgccggcgcggggatggcgacgtcgggccgggcgccgccggattcagcggtcacactcggcaaatattcaacggcgccgccggccggcgtctcgcgcgggccgcccaccggnggnggcggcggcccctgcggcaggnggatcaagcgntggtactgcgccc

SEQ ID NO: 208 - DNA, 4000 bp, Escherichia coli
  misc_feature (1985)..(1985): n is a, c, g, or t
  misc_feature (1988)..(1988): n is a, c, g, or t
  misc_feature (1991)..(1991): n is a, c, g, or t
  misc_feature (3213)..(3213): n is a, c, g, or t
  misc_feature (3383)..(3383): n is a, c, g, or t
  misc_feature (3673)..(3673): n is a, c, g, or t
  misc_feature (3703)..(3703): n is a, c, g, or t
  misc_feature (3820)..(3820): n is a, c, g, or t
agaatcttcaggcggtcttacataaggaatattttcaatctcatcatcagttactggaatattaaacttatccctaaatgacttgatattatcaagcgataattttttgacctgatgagtggtattgtctgcttctctggaaccaacaccgtatccttttgttgttaaagccaatataaccgtaggtgctccagaggaattaactgccttatgataagcagcataaactttataaggatcatgaccacctctatttagtttgtatatatcctcatcagttaaatcttctacaatttttagggcttccggatcctttgcaaagaaattttctctagtatatgcaccaccttttgctttaaaattttgcatttccccatccaatacagcatccataatatcttgaagcttaccctctttatctttagccattattggatcccactttctaccccaaacgactttaataacattccatccagcgcccctaaaagaaccctctagctcttgaataatttttccattccctcgaacaggaccatccaatctttgcaaattacaatttataacaaaaattagattttctaagctttctcttccagcaagagctattgcaccttttgattctggttcatccatctccccgtcaccacaaaaaacccatacctttctatcatttctagggactaaacctcttgcagacatatatctcattatatgagcttgatatatacccataattggtccaagacccattgagactgttggaaattgccaataatctggcatcagccagggatgagggtatgaagacaaacctggctttttaacctctcttctaaaattatctaaatcttcttcatgtagatacccttctaaaaaagaccttgcatatatcccaggagatgagtggccttgataataaatcaaatcttctagttgaccttctgaacctctaaaaaaataattaaagcctacatcatataaagttgcagctgatgagaaagttgatatatgtcctcctaaatcatcatcattcttatttgctcttaaaactaaagctaaagcattccatcttattaaagaacgaattcttctttccataaataaatcaccaggcatctgtgcctcgtcttttaatggaattgaatttctaaaaggtgttgtaaggttgtatgaaggaattgctccctcttcatttaatttcttagcgagttttgtcattaagaatgatgctctttcaacaccctctttctcaataacgctatctatagcttccaaccattcacttgtttctataggatctttgtcttcaggtatcatatatatgtcaaattttatgaatctaattttactgtagattatgttaaaaatatacaatattcataataaatgttaaatattgtaaataaattacaaatatatataattaaattatgattttagatactctagtaaatggtgatgtaaaattaagcaaatctgaaaaatggattgcgctttctgtattaaataatcccactaaagttataagtcaatcgattacatctttagccaatgaatctggtgttagcttacctactgtaaatagattctgtaaaaaacttggctttgatgggtatcctgcttttaaaattcaaatagctcaagaaattactaatactaatcaactattagacagattcaatgtagataaggatactcctgaagttgtgaagagagttatgagtgatatacagtcaactattgtaagcgttggtcaaaatcttaatccagaatcgatcgataaggcaacagactttctggcaaatgctagtagtattacattttttgggcttggtggctcaggacctgttgcattagatgcgcagcacaaattttttaggtttggaattcctgtcgttgctcatacagattatataaaccaaagaatgattgtttcaatgatgaaggaaggcgatcttctagtattaatttcttttacaggnagnacntctgaaatagtagagactgctaaaattgctaaaaaaaatggtgtaaaaacaatagcattaacttctgaagactcccctcttgccaagctttctaatgttgttctgcatatacatactcatcttgagaataatcttcatatccctatgacatctagactagctcatttagctattattgatatactttctgcgaccgtccaggctagatttggaaaggtttttgatagtagaaaggatgaagttattaaaaatattgaaaaaactagagtttaattatttaactattaagtttttaagaaataatatttattttgatttctgtttgattgagtagaaaatacaaaggtaattctttgttacttttagcttgttcatagacctctaatttctttttattaggtattaataaaaatatatttttggattgaagtatcatagacagattcatactaactcttttatgtgcaggactgcccatagcttctgtataaattatttctggttttgatgatggctcaaaatagttagaattagttttaattaatgatgggaataaagaggcaaaatgaccatcctcacccatgcccaacaacataacatcaaaaggcctttgaatatttagagctttgtcaggtgaattgcataaggatataaaatttgtatttatagcattattaatcatcaaattttctatgactagtttttcattagaatcgttatgagatttatcaacaaatctatcatcaacaagggtgatatttactttagtccaatctagatgcattagtgagagttcattaaatatttttactggactggagcccccgcttacaactaaacttgcttcgttgctttctttaatagcaagttttagtatttcgattatttgatctgataaatttttcatttttataataaattaaatgagtttgctattccatctattacaaattcaattgctagcgcgccaagaagtaaaccaaatattttttgtactacagtaataatggttggacctaattttgatgataactttgcagataaccacatggcaatagtagctataaatactactatgagtattggtagatatgaaaccaagccatctaaagctgaagcataagattcttttgatattaataagcttgttgccatagctccaggacctgctattagaggtatggataaaggaaatattgctattgattttatggtttcatcntctatggctgtatctgctgtattttgtcgcctgatttgtctttgctcaaaaaccatctgaaatgcaataacaattaagaatagtccaccaattatcttaaaagagtccatgctaatattcattgcgtcaagaatggcattaccaaataaccaaaaaatagtaagaactantaaagatacaaaactagctcgcaagtaaacagatttaacctgatgtttatttagacctgcggttagacctgcaaaaatcggtattaaagatattggatctattgcaacaaacatcaataaggtgctttctacaaaagtatcaaacatgctaaatatttataatttgaatagcttctgagtgctcttctgaaaatatacttgaaaccataataaactttaaatcttttttgtctttaccataatatttttttaaaatctttgaaacattagccaatgttttatcatggttngatagatttgataaataaaagggaactgtngaacctataagagatagttgattgagagtttttttatttccagtaaaggtaaaaactggaatgccgttaggtttagagtttgaaatgtaattagctgttttaccagttcttgtaatngctatgatgccgtctgcattaattgtctcagcaagattttttgctgccacaccaatatgctgccaatcagagtttggtgtgaaattcttctcataacctaaagttctaaacttttctgttttttctgctatagattttaagaaggttacacattccgatggatatttaccaacacttgtt

SEQ ID NO: 209 - DNA, 4000 bp, Escherichia coli
  misc_feature (1925)..(1925): n is a, c, g, or t
  misc_feature (1934)..(1936): n is a, c, g, or t
  misc_feature (1939)..(1939): n is a, c, g, or t
  misc_feature (1951)..(1952): n is a, c, g, or t
  misc_feature (1987)..(1987): n is a, c, g, or t
  misc_feature (2012)..(2012): n is a, c, g, or t
  misc_feature (2019)..(2019): n is a, c, g, or t
  misc_feature (2037)..(2037): n is a, c, g, or t
  misc_feature (2055)..(2055): n is a, c, g, or t
  misc_feature (2061)..(2061): n is a, c, g, or t
  misc_feature (2071)..(2073): n is a, c, g, or t
  misc_feature (2117)..(2118): n is a, c, g, or t
  misc_feature (2122)..(2122): n is a, c, g, or t
  misc_feature (2166)..(2166): n is a, c, g, or t
  misc_feature (2173)..(2173): n is a, c, g, or t
  misc_feature (2220)..(2220): n is a, c, g, or t
  misc_feature (2226)..(2226): n is a, c, g, or t
  misc_feature (2229)..(2229): n is a, c, g, or t
  misc_feature (2238)..(2238): n is a, c, g, or t
  misc_feature (2244)..(2244): n is a, c, g, or t
  misc_feature (2250)..(2250): n is a, c, g, or t
  misc_feature (2256)..(2256): n is a, c, g, or t
  misc_feature (2316)..(2316): n is a, c, g, or t
  misc_feature (2319)..(2319): n is a, c, g, or t
  misc_feature (2352)..(2352): n is a, c, g, or t
  misc_feature (2370)..(2370): n is a, c, g, or t
  misc_feature (2376)..(2376): n is a, c, g, or t
  misc_feature (2380)..(2380): n is a, c, g, or t
  misc_feature (2382)..(2382): n is a, c, g, or t
  misc_feature (2391)..(2391): n is a, c, g, or t
  misc_feature (2394)..(2394): n is a, c, g, or t
  misc_feature (2457)..(2457): n is a, c, g, or t
  misc_feature (2480)..(2480): n is a, c, g, or t
  misc_feature (2496)..(2496): n is a, c, g, or t
  misc_feature (2505)..(2505): n is a, c, g, or t
  misc_feature (2520)..(2520): n is a, c, g, or t
  misc_feature (2523)..(2523): n is a, c, g, or t
  misc_feature (2550)..(2550): n is a, c, g, or t
  misc_feature (2565)..(2565): n is a, c, g, or t
  misc_feature (2596)..(2596): n is a, c, g, or t
  misc_feature (2601)..(2601): n is a, c, g, or t
  misc_feature (2610)..(2610): n is a, c, g, or t
  misc_feature (2616)..(2616): n is a, c, g, or t
  misc_feature (2628)..(2628): n is a, c, g, or t
  misc_feature (2634)..(2634): n is a, c, g, or t
  misc_feature (2658)..(2658): n is a, c, g, or t
  misc_feature (2661)..(2661): n is a, c, g, or t
  misc_feature (2697)..(2697): n is a, c, g, or t
  misc_feature (2709)..(2709): n is a, c, g, or t
  misc_feature (2745)..(2745): n is a, c, g, or t
  misc_feature (2747)..(2747): n is a, c, g, or t
  misc_feature (2750)..(2750): n is a, c, g, or t
  misc_feature (2922)..(2922): n is a, c, g, or t
  misc_feature (2928)..(2928): n is a, c, g, or t
  misc_feature (2931)..(2931): n is a, c, g, or t
  misc_feature (2943)..(2943): n is a, c, g, or t
  misc_feature (2973)..(2973): n is a, c, g, or t
  misc_feature (2991)..(2991): n is a, c, g, or t
  misc_feature (2994)..(2994): n is a, c, g, or t
  misc_feature (3018)..(3018): n is a, c, g, or t
  misc_feature (3030)..(3030): n is a, c, g, or t
  misc_feature (3036)..(3036): n is a, c, g, or t
  misc_feature (3073)..(3073): n is a, c, g, or t
  misc_feature (3087)..(3087): n is a, c, g, or t
  misc_feature (3096)..(3096): n is a, c, g, or t
  misc_feature (3159)..(3159): n is a, c, g, or t
  misc_feature (3162)..(3162): n is a, c, g, or t
  misc_feature (3250)..(3250): n is a, c, g, or t
  misc_feature (3273)..(3273): n is a, c, g, or t
  misc_feature (3284)..(3284): n is a, c, g, or t
  misc_feature (3297)..(3297): n is a, c, g, or t
  misc_feature (3315)..(3315): n is a, c, g, or t
  misc_feature (3321)..(3321): n is a, c, g, or t
  misc_feature (3374)..(3374): n is a, c, g, or t
  misc_feature (3390)..(3390): n is a, c, g, or t
  misc_feature (3402)..(3402): n is a, c, g, or t
  misc_feature (3423)..(3423): n is a, c, g, or t
  misc_feature (3426)..(3426): n is a, c, g, or t
  misc_feature (3432)..(3432): n is a, c, g, or t
  misc_feature (3435)..(3435): n is a, c, g, or t
  misc_feature (3466)..(3466): n is a, c, g, or t
  misc_feature (3468)..(3468): n is a, c, g, or t
  misc_feature (3470)..(3471): n is a, c, g, or t
  misc_feature (3486)..(3486): n is a, c, g, or t
  misc_feature (3507)..(3507): n is a, c, g, or t
  misc_feature (3510)..(3510): n is a, c, g, or t
  misc_feature (3513)..(3513): n is a, c, g, or t
  misc_feature (3519)..(3519): n is a, c, g, or t
  misc_feature (3525)..(3525): n is a, c, g, or t
  misc_feature (3555)..(3555): n is a, c, g, or t
  misc_feature (3558)..(3558): n is a, c, g, or t
  misc_feature (3585)..(3585): n is a, c, g, or t
  misc_feature (3588)..(3588): n is a, c, g, or t
  misc_feature (3619)..(3619): n is a, c, g, or t
  misc_feature (3642)..(3642): n is a, c, g, or t
  misc_feature (3654)..(3654): n is a, c, g, or t
  misc_feature (3657)..(3657): n is a, c, g, or t
  misc_feature (3666)..(3666): n is a, c, g, or t
  misc_feature (3678)..(3678): n is a, c, g, or t
  misc_feature (3700)..(3700): n is a, c, g, or t
  misc_feature (3729)..(3729): n is a, c, g, or t
  misc_feature (3732)..(3732): n is a, c, g, or t
  misc_feature (3735)..(3735): n is a, c, g, or t
  misc_feature (3747)..(3747): n is a, c, g, or t
  misc_feature (3759)..(3759): n is a, c, g, or t
  misc_feature (3774)..(3774): n is a, c, g, or t
  misc_feature (3798)..(3798): n is a, c, g, or t
  misc_feature (3807)..(3807): n is a, c, g, or t
  misc_feature (3811)..(3811): n is a, c, g, or t
  misc_feature (3819)..(3819): n is a, c, g, or t
  misc_feature (3828)..(3828): n is a, c, g, or t
  misc_feature (3852)..(3852): n is a, c, g, or t
  misc_feature (3867)..(3867): n is a, c, g, or t
  misc_feature (3912)..(3912): n is a, c, g, or t
  misc_feature (3921)..(3921): n is a, c, g, or t
  misc_feature (3925)..(3925): n is a, c, g, or t
  misc_feature (3954)..(3954): n is a, c, g, or t
  misc_feature (3978)..(3978): n is a, c, g, or t
  misc_feature (3984)..(3984): n is a, c, g, or t
  misc_feature (3987)..(3987): n is a, c, g, or t
  misc_feature (4000)..(4000): n is a, c, g, or t
aaaagttatcaaagaattgcttcgtgacaaacgaaccttggctatgatgtttgtagcgccggtatttattatgtggctgatgaacctcatgttttcagctagtacaaccgtgaatgtcaagttagcgacacaagatctaccaactggtttgataacgaaaatggatgagcttgatcatgtggacatcgagacttatcaagacttagatcaggccaaagaagcgctagcaaatgaaaaagtcgatgctgtgatttcttataaagacggtgagtatcaggtcgactacgcaaatacagatgcctccaagacatctatgatacgacaagtgttacgaacaagtatcgccagtgaaggcaccgatcagttactatctcgtatcaaacaagctcttccacaattgaaattagatgcaaaggcgcctgaaatcaaagaatcttaccaatatggagataaaaatactggattctttgcacgtatgattccaattttaattggctttgtggtcttcttctttgtctttttgatttctggtatggcacttttgaaagagcgcacaagtggaaccttggatcgcttgttagcaaccccagtgaaacgttctgaaattgtctatggctatatgttgtcttacggtattattgcgatttttcaaacggcagttgtcgtcttagcagcaatttggctactagatgtagaagttgtaggaaatattttaaatgttataatagttaatgtggtactggctcttgtagcactagcttttggaattctcttgtctactctagcaaaatcagaattccaaatgatgcaatttattcctctcgtgattatgcctcaactctttttctcagggattattccattgtcatccatgggagcatgggctccaactgtggggaaatttttgccattaacctattctggtgatgcaataagccagattattctttacggacacaatcttggtgatattttgccaaatcttggtgttttaatgattttcttgatcattttaacaattctcaatattgttggattgcgtcgttatcgtaaagtttagaaatcaacataaataatgctaaaaaggtgtgaagattagatggataagactgtttttgaatcgtttgaagattacttagaagaagcgaattaccctcaaggaaagaaaaaaatcatgcaggcagcagtggatctcatatcaactaggagttaccatgggacctcaactcttcacatagctgagcgtgctggactaagccaggcaactttgtttaagtattttaagacgaaggatgatctactgacggctattttacatcctgtagtcccaggcattttcggtagttttgttgaggaactcttagcttttgaaacgacagaagagagggttcgttatctcgtccacgatcgtatgagctatctcaaaaaaaatcgtgctttgatgaaaatcattctgcaggagagtttttcaaataagaaactaaaaaatgaacagatttttatctggaatgctattcaagataaacttcgagtgcttcataaagaattgctagcagatccacgtgtaaatccagagttaacgattcctcaaatggttcgtatttgtgttggtccattgttggcttacttcgctcaactttatatcgttagcgacaacggagaaataaaggaagaggacctagacttattagaaaaacagattttaggtggtttgtggaaataagggagttctagaagagctaagatttatttacttgactttcaaacaagctaaaaaagacatgttctgcttatttcagattcatgtcttttttgttgttggattttgtattcttcataagtcctcaatcgctttgccaaaacagaaaccgacttctccagcggtgcaacgatttctcaagtgtatggaagaggagatttctggnttgctaaannnaantccttgacactnngtcagcttttgatacaatagtacaaaatcagaggnggtgggttatgattcagaaacatgngattccnattttagagtttgatganaatcctcaggcggtcatnatgccnaatcacgagnnnctggacttgcacttgcccaagaagtgtgtctatgcttttttagnngagnagattgaccgttatgcgagggaagtaggggcggactgtgtcggngaattcntttctgccaccaagacctatccagtctatgtcgtgaactacaagggngagganatntgtctggcncaggcncctgtnggttcngctccagcggcccagtttatggattggttgattggctatggtgtggagcagattatttcnacnggaacctgtggtgtgctagctgatatagagganaacgcctttctagtcccngttcgngctntncgagatganggngctagttaccactatgtggcaccttctcgttatatggaaattcagccagaggctattgctgcnattgagcgagttttggaagccanagggattccctatgangaagtcatnacctggacgacaganggnttttaccgagaaacggctgaaaaggtngcttatcgcaaggangaaggctgtgctgttgtggagatggagtgtnctgcncttgcggcngtagcncaactgcgtggngttctntggggagaattgttgtttacagcngantctctagcagacttggaccagtacgatagtcgtgantggggttcagangctttcgaaaaggccttggaactctgccttgagatngnctntcagatctagctactctccttctttttatggtacaatggatgtatgttattcaaattatttgtgaaaaaacttgaaagggtctttggcggactttcgccagctcgtcggatttttttaagtttcgctggagttatttttataggttctctccttttgagtttgccttttgtncaggcnagnggttcgcaggcnacttattttgaccatctttttacgacggtntctatggtctgtgtgacnggnctttttacgcaaccggtggctacnacctataatgtntggggncagttgatttgtatgctcttgatacagattggtggtntggggctcatgacntttatcggngtcttttatattcaggggaagcaaaagctcagtcttcgcagtcgtgaaaccattcaggagagnttnagttacggggagactcggtcgctgaaggcctttatgcggtccatctttttgacgacttttctggtggagggcttgggtgccttcctgntaagttttcgttttattcctgantttggctgggnacggggcattttnacctctatctttttagcnatttcngccttttgtaatgctggttttgataatttcggcagtagcagtttagtggcttntcagacggatcccttnatcaatctggtnattgctggcttgattatcacnggnggtctnggntttatggtctggtttgacttggcaacccagntngnnaagaagaaaaaacgncgtctgcgtttccacaccaanctngtnctcttnttgacngcagggattttgctgtttgggacagtatcnacnctctttacggagtggcacaatcctggnacnattggcaatctcagtgtcccagagaaagtgntggttagctttttccaaaccgtnagcatgagaacngcnggttttgcntctattgactanactcaagctcggcctgtgaccntgtttatctatatcctacagatgtttctnggnggngcgcctggaggnacggctgggggnctcaagattacgacnttctttgtcttattggtctttgcncgtagtganttgntgggcttncctcatgcnaatgttgcgcagagaaccattgangctcgaacagtccanaaatcctttagtgtcttcattatctttttgatgaccttcttgttnggcttgatnttgntgggaattacggcagaaggaacaccgcgntttatctacctcatgtttgagacnatttcngcncttgcgacagttn

SEQ ID NO: 210 - DNA, 4000 bp, Escherichia coli
  misc_feature (1)..(3): n is a, c, g, or t
  misc_feature (5)..(7): n is a, c, g, or t
  misc_feature (9)..(12): n is a, c, g, or t
  misc_feature (14)..(15): n is a, c, g, or t
  misc_feature (17)..(39): n is a, c, g, or t
  misc_feature (41)..(46): n is a, c, g, or t
  misc_feature (48)..(59): n is a, c, g, or t
  misc_feature (61)..(78): n is a, c, g, or t
  misc_feature (80)..(83): n is a, c, g, or t
  misc_feature (85)..(87): n is a, c, g, or t
  misc_feature (89)..(96): n is a, c, g, or t
  misc_feature (98)..(98): n is a, c, g, or t
  misc_feature (100)..(102): n is a, c, g, or t
  misc_feature (104)..(108): n is a, c, g, or t
  misc_feature (110)..(114): n is a, c, g, or t
  misc_feature (116)..(117): n is a, c, g, or t
  misc_feature (120)..(140): n is a, c, g, or t
  misc_feature (142)..(157): n is a, c, g, or t
  misc_feature (159)..(159): n is a, c, g, or t
  misc_feature (161)..(219): n is a, c, g, or t
  misc_feature (221)..(222): n is a, c, g, or t
  misc_feature (224)..(244): n is a, c, g, or t
  misc_feature (246)..(273): n is a, c, g, or t
  misc_feature (275)..(280): n is a, c, g, or t
  misc_feature (282)..(289): n is a, c, g, or t
  misc_feature (291)..(294): n is a, c, g, or t
  misc_feature (296)..(304): n is a, c, g, or t
  misc_feature (306)..(322): n is a, c, g, or t
  misc_feature (324)..(337): n is a, c, g, or t
  misc_feature (340)..(349): n is a, c, g, or t
  misc_feature (351)..(355): n is a, c, g, or t
  misc_feature (357)..(358): n is a, c, g, or t
  misc_feature (360)..(371): n is a, c, g, or t
  misc_feature (373)..(391): n is a, c, g, or t
  misc_feature (393)..(399): n is a, c, g, or t
  misc_feature (401)..(411): n is a, c, g, or t
  misc_feature (413)..(419): n is a, c, g, or t
  misc_feature (421)..(425): n is a, c, g, or t
  misc_feature (427)..(441): n is a, c, g, or t
  misc_feature (443)..(447): n is a, c, g, or t
  misc_feature (449)..(453): n is a, c, g, or t
  misc_feature (455)..(460): n is a, c, g, or t
  misc_feature (462)..(465): n is a, c, g, or t
  misc_feature (467)..(484): n is a, c, g, or t
  misc_feature (486)..(492): n is a, c, g, or t
  misc_feature (494)..(500): n is a, c, g, or t
  misc_feature (503)..(513): n is a, c, g, or t
  misc_feature (515)..(525): n is a, c, g, or t
  misc_feature (527)..(539): n is a, c, g, or t
  misc_feature (541)..(541): n is a, c, g, or t
  misc_feature (543)..(556): n is a, c, g, or t
  misc_feature (558)..(564): n is a, c, g, or t
  misc_feature (566)..(566): n is a, c, g, or t
  misc_feature (568)..(568): n is a, c, g, or t
  misc_feature (570)..(570): n is a, c, g, or t
  misc_feature (572)..(576): n is a, c, g, or t
  misc_feature (578)..(585): n is a, c, g, or t
  misc_feature (587)..(592): n is a, c, g, or t
  misc_feature (594)..(601): n is a, c, g, or t
  misc_feature (603)..(611): n is a, c, g, or t
  misc_feature (614)..(615): n is a, c, g, or t
  misc_feature (617)..(617): n is a, c, g, or t
  misc_feature (619)..(632): n is a, c, g, or t
  misc_feature (634)..(653): n is a, c, g, or t
  misc_feature (655)..(683): n is a, c, g, or t
  misc_feature (685)..(694): n is a, c, g, or t
  misc_feature (696)..(702): n is a, c, g, or t
  misc_feature (704)..(740): n is a, c, g, or t
  misc_feature (742)..(755): n is a, c, g, or t
  misc_feature (757)..(757): n is a, c, g, or t
  misc_feature (759)..(762): n is a, c, g, or t
  misc_feature (764)..(780): n is a, c, g, or t
  misc_feature (782)..(784): n is a, c, g, or t
  misc_feature (786)..(788): n is a, c, g, or t
  misc_feature (790)..(806): n is a, c, g, or t
  misc_feature (808)..(816): n is a, c, g, or t
  misc_feature (818)..(823): n is a, c, g, or t
  misc_feature (826)..(829): n is a, c, g, or t
  misc_feature (831)..(858): n is a, c, g, or t
  misc_feature (860)..(866): n is a, c, g, or t
  misc_feature (868)..(872): n is a, c, g, or t
  misc_feature (875)..(888): n is a, c, g, or t
  misc_feature (890)..(920): n is a, c, g, or t
  misc_feature (922)..(925): n is a, c, g, or t
  misc_feature (927)..(929): n is a, c, g, or t
  misc_feature (931)..(933): n is a, c, g, or t
  misc_feature (935)..(947): n is a, c, g, or t
  misc_feature (949)..(952): n is a, c, g, or t
  misc_feature (954)..(966): n is a, c, g, or t
  misc_feature (968)..(971): n is a, c, g, or t
  misc_feature (973)..(973): n is a, c, g, or t
  misc_feature (975)..(977): n is a, c, g, or t
  misc_feature (979)..(980): n is a, c, g, or t
  misc_feature (982)..(982): n is a, c, g, or t
  misc_feature (984)..(988): n is a, c, g, or t
  misc_feature (990)..(996): n is a, c, g, or t
  misc_feature (998)..(999): n is a, c, g, or t
  misc_feature (1001)..(1009): n is a, c, g, or t
  misc_feature (1011)..(1021): n is a, c, g, or t
  misc_feature (1023)..(1026): n is a, c, g, or t
  misc_feature (1028)..(1028): n is a, c, g, or t
  misc_feature (1030)..(1044): n is a, c, g, or t
  misc_feature (1046)..(1051): n is a, c, g, or t
  misc_feature (1053)..(1056): n is a, c, g, or t
  misc_feature (1058)..(1094): n is a, c, g, or t
  misc_feature (1096)..(1100): n is a, c, g, or t
  misc_feature (1102)..(1104): n is a, c, g, or t
  misc_feature (1106)..(1107): n is a, c, g, or t
  misc_feature (1109)..(1111): n is a, c, g, or t
  misc_feature (1113)..(1115): n is a, c, g, or t
  misc_feature (1117)..(1129): n is a, c, g, or t
  misc_feature (1132)..(1133): n is a, c, g, or t
  misc_feature (1135)..(1148): n is a, c, g, or t
  misc_feature (1150)..(1154): n is a, c, g, or t
  misc_feature (1157)..(1160): n is a, c, g, or t
  misc_feature (1162)..(1163): n is a, c, g, or t
  misc_feature (1165)..(1170): n is a, c, g, or t
  misc_feature (1172)..(1173): n is a, c, g, or t
  misc_feature (1175)..(1181): n is a, c, g, or t
  misc_feature (1183)..(1184): n is a, c, g, or t
  misc_feature (1186)..(1188): n is a, c, g, or t
  misc_feature (1192)..(1195): n is a, c, g, or t
  misc_feature (1197)..(1211): n is a, c, g, or t
  misc_feature (1213)..(1216): n is a, c, g, or t
  misc_feature (1219)..(1241): n is a, c, g, or t
  misc_feature (1243)..(1248): n is a, c, g, or t
  misc_feature (1250)..(1252): n is a, c, g, or t
  misc_feature (1255)..(1263): n is a, c, g, or t
  misc_feature (1265)..(1265): n is a, c, g, or t
  misc_feature (1267)..(1269): n is a, c, g, or t
  misc_feature (1271)..(1279): n is a, c, g, or t
  misc_feature (1281)..(1281): n is a, c, g, or t
  misc_feature (1283)..(1295): n is a, c, g, or t
  misc_feature (1297)..(1303): n is a, c, g, or t
  misc_feature (1305)..(1314): n is a, c, g, or t
  misc_feature (1316)..(1328): n is a, c, g, or t
  misc_feature (1331)..(1344): n is a, c, g, or t
  misc_feature (1346)..(1357): n is a, c, g, or t
  misc_feature (1359)..(1359): n is a, c, g, or t
  misc_feature (1361)..(1365): n is a, c, g, or t
  misc_feature (1367)..(1381): n is a, c, g, or t
  misc_feature (1384)..(1423): n is a, c, g, or t
  misc_feature (1425)..(1430): n is a, c, g, or t
  misc_feature (1432)..(1435): n is a, c, g, or t
  misc_feature (1437)..(1442): n is a, c, g, or t
  misc_feature (1444)..(1459): n is a, c, g, or t
  misc_feature (1461)..(1463): n is a, c, g, or t
  misc_feature (1465)..(1475): n is a, c, g, or t
  misc_feature (1477)..(1505): n is a, c, g, or t
  misc_feature (1507)..(1529): n is a, c, g, or t
  misc_feature (1531)..(1536): n is a, c, g, or t
  misc_feature (1538)..(1544): n is a, c, g, or t
  misc_feature (1546)..(1550): n is a, c, g, or t
  misc_feature (1552)..(1557): n is a, c, g, or t
  misc_feature (1560)..(1565): n is a, c, g, or t
  misc_feature (1567)..(1571): n is a, c, g, or t
  misc_feature (1573)..(1586): n is a, c, g, or t
  misc_feature (1588)..(1623): n is a, c, g, or t
  misc_feature (1625)..(1627): n is a, c, g, or t
  misc_feature (1629)..(1638): n is a, c, g, or t
  misc_feature (1640)..(1640): n is a, c, g, or t
  misc_feature (1642)..(1642): n is a, c, g, or t
  misc_feature (1644)..(1644): n is a, c, g, or t
  misc_feature (1646)..(1646): n is a, c, g, or t
  misc_feature (1648)..(1653): n is a, c, g, or t
  misc_feature (1655)..(1656): n is a, c, g, or t
  misc_feature (1658)..(1663): n is a, c, g, or t
  misc_feature (1665)..(1668): n is a, c, g, or t
  misc_feature (1670)..(1670): n is a, c, g, or t
  misc_feature (1672)..(1679): n is a, c, g, or t
  misc_feature (1681)..(1684): n is a, c, g, or t
  misc_feature (1690)..(1690): n is a, c, g, or t
  misc_feature (1692)..(1694): n is a, c, g, or t
  misc_feature (1696)..(1698): n is a, c, g, or t
  misc_feature (1700)..(1703): n is a, c, g, or t
  misc_feature (1705)..(1705): n is a, c, g, or t
  misc_feature (1708)..(1709): n is a, c, g, or t
  misc_feature (1711)..(1711): n is a, c, g, or t
  misc_feature (1714)..(1714): n is a, c, g, or t
  misc_feature (1716)..(1717): n is a, c, g, or t
  misc_feature (1724)..(1724): n is a, c, g, or t
  misc_feature (1732)..(1733): n is a, c, g, or t
  misc_feature (1740)..(1741): n is a, c, g, or t
  misc_feature (1743)..(1744): n is a, c, g, or t
  misc_feature (1746)..(1746): n is a, c, g, or t
  misc_feature (1765)..(1765): n is a, c, g, or t
  misc_feature (1778)..(1781): n is a, c, g, or t
  misc_feature (1800)..(1803): n is a, c, g, or t
  misc_feature (1816)..(1816): n is a, c, g, or t
  misc_feature (1819)..(1822): n is a, c, g, or t
  misc_feature (1844)..(1844): n is a, c, g, or t
  misc_feature (1861)..(1863): n is a, c, g, or t
  misc_feature (1869)..(1869): n is a, c, g, or t
  misc_feature (1883)..(1883): n is a, c, g, or t
  misc_feature (1923)..(1926): n is a, c, g, or t
  misc_feature (1964)..(1965): n is a, c, g, or t
  misc_feature (1980)..(1980): n is a, c, g, or t
  misc_feature (1983)..(1987): n is a, c, g, or t
  misc_feature (1992)..(1992): n is a, c, g, or t
  misc_feature (2021)..(2021): n is a, c, g, or t
  misc_feature (2026)..(2029): n is a, c, g, or t
  misc_feature (2386)..(2386): n is a, c, g, or t
  misc_feature (2479)..(2479): n is a, c, g, or t
  misc_feature (3109)..(3109): n is a, c, g, or t
  misc_feature (3112)..(3112): n is a, c, g, or t
  misc_feature (3513)..(3513): n is a, c, g, or t
nnngnnncnnnncnngnnnnnnnnnnnnnnnnnnnnnnngnnnnnngnnnnnnnnnnnncnnnnnnnnnnnnnnnnnngnnnntnnngnnnnnnnncntnnngnnnnncnnnnncnnggnnnnnnnnnnnnnnnnnnnnntnnnnnnnnnnnnnnnntngnnnnnnnnnnnnnnnnnnnnnnnnnnnnnnnnnnnnnnnnnnnnnnnnnnnnnnnnnnncnngnnnnnnnnnnnnnnnnnnnnnannnnnnnnnnnnnnnnnnnnnnnnnnnncnnnnnntnnnnnnnnannnncnnnnnnnnntnnnnnnnnnnnnnnnnntnnnnnnnnnnnnnnttnnnnnnnnnntnnnnntnngnnnnnnnnnnnntnnnnnnnnnnnnnnnnnnntnnnnnnngnnnnnnnnnnngnnnnnnntnnnnntnnnnnnnnnnnnnnngnnnnngnnnnngnnnnnncnnnngnnnnnnnnnnnnnnnnnngnnnnnnngnnnnnnngcnnnnnnnnnnngnnnnnnnnnnngnnnnnnnnnnnnngntnnnnnnnnnnnnnntnnnnnnngntntncnnnnngnnnnnnnncnnnnnnannnnnnnncnnnnnnnnnccnngncnnnnnnnnnnnnnncnnnnnnnnnnnnnnnnnnnncnnnnnnnnnnnnnnnnnnnnnnnnnnnnncnnnnnnnnnncnnnnnnntnnnnnnnnnnnnnnnnnnnnnnnnnnnnnnnnnnnnngnnnnnnnnnnnnnncntnnnntnnnnnnnnnnnnnnnnntnnngnnngnnnnnnnnnnnnnnnnngnnnnnnnnncnnnnnntgnnnngnnnnnnnnnnnnnnnnnnnnnnnnnnnncnnnnnnngnnnnnggnnnnnnnnnnnnnngnnnnnnnnnnnnnnnnnnnnnnnnnnnnnnngnnnnannngnnntnnnnnnnnnnnnngnnnngnnnnnnnnnnnnnannnngncnnngnncntnnnnngnnnnnnnanntnnnnnnnnncnnnnnnnnnnncnnnncngnnnnnnnnnnnnnnntnnnnnncnnnngnnnnnnnnnnnnnnnnnnnnnnnnnnnnnnnnnnnnngnnnnncnnntnngnnngnnncnnnnnnnnnnnnncgnngnnnnnnnnnnnnnngnnnnncannnngnngnnnnnncnncnnnnnnngnncnnnttgnnnncnnnnnnnnnnnnnnncnnnnggnnnnnnnnnnnnnnnnnnnnnnngnnnnnntnnnccnnnnnnnnntngnnnannnnnnnnncnannnnnnnnnnnnncnnnnnnncnnnnnnnnnntnnnnnnnnnnnnnctnnnnnnnnnnnnnncnnnnnnnnnnnntncnnnnngnnnnnnnnnnnnnnngcnnnnnnnnnnnnnnnnnnnnnnnnnnnnnnnnnnnnnnnngnnnnnngnnnncnnnnnngnnnnnnnnnnnnnnnngnnncnnnnnnnnnnngnnnnnnnnnnnnnnnnnnnnnnnnnnnnncnnnnnnnnnnnnnnnnnnnnnnngnnnnnncnnnnnnngnnnnngnnnnnnctnnnnnntnnnnngnnnnnnnnnnnnnngnnnnnnnnnnnnnnnnnnnnnnnnnnnnnnnnnnnngnnngnnnnnnnnnncnantntntnnnnnngnnannnnnncnnnngngnnnnnnnncnnnntttttntnnngnnngnnnnanccnngnggntnnagccctncttttttnnaagtganncnnanccctgagggtttagccctnctttttttcaagnnnngctgaaccctgagggtttnnnncttctttttttcnagnnnngctgacccctgagggtttagcnctactttttttcaagtnnngctganccctgagggtttgnggctactttttttcaagtagcgctgacccctgagggtttnnnnctactttttttcaagtagcgctgacccctgagggtttnnggctactttttttcnagnnnnnctganccctgagggtttggggctactttttttcnaggannnntgaaccctgaggtgccggcgctccttttcgaaaagtaagaccagcctttcgcctcgcggagtgtgcccaccttttgaggcgctcgtcaaatacgacgggacagggctcccgacgctgcgggggtcctgtccttaaaggcggttgtgacaaaagacatgagtggcgtcaacgcttcatttcttggacgtcggcgcgatgtattgcttgaggttgctgagcaccttgcgattgatcttgaccgcatacttccggtcgagctccttcagccagtcggcctccagtttagcctgttcctcgacgggatggctccagacgcgctcgttgctgatgttgaagagcaggatgccgtcacgatantccttcatcagtttttccaactcggggtggttggcgtccagctcgcggcgctcgaggttgttcgtgatgtcgcggacgaaaagctgatagacntcgctcatgaagtcgcccgaataggttttggtggagaagggatagaggcggaggtattcggcgaactcgctctgggggatgtccgtgtcgtggatgcggagcagcgtcttgtgcatctgtcgggcttgcttatggaagtccgaatcggtggggaaatagttgtcgcaaaggcgctggagctcttcgtaggcctcgggatagaagacgtagccgtacttctgcttcatcatgtcgtcatacgtcttgaagagttcgaagttgcggtcgccctgacgcatggtcgtgtagtagctcttttccatctcctcgtaagggggcatggggcgcttatccagcagcttgatgatgtggtatccgaagcgggtgcggacggggcgggtgaaatcgcccgtgtctttgagggcaaaggcggcctcctcgaaggggcgcaccatctcaccgagggagaaatagggcagaatgccgccgctgttgcgggtgcgtccgtcggtggagtaggtgttgacgagtgagctgaagctctcgccctttttcagcaagtcatagacctcattggcgcgtcggagcagggctacggtgtcctgatgatcttcgtcagatccgatcaggatatgggccacgcggcggcgnccnggattgggcgtgagttgatccaggcgcaggatgtggtatccggccggggagcgcacggggcccacgatctgtccgaccttcatattgaagacggtattctcgagcgacttcatgagctgcaaggggtagatgtactccacgtggtcgaagaagacggagtcgtcgtctcgtccgggggccagctcacgggctactttgtcgtagttctcgcctcggctgatgcggtcgtaggcggctttggcgcggcgatagacggctacggtgtctttcgataccgttttctcaggcaggggaaagacgatgtcgctgaacgaggggagcatcttgccccggttatagacggtgcggatggcttcggcctcgccccgcttgtcggagaggaagccggcacgcagctgcanctcatagtcgcgcagttcgttgcggaagttttccgtttggtcgtactgggcggcttcagcgtcggccaccttttgcttgaagtgcttgaaaagcgtcacaaagtcgtcgagcgacttcttgttgttcaggtccacgccgctgtctttttgggcgatgaagaggaactccgagacggggatgtctttccctgccacggtcatgatcgtcgggtcgtcagctgcctttttctgtgcgaacgctccgctgaggggcatggcgcaacacagggcgacccataaaagccttcttttcattctatcgttgattggttgatgattgatctgtgaggccgttagttggccatttcggagaggaacttgatgcggacaagccggatctcgtcctcggtatagtcgctaccgagctcttcgatggcctcctggaggctgtccgtggttgactccttgaagtattgatagatgtcgtccacgcgatcctcgtcgatgg

SEQ ID NO: 211 - DNA, 4000 bp, Escherichia coli
  misc_feature (794)..(794): n is a, c, g, or t
  misc_feature (2164)..(2164): n is a, c, g, or t
  misc_feature (2923)..(2923): n is a, c, g, or t
  misc_feature (3030)..(3030): n is a, c, g, or t
  misc_feature (3032)..(3032): n is a, c, g, or t
  misc_feature (3034)..(3036): n is a, c, g, or t
  misc_feature (3038)..(3044): n is a, c, g, or t
  misc_feature (3046)..(3046): n is a, c, g, or t
  misc_feature (3049)..(3050): n is a, c, g, or t
  misc_feature (3052)..(3052): n is a, c, g, or t
  misc_feature (3054)..(3054): n is a, c, g, or t
  misc_feature (3056)..(3057): n is a, c, g, or t
  misc_feature (3059)..(3059): n is a, c, g, or t
  misc_feature (3062)..(3062): n is a, c, g, or t
  misc_feature (3065)..(3065): n is a, c, g, or t
  misc_feature (3067)..(3069): n is a, c, g, or t
  misc_feature (3071)..(3073): n is a, c, g, or t
  misc_feature (3077)..(3077): n is a, c, g, or t
  misc_feature (3082)..(3083): n is a, c, g, or t
  misc_feature (3086)..(3092): n is a, c, g, or t
  misc_feature (3097)..(3098): n is a, c, g, or t
  misc_feature (3105)..(3106): n is a, c, g, or t
  misc_feature (3108)..(3109): n is a, c, g, or t
  misc_feature (3111)..(3111): n is a, c, g, or t
  misc_feature (3114)..(3114): n is a, c, g, or t
  misc_feature (3121)..(3124): n is a, c, g, or t
  misc_feature (3127)..(3127): n is a, c, g, or t
  misc_feature (3130)..(3130): n is a, c, g, or t
  misc_feature (3133)..(3134): n is a, c, g, or t
  misc_feature (3136)..(3137): n is a, c, g, or t
  misc_feature (3139)..(3139): n is a, c, g, or t
  misc_feature (3141)..(3141): n is a, c, g, or t
  misc_feature (3148)..(3152): n is a, c, g, or t
  misc_feature (3154)..(3157): n is a, c, g, or t
  misc_feature (3160)..(3160): n is a, c, g, or t
  misc_feature (3163)..(3163): n is a, c, g, or t
  misc_feature (3165)..(3165): n is a, c, g, or t
  misc_feature (3168)..(3168): n is a, c, g, or t
  misc_feature (3170)..(3172): n is a, c, g, or t
  misc_feature (3175)..(3175): n is a, c, g, or t
  misc_feature (3178)..(3179): n is a, c, g, or t
  misc_feature (3183)..(3184): n is a, c, g, or t
  misc_feature (3186)..(3187): n is a, c, g, or t
  misc_feature (3190)..(3190): n is a, c, g, or t
  misc_feature (3195)..(3195): n is a, c, g, or t
  misc_feature (3197)..(3202): n is a, c, g, or t
  misc_feature (3205)..(3205): n is a, c, g, or t
  misc_feature (3209)..(3212): n is a, c, g, or t
  misc_feature (3214)..(3214): n is a, c, g, or t
  misc_feature (3216)..(3218): n is a, c, g, or t
  misc_feature (3221)..(3221): n is a, c, g, or t
  misc_feature (3223)..(3224): n is a, c, g, or t
  misc_feature (3229)..(3229): n is a, c, g, or t
  misc_feature (3231)..(3231): n is a, c, g, or t
  misc_feature (3236)..(3239): n is a, c, g, or t
  misc_feature (3248)..(3248): n is a, c, g, or t
  misc_feature (3250)..(3257): n is a, c, g, or t
  misc_feature (3259)..(3260): n is a, c, g, or t
  misc_feature (3262)..(3274): n is a, c, g, or t
  misc_feature (3277)..(3282): n is a, c, g, or t
  misc_feature (3284)..(3286): n is a, c, g, or t
  misc_feature (3288)..(3290): n is a, c, g, or t
  misc_feature (3292)..(3295): n is a, c, g, or t
  misc_feature (3297)..(3297): n is a, c, g, or t
  misc_feature (3299)..(3300): n is a, c, g, or t
  misc_feature (3303)..(3305): n is a, c, g, or t
  misc_feature (3307)..(3315): n is a, c, g, or t
  misc_feature (3317)..(3321): n is a, c, g, or t
  misc_feature (3323)..(3330): n is a, c, g, or t
  misc_feature (3332)..(3336): n is a, c, g, or t
  misc_feature (3338)..(3345): n is a, c, g, or t
  misc_feature (3347)..(3351): n is a, c, g, or t
  misc_feature (3354)..(3356): n is a, c, g, or t
  misc_feature (3358)..(3367): n is a, c, g, or t
  misc_feature (3369)..(3370): n is a, c, g, or t
  misc_feature (3373)..(3374): n is a, c, g, or t
  misc_feature (3376)..(3386): n is a, c, g, or t
  misc_feature (3388)..(3388): n is a, c, g, or t
  misc_feature (3391)..(3392): n is a, c, g, or t
  misc_feature (3394)..(3394): n is a, c, g, or t
  misc_feature (3396)..(3401): n is a, c, g, or t
  misc_feature (3403)..(3404): n is a, c, g, or t
  misc_feature (3406)..(3407): n is a, c, g, or t
  misc_feature (3409)..(3414): n is a, c, g, or t
  misc_feature (3416)..(3417): n is a, c, g, or t
  misc_feature (3419)..(3427): n is a, c, g, or t
  misc_feature (3429)..(3432): n is a, c, g, or t
  misc_feature (3434)..(3442): n is a, c, g, or t
  misc_feature (3444)..(3447): n is a, c, g, or t
  misc_feature (3449)..(3457): n is a, c, g, or t
  misc_feature (3459)..(3462): n is a, c, g, or t
  misc_feature (3464)..(3466): n is a, c, g, or t
  misc_feature (3468)..(3470): n is a, c, g, or t
  misc_feature (3472)..(3481): n is a, c, g, or t
  misc_feature (3483)..(3485): n is a, c, g, or t
  misc_feature (3487)..(3490): n is a, c, g, or t
  misc_feature (3492)..(3492): n is a, c, g, or t
  misc_feature (3494)..(3496): n is a, c, g, or t
  misc_feature (3498)..(3505): n is a, c, g, or t
  misc_feature (3508)..(3517): n is a, c, g, or t
  misc_feature (3519)..(3519): n is a, c, g, or t
  misc_feature (3521)..(3523): n is a, c, g, or t
  misc_feature (3525)..(3532): n is a, c, g, or t
  misc_feature (3535)..(3538): n is a, c, g, or t
  misc_feature (3541)..(3544): n is a, c, g, or t
  misc_feature (3547)..(3547): n is a, c, g, or t
  misc_feature (3549)..(3550): n is a, c, g, or t
  misc_feature (3552)..(3553): n is a, c, g, or t
  misc_feature (3557)..(3560): n is a, c, g, or t
  misc_feature (3562)..(3565): n is a, c, g, or t
  misc_feature (3567)..(3570): n is a, c, g, or t
  misc_feature (3574)..(3575): n is a, c, g, or t
  misc_feature (3577)..(3577): n is a, c, g, or t
  misc_feature (3580)..(3585): n is a, c, g, or t
  misc_feature (3587)..(3587): n is a, c, g, or t
  misc_feature (3589)..(3592): n is a, c, g, or t
  misc_feature (3595)..(3602): n is a, c, g, or t
  misc_feature (3604)..(3605): n is a, c, g, or t
  misc_feature (3607)..(3616): n is a, c, g, or t
  misc_feature (3619)..(3620): n is a, c, g, or t
  misc_feature (3622)..(3645): n is a, c, g, or t
  misc_feature (3647)..(3661): n is a, c, g, or t
  misc_feature (3663)..(3666): n is a, c, g, or t
  misc_feature (3668)..(3670): n is a, c, g, or t
  misc_feature (3672)..(3673): n is a, c, g, or t
  misc_feature (3676)..(3681): n is a, c, g, or t
  misc_feature (3684)..(3685): n is a, c, g, or t
  misc_feature (3687)..(3688): n is a, c, g, or t
  misc_feature (3691)..(3696): n is a, c, g, or t
  misc_feature (3699)..(3704): n is a, c, g, or t
  misc_feature (3706)..(3711): n is a, c, g, or t
  misc_feature (3713)..(3715): n is a, c, g, or t
  misc_feature (3717)..(3721): n is a, c, g, or t
  misc_feature (3723)..(3730): n is a, c, g, or t
  misc_feature (3734)..(3746): n is a, c, g, or t
  misc_feature (3748)..(3752): n is a, c, g, or t
  misc_feature (3754)..(3758): n is a, c, g, or t
  misc_feature (3760)..(3773): n is a, c, g, or t
  misc_feature (3775)..(3777): n is a, c, g, or t
  misc_feature (3779)..(3787): n is a, c, g, or t
  misc_feature (3789)..(3792): n is a, c, g, or t
  misc_feature (3794)..(3798): n is a, c, g, or t
  misc_feature (3800)..(3800): n is a, c, g, or t
  misc_feature (3803)..(3807): n is a, c, g, or t
  misc_feature (3809)..(3810): n is a, c, g, or t
  misc_feature (3813)..(3813): n is a, c, g, or t
  misc_feature (3815)..(3815): n is a, c, g, or t
  misc_feature (3818)..(3818): n is a, c, g, or t
  misc_feature (3821)..(3822): n is a, c, g, or t
  misc_feature (3830)..(3830): n is a, c, g, or t
  misc_feature (3833)..(3833): n is a, c, g, or t
  misc_feature (3848)..(3848): n is a, c, g, or t
  misc_feature (3851)..(3851): n is a, c, g, or t
  misc_feature (3861)..(3861): n is a, c, g, or t
  misc_feature (3863)..(3866): n is a, c, g, or t
  misc_feature (3868)..(3868): n is a, c, g, or t
  misc_feature (3870)..(3874): n is a, c, g, or t
  misc_feature (3877)..(3878): n is a, c, g, or t
  misc_feature (3882)..(3885): n is a, c, g, or t
  misc_feature (3887)..(3893): n is a, c, g, or t
  misc_feature (3895)..(3896): n is a, c, g, or t
  misc_feature (3898)..(3907): n is a, c, g, or t
  misc_feature (3909)..(3910): n is a, c, g, or t
  misc_feature (3914)..(3915): n is a, c, g, or t
  misc_feature (3917)..(3919): n is a, c, g, or t
  misc_feature (3922)..(3922): n is a, c, g, or t
  misc_feature (3925)..(3926): n is a, c, g, or t
  misc_feature (3929)..(3931): n is a, c, g, or t
  misc_feature (3933)..(3936): n is a, c, g, or t
  misc_feature (3938)..(3939): n is a, c, g, or t
  misc_feature (3941)..(3948): n is a, c, g, or t
  misc_feature (3950)..(3963): n is a, c, g, or t
  misc_feature (3966)..(3968): n is a, c, g, or t
  misc_feature (3971)..(3971): n is a, c, g, or t
  misc_feature (3973)..(3978): n is a, c, g, or t
  misc_feature (3980)..(3989): n is a, c, g, or t
  misc_feature (3991)..(3996): n is a, c, g, or t
  misc_feature (3998)..(4000): n is a, c, g, or t
ccaccaatgctgatagcccaaaaacgtgctgaagttgcggggagaatcattacacctacagccatgagtgtcccaatagcgtggaagcctcctacaagattcagcactaccagtaaaagaaaggtgaaatgggtgattgcgctaagtccgcttactgaacgaaaaaactgcggatcagcgcattccaaaactagaggtcgaaataataaagagagtgttactagtgagaaacttgagattgagcagagtaagatcaacgttgcatcgtcaagcgctaaaacagtaccgaagagtacatgcattaggtctacattacttccacgcgtcgaaacaatcagcactccaatcgccagcgaaatcaagtagaatgctgccaaactggcatcttcacggagaattgtcatgcgagttacaaatccagatagtaacgcaaccagaagtccagctgttaaacctccgatagtcataggtattagagaaagaccaaaaacgagaaatcctacggctgccccaggcaaaattgcgtgagccatcgcatcacctgttaaactcatccgacgcagcataaggaaggttcctacgggcgtcgctccaacagaaatggctatacaaccgagaagtgctcgacgcataaatccaaattctgcaaagggttgaaatattgtatcccaaatcatgctacacttcgtccgcaaacatggggtggtccggcacaagcttcacacatctgtcgagcacggaattggttttctgcagttaaaacactttctgtcggtccgtgggctaccagttcncgtgctatcatcagcgtttgtggaaaatgagtacgaactgtatcatgattgtgcattacagccagaattgtccgcccttctccatgccagcgtgtgataatcttgagtaagtcagtcattgtacgggtatcgatagcgttgaaaggctcatctaataataccaattgtgcatcttggagaagcagtcttgcaaagagaacacgctgcatctgaccacctgaaagggcaccaatgattctggattcgaagccagatagtcccacagcagcaattgccttttcgacaaggctttgttgtgctgcgctgagccagccgaatgggccaatttctctccacaagcccattgcaacaaggtcaattactgtaattgggaatgaacgatcgatatcggattgctgcggcagataagctatattttcccggctgaacgagcctaaacccaaacttccctccataggaacgagcgtcccgatcacacccttaagcagcgtcgattttccagcaccgttgggccccactacagcagtcaaacttccagcagcaatttcagtatctagccgatggatagcgggttgatgatcatatcccagagtaaggttgttgaaccgaagagcgtgcactagaaccccccagggttggtagttgcccagaaaaagccaccccacaaggctacaatcaacaataaagcaactgctaatctcaaactggccccggttgtgagcaatcgaaacttcccgctaatcatgtttgattttagttttgttcatggccgcaattttcgcagactccttgcagttcgattacatgacgtgaaggggcaaaacccgaattggcaatgaccgctgaaagcgcgtcaagtacgcctgtgtcgatatgctcacttacaactccacaatcatcacaaattgttattacagcactttcatcatgtttgtcggttttgcaggcaatataggcatttagtgattcaagccggtgcgcacgccctctttcaaccaaatcagaaagtgttcggtagattgttgggggagcaattttaggatttttatccctcagttttcccagaatttcgtaagctgacattggttgttcactggtttgcaaaatttccagtacggcaacgctccatctattttttcgacccatttttcatatcctacttaatttgttatgttatgttataaaataacaatataaggatataaattagttaatgatattcaagattaatcatggccatgaattctctgcgggtttgggtatcattgcgaaacgacccgtgggtacgcatagtcaccatgctcacatctgatttttgaacgccgcgggttgtcatacattgatgagcggcctcgataacaacaccaacnccttttggctttagtatttcttggattgtatctgcgatttgggatgtgagtgcctcctgaatctgcattcgtttagcaaagatatctaccagacgtaccaacttagaaataccaacgactctttcatttggaagatagccgatatgagctttgccaataattggaacgatgtgatgctcgcagtgagattcaagtcgaatatctttgagaacaattaactcatcgtaaccagatatattttcaaacgtttttgccagcaacgattgagggtcttcattgtatccagcaaagaattcttcgtaagctctgaccacgcgatctggtgtacctaaaagaccgtctctatctggatcttctcctgaccattctatcaaagtgcgaactgcaccctcagcttcctctctggtaggctttttcttcgtttctgctaatggttctgtgaggttttttgacaacttttcctaataaaattaattaccgagggaaaatgatgatctggcgaatatcctgaaagattttcacttgccaaaagtttgaaaaattagtgtttgaaattgctaaagttttaagtttggattatctgggttcaactctgcaaatccctgttttccttgtattatcatctgaactgctatttcttccattagttcgaaagtgctgaaaagttctaactgaattgattttagattttctggtttgttacatatgagagagtaggtcgcagagaattctgagtgaatttcttttgctgaatgttgntgttcgtcctcatgatgttcgtcctcatgatgttcgtcctcatgatgttcgtcctcatgatgttcgtcctcatgatgttcgtcctcatgatgttcgtcctcatgatntncnnncnnnnnnntngcnncngnannantancancnnnannnttanaattnntannnnnnnaaatnntattttnnannanttnaagttgnnnnttngtnttnngnncntnttcaaannnnncnnnnttntangnagngnnnttnaanncaannannaantcagnannnnnnaanacannnntnannntgncnnccccntnaatgnnnncctctaacnannnnnnnncnnannnnnnnnnnnnnaannnnnnannnannnannnntnannaannnannnnnnnnnannnnnannnnnnnnannnnnannnnnnnnannnnnacnnnannnnnnnnnncnntannannnnnnnnnnnantanntntnnnnnnannanntnnnnnnanntnnnnnnnnntnnnntnnnnnnnnntnnnntnnnnnnnnntnnnntnnntnnnannnnnnnnnntnnnannnnantnnntnnnnnnnnaannnnnnnnnngntnnnannnnnnnngannnnaannnntgngnntnnaatnnnngnnnntnnnnttgnngntgnnnnnntngnnnntgnnnnnnnngnncnnnnnnnnnntgnncnnnnnnnnnnnnnnnnnnnnnnnntnnnnnnnnnnnnnnntnnnntnnnanntgnnnnnnttnnanntgnnnnnnttnnnnnngnnnnnntnnngnnnnngnnnnnnnngatnnnnnnnnnnnnnannnnnannnnnannnnnnnnnnnnnnannnannnnnnnnnannnnannnnnangannnnnannatnangangannaccatgangangaggatcaccatgangangaggatcacnannnngnannnnntcnngatnnnnannnnnnncnngnnnnnnnnnntnntcannannnggnagnncannncnnnnannannnnnnnnannnnnnnnnnnnnnatnnngangnnnnnngnnnnnnnnnnannnnnntnnn

SEQ ID NO: 212 - DNA, 4000 bp, Escherichia coli
  misc_feature (26)..(26): n is a, c, g, or t
  misc_feature (1983)..(1983): n is a, c, g, or t
  misc_feature (1985)..(1985): n is a, c, g, or t
  misc_feature (1992)..(1992): n is a, c, g, or t
  misc_feature (1997)..(1998): n is a, c, g, or t
  misc_feature (2012)..(2013): n is a, c, g, or t
  misc_feature (2048)..(2049): n is a, c, g, or t
  misc_feature (2052)..(2052): n is a, c, g, or t
  misc_feature (2057)..(2058): n is a, c, g, or t
  misc_feature (3184)..(3184): n is a, c, g, or t
  misc_feature (3214)..(3214): n is a, c, g, or t
  misc_feature (3232)..(3232): n is a, c, g, or t
  misc_feature (3238)..(3238): n is a, c, g, or t
  misc_feature (3243)..(3243): n is a, c, g, or t
  misc_feature (3279)..(3280): n is a, c, g, or t
  misc_feature (3286)..(3286): n is a, c, g, or t
  misc_feature (3301)..(3301): n is a, c, g, or t
  misc_feature (3325)..(3325): n is a, c, g, or t
  misc_feature (3329)..(3329): n is a, c, g, or t
  misc_feature (3339)..(3339): n is a, c, g, or t
  misc_feature (3342)..(3342): n is a, c, g, or t
  misc_feature (3344)..(3344): n is a, c, g, or t
  misc_feature (3346)..(3348): n is a, c, g, or t
  misc_feature (3350)..(3350): n is a, c, g, or t
  misc_feature (3352)..(3353): n is a, c, g, or t
  misc_feature (3357)..(3358): n is a, c, g, or t
  misc_feature (3361)..(3361): n is a, c, g, or t
  misc_feature (3363)..(3364): n is a, c, g, or t
  misc_feature (3366)..(3371): n is a, c, g, or t
  misc_feature (3373)..(3373): n is a, c, g, or t
  misc_feature (3376)..(3378): n is a, c, g, or t
  misc_feature (3382)..(3385): n is a, c, g, or t
  misc_feature (3387)..(3387): n is a, c, g, or t
  misc_feature (3389)..(3398): n is a, c, g, or t
  misc_feature (3400)..(3401): n is a, c, g, or t
  misc_feature (3403)..(3407): n is a, c, g, or t
  misc_feature (3410)..(3410): n is a, c, g, or t
  misc_feature (3413)..(3428): n is a, c, g, or t
  misc_feature (3432)..(3432): n is a, c, g, or t
  misc_feature (3434)..(3435): n is a, c, g, or t
  misc_feature (3437)..(3437): n is a, c, g, or t
  misc_feature (3439)..(3443): n is a, c, g, or t
  misc_feature (3445)..(3447): n is a, c, g, or t
  misc_feature (3450)..(3451): n is a, c, g, or t
  misc_feature (3454)..(3455): n is a, c, g, or t
  misc_feature (3458)..(3459): n is a, c, g, or t
  misc_feature (3461)..(3461): n is a, c, g, or t
  misc_feature (3463)..(3468): n is a, c, g, or t
  misc_feature (3472)..(3473): n is a, c, g, or t
  misc_feature (3476)..(3476): n is a, c, g, or t
  misc_feature (3478)..(3489): n is a, c, g, or t
  misc_feature (3491)..(3491): n is a, c, g, or t
  misc_feature (3494)..(3495): n is a, c, g, or t
  misc_feature (3497)..(3498): n is a, c, g, or t
  misc_feature (3500)..(3501): n is a, c, g, or t
  misc_feature (3503)..(3503): n is a, c, g, or t
  misc_feature (3505)..(3505): n is a, c, g, or t
  misc_feature (3508)..(3511): n is a, c, g, or t
  misc_feature (3514)..(3518): n is a, c, g, or t
  misc_feature (3521)..(3524): n is a, c, g, or t
  misc_feature (3526)..(3527): n is a, c, g, or t
  misc_feature (3529)..(3531): n is a, c, g, or t
  misc_feature (3535)..(3537): n is a, c, g, or t
  misc_feature (3540)..(3545): n is a, c, g, or t
  misc_feature (3547)..(3549): n is a, c, g, or t
  misc_feature (3554)..(3554): n is a, c, g, or t
  misc_feature (3556)..(3556): n is a, c, g, or t
  misc_feature (3558)..(3561): n is a, c, g, or t
  misc_feature (3563)..(3564): n is a, c, g, or t
  misc_feature (3566)..(3566): n is a, c, g, or t
  misc_feature (3568)..(3569): n is a, c, g, or t
  misc_feature (3571)..(3580): n is a, c, g, or t
  misc_feature (3582)..(3582): n is a, c, g, or t
  misc_feature (3585)..(3590): n is a, c, g, or t
  misc_feature (3592)..(3592): n is a, c, g, or t
  misc_feature (3594)..(3594): n is a, c, g, or t
  misc_feature (3596)..(3600): n is a, c, g, or t
  misc_feature (3602)..(3603): n is a, c, g, or t
  misc_feature (3608)..(3608): n is a, c, g, or t
  misc_feature (3610)..(3614): n is a, c, g, or t
  misc_feature (3616)..(3621): n is a, c, g, or t
  misc_feature (3626)..(3629): n is a, c, g, or t
  misc_feature (3631)..(3642): n is a, c, g, or t
  misc_feature (3646)..(3647): n is a, c, g, or t
  misc_feature (3650)..(3651): n is a, c, g, or t
  misc_feature (3653)..(3653): n is a, c, g, or t
  misc_feature (3656)..(3656): n is a, c, g, or t
  misc_feature (3658)..(3665): n is a, c, g, or t
  misc_feature (3667)..(3667): n is a, c, g, or t
  misc_feature (3669)..(3671): n is a, c, g, or t
  misc_feature (3673)..(3677): n is a, c, g, or t
  misc_feature (3679)..(3679): n is a, c, g, or t
  misc_feature (3682)..(3685): n is a, c, g, or t
  misc_feature (3688)..(3691): n is a, c, g, or t
  misc_feature (3693)..(3693): n is a, c, g, or t
  misc_feature (3695)..(3699): n is a, c, g, or t
  misc_feature (3702)..(3703): n is a, c, g, or t
  misc_feature (3705)..(3705): n is a, c, g, or t
  misc_feature (3707)..(3709): n is a, c, g, or t
  misc_feature (3711)..(3714): n is a, c, g, or t
  misc_feature (3717)..(3717): n is a, c, g, or t
  misc_feature (3719)..(3719): n is a, c, g, or t
  misc_feature (3721)..(3722): n is a, c, g, or t
  misc_feature (3724)..(3726): n is a, c, g, or t
  misc_feature (3728)..(3728): n is a, c, g, or t
  misc_feature (3730)..(3731): n is a, c, g, or t
  misc_feature (3733)..(3734): n is a, c, g, or t
  misc_feature (3738)..(3738): n is a, c, g, or t
  misc_feature (3742)..(3743): n is a, c, g, or t
  misc_feature (3745)..(3755): n is a, c, g, or t
  misc_feature (3757)..(3758): n is a, c, g, or t
  misc_feature (3760)..(3760): n is a, c, g, or t
  misc_feature (3763)..(3769): n is a, c, g, or t
  misc_feature (3771)..(3778): n is a, c, g, or t
  misc_feature (3780)..(3781): n is a, c, g, or t
  misc_feature (3783)..(3786): n is a, c, g, or t
  misc_feature (3788)..(3794): n is a, c, g, or t
  misc_feature (3796)..(3798): n is a, c, g, or t
  misc_feature (3800)..(3802): n is a, c, g, or t
  misc_feature (3804)..(3804): n is a, c, g, or t
  misc_feature (3808)..(3810): n is a, c, g, or t
  misc_feature (3813)..(3818): n is a, c, g, or t
  misc_feature (3820)..(3820): n is a, c, g, or t
  misc_feature (3823)..(3824): n is a, c, g, or t
  misc_feature (3827)..(3829): n is a, c, g, or t
  misc_feature (3831)..(3834): n is a, c, g, or t
  misc_feature (3836)..(3840): n is a, c, g, or t
  misc_feature (3842)..(3842): n is a, c, g, or t
  misc_feature (3844)..(3846): n is a, c, g, or t
  misc_feature (3848)..(3852): n is a, c, g, or t
  misc_feature (3854)..(3854): n is a, c, g, or t
  misc_feature (3858)..(3862): n is a, c, g, or t
  misc_feature (3864)..(3867): n is a, c, g, or t
  misc_feature (3869)..(3869): n is a, c, g, or t
  misc_feature (3871)..(3872): n is a, c, g, or t
  misc_feature (3874)..(3875): n is a, c, g, or t
  misc_feature (3877)..(3881): n is a, c, g, or t
  misc_feature (3883)..(3888): n is a, c, g, or t
  misc_feature (3890)..(3891): n is a, c, g, or t
  misc_feature (3893)..(3894): n is a, c, g, or t
  misc_feature (3896)..(3896): n is a, c, g, or t
  misc_feature (3898)..(3900): n is a, c, g, or t
  misc_feature (3902)..(3902): n is a, c, g, or t
  misc_feature (3904)..(3904): n is a, c, g, or t
  misc_feature (3906)..(3910): n is a, c, g, or t
  misc_feature (3912)..(3912): n is a, c, g, or t
  misc_feature (3914)..(3919): n is a, c, g, or t
  misc_feature (3921)..(3925): n is a, c, g, or t
  misc_feature (3927)..(3928): n is a, c, g, or t
  misc_feature (3931)..(3935): n is a, c, g, or t
  misc_feature (3937)..(3937): n is a, c, g, or t
  misc_feature (3941)..(3941): n is a, c, g, or t
  misc_feature (3944)..(3946): n is a, c, g, or t
  misc_feature (3950)..(3951): n is a, c, g, or t
  misc_feature (3953)..(3953): n is a, c, g, or t
  misc_feature (3955)..(3956): n is a, c, g, or t
  misc_feature (3958)..(3964): n is a, c, g, or t
  misc_feature (3966)..(3967): n is a, c, g, or t
  misc_feature (3969)..(3971): n is a, c, g, or t
  misc_feature (3973)..(3983): n is a, c, g, or t
  misc_feature (3985)..(3988): n is a, c, g, or t
  misc_feature (3990)..(3991): n is a, c, g, or t
  misc_feature (3994)..(3995): n is a, c, g, or t
  misc_feature (3998)..(3999): n is a, c, g, or t
ctagtaacaccacaaagttgtggtantgcaaaaaatggaaaaatgacctgattgacttcatacgtaattataattataccatggataaccgcggtaggtaccctcgttgtaccaaccaacgctgcaacccgcgcgatcgggcatggcgagcatattgtaaccatgccatgacgccttgccggtatacatcactagtagcatcagccgttcgactgcgatgcacgaatcgtcgcactgtactttttcgcagagacatatgagtcggaaatactcgatagcccaaataatcaattccaactctgactggctgtatttgtactttttttgggtgaaattgtaattgtaaatgctgctccacaaacgtagctgtcgcagtctgaaaactgtgtagctcagtgaggtcattactacagactgcaatatcgtccatgtacctaatgtaccgtttggtgcctaaggtatgttttacatactggtccagggcatttagatacacattggcaaacaactgactggtgagattgccaattggtataccaacaccagggtatgtatgactactgtcaataatcaggttgcatagtcgcaacatccgctgatcagccaagcggcgacgcagcaacatgagtaatgtcgcgtggttaatgctagcaaaatatctagaaatatctgccgtcaaaacatactgatttgtacgtacataacgttgaaacgtagtgattgcggcgattgtacccttaccccggcggcaagcatacgagtggtgcacgaaactcggctcatagattggctctagcgcagcatgtatcgcttgatgcacaacacgatcgcgaaacggtgccgcctggatgtgccttttcttggcatctttcacaataaattgctgatacgccccgtgacgataggtctcggtcaaaacttctgtttgtagttgtatcaaattaccttctagattttctgtaaatgaaaccacctgactgcgataccgcttacctcgtcgtgctcgtttataggctcgcaataacgcagcaaaagaaaaagcttcttcaaatacagcattgtgggttttcatgctaaaaaatacattcacttactacaaataatacatgcaactgtatgcagagcacagactgacactagcaatactgtgctctgtaataactgggagccactgaccaccccgtgagtattccaaagctgtactaacacacgacatagatacagctccgatattttcctgatgtgtgtgacacgacaagaaggatgatgtccgtatgtaccaagagtactggcctagcaccatgatgctactactcggacacatactggtgagtatgggtacataccgggcacaccgaaacccaatgttcgagttcacgttcgaaggcgcgttgttcaggttcaacgtgaacaccccagagttcgaaccgttgttgcggttgccaccgcggatgaacgcccgctggtgccagacatcaccctcacaccactcttaaccttttaaggaaaacagtggtgtgatgcttgatacctgattaataccgcactcatacaatacactatttaggactactactcttaatccaaccgccaagtaggcgaccaatttcggtgactttcttactgacaaattcgtactgcttggtgctcataaaacgcaattcgtgagctaatcgggtcaacactcgcaacatatcaagttcaacacttacttgttttaagtaaggtagtttttgtgtttcgacattggcccgcataatacccattgtgatacgtagagccaacgtctggatttgttgccctaagacaaaccgctgcgctttagggaaggtgttcaccatgggaaataaccataggttcagttcatacattttctcaaaaataatcagatctttatacataaagtggtataacaaatttggttgcgttagatatccagaaaccccagataccagatacctaccgggcacaccgaaacccaangntcgagtncacgnncgaaggcgcgttgnncaggttcaacgcgaacaccccagagtacgaaccgnngtngcggnngccaccgcggaggaacgcccgctgggcggtcgctgtgtcaccaacatcggtatacagtcgaccgacaccgttggcactactccagtcggtcactggtgggcgcaggtacgccaggcctttgtagttgatcccggcggtgtactctaggtattcgctggcaacactagcgatctcttctgggtgttcggctgcaaccgacacggcgtcagtccattcccacacgttgccagccacgtcccacaccacctcaccattattaagggcgtgggtacgcaactgggactggttggctgcaccagcactatagccggtggcgctccactgctgtgtagtaccatagtaccctttgtcagccgctgtagacccgccggcaccagttccccgcaactcacagttacccgcgctataggcgttgtcagcatgctcgagcggctgcatcaggttgcagccggtagtaaccggatcagccgaccctacagccgccaagttactggccgggccattgtcgctatggccggtggccagctgtaggccggcgtcactgtccaggtcgttgatcggcaaagtggcgatttgttcggctacagtcatccactcgggttcagagatcaggcggtactccgggccgattgcttcacaggtcaggcgggcgttgacttgactgataccgacccatggtgtaccagctgccgtcgaaacagcgttgttggagccgtcgtttttggcttcgtacttcatcatacaaaatccgggtagggtgccgtacttggcactgccgggcacccacacgtagcccgctgggcagtgctcacgcaggtcgcccgcgatgactgtgttctcgaccgctaggttacccgtactaccaatgtcagccggcagaccaggacaagcgccacccgcacagatgttgacgttctcatctagccaccacccgttaccaccactggcagaaaaaatcaggtcaccagtagcatccacctggaattccgcaaatgtagtagcatcataagcaatccgctgctgcgcagtagcagcagtgtcaaacacggtgagtcgagtggaggggctggtagtgccaatcccaacgttgccatcgctgcctacaaagataccttcatcatctccntctcccgagaggaagttagagccaagcgcnatgttggctagtgagccngacatngttanttgcttctttaatagcgtggtgctgtcgacactcanntgtccngcgattgctaactgngcttcgtctgggccgggtgcgccnacgntgtattcgtngangncnnngncnntagnnccnannannnnnntnttnnngccnnnngngnnnnnnnnnncnntnnnnngancannnnnnnnnnnnnnnncacnanngntnnnnncnnngcnngcnntgnngncnnnnnnggtnntgntnnnnnnnnnnnngntgnngnngnngncnctnnnnccnnnnncannnntnntnnngccnnnggnnnnnnannngagancntnnnnannantnncnnnnnnnnnnanacnnnnnntntnannnnngnnggcgntnnnnncnnnnnnggtgnnnntnnnnnnnnnnnngttnncgnngnggncnnnnnnnncnannncnnnnntnttnnnnccnnnngngnnnnnggnnanannntnnnnacnantnncnnnantnnanncacnaaanntnnnnnnnnnnntnncngtnnnnnnntnnnnnnnngnncnnnncnnnnnnncnnngnnntngtcnnnaannnnnncnacnncannnannnntnnnnngncnnngnnnnngntgannnnntnnnnantnntnncnnnnncnnnnnngnnanngntnnngncnannnnngnannnnnnannnnnanngtnnnnntnaggntgnnntcgnngncnncnnnnnnncnntnnncnnnnnnnnnnntnnnnannccnncgnng

SEQ ID NO: 213 - DNA, 4000 bp, Escherichia coli
  misc_feature (251)..(251): n is a, c, g, or t
  misc_feature (283)..(283): n is a, c, g, or t
  misc_feature (517)..(517): n is a, c, g, or t
  misc_feature (542)..(542): n is a, c, g, or t
  misc_feature (606)..(606): n is a, c, g, or t
  misc_feature (792)..(792): n is a, c, g, or t
  misc_feature (795)..(795): n is a, c, g, or t
  misc_feature (806)..(806): n is a, c, g, or t
  misc_feature (1970)..(1970): n is a, c, g, or t
  misc_feature (1989)..(1990): n is a, c, g, or t
  misc_feature (2316)..(2316): n is a, c, g, or t
  misc_feature (2409)..(2410): n is a, c, g, or t
  misc_feature (2415)..(2415): n is a, c, g, or t
  misc_feature (2421)..(2424): n is a, c, g, or t
  misc_feature (2431)..(2431): n is a, c, g, or t
  misc_feature (2433)..(2433): n is a, c, g, or t
  misc_feature (2437)..(2438): n is a, c, g, or t
  misc_feature (2441)..(2442): n is a, c, g, or t
  misc_feature (2449)..(2449): n is a, c, g, or t
  misc_feature (2451)..(2451): n is a, c, g, or t
  misc_feature (2455)..(2456): n is a, c, g, or t
  misc_feature (2463)..(2463): n is a, c, g, or t
  misc_feature (2465)..(2465): n is a, c, g, or t
  misc_feature (2470)..(2472): n is a, c, g, or t
  misc_feature (2475)..(2475): n is a, c, g, or t
  misc_feature (2481)..(2481): n is a, c, g, or t
  misc_feature (2484)..(2486): n is a, c, g, or t
  misc_feature (2491)..(2491): n is a, c, g, or t
  misc_feature (2496)..(2497): n is a, c, g, or t
  misc_feature (2500)..(2500): n is a, c, g, or t
  misc_feature (2503)..(2504): n is a, c, g, or t
  misc_feature (2515)..(2515): n is a, c, g, or t
  misc_feature (2517)..(2517): n is a, c, g, or t
  misc_feature (2519)..(2519): n is a, c, g, or t
  misc_feature (2523)..(2523): n is a, c, g, or t
  misc_feature (2528)..(2530): n is a, c, g, or t
  misc_feature (2532)..(2533): n is a, c, g, or t
  misc_feature (2536)..(2536): n is a, c, g, or t
  misc_feature (2539)..(2540): n is a, c, g, or t
  misc_feature (2543)..(2543): n is a, c, g, or t
  misc_feature (2545)..(2548): n is a, c, g, or t
  misc_feature (2550)..(2550): n is a, c, g, or t
  misc_feature (2552)..(2556): n is a, c, g, or t
  misc_feature (2558)..(2560): n is a, c, g, or t
  misc_feature (2562)..(2563): n is a, c, g, or t
  misc_feature (2565)..(2568): n is a, c, g, or t
  misc_feature (2574)..(2576): n is a, c, g, or t
  misc_feature (2579)..(2582): n is a, c, g, or t
  misc_feature (2584)..(2586): n is a, c, g, or t
  misc_feature (2590)..(2590): n is a, c, g, or t
  misc_feature (2592)..(2597): n is a, c, g, or t
  misc_feature (2599)..(2599): n is a, c, g, or t
  misc_feature (2601)..(2601): n is a, c, g, or t
  misc_feature (2603)..(2603): n is a, c, g, or t
  misc_feature (2605)..(2605): n is a, c, g, or t
  misc_feature (2608)..(2615): n is a, c, g, or t
  misc_feature (2617)..(2617): n is a, c, g, or t
  misc_feature (2620)..(2623): n is a, c, g, or t
  misc_feature (2626)..(2632): n is a, c, g, or t
  misc_feature (2634)..(2635): n is a, c, g, or t
  misc_feature (2637)..(2640): n is a, c, g, or t
  misc_feature (2642)..(2642): n is a, c, g, or t
  misc_feature (2644)..(2644): n is a, c, g, or t
  misc_feature (2646)..(2651): n is a, c, g, or t
  misc_feature (2655)..(2665): n is a, c, g, or t
  misc_feature (2667)..(2667): n is a, c, g, or t
  misc_feature (2671)..(2672): n is a, c, g, or t
  misc_feature (2674)..(2675): n is a, c, g, or t
  misc_feature (2677)..(2677): n is a, c, g, or t
  misc_feature (2680)..(2688): n is a, c, g, or t
  misc_feature (2690)..(2693): n is a, c, g, or t
  misc_feature (2695)..(2695): n is a, c, g, or t
  misc_feature (2697)..(2698): n is a, c, g, or t
  misc_feature (2700)..(2704): n is a, c, g, or t
  misc_feature (2706)..(2706): n is a, c, g, or t
  misc_feature (2708)..(2714): n is a, c, g, or t
  misc_feature (2716)..(2719): n is a, c, g, or t
  misc_feature (2721)..(2722): n is a, c, g, or t
  misc_feature (2726)..(2727): n is a, c, g, or t
  misc_feature (2730)..(2733): n is a, c, g, or t
  misc_feature (2735)..(2738): n is a, c, g, or t
  misc_feature (2740)..(2749): n is a, c, g, or t
  misc_feature (2751)..(2753): n is a, c, g, or t
  misc_feature (2755)..(2773): n is a, c, g, or t
  misc_feature (2775)..(2779): n is a, c, g, or t
  misc_feature (2781)..(2782): n is a, c, g, or t
  misc_feature (2784)..(2784): n is a, c, g, or t
  misc_feature (2786)..(2787): n is a, c, g, or t
  misc_feature (2789)..(2799): n is a, c, g, or t
  misc_feature (2801)..(2801): n is a, c, g, or t
  misc_feature (2803)..(2811): n is a, c, g, or t
  misc_feature (2813)..(2815): n is a, c, g, or t
  misc_feature (2817)..(2831): n is a, c, g, or t
  misc_feature (2833)..(2836): n is a, c, g, or t
  misc_feature (2838)..(2838): n is a, c, g, or t
  misc_feature (2842)..(2849): n is a, c, g, or t
  misc_feature (2851)..(2851): n is a, c, g, or t
  misc_feature (2853)..(2853): n is a, c, g, or t
  misc_feature (2856)..(2857): n is a, c, g, or t
  misc_feature (2859)..(2864): n is a, c, g, or t
  misc_feature (2866)..(2869): n is a, c, g, or t
  misc_feature (2871)..(2872): n is a, c, g, or t
  misc_feature (2875)..(2875): n is a, c, g, or t
  misc_feature (2877)..(2877): n is a, c, g, or t
  misc_feature (2879)..(2882): n is a, c, g, or t
  misc_feature (2884)..(2888): n is a, c, g, or t
  misc_feature (2890)..(2894): n is a, c, g, or t
  misc_feature (2896)..(2897): n is a, c, g, or t
  misc_feature (2899)..(2902): n is a, c, g, or t
  misc_feature (2904)..(2908): n is a, c, g, or t
  misc_feature (2911)..(2911): n is a, c, g, or t
  misc_feature (2913)..(2913): n is a, c, g, or t
  misc_feature (2915)..(2917): n is a, c, g, or t
  misc_feature (2919)..(2920): n is a, c, g, or t
  misc_feature (2922)..(2926): n is a, c, g, or t
  misc_feature (2928)..(2934): n is a, c, g, or t
  misc_feature (2936)..(2936): n is a, c, g, or t
  misc_feature (2939)..(2940): n is a, c, g, or t
  misc_feature (2945)..(2946): n is a, c, g, or t
  misc_feature (2948)..(2949): n is a, c, g, or t
  misc_feature (2952)..(2954): n is a, c, g, or t
  misc_feature (2956)..(2961): n is a, c, g, or t
  misc_feature (2964)..(2966): n is a, c, g, or t
  misc_feature (2968)..(2971): n is a, c, g, or t
  misc_feature (2973)..(2976): n is a, c, g, or t
  misc_feature (2979)..(2982): n is a, c, g, or t
  misc_feature (2985)..(2987): n is a, c, g, or t
  misc_feature (2989)..(2994): n is a, c, g, or t
  misc_feature (2996)..(2999): n is a, c, g, or t
  misc_feature (3003)..(3003): n is a, c, g, or t
  misc_feature (3005)..(3005): n is a, c, g, or t
  misc_feature (3007)..(3008): n is a, c, g, or t
  misc_feature (3010)..(3010): n is a, c, g, or t
  misc_feature (3012)..(3014): n is a, c, g, or t
  misc_feature (3016)..(3017): n is a, c, g, or t
  misc_feature (3019)..(3020): n is a, c, g, or t
  misc_feature (3023)..(3026): n is a, c, g, or t
  misc_feature (3028)..(3035): n is a, c, g, or t
  misc_feature (3037)..(3037): n is a, c, g, or t
  misc_feature (3039)..(3041): n is a, c, g, or t
  misc_feature (3044)..(3060): n is a, c, g, or t
  misc_feature (3062)..(3064): n is a, c, g, or t
  misc_feature (3067)..(3073): n is a, c, g, or t
  misc_feature (3075)..(3075): n is a, c, g, or t
  misc_feature (3078)..(3080): n is a, c, g, or t
  misc_feature (3082)..(3094): n is a, c, g, or t
  misc_feature (3097)..(3106): n is a, c, g, or t
  misc_feature (3108)..(3109): n is a, c, g, or t
  misc_feature (3111)..(3115): n is a, c, g, or t
  misc_feature (3117)..(3125): n is a, c, g, or t
  misc_feature (3127)..(3136): n is a, c, g, or t
  misc_feature (3139)..(3139): n is a, c, g, or t
  misc_feature (3141)..(3145): n is a, c, g, or t
  misc_feature (3149)..(3153): n is a, c, g, or t
  misc_feature (3155)..(3157): n is a, c, g, or t
  misc_feature (3160)..(3163): n is a, c, g, or t
  misc_feature (3165)..(3168): n is a, c, g, or t
  misc_feature (3171)..(3171): n is a, c, g, or t
  misc_feature (3174)..(3174): n is a, c, g, or t
  misc_feature (3176)..(3176): n is a, c, g, or t
  misc_feature (3178)..(3178): n is a, c, g, or t
  misc_feature (3180)..(3180): n is a, c, g, or t
  misc_feature (3184)..(3185): n is a, c, g, or t
  misc_feature (3187)..(3187): n is a, c, g, or t
  misc_feature (3189)..(3189): n is a, c, g, or t
  misc_feature (3191)..(3191): n is a, c, g, or t
  misc_feature (3193)..(3194): n is a, c, g, or t
  misc_feature (3197)..(3198): n is a, c, g, or t
  misc_feature (3200)..(3204): n is a, c, g, or t
  misc_feature (3207)..(3208): n is a, c, g, or t
  misc_feature (3210)..(3210): n is a, c, g, or t
  misc_feature (3212)..(3214): n is a, c, g, or t
  misc_feature (3216)..(3216): n is a, c, g, or t
  misc_feature (3219)..(3220): n is a, c, g, or t
  misc_feature (3223)..(3228): n is a, c, g, or t
  misc_feature (3230)..(3231): n is a, c, g, or t
  misc_feature (3233)..(3233): n is a, c, g, or t
  misc_feature (3235)..(3235): n is a, c, g, or t
  misc_feature (3237)..(3240): n is a, c, g, or t
  misc_feature (3243)..(3243): n is a, c, g, or t
  misc_feature (3245)..(3251): n is a, c, g, or t
  misc_feature (3253)..(3257): n is a, c, g, or t
  misc_feature (3259)..(3261): n is a, c, g, or t
  misc_feature (3264)..(3265): n is a, c, g, or t
  misc_feature (3268)..(3269): n is a, c, g, or t
  misc_feature (3271)..(3271): n is a, c, g, or t
  misc_feature (3273)..(3278): n is a, c, g, or t
  misc_feature (3280)..(3281): n is a, c, g, or t
  misc_feature (3283)..(3288): n is a, c, g, or t
  misc_feature (3294)..(3294): n is a, c, g, or t
  misc_feature (3296)..(3296): n is a, c, g, or t
  misc_feature (3298)..(3301): n is a, c, g, or t
  misc_feature (3305)..(3312): n is a, c, g, or t
  misc_feature (3314)..(3320): n is a, c, g, or t
  misc_feature (3323)..(3323): n is a, c, g, or t
  misc_feature (3325)..(3330): n is a, c, g, or t
  misc_feature (3332)..(3334): n is a, c, g, or t
  misc_feature (3336)..(3337): n is a, c, g, or t
  misc_feature (3339)..(3340): n is a, c, g, or t
  misc_feature (3343)..(3346): n is a, c, g, or t
  misc_feature (3348)..(3348): n is a, c, g, or t
  misc_feature (3351)..(3351): n is a, c, g, or t
  misc_feature (3353)..(3361): n is a, c, g, or t
  misc_feature (3365)..(3365): n is a, c, g, or t
  misc_feature (3367)..(3373): n is a, c, g, or t
  misc_feature (3375)..(3375): n is a, c, g, or t
  misc_feature (3377)..(3381): n is a, c, g, or t
  misc_feature (3383)..(3390): n is a, c, g, or t
  misc_feature (3393)..(3394): n is a, c, g, or t
  misc_feature (3396)..(3397): n is a, c, g, or t
  misc_feature (3399)..(3403): n is a, c, g, or t
  misc_feature (3406)..(3406): n is a, c, g, or t
  misc_feature (3408)..(3408): n is a, c, g, or t
  misc_feature (3414)..(3415): n is a, c, g, or t
  misc_feature (3417)..(3421): n is a, c, g, or t
  misc_feature (3423)..(3424): n is a, c, g, or t
  misc_feature (3426)..(3430): n is a, c, g, or t
  misc_feature (3433)..(3433): n is a, c, g, or t
  misc_feature (3435)..(3436): n is a, c, g, or t
  misc_feature (3438)..(3439): n is a, c, g, or t
  misc_feature (3442)..(3443): n is a, c, g, or t
  misc_feature (3445)..(3451): n is a, c, g, or t
  misc_feature (3453)..(3455): n is a, c, g, or t
  misc_feature (3457)..(3457): n is a, c, g, or t
  misc_feature (3460)..(3460): n is a, c, g, or t
  misc_feature (3462)..(3462): n is a, c, g, or t
  misc_feature (3464)..(3471): n is a, c, g, or t
  misc_feature (3473)..(3486): n is a, c, g, or t
  misc_feature (3488)..(3490): n is a, c, g, or t
  misc_feature (3492)..(3494): n is a, c, g, or t
  misc_feature (3496)..(3498): n is a, c, g, or t
  misc_feature (3500)..(3500): n is a, c, g, or t
  misc_feature (3503)..(3507): n is a, c, g, or t
  misc_feature (3510)..(3514): n is a, c, g, or t
  misc_feature (3516)..(3519): n is a, c, g, or t
  misc_feature (3522)..(3524): n is a, c, g, or t
  misc_feature (3528)..(3530): n is a, c, g, or t
  misc_feature (3533)..(3535): n is a, c, g, or t
  misc_feature (3538)..(3540): n is a, c, g, or t
  misc_feature (3542)..(3542): n is a, c, g, or t
  misc_feature (3544)..(3548): n is a, c, g, or t
  misc_feature (3550)..(3554): n is a, c, g, or t
  misc_feature (3556)..(3559): n is a, c, g, or t
  misc_feature (3563)..(3570): n is a, c, g, or t
  misc_feature (3573)..(3580): n is a, c, g, or t
  misc_feature (3582)..(3582): n is a, c, g, or t
  misc_feature (3584)..(3589): n is a, c, g, or t
  misc_feature (3592)..(3594): n is a, c, g, or t
  misc_feature (3596)..(3596): n is a, c, g, or t
  misc_feature (3599)..(3599): n is a, c, g, or t
  misc_feature (3604)..(3607): n is a, c, g, or t
  misc_feature (3609)..(3611): n is a, c, g, or t
  misc_feature (3613)..(3617): n is a, c, g, or t
  misc_feature (3619)..(3620): n is a, c, g, or t
  misc_feature (3622)..(3622): n is a, c, g, or t
  misc_feature (3624)..(3624): n is a, c, g, or t
  misc_feature (3628)..(3628): n is a, c, g, or t
  misc_feature (3630)..(3630): n is a, c, g, or t
  misc_feature (3632)..(3632): n is a, c, g, or t
  misc_feature (3634)..(3639): n is a, c, g, or t
  misc_feature (3642)..(3645): n is a, c, g, or t
  misc_feature (3647)..(3648): n is a, c, g, or t
  misc_feature (3650)..(3651): n is a, c, g, or t
  misc_feature (3656)..(3659): n is a, c, g, or t
  misc_feature (3662)..(3665): n is a, c, g, or t
  misc_feature (3667)..(3668): n is a, c, g, or t
  misc_feature (3670)..(3675): n is a, c, g, or t
  misc_feature (3678)..(3679): n is a, c, g, or t
  misc_feature (3681)..(3682): n is a, c, g, or t
  misc_feature (3684)..(3688): n is a, c, g, or t
  misc_feature (3690)..(3690): n is a, c, g, or t
  misc_feature (3693)..(3695): n is a, c, g, or t
  misc_feature (3700)..(3701): n is a, c, g, or t
  misc_feature (3705)..(3705): n is a, c, g, or t
  misc_feature (3708)..(3709): n is a, c, g, or t
  misc_feature (3711)..(3723): n is a, c, g, or t
  misc_feature (3728)..(3736): n is a, c, g, or t
  misc_feature (3738)..(3738): n is a, c, g, or t
  misc_feature (3740)..(3742): n is a, c, g, or t
  misc_feature (3744)..(3744): n is a, c, g, or t
  misc_feature (3747)..(3747): n is a, c, g, or t
  misc_feature (3752)..(3753): n is a, c, g, or t
  misc_feature (3756)..(3759): n is a, c, g, or t
  misc_feature (3761)..(3761): n is a, c, g, or t
  misc_feature (3764)..(3770): n is a, c, g, or t
  misc_feature (3773)..(3779): n is a, c, g, or t
  misc_feature (3781)..(3788): n is a, c, g, or t
  misc_feature (3790)..(3790): n is a, c, g, or t
  misc_feature (3792)..(3793): n is a, c, g, or t
  misc_feature (3795)..(3795): n is a, c, g, or t
  misc_feature (3797)..(3797): n is a, c, g, or t
  misc_feature (3799)..(3799): n is a, c, g, or t
  misc_feature (3801)..(3802): n is a, c, g, or t
  misc_feature (3806)..(3807): n is a, c, g, or t
  misc_feature (3809)..(3809): n is a, c, g, or t
  misc_feature (3814)..(3815): n is a, c, g, or t
  misc_feature (3817)..(3820): n is a, c, g, or t
  misc_feature (3824)..(3824): n is a, c, g, or t
  misc_feature (3826)..(3830): n is a, c, g, or t
  misc_feature (3834)..(3836): n is a, c, g, or t
  misc_feature (3838)..(3840): n is a, c, g, or t
  misc_feature (3842)..(3842): n is a, c, g, or t
  misc_feature (3844)..(3844): n is a, c, g, or t
  misc_feature (3847)..(3847): n is a, c, g, or t
  misc_feature (3850)..(3850): n is a, c, g, or t
  misc_feature (3852)..(3852): n is a, c, g, or t
  misc_feature (3855)..(3856): n is a, c, g, or t
  misc_feature (3858)..(3858): n is a, c, g, or t
  misc_feature (3860)..(3864): n is a, c, g, or t
  misc_feature (3868)..(3869): n is a, c, g, or t
  misc_feature (3871)..(3873): n is a, c, g, or t
  misc_feature (3876)..(3876): n is a, c, g, or t
  misc_feature (3880)..(3880): n is a, c, g, or t
  misc_feature (3883)..(3886): n is a, c, g, or t
  misc_feature (3888)..(3889): n is a, c, g, or t
  misc_feature (3892)..(3896): n is a, c, g, or t
  misc_feature (3898)..(3905): n is a, c, g, or t
  misc_feature (3908)..(3910): n is a, c, g, or t
  misc_feature (3912)..(3912): n is a, c, g, or t
  misc_feature (3914)..(3914): n is a, c, g, or t
  misc_feature (3917)..(3917): n is a, c, g, or t
  misc_feature (3919)..(3923): n is a, c, g, or t
  misc_feature (3925)..(3925): n is a, c, g, or t
  misc_feature (3927)..(3928): n is a, c, g, or t
  misc_feature (3930)..(3932): n is a, c, g, or t
  misc_feature (3935)..(3936): n is a, c, g, or t
  misc_feature (3938)..(3938): n is a, c, g, or t
  misc_feature (3940)..(3950): n is a, c, g, or t
  misc_feature (3952)..(3952): n is a, c, g, or t
  misc_feature (3954)..(3954): n is a, c, g, or t
  misc_feature (3956)..(3964): n is a, c, g, or t
  misc_feature (3966)..(3966): n is a, c, g, or t
  misc_feature (3969)..(3971): n is a, c, g, or t
  misc_feature (3973)..(3976): n is a, c, g, or t
  misc_feature (3980)..(3985): n is a, c, g, or t
  misc_feature (3987)..(3987): n is a, c, g, or t
  misc_feature (3992)..(3992): n is a, c, g, or t
  misc_feature (3994)..(4000): n is a, c, g, or t
aagtctcccacctatgctacacagaacgttccgagtaccaatatcaagatatagtaaaggtcccggggtctttccgtctttccgcgcgtaacgagcatctttactcgtactgcaatttcgccgagttcatggtggagacagcgctcaagtcgttacgccattcgtgcaggtcggaacttacccgacaaggaatttcgctaccttaggatggttatagttaccaccgccgtttactggggcttaagttctcngcttcgctccgaagagctaaccagtccccttnaccttccagcaccgggcaggcgtcagtccgtatacatcgttttgcaacttcgcacggacctgtgtttttggtaaacagtcgcttgagcctattctctgcgtctaacttatgcttcgaaggtaaacctctacacaaaaattagccccccttctcccgaagttacgggggtattttgccgagttccttcaccacgattctctcgatcaccttggtattctctacctgaccacctgngtcggtttcgggtacgggccactanaaacctcgctagaagattttcttggcagcataggatcatccacttcgccttacggctcggcatnaagtctcagagattgttctgcggattttcctacagaacctcctacactcttaccccaggtcaaccatcgcctgggttggactaccttcctgcgtctctccattgcttgactactaccaacttgggtcgtgcgctccatcagctattgctagccaacttcaaacacttagcattattgattcgtcanggncggtttattgngggtactggaatatcaaccagttgtccatcgactacgcctgtcggcctcgccttaggacccgacttaccctgagcggattagcctggctcaggaacccttggtcattcggtggacgggtttctcacccgtctttcgctactcatgtctacattctcacttgtgtaacttccacggctggattcctccgccgcttcactagttacacaacgctctcctacccatccacactcctggatcttgcgaccgggatagtgtgtgaatgacagaacttcggtgctgtgcttgagccccgttacattgtcggcgcgaaatcacttgaccagtgagctattacgcactcttttaagggtggctgcttctaagccaacctcctggttgtctatgcgacttcacatccttttccacttagcacaggctttgggaccttagttgctgttctgggttgtttccctctcgacaatgaagcttatcccccactgtctcactgccacgttctcacttactggcattcggagtttggctgacgttggtaatcttgtaggacccctcggccatccagtagctctacctccagtaagaaacacgtgacgctgcacctaaatgcatttcggagagaaccagctatcacgaagtttgattggtctttcacccctagccacaactcatcccctaaattttcaactttagtgggttcggtcctccacgcggtcttacccgcgcttcaacctggtcatggcgagatcacctcgcttcgggtttagatgatgcgacttattcgccctattcagactcgctttcgctacggcttcccctcgacgggttaaccttgccacatcacactaactcgtagactcattcttcaaaaggcacgctgtcactgcacaaggcagctccaacggtttgtatgcaaacggtttcagattctatttcactccccttgcggggttcttttcacctttccctcacggtacttgttcactatcggtcaccagagagtatttaggcttagcgggtggtcccgccagattcataccggattacacgagtccggtattacttgggatactaaaaacaagataatgaaatttcgactacaggggtctcaccttctatgccggactttcccacgtccttcatctatttcattattttctgacttgttnaattaacggcagttaattnnatttagtcccacgacaccgatcatgcaacgcctgccggcttggcacatgattggtttagcctcttccgctttcgctcgccactactaacggaatcacggttgttttctcttcctgagggtactgagatgtttcacttcccctcgttacctttgactctcctatttattcagagagaaatgactggacattactccagccgggtttccccattcggtaatcctcggatcgaagcctggttggcggctccccgaggcttttcgcagcctcctacgaccttcatcggcttctggtgcctaggcatccgccatttgcacttattaatttntttctacatttattacaaagatgctcgcgttcactgtgtagttctcaaggtacgggcgatgttaattaacattgatgagttatttttattttnnatttnttaaannnntaaaaanantttnnccnnttaattnantccnnagggttngnacccnnnggncccaanaannngcaanatttnnaanaannaaaatttaaantnantttnaaaannnanntgnggnnaanannnnantnnnnncnnnanntnnnnaaagannnctnnnnannnaggngnnnnnncngncncnccnnnnnnnncnccnnnnttnnnnnnncnncnnnncnancnnnnnncccnnnnnnnnnnncncccnncnngnggnnnnnnnnntnnnngngnntnnnnncntnnnnnnngnnnngnngggnngtnnnnannnncnnnnnnnnnntnnncnnnnnnnnnnnnnnnnnnnannnnnannancnncnnnnnnnnnnngngnnnnnnnnncnnncnnnnnnnnnnnnnnngnnnntntttnnnnnnnncncnccnncnnnnnntnnnncnnccntntnnnncnnnnntnnnnncnngnnnncnnnnnaananannngnngnnnnntnnnnnnncntcnnccccnncnnccnnngnnnnnnccnnngnnnncnnnngtnnnnccnnnannnnnngnnnncaananannangnnngnngnnctnnnngnnnnnnnncncnnnacnnnnnnnnnnnnnnnnngnnnacnnnnnnncnccnnntnnnnnnnnnnnnngcnnnnnnnnnntnncnnnnntnnnnnnnnntnnnnnnnnnnttngnnnnnttcnnnnngnnncgnnnnannnngcngcntncncngctnntngngngnnccnncnnnnnttnntntnnntnttnntcnnnnnntnntncncnnnnggngnnnnnnntnnnnngnnngcnncgnngnannnnnngnngnnnnnncccacnantnnnncccnnnnnnnncnnnnnnnacnannnnnntnnntnntnntgnnnncnccncnnnnnnnnnctcntnnnnnnnantnnnnncnnnnnnnnctnncnncnnnnntgntnttcctnntnnnnncnncnnnnnccncnncnncannannnnnnncnnncnccncnannnnnnnntnnnnnnnnnnnnnngnnngnnngnnngnggnnnnnccnnnnntnnnnacnnncgannnaannnacnnncnannnnntnnnnncnnnnaatnnnnnnnnacnnnnnnnncncnnnnnntannncngcngctgnnnncnnntnnnnngnngntncttntntngnnnnnnccnnnncnntnncttcnnnnctnnnnanngnnnnnnacnncnngnnnnncntcnnnccgcnngcgncgnngnnnnnnnnnnnnntcctnnnnnnnnnantnnncnccnctgcnnccnnnngnagnnnnnnnggnnnnnnntnnnnnnnngngnngncngncnncctnncnggccnncnnnncgtngnnnnnttgnnnannnantnccncancnacnngntnnnnngccnngnnntcntccnccnnnnannttnnnnnannnnnnnntgnnncnanttntnnnnnantnntnnntannancnnnnnnnnnnngntntnnnnnnnnngnggnnngnnnnttcnnnnnntnttccncnnnnnnn

SEQ ID NO: 214 - DNA, 4000 bp, Escherichia coli
  misc_feature (1940)..(1940): n is a, c, g, or t
  misc_feature (1943)..(1944): n is a, c, g, or t
  misc_feature (1952)..(1952): n is a, c, g, or t
  misc_feature (1958)..(1958): n is a, c, g, or t
  misc_feature (1964)..(1965): n is a, c, g, or t
  misc_feature (1973)..(1974): n is a, c, g, or t
  misc_feature (1979)..(1980): n is a, c, g, or t
  misc_feature (1983)..(1983): n is a, c, g, or t
  misc_feature (1988)..(1989): n is a, c, g, or t
  misc_feature (1997)..(1998): n is a, c, g, or t
  misc_feature (2003)..(2004): n is a, c, g, or t
gccaaagatcggcgacaaaaatacgtggctggtctacgacgacaatctcaacgcgtatgtcgatacgggtatcgaggtcggatatgcgaacctgttgtcacgctacgacggtaagtttgccgaaatcgtcgtcccgtgtaccgaggcaaccaacgcggccgcagcggccacggtcgccgcaaacaacgcggccgcagcagccaatagcgcagcaggaagtgcatcgacggagacaacagcagcgaatacagccgcaggcaaggccaacgccgcaacgacggccgcaaataacgcagcaacagcggccaacacagccacgggtaaggcaaacgaggcggcgacagcagcaaataatgcagcggaatccgcacagcgcgtcgtcgacacctacgacgacgttatcaatacgctcgcgcactccgactgcaccctcgacgagcgggtcgaggcactcgaaaaggcgcttatagccgtcttgtcgggtgctgtcgtgattcccaaattgcagatcaaggaattgaacgtatggggcaataacagccttgcccccgtcggcgacggcgcaccgacgaaagccccggacagagccgggcagttctacatcgacaagaccgcccgcgcgctctatttctcaacgggtaacgcggccgtgtcagactggaaaattcaataatgcaaacggaatatggcacaggttaacaaatacgcagatcgggccgcttatacggccgacgcgaaacgtctttcaacgaaatcggccgtttcgttcatcgaaaatgaaacgacaacgatttacgacggtgtgaataccgtcgtcggaaaatcggctgccgccatcggcgatctcgccgttttcgataaaacggacggggttatcaaatacatcaaaagcgcaacgattgccaaggcgcagattccagcaaaccttgtaccgctggccgtcgtctatgcgcgacaaggtgaacagctattgatcgtatcgctcgaccatgtttcgggcagcatccgctgggcacatacctacgaggttgcattgtcgggtttcgatctcgctgcgggcggcacaatcgtgttgaagctcggttccgaccctgccgccgcagaggtgtcgatagcgtataccgcaggcgcaacgctcgcggatgttgcatcggctatcaacgcgaaactcaaaggtgggacacccaattactcctcgacggattatggcggatgggcggcgactgcggcggacaatttcgtcgtgatgggttcgaacacgtataacgcctcccgtgcggcgattgccgttgttggcggttgtcagatcgcaaggacaccggaagacattaactaccaaacaacgttgacgggggtgttgatcgaggggtcaaccgaatatgtccgccgcaacaacggcgttaattcgtcgtttgcgggctgtaatcccgaaaaattcctgcaatactattcggccaacggaaccgataccacaggaatcaaacccggaagtagcaccataattcgggaaagcgcttttacggaagaggccaacccggaactggtcgccgcctatccaacctaccgggattatctgttcggagaacatttgctgcaatatcccgcagcctacggcgcgctgcttcgtgatggcaaggccaacacgcacctgatcggcggtctgcggttcgtcgacatccacggcgaaagcgttccccgttatccggccgctgcggccgctctcgactacggcgtcacggtcgagggcgcaactaccggactggaagcgggcgcatggtggctgccgtccgtcgatgaagtctacctgctcatgcacgaccgcgtgctaacgtccgccgaccgggaaagcgaccctgtaaaccgcacgctgtcgcgcctcggtaagacgacctgctacggatcgggttattatccgtggacatcgtgcgagtacaattccnacnncgcgttcntctacnacggcnncacgggcnncgtgnncancaacnncaagtatnncacgnncgccgtgcgtccggtttccgctttgtaaaaacagttttcagtttttaattcccgcgccgcatcgcgtcggcgtgcggtgcgggttcgcaagttagacctatggcaaagaaattatctatcctcgacaaaacgttccaactggcgttgctcctgcatcgccggacggcggaattcaatcgcaaatacaaattcactatcggcgaccgcatcgacgttgtggcagaggaagcgcaggaaatgatactgcgggcgaatcatcaaaccgacccgaaacgggccgcacaaatcatctacgatttcgtcctgcgtattgacaccctgtcgctaaaactgcggatggccgttgcgctgggtctgatgagtgacgacgcaaaagcacaatgcgatatgcttatcgcaaagattaaagacgaggcgaggggttggcgaaactattttctgcgtggcgagggtgtcgtcggcaagagcaacgggccgtcggcagagagcctataattattattttgaaaagggtttgcatactatcattcatagttataccgacaatgcaaaaaactggcgagtacaattccaacaacgcgttcatctacaacggcaacacgggcaacgtgaacaacaacaacaagtataacacgaacgccgtgcgtccggtttccgaatttcaaggtaatgtagaccctttcgcctcgttctataaatcaatgcgggcggcatatcgcctatgcttaaaaaacaaagtgcataccgctaacgcgatacgcttttggcttgatgaagaaagcgagcttgtcgcgctcgcccgcgaggtgttcaactgcgaatatgtcccgcggcaatccatcgcatttatcgttacgaaaccatgcctgcgcgaagtggtagccgccgatttccgcgaccgaatcgtgcagcactatatcgtcatgcgcctcgaagctcttttcgaggaatgcggaacactcgacgataacatgttcagttgccgcgtcgggaaaggcaaccttgcggccatacaggccctacaacagcagatattccaccagtcgaaaggttataccgccgactgttatgtggcaaaattcgacctgcaatcattctttatgagcatcgacaaacgccgtctttacgacgagttggtcgcattggtcgccaaacgctacgagggatgggataaggatacgctgttgtatcttatccgcgtcgttacgctgcataatccgcaggacaacgccgtgcggaaaactccactttgcgattgggctgacctgccgcgctcgaagagcctctacaatgtcgattggttcctcggtttagccatcgggaacctcacgtcgcaatccgacgcgaatttctacaacgcacccgcgatgcggtggatgcgctccgttggcctcgctcctgtgaactacgtcgatgatttcgcattcgtcgtccgggataaggcatcgtttcttacggccatgccttatattcgaaactatttcgccgcagaacggggactgacgatgcacccgcggaaattctacctgcaacactactcgaaaggcatcaagtttttaggtgcggttatcaaatacaaccgcgtctacacgaacaaccaaaccgtcgcacggtgtttcggaaagattcactactacaacgaagcgtgccgacacagtagccgccgcaaggcccggcatgtcgagaagctggcgacaatcctaaactcctatttggggttgatgcggcatttcgatacgttcaacattcgtaaacgcatcgccgcagaggtcggaaccgtatggtgcgactatatccgtttcgacgacgacatcacgacggcaacggtcgtcaaacatttccggcaacgggaaatctgcaaatacaacgtccgcaaacaacgcagacgcgatttattcacactcaaaaacttactcaacgatggaaacacagcagcaaattaacgaattacagtcgcgccagttggaactgcgcgcgatcatggcatcgtcggacg

SEQ ID NO: 215 - DNA, 4000 bp, Escherichia coli
  misc_feature (2016)..(2016): n is a, c, g, or t
  misc_feature (2019)..(2019): n is a, c, g, or t
  misc_feature (2578)..(2578): n is a, c, g, or t
  misc_feature (2953)..(2953): n is a, c, g, or t
aaaatttttattaaaataacaattataaaaactattatcactacaataattgagtgaaaaaatggacaaagacgatttgagcaactcttttatggaccttaagtttgaaactttatcagttagggctgggcacaatagaactcatgaaggggagcattcagaacccttatttctgacatctagttttgtttttgaaagtgcttctgaggctgcttcaaagttttctggtgaacaggagggaaatgtctattctagatatacaaatccgacggtaaacatactagaagaaagaattgcagctctcgagggagcagagaaagctgtcgctacctcatctggcatggctgctatattaagcacatgtatggctcttttaaaatcaggggatcatattatctgctctcgaagtgtatttggagcaacaactgttctcttagaaaaataccttttgaagttcaatatagaaacgacctttgtgccactaattgatgaagaaagctggaaggctgctattaggcccgaaacaaaaattttgtacttagagaccccatcaaatccattgtgtgatgttgcagatattaaatctatatcaaaaatagctaaagataataacgcaatgatgattgtagacaattgtttttgtacgcctgcgttacaacagccccttaagcttggtgcagacctaatcatacattctgcgactaaatatttagatgggcagggtagatgtcttggtggcattgtggctggaaaagaaactgtgataagtgaaatcttaggctttgttcgaacagctgggcctacaatgagtccatttaatgcatggatatttttaaaaggcctagaaaccctgaggattcggatgctggctcattctagtagtgctcttgatttagcgttatggctggagaagcaacctcaggttactaaggttttttatacggggcttgagagtcaccctgggcatacattggcatctaaacaacaactagcttttggaggtgtgctgtctttcacagtcaaaggttctagaaaagaggcatggaaggttattgatggaacaaagctgatttcgctaaccgcaaatttaggtgatacgaaaacaacaataattcatccagccacgactacacacggtaggcttacagaaaaacaaaaaatcgaagcaggaattacagaaaatctgattcgtatagcggttgggttagaagatgtaggtgatatcaagaacgatattttaaatggccttgaagttctttagagtaaaaataggttcatattactttgttagcatgtttctcgctcccacaacaaattcatctttcttagagtcttttaaaattaatgcgggagtgtttattcctttaatgaaagatgggcgttcccccaaaatatttaaccaagatgacaagttaggaaaatcacccagacctacgccagaccatttatgtagtttcacccatggccaacatgcaatatctgcaatacttagctcacttgagagataggttctgccatttaagtggacatccataacaccaaataatctcttgacttcattttgatagcggtcgatagcaggctgatattcttcatgccaataacgataaaaaacattagcttgacccatcattgggcctattccacccatctggaacatcagccattgtatagctattgatcgatcatattcattcagaggtaaaagtttgcctgttttttcagctaaatatataagaatagctccagactcgaatacaacaaaatcattattatcatgatcaataataacaggtattttcccattgggattaagctttaggtaattattttttttttgatcatttgcgccgagatttaattcatttacagtataaataagaccaagctcttctaaagctatgctaatcttgtgaccatttggcgttgctgaagtgaaaagttcaatcatcatttagaccgtaattttatatcagaatcatagttgctagaataacacataaaactaatatcccntangaaaaaatttaaagtctcatggagaaaaaaatgatagaaacttcatttaaaaaccaaattattgcccaaaataaggcattaaaaggaagacaagaaaaacaggcggtaacaaatgcgcattatgtccataaacgagcgataacaggcccttttcaagattctctcgaggatatttctctaggccttggttgcttttggggtgctgaaaaaaaattctggaatcaggatggtgtgtacactactgcagttggttattcaggtggttatacgcaaaatccaacctatgatgaggtttgctctggattaactgggcactctgaggtcgtgaaagttatatacaattcaaaaaaaataacattgaaacacttactttcaatattttgggaatcacatgatccaacacaaggcatgaggcagggcaatgattcaggcacacaatatcgttctgcgatttactgttataataaaaaacaacttaatgacgcgttattttcaaaaaatctctatcaagagcaattaaaaacatatggttacggagaaataactactgaagtatgtnttaacaaagaatttttttatgctgaagactaccatcaacaatacttagccaaaaatccaaatggctactgtggtttgggtggtacaggaatcaaatatacccatagcttacccaataaaatttgataaatattccagctcaaaagttgatcataaaacaagatatataggtgattaaagaattgcattacatgtataattgtatattaagattttttatcagactaaatgcaaattaaatcaagactattctttttataaataattgattttaatgatataatttattaaaaattataattccttaaaaaaaattgataaaggcatcatatatctatagatttgttagacaaaggtcattaaaatcgattttcgntaatagtcatatataaatttcataattgactttttgttattgaaattaaaaaaatattggcgattcagcactttttttctgaatgctgaatataagttttaaatataatttttaaaggggaatgagagaatgaatattgttaaattacttggtgtatctttactagtattagggctagtagcatgtgccgataaatcagaagaagctgaggctcctgctccagaggcgactgaatcatctactggaaatagtaatattgataaattcaatacagaaaaatttggtagctcatcagatccgtctactgctccagctccagcttttgctatttcgaaaaacttgaagccaggcgagtatgtaaatgagaaaggagaggttgttaaaaatagagatctcgctactgcaaaagaaaatccaaagttacgtgaaatccctgaaggtattgaggaaggaagcgttgaacataccatgtggttgctttctcaagaagaatagcagtcattttataaaaaaagaattttttaaatcccaacttttatactagttgggattttttttgcaacgcctaacttgttctcgtaaataacctataaagtagagcagagcatttgaagtacactcaattttcaactcttgctttaaatagcaatctaattaaaagtaccttatcactgggttatgacaagttaacatctatacaggcagaaacactacctgaaattctaaagggatacgatgtaattggacaaggagtgactggctctggtaaaacagccgctttttctttgggtattttaaacaaacttgatgctgcaaaatttaaaatccaagcactagttttatgcccaacaagagagctagccgatcaggttgctggcgaaatacgtaagctaggatgcatgatacataatgtcaaagttctcacattatgtggaggctctgcatttggtccacaaaaaggatcactcgcacacggagcgcatataatagtaggaacacctggtcgaattttggatcacctagataaaaataatttatcatttgata

SEQ ID NO: 216 - DNA, 4000 bp, Escherichia coli
  misc_feature (1691)..(1691): n is a, c, g, or t
  misc_feature (1957)..(1957): n is a, c, g, or t
  misc_feature (2989)..(2989): n is a, c, g, or t
gagaaaaatgacattgttaccggcgtgatcaacggcaaagtcaagggcggtttcacggtcgaccttaacaacatcagagcattcttgcccgggtctctggtcgatgtaagaccggttcgcgatacgctgcatctcgaggggcaggaactggagttccgcctgatcaaactggatcgaaagcgcaataacgtggtggtatcgcgcagagcagtgctggagtctgtcagcagcgaagaacgtgatgcgctgctcgaaaagctgcaggaaggtatgtcggttaagggcattgtcaagaacctcaccgactatggcgcgtttgttgatctcggaggcgtggacggcttgttgcatatcacggatatgtcgtggaagcggatcaagcacccgagtgaaatcgtcaacgtcggtgacgagatcgatgtaaaagtgctcaagtacgaccgcgagcgcaatcgcgtctccctcggtctcaagcaactgggagaggatccctgggttgctatcaaggcccgctatccggagcattcaagggtcaaggctgttgtgaccaatctaaccgattacggctgttttgccgaattggaagaaggggttgagggcctggtccatgtgtcagaaatggactggacaaacaaaaacatccacccttccaaggtagttcagttaggcgatgagatcgacgtcatggtgctggacattgatgaagagcgtcgccggatatcgctcggtatcaagcagtgtttccagaatccttgggacggttttgccgaaagatttcaaaagggtgacaagatttccggcagcattaagtcaatcaccgactttggtattttcattggtcttgacggcaatatagacggactcgttcacctgtctgacatttcgtgggatgaggcgggggaagaggctgttcgcaactacaccaagggcgatgagatcgaaacggttatcctgtcgatagacccggagcgcgagagaatctcgctgggtatcaagcagctggaagaagatccctttacggactacgtcggtcagttcgaaaaaggcagtatcgtcaagggtactgtggtgtcggtagatgccaagacggcagttctgaccttggctgatggcgttgaaggtatcctgcgcgcgtcagaaatcagtcgtgacaaggtcgaggatgcccgcaatgccttgaaagagggtgaagaagtcgaggttaaggtggtcagtgttgaccggaaaaaccgagcgctcagcctgtctatcaaagcgatcgagattgacgatgaaaaagcagcgattcaggagcataagaactccgatgccgctgacgtctcaccgggaaccatcggtgatttgattaaggctgaaatggataaaaactagttgttacaagagtttacgttctgatagtctaggctgaaaagccggccataacagcagagccggcgaccggggcaggaggataacaatgacgaagtctgagctgattgaacgcattgcggaaaaacaaactcagttatcctccaaggacgtcgagttggcggtgaaagcagtgcttgaatatatgtctcaggtattgtctgacggtggccggattgagattcgaggtttcggcagtttctcactgcactatcgggtaccgcggatcgggcggaatccgaagaccggtactcccgttgctctgagtggaaaatacgtacccnatttcaaacccggaaaggaactccgagacagggtgaacgaaagcatgctcagtgagagcgcgccgagtgagagctttttctgacgtcggcaacgccctggttcgatttctctcagttcagccagagctgtcagctctggctgatcaaccggcaaccgtcaaagcacggttcgacccaagccaagtatgtccgttccatgcgctccctgctctgtaattagtgcgtaaagcttcaagccatgcgaaatttaagcaacttgctgtctngatttgttctgctgtcagtttttgtcgctgcaatcacattcacctacttcaacaccgattcagtcactatcactttcggtactctcgtcttcgctccgcggccggtttcggcctggataatcggagcgtttgtacttgggggagcgttaggtttgctcctggggctgaatgtcttctctcagctcaaatcaagagccaagcttaagcgcatgactaaagaccttgaaaacgcccgtcgggaggttgagcaactgcgtaatttgtctttgcgggatctcgactagatggagggagttgctctttacgcgctgctgctgatcgcgatctgtataggctggttgctcggacgatctggttcacgttccataatattccggccacggcaaacgagggatatttttcacgaatatttcgccgggctgaattacttgctcaacgacgagcccgatgaggcgattgataccttcattaaggctttggaagtcaacggagaaaccgtggagacgcatcttgcgcttggtgcgctgctcaggcgaagagggaaggtcgataaagccattaaagtgcatcaggcgttgttagcccgttcaggtttggaggcgtcgctggcagatgcagcgcgccttcagcttgcaaaggactacatttccggggggcttctcgacagagcggagcgcctactgaaagagctcgcgcagggaaagtctgaagggaaatgggaagcccttccgcttcttgtcagtatttatcagctggaaaaagagtggcaccgtgcgatcacctgtacaaaagaattgctctcacattcagcgtatcgacgcagcgcagaatggaatgcgcggatggtgcactatcactgtgaaatagcggaggggctgcttgtcgaagggcagttgggtgaagctcgtcagcagctgcgaagagggggccggtttcaacgtcaccatctccgggcgagtttattaacggcgaggcttgagcatgaatccggtaattgcaatggtgctattcgggaatgcaggcgcatcgcgnaacacagcccagagtttctcccagagttggtggatgtgatggcggccagctattccgagcttggccgttcaggtgagttgattcaggttctcgatggtttccttgataaggaggcgaacccggttgcgcttcagcttatctcccgactcattgctgaagctgagggcgctgacagggcgattcaatatattcgccgtcatcttgctgcacaaccttcgcttgcaggagtcgctcagttgctggaactagaggtggaaaccaatcaattcgaccccgcaatgctcagcgatattgaaaagattcgtgaggtgctgctggctcatctggctaagcaacccggtttccggtgtggctactgcggctacgaagcgaggcagctgtactggctttgtcccgggtgtcacaggtgggatagtatccagccaaaacttgagaaggggcgctgacggttaccagagtccgagatcgcgcacagcggcgttggatcttaccgctagccatcctttactgcaggcgtttgtccgttttatgagcgtcacatgctacacatacagggggttcacttgactgaaaagagaataataattgctctggatttcccgaccgctgctgcggctgagcaattcttgtccggactagatcccgcaagctgcagggttaaaattggcaaagagctcttcacagctgcggggccagattttgtcaggcgcgtggtcgctatgggctttgatgtctttcttgatctcaaatttcatgacatcccgaataccgtagcaggggctgtcagggtcgctgctgagctgggcgtctggatgataaacgttcatgcatccggtggggtcgctatgatgagcgaggcccgggaggcgctcgaagtcgtttccggcacccggccgttgctgattgcggtgaccatcctgaccagtctggccgaggacgatctcaccaggcaggggatttcgtgtagtccggcagagcaggtgattcgcctggcggagatgacgtcggaag

SEQ ID NO: 217 - DNA, 4000 bp, Escherichia coli
  misc_feature (1313)..(1313): n is a, c, g, or t
  misc_feature (1331)..(1331): n is a, c, g, or t
  misc_feature (1871)..(1871): n is a, c, g, or t
  misc_feature (1982)..(1982): n is a, c, g, or t
  misc_feature (1988)..(1988): n is a, c, g, or t
  misc_feature (1991)..(1991): n is a, c, g, or t
  misc_feature (2003)..(2003): n is a, c, g, or t
  misc_feature (2372)..(2372): n is a, c, g, or t
  misc_feature (2381)..(2381): n is a, c, g, or t
tgctaagactctagggcctgcgagagtaggattccagaaaatctgaactcgaaccaacccccttaaagctctttagtgcctcctcgtggagcatttccatagcatgacgtttatattcataagcctgtgaagaactcagcatctccagatttctcggccgtggcaaatcaatctgcactacttctctcaccgtggctggccggtttgacagtacaaccaggctgtcagcaaggataatagcctcctcaagctcagaggtgacaaatacgttagtccgagcctcctgctcgcataagcgcatgtagaactcctgcatcaactgacgagtcatggcgtccagaccgcggaatggctcatccatgaccatcaccagcggttggttaatcaatgcccgtgcaagctcagcacgccgttgcatgccacctgacagctgcaaaggatacttgtcccgaaactctttgagtccaaccgtttcaataatactgtcggccgcctcttttaattgatcgcgaggtatatcgccgcgcaacttggggccaaaggtgacgttctggtaggtagttaaccaaggcatcaaagcggtttcctgaaagacaaccagcgtatctttgctgggacctgtaactgggcgcccatccagcaggatttgaccgctgtctggcttctcgaaccctgccaacaagttgactactgtcgatttgccacagcctgagggcccaacaatcgcggtaagttgattgcgtcgaattttgagactgagattctcaataaccatctcacgttcccagtcctccccaaatgccttggagacattatttacttgcatcatgtcaggtgcgtctgccattaaatcttccaccggttcagttcacgatttaccattttctattcttgaaattttcctgaaatactacaatcagaacatccgccgccacggcatcgatctgtagccgatataccgtataagactactggagatatatcctgccaatcctatgctgatcatgccgacgataacctgatccattacgccacccatgtaggaactccagatgaaaaagcctaatcccccgccactttgctgaccaccaccggaaatcatctcagccgctagcactacttcccatgtaattcccatacctacggcggcgccgataaaaatggatggcaaagtgccgggcagaataatcttacgaaaaagatcccactgagttgcgcccatcgactgcgccgcccgtaggtactggatatctacagcacgtgcgccgccgagtacattaatgacgatggtatagaacgctccaagaaacgtnacaaacatgatcgacaantctgtagttggccagaaaatgatggaggccggcacccatgcaagcggtggtatcggacgaaggatctcaaatggcgggaaaaacatgcctcgaaagtatttattgactgccatcgctagtccaaatgggattccaataacttgtgcaatcaaaaaacctaggaacacccgacccatactcagataccaactttcccaatatccaggcaaaagaaccacatcgctccagcgagtcgcaacgattgatggcgcatccacctttcccacaaacgggaccataactccgaaccactcgttgaatcgaaatccgatctcccacagagtaagaaatatcagtattgataaaacaccacgtctgaaagtcagatctgaaactagggctttagctctagcgcctagcgtttcctgtctcttcgatgcctttcccatcttatttcctcaactttcagttactgcgcgcgatgaacattaagcaagctctcgctcacccgcttcaaacgctttgactgcttcttcatgaaccgcttctttggtctcttgnactaaaatcctaaactcttcagaagacagtaaccgataatctcttggcctattgatttttacttcgactattttctttgtcctggcaggacgcgtcgtcataacaatgacnctatcnccnaggaaaattgcntcttccaaatcatgcgttatgaaaaagatggtaactcgagtgcggtcatatacctcaagcagagattcatgcatgattgacttggtcagcgcgtccatagcacgatagggttcatccagcagcaatactttgggatcgtttatcaacgcgcgaacgatttctgcccgtcgcgccattcccgaggacacttcgcccggatacttgtctgcgacacccgataatccagcctcagatagcatcgaaattgctttctcgcgagcatcggctttattcattaatccctgaacaatcgggccataagctacgttatcagccaacgttttccaggggaacagtgcgccattctggaatacgacaacccgatcagcnccctgatcngccagcggtttgtccggtccacagagcatttcaccatcaagatctatctgccctgatgtgatcgagtgaaaaccggcaatagcgttcagcaaggttgtcttgccacagccggatggcccaacaatcatacagacctcagccggcgctatttctaaagagcaatcgtccaccgcaaggacatttgcaccctttgggtcataaatcttggtgacattgcgtatgctgatcgcccccttagtggaagcgttcttatctgttgccggctgctgatgagctgctgtagtcatctacacacctccttggccaagcgcctttgctcgccaccgcatcatacgattgccggcagcgcgcaccattgctgaggttatccaaccaacgagtcccagcgttaacatggccataaccatggtggtgtacttgttaaccatataagaagccataatcatataacccaacccataatcaccagagatcatctctgctgccactagagaaaaccaagctaccccgatactgatctgcaaaccggtaaatataaatggcaaagagccgggcacgaccacgttgatgaagacatgtcgtttcttagagccaaggcaacctgctgcgcggaaatatgattcatcaatggactctacaccgagcattgtgtttaaagcggtcacaaaaaaagaggctaaggttgccagatagatgattggcgtctcaaaccccgagaacatcacaattgcaagcggaacccatgcgagaatcggaatcggccgtaaggtctccagcactggaaaagtataatccttaaacttctttgaccagcccataaagaggcccaggggcacaccgagaactgttgccagagcgaagccaataatgactcgcctgcaactgacccaaatattaatatagtagtcttcggtaaaaagcgaggtaccccagatcgggtctctacttagccattcggttattacctcgaccgggcccgggatcttaaaaaaggggaaaattttccaatactcatttaaaagaaaataggtcagtagccatagcccgatacccgcgaacgccaggtatggcatgggcgtcttcaatgatttccaggtcttgtacaaaaaatactgaaagcctgttggagcgtgcccgctgacaccttgattactcattcacatcttccccttttgcccatgtctctggtgaacagtaagtactactctgcataccaccgggcgagctttttacaggcaggctcgcctacggcgggtgatactttaactttgtttttacttagaaatcaaaagcgggctccgagatactctcgaggcccgcttttcaatcaatctactaaactaacatcttaattattggtatgcagaatccggctgttcacccacaaatccgatgggtgccgacaagcctcgtgatgtcagaacttcttttgctacatcatccatgatggcttctggtcgcaatatcgcattcggtaccaccttccggccattcaggaacctagttgccgcagaaaccagttgcctggccgtatcatcaaacacgtatcgcaacgtcagcttttcttctccgccaccgatcgcaggagggttcttaccatacagtgatgcccagagtac

SEQ ID NO: 218 - DNA, 4000 bp, Escherichia coli
  misc_feature (2)..(15): n is a, c, g, or t
  misc_feature (20)..(25): n is a, c, g, or t
  misc_feature (27)..(28): n is a, c, g, or t
  misc_feature (33)..(39): n is a, c, g, or t
  misc_feature (44)..(48): n is a, c, g, or t
  misc_feature (52)..(58): n is a, c, g, or t
  misc_feature (60)..(61): n is a, c, g, or t
  misc_feature (63)..(64): n is a, c, g, or t
  misc_feature (66)..(80): n is a, c, g, or t
  misc_feature (82)..(82): n is a, c, g, or t
  misc_feature (90)..(104): n is a, c, g, or t
  misc_feature (106)..(106): n is a, c, g, or t
  misc_feature (108)..(140): n is a, c, g, or t
  misc_feature (142)..(143): n is a, c, g, or t
  misc_feature (145)..(146): n is a, c, g, or t
  misc_feature (148)..(176): n is a, c, g, or t
  misc_feature (178)..(188): n is a, c, g, or t
  misc_feature (193)..(193): n is a, c, g, or t
  misc_feature (195)..(250): n is a, c, g, or t
  misc_feature (255)..(255): n is a, c, g, or t
  misc_feature (257)..(262): n is a, c, g, or t
  misc_feature (265)..(270): n is a, c, g, or t
  misc_feature (272)..(294): n is a, c, g, or t
  misc_feature (296)..(301): n is a, c, g, or t
  misc_feature (303)..(320): n is a, c, g, or t
  misc_feature (322)..(326): n is a, c, g, or t
  misc_feature (328)..(339): n is a, c, g, or t
  misc_feature (344)..(347): n is a, c, g, or t
  misc_feature (349)..(358): n is a, c, g, or t
  misc_feature (360)..(364): n is a, c, g, or t
  misc_feature (366)..(388): n is a, c, g, or t
  misc_feature (390)..(420): n is a, c, g, or t
  misc_feature (423)..(423): n is a, c, g, or t
  misc_feature (426)..(426): n is a, c, g, or t
  misc_feature (428)..(440): n is a, c, g, or t
  misc_feature (442)..(443): n is a, c, g, or t
  misc_feature (445)..(460): n is a, c, g, or t
  misc_feature (462)..(496): n is a, c, g, or t
  misc_feature (498)..(522): n is a, c, g, or t
  misc_feature (530)..(550): n is a, c, g, or t
  misc_feature (552)..(552): n is a, c, g, or t
  misc_feature (554)..(557): n is a, c, g, or t
  misc_feature (559)..(561): n is a, c, g, or t
  misc_feature (563)..(569): n is a, c, g, or t
  misc_feature (571)..(572): n is a, c, g, or t
  misc_feature (574)..(575): n is a, c, g, or t
  misc_feature (577)..(582): n is a, c, g, or t
  misc_feature (584)..(585): n is a, c, g, or t
  misc_feature (587)..(588): n is a, c, g, or t
  misc_feature (600)..(601): n is a, c, g, or t
  misc_feature (603)..(617): n is a, c, g, or t
  misc_feature (619)..(626): n is a, c, g, or t
  misc_feature (628)..(673): n is a, c, g, or t
  misc_feature (675)..(675): n is a, c, g, or t
  misc_feature (678)..(680): n is a, c, g, or t
  misc_feature (684)..(684): n is a, c, g, or t
  misc_feature (686)..(686): n is a, c, g, or t
  misc_feature (690)..(705): n is a, c, g, or t
  misc_feature (708)..(708): n is a, c, g, or t
  misc_feature (710)..(720): n is a, c, g, or t
  misc_feature (723)..(730): n is a, c, g, or t
  misc_feature (732)..(733): n is a, c, g, or t
  misc_feature (740)..(748): n is a, c, g, or t
  misc_feature (750)..(781): n is a, c, g, or t
  misc_feature (783)..(787): n is a, c, g, or t
  misc_feature (789)..(811): n is a, c, g, or t
  misc_feature (815)..(817): n is a, c, g, or t
  misc_feature (819)..(819): n is a, c, g, or t
  misc_feature (822)..(823): n is a, c, g, or t
  misc_feature (827)..(853): n is a, c, g, or t
  misc_feature (855)..(856): n is a, c, g, or t
  misc_feature (858)..(863): n is a, c, g, or t
  misc_feature (865)..(865): n is a, c, g, or t
  misc_feature (871)..(871): n is a, c, g, or t
  misc_feature (874)..(874): n is a, c, g, or t
  misc_feature (876)..(881): n is a, c, g, or t
  misc_feature (883)..(884): n is a, c, g, or t
  misc_feature (886)..(886): n is a, c, g, or t
  misc_feature (888)..(888): n is a, c, g, or t
  misc_feature (892)..(892): n is a, c, g, or t
  misc_feature (895)..(895): n is a, c, g, or t
  misc_feature (901)..(901): n is a, c, g, or t
  misc_feature (904)..(910): n is a, c, g, or t
  misc_feature (912)..(933): n is a, c, g, or t
  misc_feature (936)..(940): n is a, c, g, or t
  misc_feature (942)..(954): n is a, c, g, or t
  misc_feature (956)..(969): n is a, c, g, or t
  misc_feature (971)..(979): n is a, c, g, or t
  misc_feature (981)..(1000): n is a, c, g, or t
  misc_feature (1002)..(1003): n is a, c, g, or t
  misc_feature (1006)..(1013): n is a, c, g, or t
  misc_feature (1015)..(1032): n is a, c, g, or t
  misc_feature (1034)..(1040): n is a, c, g, or t
  misc_feature (1042)..(1042): n is a, c, g, or t
  misc_feature (1044)..(1047): n is a, c, g, or t
  misc_feature (1049)..(1049): n is a, c, g, or t
  misc_feature (1052)..(1055): n is a, c, g, or t
  misc_feature (1058)..(1060): n is a, c, g, or t
  misc_feature (1062)..(1069): n is a, c, g, or t
  misc_feature (1072)..(1099): n is a, c, g, or t
  misc_feature (1102)..(1111): n is a, c, g, or t
  misc_feature (1113)..(1120): n is a, c, g, or t
  misc_feature (1122)..(1123): n is a, c, g, or t
  misc_feature (1125)..(1135): n is a, c, g, or t
  misc_feature (1137)..(1137): n is a, c, g, or t
  misc_feature (1140)..(1140): n is a, c, g, or t
  misc_feature (1142)..(1153): n is a, c, g, or t
  misc_feature (1156)..(1158): n is a, c, g, or t
  misc_feature (1160)..(1161): n is a, c, g, or t
  misc_feature (1164)..(1166): n is a, c, g, or t
  misc_feature (1168)..(1170): n is a, c, g, or t
  misc_feature (1173)..(1175): n is a, c, g, or t
  misc_feature (1178)..(1186): n is a, c, g, or t
  misc_feature (1190)..(1190): n is a, c, g, or t
  misc_feature (1196)..(1203): n is a, c, g, or t
  misc_feature (1205)..(1205): n is a, c, g, or t
  misc_feature (1208)..(1209): n is a, c, g, or t
  misc_feature (1211)..(1213): n is a, c, g, or t
  misc_feature (1215)..(1215): n is a, c, g, or t
  misc_feature (1219)..(1219): n is a, c, g, or t
  misc_feature (1221)..(1221): n is a, c, g, or t
  misc_feature (1223)..(1225): n is a, c, g, or t
  misc_feature (1227)..(1233): n is a, c, g, or t
  misc_feature (1235)..(1241): n is a, c, g, or t
  misc_feature (1245)..(1252): n is a, c, g, or t
  misc_feature (1255)..(1255): n is a, c, g, or t
  misc_feature (1257)..(1258): n is a, c, g, or t
  misc_feature (1260)..(1260): n is a, c, g, or t
  misc_feature (1262)..(1263): n is a, c, g, or t
  misc_feature (1265)..(1277): n is a, c, g, or t
  misc_feature (1279)..(1279): n is a, c, g, or t
  misc_feature (1282)..(1283): n is a, c, g, or t
  misc_feature (1287)..(1291): n is a, c, g, or t
  misc_feature (1296)..(1296): n is a, c, g, or t
  misc_feature (1299)..(1301): n is a, c, g, or t
  misc_feature (1304)..(1305): n is a, c, g, or t
  misc_feature (1311)..(1311): n is a, c, g, or t
  misc_feature (1313)..(1315): n is a, c, g, or t
  misc_feature (1508)..(1508): n is a, c, g, or t
  misc_feature (1512)..(1512): n is a, c, g, or t
  misc_feature (1526)..(1526): n is a, c, g, or t
  misc_feature (1986)..(1986): n is a, c, g, or t
  misc_feature (2611)..(2611): n is a, c, g, or t
  misc_feature (2614)..(2614): n is a, c, g, or t
  misc_feature (2616)..(2616): n is a, c, g, or t
  misc_feature (2618)..(2620): n is a, c, g, or t
  misc_feature (2622)..(2624): n is a, c, g, or t
  misc_feature (2629)..(2631): n is a, c, g, or t
  misc_feature (2633)..(2633): n is a, c, g, or t
  misc_feature (2636)..(2638): n is a, c, g, or t
  misc_feature (2642)..(2642): n is a, c, g, or t
  misc_feature (2645)..(2646): n is a, c, g, or t
  misc_feature (2648)..(2649): n is a, c, g, or t
  misc_feature (2653)..(2654): n is a, c, g, or t
  misc_feature (2664)..(2664): n is a, c, g, or t
  misc_feature (2799)..(2799): n is a, c, g, or t
  misc_feature (2948)..(2949): n is a, c, g, or t
  misc_feature (2951)..(2951): n is a, c, g, or t
  misc_feature (2954)..(2957): n is a, c, g, or t
  misc_feature (2959)..(2961): n is a, c, g, or t
  misc_feature (2963)..(2963): n is a, c, g, or t
  misc_feature (2965)..(2968): n is a, c, g, or t
  misc_feature (2970)..(2974): n is a, c, g, or t
  misc_feature (2976)..(2976): n is a, c, g, or t
  misc_feature (2978)..(2981): n is a, c, g, or t
  misc_feature (2983)..(2992): n is a, c, g, or t
  misc_feature (2995)..(2997): n is a, c, g, or t
  misc_feature (2999)..(3000): n is a, c, g, or t
  misc_feature (3003)..(3006): n is a, c, g, or t
  misc_feature (3011)..(3011): n is a, c, g, or t
  misc_feature (3015)..(3017): n is a, c, g, or t
  misc_feature (3019)..(3021): n is a, c, g, or t
  misc_feature (3023)..(3033): n is a, c, g, or t
  misc_feature (3036)..(3039): n is a, c, g, or t
  misc_feature (3041)..(3043): n is a, c, g, or t
  misc_feature (3046)..(3046): n is a, c, g, or t
  misc_feature (3048)..(3054): n is a, c, g, or t
  misc_feature (3056)..(3057): n is a, c, g, or t
  misc_feature (3060)..(3061): n is a, c, g, or t
  misc_feature (3064)..(3067): n is a, c, g, or t
  misc_feature (3069)..(3073): n is a, c, g, or t
  misc_feature (3075)..(3077): n is a, c, g, or t
  misc_feature (3079)..(3084): n is a, c, g, or t
  misc_feature (3087)..(3089): n is a, c, g, or t
  misc_feature (3091)..(3091): n is a, c, g, or t
  misc_feature (3093)..(3095): n is a, c, g, or t
  misc_feature (3097)..(3099): n is a, c, g, or t
  misc_feature (3101)..(3101): n is a, c, g, or t
  misc_feature (3103)..(3103): n is a, c, g, or t
  misc_feature (3105)..(3108): n is a, c, g, or t
  misc_feature (3110)..(3113): n is a, c, g, or t
  misc_feature (3115)..(3116): n is a, c, g, or t
  misc_feature (3118)..(3118): n is a, c, g, or t
  misc_feature (3122)..(3124): n is a, c, g, or t
  misc_feature (3126)..(3127): n is a, c, g, or t
  misc_feature (3129)..(3130): n is a, c, g, or t
  misc_feature (3133)..(3135): n is a, c, g, or t
  misc_feature (3137)..(3137): n is a, c, g, or t
  misc_feature (3141)..(3143): n is a, c, g, or t
  misc_feature (3146)..(3157): n is a, c, g, or t
  misc_feature (3159)..(3159): n is a, c, g, or t
  misc_feature (3163)..(3164): n is a, c, g, or t
  misc_feature (3166)..(3167): n is a, c, g, or t
  misc_feature (3170)..(3170): n is a, c, g, or t
  misc_feature (3174)..(3177): n is a, c, g, or t
  misc_feature (3179)..(3180): n is a, c, g, or t
  misc_feature (3182)..(3183): n is a, c, g, or t
  misc_feature (3186)..(3186): n is a, c, g, or t
  misc_feature (3188)..(3193): n is a, c, g, or t
  misc_feature (3195)..(3198): n is a, c, g, or t
  misc_feature (3200)..(3200): n is a, c, g, or t
  misc_feature (3203)..(3203): n is a, c, g, or t
  misc_feature (3205)..(3212): n is a, c, g, or t
  misc_feature (3215)..(3216): n is a, c, g, or t
  misc_feature (3218)..(3218): n is a, c, g, or t
  misc_feature (3223)..(3227): n is a, c, g, or t
  misc_feature (3229)..(3238): n is a, c, g, or t
  misc_feature (3240)..(3241): n is a, c, g, or t
  misc_feature (3243)..(3245): n is a, c, g, or t
  misc_feature (3247)..(3247): n is a, c, g, or t
  misc_feature (3249)..(3258): n is a, c, g, or t
  misc_feature (3261)..(3268): n is a, c, g, or t
  misc_feature (3270)..(3272): n is a, c, g, or t
  misc_feature (3275)..(3275): n is a, c, g, or t
  misc_feature (3277)..(3279): n is a, c, g, or t
  misc_feature (3281)..(3281): n is a, c, g, or t
  misc_feature (3283)..(3283): n is a, c, g, or t
  misc_feature (3285)..(3285): n is a, c, g, or t
  misc_feature (3287)..(3293): n is a, c, g, or t
  misc_feature (3295)..(3296): n is a, c, g, or t
  misc_feature (3298)..(3300): n is a, c, g, or t
  misc_feature (3302)..(3304): n is a, c, g, or t
  misc_feature (3307)..(3308): n is a, c, g, or t
  misc_feature (3313)..(3315): n is a, c, g, or t
  misc_feature (3317)..(3317): n is a, c, g, or t
  misc_feature (3322)..(3323): n is a, c, g, or t
  misc_feature (3325)..(3326): n is a, c, g, or t
  misc_feature (3328)..(3328): n is a, c, g, or t
  misc_feature (3330)..(3330): n is a, c, g, or t
  misc_feature (3335)..(3335): n is a, c, g, or t
  misc_feature (3337)..(3337): n is a, c, g, or t
  misc_feature (3341)..(3342): n is a, c, g, or t
  misc_feature (3344)..(3345): n is a, c, g, or t
  misc_feature (3347)..(3347): n is a, c, g, or t
  misc_feature (3349)..(3351): n is a, c, g, or t
  misc_feature (3353)..(3357): n is a, c, g, or t
  misc_feature (3359)..(3360): n is a, c, g, or t
  misc_feature (3362)..(3363): n is a, c, g, or t
  misc_feature (3365)..(3366): n is a, c, g, or t
  misc_feature (3368)..(3368): n is a, c, g, or t
  misc_feature (3370)..(3374): n is a, c, g, or t
  misc_feature (3378)..(3378): n is a, c, g, or t
  misc_feature (3380)..(3380): n is a, c, g, or t
  misc_feature (3382)..(3382): n is a, c, g, or t
  misc_feature (3384)..(3386): n is a, c, g, or t
  misc_feature (3390)..(3391): n is a, c, g, or t
  misc_feature (3393)..(3394): n is a, c, g, or t
  misc_feature (3396)..(3396): n is a, c, g, or t
  misc_feature (3398)..(3400): n is a, c, g, or t
  misc_feature (3402)..(3407): n is a, c, g, or t
  misc_feature (3413)..(3415): n is a, c, g, or t
  misc_feature (3418)..(3421): n is a, c, g, or t
  misc_feature (3427)..(3437): n is a, c, g, or t
  misc_feature (3440)..(3441): n is a, c, g, or t
  misc_feature (3444)..(3444): n is a, c, g, or t
  misc_feature (3450)..(3451): n is a, c, g, or t
  misc_feature (3457)..(3461): n is a, c, g, or t
  misc_feature (3464)..(3468): n is a, c, g, or t
  misc_feature (3471)..(3478): n is a, c, g, or t
  misc_feature (3481)..(3481): n is a, c, g, or t
  misc_feature (3485)..(3486): n is a, c, g, or t
  misc_feature (3493)..(3494): n is a, c, g, or t
  misc_feature (3500)..(3501): n is a, c, g, or t
  misc_feature (3506)..(3508): n is a, c, g, or t
  misc_feature (3515)..(3523): n is a, c, g, or t
  misc_feature (3528)..(3529): n is a, c, g, or t
  misc_feature (3536)..(3538): n is a, c, g, or t
  misc_feature (3541)..(3541): n is a, c, g, or t
  misc_feature (3545)..(3553): n is a, c, g, or t
  misc_feature (3556)..(3558): n is a, c, g, or t
  misc_feature (3561)..(3562): n is a, c, g, or t
  misc_feature (3565)..(3565): n is a, c, g, or t
  misc_feature (3568)..(3574): n is a, c, g, or t
  misc_feature (3579)..(3579): n is a, c, g, or t
  misc_feature (3582)..(3583): n is a, c, g, or t
  misc_feature (3586)..(3587): n is a, c, g, or t
  misc_feature (3597)..(3598): n is a, c, g, or t
  misc_feature (3601)..(3601): n is a, c, g, or t
  misc_feature (3611)..(3615): n is a, c, g, or t
  misc_feature (3619)..(3626): n is a, c, g, or t
  misc_feature (3631)..(3633): n is a, c, g, or t
  misc_feature (3636)..(3636): n is a, c, g, or t
  misc_feature (3642)..(3643): n is a, c, g, or t
  misc_feature (3648)..(3650): n is a, c, g, or t
  misc_feature (3657)..(3659): n is a, c, g, or t
  misc_feature (3664)..(3664): n is a, c, g, or t
  misc_feature (3667)..(3669): n is a, c, g, or t
  misc_feature (3672)..(3672): n is a, c, g, or t
  misc_feature (3675)..(3675): n is a, c, g, or t
  misc_feature (3679)..(3681): n is a, c, g, or t
  misc_feature (3685)..(3688): n is a, c, g, or t
  misc_feature (3693)..(3693): n is a, c, g, or t
  misc_feature (3696)..(3698): n is a, c, g, or t
  misc_feature (3701)..(3701): n is a, c, g, or t
  misc_feature (3704)..(3704): n is a, c, g, or t
  misc_feature (3711)..(3711): n is a, c, g, or t
  misc_feature (3714)..(3714): n is a, c, g, or t
  misc_feature (3717)..(3717): n is a, c, g, or t
  misc_feature (3720)..(3725): n is a, c, g, or t
  misc_feature (3730)..(3730): n is a, c, g, or t
  misc_feature (3733)..(3736): n is a, c, g, or t
  misc_feature (3740)..(3741): n is a, c, g, or t
  misc_feature (3744)..(3745): n is a, c, g, or t
  misc_feature (3748)..(3748): n is a, c, g, or t
  misc_feature (3753)..(3754): n is a, c, g, or t
  misc_feature (3761)..(3761): n is a, c, g, or t
  misc_feature (3764)..(3766): n is a, c, g, or t
  misc_feature (3769)..(3774): n is a, c, g, or t
  misc_feature (3777)..(3778): n is a, c, g, or t
  misc_feature (3782)..(3782): n is a, c, g, or t
  misc_feature (3785)..(3792): n is a, c, g, or t
  misc_feature (3798)..(3799): n is a, c, g, or t
  misc_feature (3802)..(3802): n is a, c, g, or t
  misc_feature (3805)..(3809): n is a, c, g, or t
  misc_feature (3812)..(3815): n is a, c, g, or t
  misc_feature (3819)..(3821): n is a, c, g, or t
  misc_feature (3824)..(3833): n is a, c, g, or t
  misc_feature (3838)..(3838): n is a, c, g, or t
  misc_feature (3845)..(3848): n is a, c, g, or t
  misc_feature (3852)..(3852): n is a, c, g, or t
  misc_feature (3858)..(3864): n is a, c, g, or t
  misc_feature (3867)..(3867): n is a, c, g, or t
  misc_feature (3870)..(3871): n is a, c, g, or t
  misc_feature (3878)..(3881): n is a, c, g, or t
  misc_feature (3888)..(3889): n is a, c, g, or t
  misc_feature (3892)..(3893): n is a, c, g, or t
  misc_feature (3896)..(3901): n is a, c, g, or t
  misc_feature (3904)..(3904): n is a, c, g, or t
  misc_feature (3910)..(3913): n is a, c, g, or t
  misc_feature (3916)..(3924): n is a, c, g, or t
  misc_feature (3926)..(3926): n is a, c, g, or t
  misc_feature (3937)..(3938): n is a, c, g, or t
  misc_feature (3940)..(3948): n is a, c, g, or t
  misc_feature (3950)..(3959): n is a, c, g, or t
  misc_feature (3962)..(3962): n is a, c, g, or t
  misc_feature (3967)..(3969): n is a, c, g, or t
  misc_feature (3971)..(3975): n is a, c, g, or t
  misc_feature (3977)..(3977): n is a, c, g, or t
  misc_feature (3981)..(3981): n is a, c, g, or t
  misc_feature (3986)..(3989): n is a, c, g, or t
  misc_feature (3991)..(3993): n is a, c, g, or t
  misc_feature (3997)..(3998): n is a, c, g, or t
  misc_feature (4000)..(4000): n is a, c, g, or t
gnnnnnnnnnnnnnnggggnnnnnngnnggggnnnnnnnccccnnnnncccnnnnnnncnncnncnnnnnnnnnnnnnnngngggggggnnnnnnnnnnnnnnngngnnnnnnnnnnnnnnnnnnnnnnnnnnnnnnnnngnngnngnnnnnnnnnnnnnnnnnnnnnnnnnnnnngnnnnnnnnnnnggggngnnnnnnnnnnnnnnnnnnnnnnnnnnnnnnnnnnnnnnnnnnnnnnnnnnnnnnnnggggngnnnnnnccnnnnnncnnnnnnnnnnnnnnnnnnnnnnncnnnnnngnnnnnnnnnnnnnnnnnnannnnnannnnnnnnnnnnggggnnnncnnnnnnnnnngnnnnngnnnnnnnnnnnnnnnnnnnnnnnannnnnnnnnnnnnnnnnnnnnnnnnnnnnnnggnggngnnnnnnnnnnnnngnngnnnnnnnnnnnnnnnngnnnnnnnnnnnnnnnnnnnnnnnnnnnnnnnnnnngnnnnnnnnnnnnnnnnnnnnnnnnncccccccnnnnnnnnnnnnnnnnnnnnngngnnnncnnncnnnnnnncnncnncnnnnnngnngnngggggggggggnngnnnnnnnnnnnnnnncnnnnnnnncnnnnnnnnnnnnnnnnnnnnnnnnnnnnnnnnnnnnnnnnnnnnnncnccnnngggngngggnnnnnnnnnnnnnnnnccncnnnnnnnnnnnggnnnnnnnncnnccccccnnnnnnnnngnnnnnnnnnnnnnnnnnnnnnnnnnnnnnnnngnnnnngnnnnnnnnnnnnnnnnnnnnnnncccnnncnccnncccnnnnnnnnnnnnnnnnnnnnnnnnnnncnncnnnnnnangggggnggngnnnnnngnngngngggnggngggggnggnnnnnnnannnnnnnnnnnnnnnnnnnnnnggnnnnngnnnnnnnnnnnnntnnnnnnnnnnnnnntnnnnnnnnnannnnnnnnnnnnnnnnnnnngnnggnnnnnnnncnnnnnnnnnnnnnnnnnngnnnnnnncncnnnncnccnnnnccnnngnnnnnnnnccnnnnnnnnnnnnnnnnnnnnnnnnnnnngannnnnnnnnnannnnnnnntnntnnnnnnnnnnntnttntnnnnnnnnnnnnaannnannatnnnannnatnnntcnnnnnnnnnaaanaagaannnnnnnntnatnnannngngagnancnnntnnnnnnnannnnnnngaannnnnnnngcngnngnannannnnnnnnnnnnncnacnnacgnnnnntattnatnnnatnnattaantnnntttagcgacacgtggatatcccgcgggcccgatgcggtcccgcaagataccacgggcgcacggcggatgccttggcacagggagccgatgaaggacgcggcaagctgcgataatccccggcgaggagcacacatccttcgacccgggggtctccgaatgggcgaacccatgcacagcagtgtgcatatccccncccngaacacataggggnggggaggacaacccggggaactgaaacatctaagtacccggaggagaggaaatcaatctcgagactccccgagtagcggcgagcgaaaggggaccgatggccaaaccgtcgagcgggcatacccggcaggggttccgccgacggggttgcagggccgcgcatccgggggctgccgcccccgggcgcaggtccggctggggagcggaacggcatgggagggccggccgcagcgggtgacagccccgtacgcgaacccagaccggacggcgcgacgcggtccctgagtagggccgggcacgtgaaacccggtccgaacctgggtggaccaccatccaagcctgagtactaccctgtgaccgatagcgcaccagtaccgtgagggaaaggtgaaaagcaccccgggaggggagtgaaacagtacctgaaaccgtgcgcccacgagcagtcggagcaactttangttgtgacggcgtgccttttgtagaatgagccagcgagtcgctggcgcggggcgaggttaaccgaaagggagccggagcgaaagcgagccttaacagggcgacttgagtcccgcgccgcggacgcgaagccgggtgagctatccgtgggcaggctgaagcgggggtaagaccccgtggagggccgaacgcacgtcggttgaaaacggcggcgatgacctgcggataggggtgaaaggccaatcaaacccggagatatctcgttctccccgaaatagctttagggctagcgtcgcgcgttcaccgccggaggtagagcaccggatggacgagggggcttcgccgcctaccgaatccaaccgaactccgaatgccggcggcccagagcgcggcagtcagagcatgtgggctaagctgtgtgctcgagagggaaacagcccggaccgcccgctaaggtccccaagttccagccgagtggcaaaggatgtgcgtccgcccagacaaccaggatgttggcttagaagcagccatccattcaaagagtgcgtaacagctcactggtcgagtggacatgcgccgacaatacacggggctaagctggacaccgaagcggcgggattttaattnatnanannngnnnggggnnntnccnnngggnggnnannccgnngggcgaccgncggtggagcgcatgggagtgagaatgctggcatgagtagcgagagacgagagagtaactcgtccgccgtgaacccgaggtttcctgggcaaggctaatcctcccagggtcagtcgggggctaaggcgaggccggnaggcgtagccgacgcgcagcaggcagacattcctgcaccgcgcacgcggcgctacgaccgacggggcgacggatgggggtggctcggcggggttctggacgtccccgtgatggagcgcggcccgcggaccagggaaatccggtccgcannanggnnnngnnncngnnnnannnnntnannnnannnnnnnnnnccnnngnnccnnnnaaaancccnnngnnngnnnnnnnnnnnccnnnncnnnaancnnnnnnngnnggnnggnnnnannnnncnnngnnnnnnggnnnancnnngnnnangnannnngnnnnanngncccnnnanntnnggnnnangggnnnccnnnnnnnnnnnnancggnntnnccngggnnnngnngnnggncnnnnnngnnnngnccnannnnnnnnttnncnaaaannnnngnnnnnnnnnnanncnnnangnnnnnnnnnnggnnnnnnnncnnnccngnnncngnangnnnnnnngnngnnntnnncgnntcggnnnanccccnnanncnanccccngnaaanngnngncnnnannnnnanngnncnnangnnnnnaaantncntnnngggnnanntncnnncnnnnnnaaaggnnnaannnnttgggnnnnnnnnnnnccnnggncccggnnaaattnnnnnggnnnnnaannnnnnnnttncccnnggaaggnnggaaannccccnnnaaccttnnnnnnnnnttggnnttggccnnnggncccnnnnnnnnnggnnnggnnggnggnnnnnnnccggnggnnccnncccccggggnnccncccttggaannnnncccnnnnnnnnccggnnnccnaacccnnggccnnnaaccggnnnggggnccnnnccnggngggnnntttnnnnggggnggnnnccnccnaaagggnaanggnggnnnnnnaaggnccnnnngggnnggnnggnaaccnnccttttnaannnaannnnnnaanngggnttnnnnnnnnggcccnnaanccnnnnnggnnnnaaannnggnnnnnnnnnnccggnggccccnnnngggngggccnnnnnnnaanggnnaaaaggnnnnccggggnnaannggnnnnnnttncccaannnnccnnnnnnnnngnaaggtttggcnncnnnnnnnnngnnnnnnnnnnccnggggnnngnnnnngncccnagggnnnngnnnttcnncn

SEQ ID NO: 219 - DNA, 4000 bp, Escherichia coli
  misc_feature (1)..(202): n is a, c, g, or t
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaacgtatagcgaactcgtcgaagcgctagaaactgcgctactggccatttctatacacgattgtaataactggtttcatcacgctggatacacacttccatgatccgtgcttatgaaaaccgctctaatatattgtagccttatcgggttaatcgcgactccttctcatcgataggcatattttagcgttgccttgggctcgagacccttgcttttcggctttctctcgcgctattctcacggcatgaagctcgcgcgtctgcttacgctggtggtcgcaactgcgtgtactcctccgaacgtgggttcgcgtcctttggatagggtcgaggaaaagccgaaggaacaatgtacgcttttcgaacgggatccgaccaaagagccggacttgatggcgtgggatccgacccagcgtcagaagatccatgcaaagcggacgcgaggggtggtggtggtacatatcgacttgaatggctgcgatgtgacggcgcgggtattggattgcgtgggcaaggtggaggcaagcagcgagccctacgaatttagctggtattacgcgaatgacacggtggtggcccattctcagcgcgaggcgtatatgaagctaccgttgggtgcggcgtcggtgggggcgcagcttgggtcgggtcaatcgcttcgtgtggattatgtgatggcaggctcgtatgtattgccggatgatgcgcagataagcgaatgggtgggcagcgaatgcagtgaagggacgcattatgttacggccgtggtggtgggagggtttgcgcgggcggtggggcgacggcaggaggtggagggtagcgctggtctgtttgggattggggcgggagccggtgagacgacgagccagctcaattggcgaacggagggcagcccatcggcgtgcagggaggcggagcagaaaaagagcgtgaatacgggttgtgatatgccgcttcgtttggaactgaggccgcttcgcacggcgtctgcgccagtgcccacgccgcctcagccagccaagccggaaccaactcccaccgcggtcgcgcccacgccgccacctacacagcagccagccaagccggaaccaactcccaccgcggtcgcgcccacgccgccacctacacagcagccagccaagccggaaccagttcgcacggcggcagttcccacggcgacaccgccggtttctccggcgtcgcaagggggaaattgcccgagtggcatggcgtggatccccggaggctcgttcatgatggggtccaacaagggtgataatgacgaaaaaccggtccatcgtgtggagttggacggattttgtctggacatcacgcctgtgacggtggatgcgtacgcgcgttgcagtgggtgttcgaagccgaacaccaacaacgaattctgcaactgggggaagtcgggaaaggggaatcatccgatcaattgcgtggattggggacaggcgagtgcctattgtcgttcggtgggcaagcaattgcccacggaggcgcagtgggagtatgcggcgcggggcgggtcgaggcagctcgagtatccgtggggttcggagggatccaacgggcgggcgtgttggaatcggtgggattcttgggaagggacgtgtgcggtgggaagctatgcctcgggggcgtttggattgaaggatatggctgggaacgtctgggagtgggtgcaagactggtatggggcctatccaagctctacaagcaagaatcatgccggaccttcttccggctcttcccgcgtgtgccgcggcggcggttgggacgtcaatgacccgtcgtggctgcgcggtgccttccgcggctgccgcacgcccgacattcggctcggcaacctcgggtttcgttgcgccaggaccaggtaggacggtggcataagtcttgcatataacctgtagggcatcatcaccctcaatacttgatccctcattccctcaaaaacaatgacagataagaagacgtccccaccggagaacgaacccgaaatggggaccaggggcgaagcccctggccgacaaaaaattccgccaagcttgcctcccgtcgtgctgcaaatggaagatctgaccctctggatcatgctgcgcgtcgccaagtttccccgcgatcaccgtttcaccctcggtgataggctcatcgaagcttgcctttcggtgctcgatgacctggttcatgccgcgttcagccgcgacaaggtcgccttgctcacccatgcttcccgtacgttgacccgagcccgcaccctcgtgcgccttgccaaccgcgcccatctccttgcggaaaaacagcgcacctatttcgctgagcaatccgacgaaatcggaaagaagatttctggctggacacgccatgctcgcacgcgataaactcgccaacgcgtgcggggttccgcatgcgcgtcggctggggaagctctaaccgcgtgtgccgcggcggcagttggaacaacaatgacccgtcgaggctgcgcggtgccaaccgcaacaacaacacgcccgacaatcggaacaacaacctcgggtttcgttgcgccagcaccaggaatctccccgcctttcggcccaaaacgccatcaggcgagccagagcagacgcgatgccccaacgtcgcgcctggcgtgcttgtcctggtccacccgttgccgacgcgggtcccccaagacccgatgagcatcgttggtctccgccaacgatcccccgctcgccgagtcgcctccacctcatacgagcgcgcgcggacgacgggcgggatttatccatcctcaaaacacgatgtcctccatcacagcttcgaccaatcgtcgcgtgtgtccatgcctcgcatgcgcaagccacgcttgcacccgcgaccgaacctccgatgcctcgatcgctcccgcctgaaacagcgagcgcatcaaccgcaccctttgtcgaaatcgacgcaagctatctttgcgcagatgcacgatgacgccatcgccacgacgtcgcaacacgaatcccacgaaggatactgggtccgtggtgcgatacaaccgtgttttcgatggatgcagtcgcaagcgcaggcgctgtgctgcttgctgcatctgcgccagcgcgtttcgaagcacctgcggatcgtcatgccacacgagccaatcgtcgcagtaacgaacgaagcttccgatgccgagacctgcggccagcagatgatccaaggccgacacataaaaattcgcccatatctgggaagtcagcgagccgatggcaagtccatggggccgttcgaccggagtccataaggtatcaccgggaaaccatagatgtacttgctcaccttcataaggcgcatcgatgaatcggtccgaaagccatctccaactcacaggagtcaccgaatgcagccgacgtcgcaggagttcatggtcgatactcggaaaaaactttcgaatatccaccttcaacacccagcgacgcgcgcgagtccaacccatggcttcccgcagggcgcgatgggtcccatgtccttttcggcaggcatgggattggggtgccattcgtcgttcgatggcttgcagtgtcgtgtcgatgagcagatgctgcacgacccggtcgcgaaacggaatgacgctgatcagccgacgcttcggatcttggatccacatcgggcgaacggggccgggttcgtaggtttgggctgccaattccgttcgtaagtgcagcagttccgtgtcctcatcgagcagaaagcgcgcaacctgggggcttcgtcgctttcctcgggccgcgcgcgtcaccatttcccgaagccgccc

SEQ ID NO: 220 - DNA, 4000 bp, Escherichia coli
  misc_feature (129)..(129): n is a, c, g, or t
  misc_feature (267)..(267): n is a, c, g, or t
  misc_feature (279)..(279): n is a, c, g, or t
  misc_feature (644)..(644): n is a, c, g, or t
  misc_feature (1440)..(1440): n is a, c, g, or t
  misc_feature (1463)..(1463): n is a, c, g, or t
  misc_feature (1986)..(1987): n is a, c, g, or t
  misc_feature (1989)..(1989): n is a, c, g, or t
  misc_feature (2701)..(2701): n is a, c, g, or t
  misc_feature (3067)..(3067): n is a, c, g, or t
  misc_feature (3283)..(3283): n is a, c, g, or t
  misc_feature (3355)..(3355): n is a, c, g, or t
  misc_feature (3560)..(3560): n is a, c, g, or t
  misc_feature (3579)..(3579): n is a, c, g, or t
  misc_feature (3588)..(3588): n is a, c, g, or t
ccgtgagcgcggcagcgcgaaaccgcatgctgcatggcgctgtcgatctcggcggcgttcggcgccacctggtcgccattcgacagtgcgatcgaaagatcggacggaccgacgaaaatgccgtcgatnccggcaacacccaggataccgtcgatcgcgtcgagcgccgcccgggtctcgaccatggcgatggcgacggtgagcgcgttggcgttcttcagataatcatcacccgacaggccggtataattcagcgccagcgacggnccccagctgcgntcgccggcgggcgggtatttcgtggtccgcaccagggcttgcgcgtcttcgaccgaattgatcatcggcgcgatgatgccggaggcgccggcatcgagcaggcgcgaggcggaagcaaaatcgccgaccggaatgcgcgccagcgccggcttgccggcaagccgcacctgaccgacggcgttcgccgccgatggcatgtcccacatgccatgctgcatatccagcacgacggcatcgaaggcctcctgcgccagatgattgacgagcgtggcgtcgggaatgccgacccaggcggagatcatgccgccccggtggctcctgatccgctccgcaaagccgtcgatttcagctgcgctcatgccatnctcctcacttcgacaggccgtcagcggccagatatttcacctcgaggagctcttcggtgtcgaatttcctcgaagccatgcatgttctgccggctcatcctctccggcgcagccgtgaaacgatgattgtcacggcaagcccggctgcagccgtgatgcttccccagagaatccagatgctctggttgatcatgaagctggatgacggatagggaaaatagccgcttccctgggcgacccagatcagccccgagaggatcatcagcaatcccacgacatatccgattgtgcgccacatgcttcggcaacccttcttatgaatcagtgtcacaatgtcgaccggcatcgttgatgacaaggcttctctcccaaacgcgacgatattcccgaatgtcatgtcctgccgacttcatccaccagccaggtgctgagcctttcgctatgaatatttgccgattgcggcggtatcagccagtaaccgcggtcgggcgcctcgagcggcggcccggcttccaccagcatatgcgcggagagaagcgtgtcgaccagccccatccagccgatcgccacgccctgctcgctgagagcagcctggacgaccagcgaataggtgttgaagctgatatccccgcggccggcatggagatcgcgcgtgacggagaattcggcaagatagcttcgccaatcgaaccagggtggcggcatcggcgaatcgaggtggatcaggatcgtcctggcaagctgctgcggatcgtcgaacgggccgttgcgatcgagaaatcctcgtgtgcagacnggcacgaccttttcctgcaacancagcgatccgaaggcgccgaattccgcccgcgtcccgaaaaccaccactacatctgcgtcgtcacgaaagccgggctcgagccgctgggtcgcgacgatctgtatatccgtttccggatgaagctggcgaaagccatgcatgcgcgggatcagccaaagggctgaaaaagcatagtctgttctcagcctgacgaccggtctttgagcctcggtgcggaagctgcgcgccagcgcatcgatgtcaccgacggtcttggcagcgacctggaaaagccgctcgccctccgcggtcagctcgacgccgcgatgctggcggcgcaacaggccgaccccgaattgctcttccagccgccgcatctgatagctgacggccggttgcgtgagcccgatacgtgctgccgccgacgaaaagctcccgagtgtcgcgacctcgacgaagatgcgcatccagccaagctcgggcgggcggtctgacataaaaaatcctttagtcacccatcgaaaaaagctgtctttacagccnnancaataagcgattgaataaatttctcaaatagcaaaagaggaattccatgccgcgtccgaatatcctcatcctgatggtggaccagctgaacgggaccttctttccggatggccccgcggatttccttcatgcgccgcatctgagatcattggcagagcgctccgtgcgtttcaccaacacctatacggcaagcccgctctgcgcgccggcgcgagcctccttcatgtccggacaattgccgagccggacgcgcgtctatgacaatgcggcggaattcgcctccgacatcccgacttacgcgcatcatctgcgcgctgccggataccagacggcgctatcaggcaagatgcatttcgtcggccccgaccagctgcatggcttcgaggagcgcctgacgacggacatctacccggccgatttcggctggacacccgactatagcaagcccggcgaacgcatagactggtggtatcataatctcggttcggtgaccggcgccggtgttgccgaaatcaccaaccagatggagtatgacgacgaggtcgcctaccatgccgcccgcaagctgttcgatctctcgcgtggccacgacggacgcccctggtgcctgaccgtcagcttcacccatccgcacgacccgtacgtcgcgcgccgcaaattctgggacctttatgaggattgcccggcccttgatccggcagttgcgccgatngccttcgagcggcaagacccgcattcgcagcgcctgatgaaagcctgtgaccacgatgccttcgacatcagcgatgagcaaatcaggcgggcaaggcggggctacttcgccaatatctcctatgtcgatgacaagatcggcgagattctcggcgtcctggaacggacccgcatggcggaaaatacgatcattctcttcgcctcggaccatggcgacatgctcggggatcgcggcctctggttcaagatgaacttcttcgaaggatcggcccgcgttccgctgatgatcgcagcccccggctggaagcccaaacgcatcgatcagcccgtctccacgctcgacgtgacgccgacgctcgccggtctngccgggatcgatatcgcttcgttgaaaccatggaccgagggcgaggatctggcattgcttgccgaaggcaccggcaatcgcagcccggtgccgatggaatatgccgcggagggttccgaagcaccgctcgtctgcattcgggacggacggtacaagctctcgctctgcgagaaggacccgccgatgctgtttgacctcgaggccgatccccaaganctcgacaatctggcggccgacccggcgcacgccgacatcttggcaaggcttgccgaacaggccgggcgccgntggaatcttgccgctttcgacgcagccgtgcgcgaaagccaggcgcgccgctgggtggtctatgcagcgctgcgcaacggcgcctattatccatgggactaccagccgctgcagaaagcctcggagcgctatatgcgcaaccacatggatctcaacgtgctggaggaaaaccagaggttcccgcgccaggaatgagcgaaacgcntctgattaagccgtcctgngcgccggcncctcgcgcaggaaatcctcgatgaacgccttttgcagcagaatgccgtcccattcatcggggaagaagggcgagtcgtagatcagcgtgaagggaccgtcatagccggcccgctcgcacatctccaggcacttgcgataatcgtcggcatcgaggccggtgacgccataatcggccttggcgtggcaaatttccgcccggcccatgatgtcggccaggccttcatatttcgccggcgccgcccagttgccgaggtcgccgttgaggccgaccttgccgtccagccggtccagcagccagttcatctcgatgggcgacggcagcaggtcgaaccaattctcgacgacgacgcgcacgccgctgccttctgcctttccgcccagccagctcagatgacgggcggcgcgggcaag

SEQ ID NO: 221 - DNA, 4000 bp, Escherichia coli
  misc_feature (1)..(1): n is a, c, g, or t
  misc_feature (3)..(3): n is a, c, g, or t
  misc_feature (6)..(7): n is a, c, g, or t
  misc_feature (9)..(9): n is a, c, g, or t
  misc_feature (13)..(13): n is a, c, g, or t
  misc_feature (15)..(16): n is a, c, g, or t
  misc_feature (19)..(19): n is a, c, g, or t
  misc_feature (27)..(27): n is a, c, g, or t
  misc_feature (30)..(30): n is a, c, g, or t
  misc_feature (33)..(38): n is a, c, g, or t
  misc_feature (40)..(42): n is a, c, g, or t
  misc_feature (44)..(45): n is a, c, g, or t
  misc_feature (50)..(56): n is a, c, g, or t
  misc_feature (58)..(59): n is a, c, g, or t
  misc_feature (62)..(62): n is a, c, g, or t
  misc_feature (65)..(74): n is a, c, g, or t
  misc_feature (76)..(76): n is a, c, g, or t
  misc_feature (78)..(82): n is a, c, g, or t
  misc_feature (84)..(90): n is a, c, g, or t
  misc_feature (94)..(106): n is a, c, g, or t
  misc_feature (108)..(108): n is a, c, g, or t
  misc_feature (110)..(117): n is a, c, g, or t
  misc_feature (120)..(127): n is a, c, g, or t
  misc_feature (130)..(131): n is a, c, g, or t
  misc_feature (133)..(144): n is a, c, g, or t
  misc_feature (148)..(149): n is a, c, g, or t
  misc_feature (152)..(153): n is a, c, g, or t
  misc_feature (156)..(158): n is a, c, g, or t
  misc_feature (160)..(163): n is a, c, g, or t
  misc_feature (165)..(165): n is a, c, g, or t
  misc_feature (168)..(168): n is a, c, g, or t
  misc_feature (170)..(171): n is a, c, g, or t
  misc_feature (173)..(173): n is a, c, g, or t
  misc_feature (175)..(175): n is a, c, g, or t
  misc_feature (177)..(177): n is a, c, g, or t
  misc_feature (179)..(187): n is a, c, g, or t
  misc_feature (189)..(189): n is a, c, g, or t
  misc_feature (192)..(192): n is a, c, g, or t
  misc_feature (195)..(196): n is a, c, g, or t
  misc_feature (198)..(198): n is a, c, g, or t
  misc_feature (200)..(202): n is a, c, g, or t
  misc_feature (204)..(206): n is a, c, g, or t
  misc_feature (208)..(208): n is a, c, g, or t
  misc_feature (210)..(212): n is a, c, g, or t
  misc_feature (215)..(216): n is a, c, g, or t
  misc_feature (219)..(220): n is a, c, g, or t
  misc_feature (223)..(223): n is a, c, g, or t
  misc_feature (226)..(230): n is a, c, g, or t
  misc_feature (232)..(233): n is a, c, g, or t
  misc_feature (235)..(237): n is a, c, g, or t
  misc_feature (239)..(244): n is a, c, g, or t
  misc_feature (247)..(247): n is a, c, g, or t
  misc_feature (249)..(253): n is a, c, g, or t
  misc_feature (255)..(255): n is a, c, g, or t
  misc_feature (257)..(258): n is a, c, g, or t
  misc_feature (260)..(263): n is a, c, g, or t
  misc_feature (265)..(267): n is a, c, g, or t
  misc_feature (269)..(270): n is a, c, g, or t
  misc_feature (272)..(275): n is a, c, g, or t
  misc_feature (277)..(281): n is a, c, g, or t
  misc_feature (284)..(288): n is a, c, g, or t
  misc_feature (290)..(291): n is a, c, g, or t
  misc_feature (295)..(295): n is a, c, g, or t
  misc_feature (297)..(297): n is a, c, g, or t
  misc_feature (301)..(301): n is a, c, g, or t
  misc_feature (304)..(306): n is a, c, g, or t
  misc_feature (308)..(310): n is a, c, g, or t
  misc_feature (313)..(315): n is a, c, g, or t
  misc_feature (318)..(321): n is a, c, g, or t
  misc_feature (324)..(329): n is a, c, g, or t
  misc_feature (331)..(332): n is a, c, g, or t
  misc_feature (335)..(336): n is a, c, g, or t
  misc_feature (338)..(340): n is a, c, g, or t
  misc_feature (342)..(344): n is a, c, g, or t
  misc_feature (347)..(350): n is a, c, g, or t
  misc_feature (353)..(353): n is a, c, g, or t
  misc_feature (355)..(356): n is a, c, g, or t
  misc_feature (358)..(358): n is a, c, g, or t
  misc_feature (360)..(362): n is a, c, g, or t
  misc_feature (364)..(365): n is a, c, g, or t
  misc_feature (367)..(367): n is a, c, g, or t
  misc_feature (370)..(374): n is a, c, g, or t
  misc_feature (376)..(385): n is a, c, g, or t
  misc_feature (387)..(389): n is a, c, g, or t
  misc_feature (391)..(391): n is a, c, g, or t
  misc_feature (393)..(397): n is a, c, g, or t
  misc_feature (399)..(400): n is a, c, g, or t
  misc_feature (402)..(402): n is a, c, g, or t
  misc_feature (404)..(405): n is a, c, g, or t
  misc_feature (407)..(417): n is a, c, g, or t
  misc_feature (419)..(420): n is a, c, g, or t
  misc_feature (422)..(424): n is a, c, g, or t
  misc_feature (426)..(430): n is a, c, g, or t
  misc_feature (432)..(438): n is a, c, g, or t
  misc_feature (440)..(444): n is a, c, g, or t
  misc_feature (446)..(446): n is a, c, g, or t
  misc_feature (449)..(449): n is a, c, g, or t
  misc_feature (451)..(451): n is a, c, g, or t
  misc_feature (453)..(453): n is a, c, g, or t
  misc_feature (455)..(459): n is a, c, g, or t
  misc_feature (461)..(467): n is a, c, g, or t
  misc_feature (469)..(473): n is a, c, g, or t
  misc_feature (477)..(479): n is a, c, g, or t
  misc_feature (481)..(481): n is a, c, g, or t
  misc_feature (483)..(483): n is a, c, g, or t
  misc_feature (485)..(489): n is a, c, g, or t
  misc_feature (491)..(494): n is a, c, g, or t
  misc_feature (496)..(497): n is a, c, g, or t
  misc_feature (499)..(500): n is a, c, g, or t
  misc_feature (502)..(502): n is a, c, g, or t
  misc_feature (504)..(510): n is a, c, g, or t
  misc_feature (512)..(514): n is a, c, g, or t
  misc_feature (516)..(518): n is a, c, g, or t
  misc_feature (520)..(521): n is a, c, g, or t
  misc_feature (523)..(523): n is a, c, g, or t
  misc_feature (525)..(526): n is a, c, g, or t
  misc_feature (529)..(529): n is a, c, g, or t
  misc_feature (531)..(534): n is a, c, g, or t
  misc_feature (537)..(541): n is a, c, g, or t
  misc_feature (543)..(543): n is a, c, g, or t
  misc_feature (545)..(551): n is a, c, g, or t
  misc_feature (553)..(553): n is a, c, g, or t
  misc_feature (555)..(565): n is a, c, g, or t
  misc_feature (567)..(569): n is a, c, g, or t
  misc_feature (571)..(572): n is a, c, g, or t
  misc_feature (574)..(574): n is a, c, g, or t
  misc_feature (581)..(584): n is a, c, g, or t
  misc_feature (586)..(588): n is a, c, g, or t
  misc_feature (590)..(602): n is a, c, g, or t
  misc_feature (604)..(607): n is a, c, g, or t
  misc_feature (609)..(625): n is a, c, g, or t
  misc_feature (628)..(628): n is a, c, g, or t
  misc_feature (631)..(633): n is a, c, g, or t
  misc_feature (636)..(638): n is a, c, g, or t
  misc_feature (640)..(642): n is a, c, g, or t
  misc_feature (645)..(645): n is a, c, g, or t
  misc_feature (647)..(647): n is a, c, g, or t
  misc_feature (649)..(649): n is a, c, g, or t
  misc_feature (652)..(657): n is a, c, g, or t
  misc_feature (659)..(665): n is a, c, g, or t
  misc_feature (667)..(671): n is a, c, g, or t
  misc_feature (674)..(678): n is a, c, g, or t
  misc_feature (682)..(685): n is a, c, g, or t
  misc_feature (688)..(688): n is a, c, g, or t
  misc_feature (690)..(692): n is a, c, g, or t
  misc_feature (694)..(699): n is a, c, g, or t
  misc_feature (701)..(701): n is a, c, g, or t
  misc_feature (704)..(705): n is a, c, g, or t
  misc_feature (707)..(716): n is a, c, g, or t
  misc_feature (718)..(718): n is a, c, g, or t
  misc_feature (720)..(724): n is a, c, g, or t
  misc_feature (730)..(731): n is a, c, g, or t
  misc_feature (733)..(733): n is a, c, g, or t
  misc_feature (735)..(737): n is a, c, g, or t
  misc_feature (739)..(741): n is a, c, g, or t
  misc_feature (743)..(745): n is a, c, g, or t
  misc_feature (747)..(748): n is a, c, g, or t
  misc_feature (751)..(752): n is a, c, g, or t
  misc_feature (754)..(754): n is a, c, g, or t
  misc_feature (758)..(758): n is a, c, g, or t
  misc_feature (761)..(761): n is a, c, g, or t
  misc_feature (764)..(765): n is a, c, g, or t
  misc_feature (768)..(771): n is a, c, g, or t
  misc_feature (773)..(773): n is a, c, g, or t
  misc_feature (777)..(779): n is a, c, g, or t
  misc_feature (781)..(792): n is a, c, g, or t
  misc_feature (795)..(796): n is a, c, g, or t
  misc_feature (798)..(798): n is a, c, g, or t
  misc_feature (801)..(817): n is a, c, g, or t
  misc_feature (819)..(819): n is a, c, g, or t
  misc_feature (821)..(829): n is a, c, g, or t
  misc_feature (831)..(831): n is a, c, g, or t
  misc_feature (835)..(835): n is a, c, g, or t
  misc_feature (837)..(844): n is a, c, g, or t
  misc_feature (846)..(847): n is a, c, g, or t
  misc_feature (849)..(850): n is a, c, g, or t
  misc_feature (852)..(856): n is a, c, g, or t
  misc_feature (858)..(858): n is a, c, g, or t
  misc_feature (860)..(860): n is a, c, g, or t
  misc_feature (862)..(862): n is a, c, g, or t
  misc_feature (864)..(865): n is a, c, g, or t
  misc_feature (867)..(867): n is a, c, g, or t
  misc_feature (870)..(870): n is a, c, g, or t
  misc_feature (872)..(874): n is a, c, g, or t
  misc_feature (878)..(883): n is a, c, g, or t
  misc_feature (887)..(887): n is a, c, g, or t
  misc_feature (890)..(895): n is a, c, g, or t
  misc_feature (899)..(899): n is a, c, g, or t
  misc_feature (901)..(902): n is a, c, g, or t
  misc_feature (904)..(904): n is a, c, g, or t
  misc_feature (906)..(907): n is a, c, g, or t
  misc_feature (910)..(911): n is a, c, g, or t
  misc_feature (914)..(915): n is a, c, g, or t
  misc_feature (917)..(921): n is a, c, g, or t
  misc_feature (924)..(927): n is a, c, g, or t
  misc_feature (929)..(929): n is a, c, g, or t
  misc_feature (931)..(931): n is a, c, g, or t
  misc_feature (933)..(934): n is a, c, g, or t
  misc_feature (936)..(936): n is a, c, g, or t
  misc_feature (939)..(943): n is a, c, g, or t
  misc_feature (945)..(946): n is a, c, g, or t
  misc_feature (948)..(952): n is a, c, g, or t
  misc_feature (955)..(960): n is a, c, g, or t
  misc_feature (963)..(963): n is a, c, g, or t
  misc_feature (965)..(965): n is a, c, g, or t
  misc_feature (967)..(970): n is a, c, g, or t
  misc_feature (972)..(974): n is a, c, g, or t
  misc_feature (976)..(979): n is a, c, g, or t
  misc_feature (981)..(984): n is a, c, g, or t
  misc_feature (988)..(988): n is a, c, g, or t
  misc_feature (991)..(994): n is a, c, g, or t
  misc_feature (997)..(997): n is a, c, g, or t
  misc_feature (999)..(1002): n is a, c, g, or t
  misc_feature (1004)..(1005): n is a, c, g, or t
  misc_feature (1008)..(1013): n is a, c, g, or t
  misc_feature (1015)..(1019): n is a, c, g, or t
  misc_feature (1021)..(1027): n is a, c, g, or t
  misc_feature (1029)..(1029): n is a, c, g, or t
  misc_feature (1031)..(1031): n is a, c, g, or t
  misc_feature (1033)..(1035): n is a, c, g, or t
  misc_feature (1037)..(1037): n is a, c, g, or t
  misc_feature (1039)..(1043): n is a, c, g, or t
  misc_feature (1045)..(1051): n is a, c, g, or t
  misc_feature (1053)..(1054): n is a, c, g, or t
  misc_feature (1056)..(1058): n is a, c, g, or t
  misc_feature (1060)..(1064): n is a, c, g, or t
  misc_feature (1066)..(1067): n is a, c, g, or t
  misc_feature (1069)..(1069): n is a, c, g, or t
  misc_feature (1071)..(1071): n is a, c, g, or t
  misc_feature (1074)..(1074): n is a, c, g, or t
  misc_feature (1076)..(1076): n is a, c, g, or t
  misc_feature (1078)..(1078): n is a, c, g, or t
  misc_feature (1080)..(1080): n is a, c, g, or t
  misc_feature (1083)..(1087): n is a, c, g, or t
  misc_feature (1090)..(1090): n is a, c, g, or t
  misc_feature (1092)..(1109): n is a, c, g, or t
  misc_feature (1113)..(1113): n is a, c, g, or t
  misc_feature (1115)..(1118): n is a, c, g, or t
  misc_feature (1121)..(1121): n is a, c, g, or t
  misc_feature (1123)..(1124): n is a, c, g, or t
  misc_feature (1126)..(1130): n is a, c, g, or t
  misc_feature (1132)..(1134): n is a, c, g, or t
  misc_feature (1137)..(1140): n is a, c, g, or t
  misc_feature (1145)..(1145): n is a, c, g, or t
  misc_feature (1147)..(1149): n is a, c, g, or t
  misc_feature (1151)..(1152): n is a, c, g, or t
  misc_feature (1154)..(1156): n is a, c, g, or t
  misc_feature (1158)..(1158): n is a, c, g, or t
  misc_feature (1160)..(1161): n is a, c, g, or t
  misc_feature (1165)..(1165): n is a, c, g, or t
  misc_feature (1167)..(1167): n is a, c, g, or t
  misc_feature (1169)..(1174): n is a, c, g, or t
  misc_feature (1993)..(1994): n is a, c, g, or t
  misc_feature (2008)..(2009): n is a, c, g, or t
  misc_feature (2030)..(2030): n is a, c, g, or t
  misc_feature (2036)..(2036): n is a, c, g, or t
  misc_feature (2038)..(2039): n is a, c, g, or t
  misc_feature (2043)..(2045): n is a, c, g, or t
  misc_feature (2065)..(2065): n is a, c, g, or t
  misc_feature (3667)..(3671): n is a, c, g, or t
  misc_feature (3674)..(3677): n is a, c, g, or t
ntnttnnanaaanannctntttttttnttntcnnnnnnannngnnaaaannnnnnnannttnttnnnnnnnnnnanannnnnannnnnnntttnnnnnnnnnnnnnanannnnnnnnccnnnnnnnnttnnannnnnnnnnnnncccnnaannttnnnannnntnttntnntntntntnnnnnnnnntnttntanncncnnnannntntnnnaannccnnaanatnnnnntnnannntnnnnnnaanannnnngngnnannnnannntnntnnnnannnnnttnnnnntnntctntntttntcnnnannntcnnnttnnnnttnnnnnncnnaanncnnnannncgnnnnaanannanannncnnanaannnnnannnnnnnnnnannntntnnnnntnntntnntnnnnnnnnnnngnnannntnnnnntnnnnnnnannnnnanatntntntnnnnngnnnnnnntnnnnnagannntntntnnnnntnnnnannannanannnnnnncnnnannncnnanannatntnnnnttnnnnntntnnnnnnnanannnnnnnnnnncnnntnnanatatatnnnngnnnannnnnnnnnnnnnannnncnnnnnnnnnnnnnnnnnganaannnttnnnannnttntntntannnnnnannnnnnntnnnnntcnnnnntttnnnnttntnnnannnnnnanaanntnnnnnnnnnnanannnnnaaaaanntntnnnannncnnntnngannanaaanatnttnngannnntntttnnncnnnnnnnnnnnnaanntntcnnnnnnnnnnnnnnnnntntnnnnnnnnntntctntnnnnnnnnannannannnnnananananntnttntnnnaaannnnnnatanaannnnnnaaananngngnngtnnaanncnnnnncgnnnncncncnntntgnnnnntnntnnnnnttnnnnnncananannnnannngnnnnannnngagngtnnnnatntnnnncnnttnnnnnntnnnnntnnnnnnnananannntntnnnnnannnnnnncnnannntnnnnnanntntnttntntntnttnnnnnttntnnnnnnnnnnnnnnnnnnaaanannnnttntnnannnnnannntcnnnnaaaanannntnntnnnananntttntntnnnnnncccccccaactggttttgatgtgcctttggtacataagatttgcgaggtttataaaaagatttatttactatccgcaaaaataccgaaaaaagaccgtttcggaatttatgtaaaaatagaaaatatttgtttggaaatcattaatctggcgattctagcttcgttggaaaataaaattaataaactttcaccattaaattccgctaggattaaaatagaaatcttaaaaagattattcagaattaccaatgaattaaatattatagaaactaagcactatatagatatagagttgagtttacaggaaatttccaaaatgacaaatggttggataaaatatttaaataatcactaatctaaaagacaaatcccgtattaatacgggatttgtctttttggaaacttctgacgggaacacagattgtcgttgacattgtcgggattgtaccagttgaccttgaacttgccgctgttccaattggcgttcggcacattgccgtcgtcatagcacgaacccattaattgcctgatttcttccatatcaccgataatctttacaaaattatctgcgttagccggctctctaccggattttttcacgaagcatcgcctttagaagacaaaccttctctaaaaccagacaagcagtttccttttttaatcggcaaaccgatatcccgctaagcgagaccgattgtattagccgacttaattataaaagaaaatccccgttttgaaaatttctcaacacggggataagataaaaagttagaagttaaaagattaagaaactgcctgacgggaacacagatcgtcgnngacatcgccggganngcaccagtcgacctcgaactngccgcngnnccannnggcgctcggcacattgccgncgtcatagcacgaacccagacaaaacgtccaatttttaatgtccaggtgcttgccggcggtttccttgaaaaatttgagctcaaatatctctcgctcctcaagagtgataccgatgatgccctgccgcttcaaatcgttgtaggaacgatttctcagctcttcatcggcttctacgcggtcacgaacacgaatggcatagacatctttggctgtacgctctgaaactacaacctcgtccaagtttttatccgtatatttccagcacggaaaaaacttagcgcaaaggtcatagcccgattgcggcgtgatgccctgagccatgataataactcggccgaatccgcccggatcatcgggaatgatgacgcccgacaaatcgcagtcaatgccgagaccgcaatagaatgcctgccagtcggcaattaaatcagcgtgagaattgtccaccgaaaaaatctttttcatttccgtacctagccattttttcctcccgataaaatactgggccatttcataggttaaattgttaacagggatgctttccaccacggccgaaataacatccttgatttggccgggcgttgccatgcggacggtctgattactttgctttttcatcagcaattcctcctttcttccttcaaaaagtttgattgttaaagagccgaatggccctctttactcaaaaagagcttaatttaagcaatgctaatatgctatcacaaggtggttattttgtcaataccaaatagccattatccgtaaccgccacggtgtgctcaaaatgagccgaaaaagagccatcgaccgtttcataaccaaaaccatcttctgagagttttacttctcccgatcctaaagttaccatcggctcaattgctaaaaccatcccggatttcaaaaccggtccctcgcccattttaccgtaatttgggatactcggttcttcatgaactgcatagccaacgccgtggccaaccaaaattctgacaacgtgtaacccttctctttcaacataactttctataatatgaccaatatcgccaatatggttgcccgtttttacttcattgacggctaattccaaagcgcgcttcgtgacattaattaatttatttttttcatcggtcatttttccgatgccaattgtgagcgcggcgtcagtaaaaagatttttgtatttaacaccaagatccaatttcaaaatgtcgccctctttcaaaattacttcctcggagggcaaaccatggactacaacattattcagtgacgcgcacatagcggctggataaggcctatcggaaaaactggatttatatccttcaaatgaaggcagggcgccgcgggctaaaatcatttcacgggctttttgattcaaaaagcccgtgctgataccaggcctgacaaattccgaaattttctttaaaacttcggctaaaatttccccgccttctttcagaatttctatttcttcttttgtttttattgttatcattacaatttgtttattatatctgctatagcatttataacaaactaaaatctatttcaatttagacaataatatttttaatatatctttatgaattttcattattttnnnnncgnnnngcggttaaaggcgtcaagacgttttttaataatctctctcgtgtccagttccggcaaatctttccgctggcgcttcaaattcctggcatagacttctttcgacccaattataacatggaaaaagtaaatatcttttccacataatttatcaagaagcggcaactcgtcttttaattccctcaaagttcttggcgaaccgctcatcacaatgcccttgccgcgataatccgccgacttaatttcggacttaataagagtcgacacaaattccggagtatttaaaaagccgcttatttgcaaatggcgctctttttcaagattat

SEQ ID NO: 222 - DNA, 4000 bp, Escherichia coli
  misc_feature (2144)..(2144): n is a, c, g, or t
  misc_feature (2747)..(2747): n is a, c, g, or t
  misc_feature (2771)..(2771): n is a, c, g, or t
  misc_feature (2775)..(2775): n is a, c, g, or t
  misc_feature (2778)..(2784): n is a, c, g, or t
  misc_feature (2792)..(2794): n is a, c, g, or t
  misc_feature (2797)..(2802): n is a, c, g, or t
  misc_feature (2808)..(2814): n is a, c, g, or t
  misc_feature (2817)..(2824): n is a, c, g, or t
  misc_feature (2827)..(2832): n is a, c, g, or t
  misc_feature (2837)..(2838): n is a, c, g, or t
  misc_feature (2841)..(2846): n is a, c, g, or t
  misc_feature (2849)..(2850): n is a, c, g, or t
  misc_feature (2853)..(2856): n is a, c, g, or t
  misc_feature (2859)..(2862): n is a, c, g, or t
  misc_feature (2865)..(2865): n is a, c, g, or t
  misc_feature (2868)..(2870): n is a, c, g, or t
  misc_feature (2872)..(2872): n is a, c, g, or t
  misc_feature (2875)..(2877): n is a, c, g, or t
  misc_feature (2880)..(2881): n is a, c, g, or t
  misc_feature (2886)..(2888): n is a, c, g, or t
  misc_feature (2898)..(2902): n is a, c, g, or t
  misc_feature (2905)..(2906): n is a, c, g, or t
  misc_feature (2910)..(2918): n is a, c, g, or t
  misc_feature (2921)..(2931): n is a, c, g, or t
  misc_feature (2941)..(2942): n is a, c, g, or t
  misc_feature (2947)..(2949): n is a, c, g, or t
  misc_feature (2952)..(2958): n is a, c, g, or t
  misc_feature (2962)..(2968): n is a, c, g, or t
  misc_feature (2971)..(2974): n is a, c, g, or t
  misc_feature (2981)..(2991): n is a, c, g, or t
  misc_feature (2994)..(2995): n is a, c, g, or t
  misc_feature (2998)..(3002): n is a, c, g, or t
  misc_feature (3006)..(3008): n is a, c, g, or t
  misc_feature (3011)..(3018): n is a, c, g, or t
  misc_feature (3022)..(3022): n is a, c, g, or t
  misc_feature (3029)..(3031): n is a, c, g, or t
  misc_feature (3035)..(3043): n is a, c, g, or t
  misc_feature (3046)..(3051): n is a, c, g, or t
  misc_feature (3056)..(3064): n is a, c, g, or t
  misc_feature (3069)..(3075): n is a, c, g, or t
  misc_feature (3078)..(3078): n is a, c, g, or t
  misc_feature (3082)..(3084): n is a, c, g, or t
  misc_feature (3087)..(3093): n is a, c, g, or t
  misc_feature (3096)..(3098): n is a, c, g, or t
  misc_feature (3102)..(3103): n is a, c, g, or t
  misc_feature (3107)..(3111): n is a, c, g, or t
  misc_feature (3114)..(3115): n is a, c, g, or t
  misc_feature (3122)..(3134): n is a, c, g, or t
  misc_feature (3137)..(3144): n is a, c, g, or t
  misc_feature (3149)..(3149): n is a, c, g, or t
  misc_feature (3152)..(3159): n is a, c, g, or t
  misc_feature (3162)..(3166): n is a, c, g, or t
  misc_feature (3169)..(3170): n is a, c, g, or t
  misc_feature (3175)..(3181): n is a, c, g, or t
  misc_feature (3184)..(3187): n is a, c, g, or t
  misc_feature (3190)..(3191): n is a, c, g, or t
  misc_feature (3194)..(3197): n is a, c, g, or t
  misc_feature (3200)..(3202): n is a, c, g, or t
  misc_feature (3205)..(3205): n is a, c, g, or t
  misc_feature (3208)..(3229): n is a, c, g, or t
  misc_feature (3234)..(3237): n is a, c, g, or t
  misc_feature (3242)..(3243): n is a, c, g, or t
  misc_feature (3247)..(3247): n is a, c, g, or t
  misc_feature (3250)..(3252): n is a, c, g, or t
  misc_feature (3255)..(3256): n is a, c, g, or t
  misc_feature (3261)..(3262): n is a, c, g, or t
  misc_feature (3267)..(3272): n is a, c, g, or t
  misc_feature (3278)..(3286): n is a, c, g, or t
  misc_feature (3289)..(3289): n is a, c, g, or t
  misc_feature (3293)..(3294): n is a, c, g, or t
  misc_feature (3297)..(3298): n is a, c, g, or t
  misc_feature (3304)..(3305): n is a, c, g, or t
  misc_feature (3308)..(3309): n is a, c, g, or t
  misc_feature (3312)..(3312): n is a, c, g, or t
  misc_feature (3315)..(3319): n is a, c, g, or t
  misc_feature (3322)..(3322): n is a, c, g, or t
  misc_feature (3325)..(3330): n is a, c, g, or t
  misc_feature (3333)..(3336): n is a, c, g, or t
  misc_feature (3341)..(3342): n is a, c, g, or t
  misc_feature (3347)..(3351): n is a, c, g, or t
  misc_feature (3354)..(3357): n is a, c, g, or t
  misc_feature (3364)..(3366): n is a, c, g, or t
  misc_feature (3369)..(3372): n is a, c, g, or t
  misc_feature (3375)..(3376): n is a, c, g, or t
  misc_feature (3378)..(3381): n is a, c, g, or t
  misc_feature (3384)..(3387): n is a, c, g, or t
  misc_feature (3390)..(3397): n is a, c, g, or t
  misc_feature (3399)..(3402): n is a, c, g, or t
  misc_feature (3407)..(3411): n is a, c, g, or t
  misc_feature (3413)..(3418): n is a, c, g, or t
  misc_feature (3420)..(3420): n is a, c, g, or t
  misc_feature (3422)..(3427): n is a, c, g, or t
  misc_feature (3429)..(3439): n is a, c, g, or t
  misc_feature (3441)..(3446): n is a, c, g, or t
  misc_feature (3448)..(3452): n is a, c, g, or t
  misc_feature (3455)..(3457): n is a, c, g, or t
  misc_feature (3459)..(3461): n is a, c, g, or t
  misc_feature (3465)..(3468): n is a, c, g, or t
  misc_feature (3470)..(3475): n is a, c, g, or t
  misc_feature (3477)..(3479): n is a, c, g, or t
  misc_feature (3481)..(3481): n is a, c, g, or t
  misc_feature (3483)..(3483): n is a, c, g, or t
  misc_feature (3485)..(3487): n is a, c, g, or t
  misc_feature (3492)..(3495): n is a, c, g, or t
  misc_feature (3497)..(3503): n is a, c, g, or t
  misc_feature (3507)..(3508): n is a, c, g, or t
  misc_feature (3510)..(3513): n is a, c, g, or t
  misc_feature (3515)..(3516): n is a, c, g, or t
  misc_feature (3520)..(3526): n is a, c, g, or t
  misc_feature (3530)..(3530): n is a, c, g, or t
  misc_feature (3532)..(3532): n is a, c, g, or t
  misc_feature (3534)..(3538): n is a, c, g, or t
  misc_feature (3540)..(3546): n is a, c, g, or t
  misc_feature (3549)..(3554): n is a, c, g, or t
  misc_feature (3557)..(3563): n is a, c, g, or t
  misc_feature (3566)..(3568): n is a, c, g, or t
  misc_feature (3572)..(3577): n is a, c, g, or t
  misc_feature (3583)..(3583): n is a, c, g, or t
  misc_feature (3586)..(3593): n is a, c, g, or t
  misc_feature (3595)..(3597): n is a, c, g, or t
  misc_feature (3600)..(3604): n is a, c, g, or t
  misc_feature (3606)..(3606): n is a, c, g, or t
  misc_feature (3608)..(3608): n is a, c, g, or t
  misc_feature (3610)..(3610): n is a, c, g, or t
  misc_feature (3612)..(3614): n is a, c, g, or t
  misc_feature (3618)..(3618): n is a, c, g, or t
  misc_feature (3626)..(3633): n is a, c, g, or t
  misc_feature (3636)..(3637): n is a, c, g, or t
  misc_feature (3640)..(3643): n is a, c, g, or t
  misc_feature (3647)..(3648): n is a, c, g, or t
  misc_feature (3654)..(3654): n is a, c, g, or t
  misc_feature (3657)..(3657): n is a, c, g, or t
  misc_feature (3664)..(3664): n is a, c, g, or t
  misc_feature (3667)..(3667): n is a, c, g, or t
  misc_feature (3669)..(3669): n is a, c, g, or t
  misc_feature (3676)..(3678): n is a, c, g, or t
  misc_feature (3680)..(3680): n is a, c, g, or t
  misc_feature (3683)..(3684): n is a, c, g, or t
  misc_feature (3690)..(3690): n is a, c, g, or t
  misc_feature (3697)..(3697): n is a, c, g, or t
  misc_feature (3700)..(3704): n is a, c, g, or t
  misc_feature (3706)..(3706): n is a, c, g, or t
  misc_feature (3714)..(3714): n is a, c, g, or t
  misc_feature (3719)..(3719): n is a, c, g, or t
  misc_feature (3722)..(3722): n is a, c, g, or t
  misc_feature (3724)..(3726): n is a, c, g, or t
  misc_feature (3729)..(3731): n is a, c, g, or t
  misc_feature (3737)..(3741): n is a, c, g, or t
  misc_feature (3745)..(3747): n is a, c, g, or t
  misc_feature (3753)..(3756): n is a, c, g, or t
  misc_feature (3762)..(3763): n is a, c, g, or t
  misc_feature (3768)..(3768): n is a, c, g, or t
  misc_feature (3771)..(3771): n is a, c, g, or t
  misc_feature (3774)..(3775): n is a, c, g, or t
  misc_feature (3777)..(3784): n is a, c, g, or t
  misc_feature (3786)..(3786): n is a, c, g, or t
  misc_feature (3791)..(3794): n is a, c, g, or t
  misc_feature (3797)..(3797): n is a, c, g, or t
  misc_feature (3804)..(3805): n is a, c, g, or t
  misc_feature (3808)..(3808): n is a, c, g, or t
  misc_feature (3811)..(3811): n is a, c, g, or t
  misc_feature (3813)..(3813): n is a, c, g, or t
  misc_feature (3820)..(3822): n is a, c, g, or t
  misc_feature (3824)..(3824): n is a, c, g, or t
  misc_feature (3826)..(3827): n is a, c, g, or t
  misc_feature (3830)..(3830): n is a, c, g, or t
  misc_feature (3833)..(3833): n is a, c, g, or t
  misc_feature (3836)..(3836): n is a, c, g, or t
  misc_feature (3838)..(3839): n is a, c, g, or t
  misc_feature (3843)..(3843): n is a, c, g, or t
  misc_feature (3845)..(3848): n is a, c, g, or t
  misc_feature (3851)..(3851): n is a, c, g, or t
  misc_feature (3858)..(3860): n is a, c, g, or t
  misc_feature (3864)..(3865): n is a, c, g, or t
  misc_feature (3868)..(3870): n is a, c, g, or t
  misc_feature (3876)..(3876): n is a, c, g, or t
  misc_feature (3882)..(3895): n is a, c, g, or t
  misc_feature (3899)..(3899): n is a, c, g, or t
  misc_feature (3901)..(3902): n is a, c, g, or t
  misc_feature (3907)..(3908): n is a, c, g, or t
  misc_feature (3911)..(3911): n is a, c, g, or t
  misc_feature (3914)..(3914): n is a, c, g, or t
  misc_feature (3918)..(3919): n is a, c, g, or t
  misc_feature (3922)..(3923): n is a, c, g, or t
  misc_feature (3926)..(3927): n is a, c, g, or t
  misc_feature (3929)..(3931): n is a, c, g, or t
  misc_feature (3934)..(3935): n is a, c, g, or t
  misc_feature (3940)..(3943): n is a, c, g, or t
  misc_feature (3947)..(3949): n is a, c, g, or t
  misc_feature (3953)..(3953): n is a, c, g, or t
  misc_feature (3957)..(3957): n is a, c, g, or t
  misc_feature (3960)..(3962): n is a, c, g, or t
  misc_feature (3964)..(3964): n is a, c, g, or t
  misc_feature (3967)..(3967): n is a, c, g, or t
  misc_feature (3972)..(3979): n is a, c, g, or t
  misc_feature (3985)..(3985): n is a, c, g, or t
  misc_feature (3991)..(3993): n is a, c, g, or t
  misc_feature (3997)..(3997): n is a, c, g, or t
gatgttttaaaagcaccggacaaaccggtggttggcccacttggattatccgatatcgaccggttgcgggcgcatttatcaaaatgctgggatccgcccatcggcgcggctggcagcgataccctcattgttgacataattgtgtcgttagatcgtgatggacacgtgcttagcgccaaagttgataacaatttgaggtttaacacagatcggatttttaaggttgcagctgaagaggccattcgggcaacacgcgaatgttcgcctttgccgctgccaccggaaaaatatgagcaatggaagagctttatatttgtttttgacccgcggtttttgacccggtgaaaaacccgccattgggtgacaaacccgccattgggtggcaagattacaggcaccaaaatatcggtcatatggtgtcgccatgtcgggtcgagcgaaatgaagcggaataaacgggcataaagggtaaatttatcatggtagcaaaaattttccggccgatactgtgccgctgcgttgcggttgttgcggttctggctatcgctctggggctggcccctatcgggcaagccgaggcccagctccgtattgaaatcaccgaaggacaggtggcgccgacgcccattgccatagccgaatttaccgggccggatggcaatgtcaccgctgtcgggcgtcaattaacgcagattatttctgatgatttggaaagttctggtctgtttcggccggtggatagtgcggcctttattgatccgccaaaagcgccgtcggtaaagccaaattttgccaattggtcgccgcttggggtgaaagggctgctggttggttcagcctatattgacgatgccggcatgctgcaggttgaatttgtgttatgggatgtggtgatccagcgcaatattaccgctggcggcggcaatgctgatcaatccggattgcgccggctagcccaccagattgccgattttgtatatgaagaatttaccggcgatagtggctattttgacacgcaaattgtctatgtggctgaatccggcacgcaaagccggcggttaaaacgcttggcgattatggatcaggacgggcataaccaccgctatttaacctcgggtcttgatttggtgctgacaccgcgcttttccccgacggccaatgaaattgcctatctgaattactttaatgacgagccgaatgtgtatctttttgaggtggccactggtcgcaccgagcggttgggctcattccccggcatgacatttgcgccgcgtttcgggccagatggcgataagctgatcatgagcctggcccaggacgggatgactgatatctacgaaatggacatgcgtacccaatcgattaaccaattaaccaaatcagcatcgattgacacctcgccgtcctatgcgccagatggcaatcgcattgtctttaattctgaccgtggcggcagtcagcaactctatgtgatggacgccgatggcagcaatgtcaggcgcatcagctatggtgttggccgctatgccaccccggtttggtcgccgcggggtgacatcattgccttcaccaagatggcaaatggccagttttacatcggtgtgatgaatgtcgatggcagtggcgagcgtttgttggcggacgggtttttggtcgaagggcccacctgggcgccgaatggtcgggtgttgatgtattttaaacaggaaccgtttgaagctgatgggtctggcggcgcaacacatgtttaccgcattgatatcactggatttaatgagcggcgaattgtcaccccgtcggatgcgtcggatccggcatggtcacctttgctgcgctagatgattgcggcacagaaaatcagcgctatcgatatgacaatcaccatttggcgacaaatagaaaaaaatatcagaaaatcgctatttttcgccaaatatatgtatttttaggtttcattactgtaccatatcctatatgtctcgtgttatgaattgaccggttgcccggccatggatccattcgtgcacaaatagcgctgcgttaagatagacctgttacaaggtgcgcgtagcattgttttggcaaaacagaacttaaggttcgctgaaaaaaaattaggagcatcatgatgtttcaacgcatantggcgatagttgccgcaacattcttattcgcagcttgtgaaacggcctcagaggtcggtggtgacagcgcctcgaccagttcggcgagttcggcttcatctgcatcatcatctgcttcggccgcaaagaccgaagctgacaagctggctgaagttggtaatacggtttattttgattttgacagctccgagctgtctgaaaacgcgcaaatgactttgaacaggcaggccgcatttttgaatgtgaacccaaccctggtcattgttgttgagggtcatgctgatgagcgcggtacccgtgaatacaaccttgcgctgggtgatcggcgtgcgacagcggtgcgcgattatctgctggccaaggggttgaattcggcgcgggtgcgcaccgtatcatacggcaaagaacgcccagcagttgaaggctcgacagaagctgcatgggaaaagaacagacgtgcagcaactgtgctgaactaatcctgtttgaaacaacaaaaagaggggcgggtggctcctctttttttttgcctaatttatgcctaaaatagctgttactgcttggtaactgccgtgtcattgctaggatttatctaccatgaanaaacgcttctttattgttttggcntttnttnnnnnnnttcccggnnnggnnnnnncccaannnnnnnccnnnnnnnnggnnnnnnaaaannccnnnnnnttnnttnnnnggnnnnaanaannnanggnnnttnnggaannnggtttaaaannnnnccnngggnnnnnnnnnaannnnnnnnnnnaaattaaaannaaggnnnaannnnnnnaaannnnnnnttnnnnggccggnnnnnnnnnnnccnnggnnnnnaaannnttnnnnnnnnaaanggaaaannngggnnnnnnnnnggnnnnnnccaannnnnnnnnggaannnnnnnttnaaannnccnnnnnnnccnnntttnntttnnnnnggnnggaaaannnnnnnnnnnnnttnnnnnnnnttggnggnnnnnnnnccnnnnnggnnttggnnnnnnnggnnnnaannggnnnnggnnnggnggnnnnnnnnnnnnnnnnnnnnnnccttnnnnccggnntttnaannnggnnggttnnggaannnnnnttaaannnnnnnnnggnaaannttnngggggnnaannccnccnnnnnggnaannnnnnttnnnnaaaannccggnnnnnccnnnnccggttnnnccnnnnccnnannnnccnnnnccnnnnnnnncnnnnccggnnnnntnnnnnncngnnnnnncnnnnnnnnnnntnnnnnngnnnnnaannncnnncccnnnnannnnnnannnancngnnnaaccnnnncnnnnnnncccnnannnntnncggnnnnnnncccngnannnnnannnnnnnttnnnnnnggnnnnnnnttnnnaaannnnnnggaaanggnnnnnnnngnnnttnnnnnantncngnnntttnaccaaggnnnnnnnnggnnggnnnnttcnnttttcnggnttggccnggngnaatttannngnggnnaatttnaaaaggnggnnnnnantttttctnaattnaanannnccnnnccgggnnnnncccnnnttgttnnnncgaccnngtggnttnccnngnnnnnnnngnatttnnnnccnccggaannggnttntnaaatttnnncntnnttnccncancnnattnannnnccnccggatnnntttnnggnnnaattgnccaaannnnnnnnnnnnnnaaantnngccgnntanccntttnnccnnttnngnnnccnnttttnnnngggnnntgcnggcnttnnngnttnccaannnnnnnntttttntaaccnnnttanccg

SEQ ID NO: 223 - DNA, 4000 bp, Escherichia coli
  misc_feature (313)..(313): n is a, c, g, or t
  misc_feature (376)..(376): n is a, c, g, or t
  misc_feature (484)..(484): n is a, c, g, or t
  misc_feature (736)..(736): n is a, c, g, or t
  misc_feature (871)..(871): n is a, c, g, or t
  misc_feature (883)..(883): n is a, c, g, or t
  misc_feature (1489)..(1489): n is a, c, g, or t
  misc_feature (1512)..(1512): n is a, c, g, or t
  misc_feature (1537)..(1537): n is a, c, g, or t
  misc_feature (1557)..(1557): n is a, c, g, or t
  misc_feature (1583)..(1583): n is a, c, g, or t
  misc_feature (2000)..(2000): n is a, c, g, or t
  misc_feature (2065)..(2065): n is a, c, g, or t
  misc_feature (2069)..(2069): n is a, c, g, or t
  misc_feature (2078)..(2078): n is a, c, g, or t
  misc_feature (2156)..(2156): n is a, c, g, or t
  misc_feature (2201)..(2201): n is a, c, g, or t
  misc_feature (2221)..(2221): n is a, c, g, or t
  misc_feature (2232)..(2232): n is a, c, g, or t
  misc_feature (2234)..(2234): n is a, c, g, or t
  misc_feature (2249)..(2249): n is a, c, g, or t
  misc_feature (2254)..(2254): n is a, c, g, or t
  misc_feature (2257)..(2257): n is a, c, g, or t
  misc_feature (2279)..(2282): n is a, c, g, or t
  misc_feature (2287)..(2287): n is a, c, g, or t
  misc_feature (2292)..(2293): n is a, c, g, or t
  misc_feature (2297)..(2299): n is a, c, g, or t
  misc_feature (2304)..(2305): n is a, c, g, or t
  misc_feature (2308)..(2308): n is a, c, g, or t
  misc_feature (2313)..(2313): n is a, c, g, or t
  misc_feature (2317)..(2317): n is a, c, g, or t
  misc_feature (2333)..(2333): n is a, c, g, or t
  misc_feature (2336)..(2336): n is a, c, g, or t
  misc_feature (2348)..(2348): n is a, c, g, or t
  misc_feature (2359)..(2360): n is a, c, g, or t
  misc_feature (2367)..(2367): n is a, c, g, or t
  misc_feature (2370)..(2371): n is a, c, g, or t
  misc_feature (2373)..(2377): n is a, c, g, or t
  misc_feature (2379)..(2380): n is a, c, g, or t
  misc_feature (2384)..(2385): n is a, c, g, or t
  misc_feature (2387)..(2388): n is a, c, g, or t
  misc_feature (2392)..(2395): n is a, c, g, or t
  misc_feature (2398)..(2398): n is a, c, g, or t
  misc_feature (2400)..(2400): n is a, c, g, or t
  misc_feature (2404)..(2404): n is a, c, g, or t
  misc_feature (2408)..(2408): n is a, c, g, or t
  misc_feature (2414)..(2420): n is a, c, g, or t
  misc_feature (2428)..(2428): n is a, c, g, or t
  misc_feature (2430)..(2431): n is a, c, g, or t
  misc_feature (2436)..(2436): n is a, c, g, or t
  misc_feature (2438)..(2439): n is a, c, g, or t
  misc_feature (2441)..(2444): n is a, c, g, or t
  misc_feature (2448)..(2448): n is a, c, g, or t
  misc_feature (2450)..(2455): n is a, c, g, or t
  misc_feature (2458)..(2458): n is a, c, g, or t
  misc_feature (2461)..(2462): n is a, c, g, or t
  misc_feature (2464)..(2464): n is a, c, g, or t
  misc_feature (2470)..(2470): n is a, c, g, or t
  misc_feature (2473)..(2473): n is a, c, g, or t
  misc_feature (2477)..(2477): n is a, c, g, or t
  misc_feature (2480)..(2481): n is a, c, g, or t
  misc_feature (2486)..(2486): n is a, c, g, or t
  misc_feature (2488)..(2488): n is a, c, g, or t
  misc_feature (2490)..(2491): n is a, c, g, or t
  misc_feature (2497)..(2498): n is a, c, g, or t
  misc_feature (2509)..(2511): n is a, c, g, or t
  misc_feature (2518)..(2518): n is a, c, g, or t
  misc_feature (2521)..(2526): n is a, c, g, or t
  misc_feature (2532)..(2532): n is a, c, g, or t
  misc_feature (2536)..(2537): n is a, c, g, or t
  misc_feature (2541)..(2541): n is a, c, g, or t
  misc_feature (2546)..(2548): n is a, c, g, or t
  misc_feature (2553)..(2553): n is a, c, g, or t
  misc_feature (2557)..(2557): n is a, c, g, or t
  misc_feature (2560)..(2560): n is a, c, g, or t
  misc_feature (2562)..(2562): n is a, c, g, or t
  misc_feature (2568)..(2568): n is a, c, g, or t
  misc_feature (2570)..(2570): n is a, c, g, or t
  misc_feature (2572)..(2574): n is a, c, g, or t
  misc_feature (2576)..(2576): n is a, c, g, or t
  misc_feature (2586)..(2586): n is a, c, g, or t
  misc_feature (2588)..(2591): n is a, c, g, or t
  misc_feature (2595)..(2595): n is a, c, g, or t
  misc_feature (2599)..(2599): n is a, c, g, or t
  misc_feature (2601)..(2602): n is a, c, g, or t
  misc_feature (2606)..(2608): n is a, c, g, or t
  misc_feature (2615)..(2617): n is a, c, g, or t
  misc_feature (2620)..(2620): n is a, c, g, or t
  misc_feature (2622)..(2623): n is a, c, g, or t
  misc_feature (2626)..(2626): n is a, c, g, or t
  misc_feature (2628)..(2628): n is a, c, g, or t
  misc_feature (2631)..(2631): n is a, c, g, or t
  misc_feature (2633)..(2633): n is a, c, g, or t
  misc_feature (2635)..(2636): n is a, c, g, or t
  misc_feature (2640)..(2641): n is a, c, g, or t
  misc_feature (2645)..(2647): n is a, c, g, or t
  misc_feature (2649)..(2651): n is a, c, g, or t
  misc_feature (2655)..(2657): n is a, c, g, or t
  misc_feature (2659)..(2659): n is a, c, g, or t
  misc_feature (2661)..(2661): n is a, c, g, or t
  misc_feature (2665)..(2665): n is a, c, g, or t
  misc_feature (2668)..(2668): n is a, c, g, or t
  misc_feature (2670)..(2680): n is a, c, g, or t
  misc_feature (2685)..(2685): n is a, c, g, or t
  misc_feature (2689)..(2694): n is a, c, g, or t
  misc_feature (2698)..(2698): n is a, c, g, or t
  misc_feature (2700)..(2700): n is a, c, g, or t
  misc_feature (2702)..(2702): n is a, c, g, or t
  misc_feature (2705)..(2705): n is a, c, g, or t
  misc_feature (2709)..(2711): n is a, c, g, or t
  misc_feature (2713)..(2713): n is a, c, g, or t
  misc_feature (2715)..(2716): n is a, c, g, or t
  misc_feature (2719)..(2719): n is a, c, g, or t
  misc_feature (2722)..(2723): n is a, c, g, or t
  misc_feature (2726)..(2728): n is a, c, g, or t
  misc_feature (2730)..(2731): n is a, c, g, or t
  misc_feature (2735)..(2735): n is a, c, g, or t
  misc_feature (2738)..(2738): n is a, c, g, or t
  misc_feature (2741)..(2741): n is a, c, g, or t
  misc_feature (2743)..(2747): n is a, c, g, or t
  misc_feature (2752)..(2753): n is a, c, g, or t
  misc_feature (2755)..(2761): n is a, c, g, or t
  misc_feature (2764)..(2765): n is a, c, g, or t
  misc_feature (2767)..(2767): n is a, c, g, or t
  misc_feature (2769)..(2777): n is a, c, g, or t
  misc_feature (2780)..(2785): n is a, c, g, or t
  misc_feature (2788)..(2793): n is a, c, g, or t
  misc_feature (2797)..(2797): n is a, c, g, or t
  misc_feature (2799)..(2799): n is a, c, g, or t
  misc_feature (2802)..(2803): n is a, c, g, or t
  misc_feature (2805)..(2806): n is a, c, g, or t
  misc_feature (2809)..(2809): n is a, c, g, or t
  misc_feature (2811)..(2811): n is a, c, g, or t
  misc_feature (2813)..(2814): n is a, c, g, or t
  misc_feature (2820)..(2822): n is a, c, g, or t
  misc_feature (2825)..(2825): n is a, c, g, or t
  misc_feature (2828)..(2830): n is a, c, g, or t
  misc_feature (2833)..(2834): n is a, c, g, or t
  misc_feature (2837)..(2839): n is a, c, g, or t
  misc_feature (2847)..(2850): n is a, c, g, or t
  misc_feature (2853)..(2859): n is a, c, g, or t
  misc_feature (2861)..(2861): n is a, c, g, or t
  misc_feature (2863)..(2867): n is a, c, g, or t
  misc_feature (2870)..(2870): n is a, c, g, or t
  misc_feature (2874)..(2875): n is a, c, g, or t
  misc_feature (2880)..(2883): n is a, c, g, or t
  misc_feature (2885)..(2891): n is a, c, g, or t
  misc_feature (2894)..(2894): n is a, c, g, or t
  misc_feature (2897)..(2898): n is a, c, g, or t
  misc_feature (2900)..(2902): n is a, c, g, or t
  misc_feature (2907)..(2907): n is a, c, g, or t
  misc_feature (2912)..(2914): n is a, c, g, or t
  misc_feature (2919)..(2919): n is a, c, g, or t
  misc_feature (2922)..(2927): n is a, c, g, or t
  misc_feature (2929)..(2930): n is a, c, g, or t
  misc_feature (2933)..(2933): n is a, c, g, or t
  misc_feature (2936)..(2936): n is a, c, g, or t
  misc_feature (2941)..(2942): n is a, c, g, or t
  misc_feature (2944)..(2947): n is a, c, g, or t
  misc_feature (2950)..(2956): n is a, c, g, or t
  misc_feature (2958)..(2959): n is a, c, g, or t
  misc_feature (2961)..(2961): n is a, c, g, or t
  misc_feature (2963)..(2967): n is a, c, g, or t
  misc_feature (2969)..(2972): n is a, c, g, or t
  misc_feature (2974)..(2974): n is a, c, g, or t
  misc_feature (2978)..(2981): n is a, c, g, or t
  misc_feature (2984)..(2985): n is a, c, g, or t
  misc_feature (2991)..(2992): n is a, c, g, or t
  misc_feature (2995)..(2996): n is a, c, g, or t
  misc_feature (2998)..(3002): n is a, c, g, or t
  misc_feature (3005)..(3006): n is a, c, g, or t
  misc_feature (3008)..(3008): n is a, c, g, or t
  misc_feature (3011)..(3011): n is a, c, g, or t
  misc_feature (3014)..(3015): n is a, c, g, or t
  misc_feature (3017)..(3023): n is a, c, g, or t
  misc_feature (3029)..(3029): n is a, c, g, or t
  misc_feature (3031)..(3031): n is a, c, g, or t
  misc_feature (3033)..(3038): n is a, c, g, or t
  misc_feature (3044)..(3046): n is a, c, g, or t
  misc_feature (3048)..(3048): n is a, c, g, or t
  misc_feature (3051)..(3057): n is a, c, g, or t
  misc_feature (3059)..(3059): n is a, c, g, or t
  misc_feature (3066)..(3067): n is a, c, g, or t
  misc_feature (3071)..(3071): n is a, c, g, or t
  misc_feature (3074)..(3075): n is a, c, g, or t
  misc_feature (3077)..(3077): n is a, c, g, or t
  misc_feature (3080)..(3089): n is a, c, g, or t
  misc_feature (3091)..(3091): n is a, c, g, or t
  misc_feature (3093)..(3099): n is a, c, g, or t
  misc_feature (3101)..(3101): n is a, c, g, or t
  misc_feature (3103)..(3105): n is a, c, g, or t
  misc_feature (3107)..(3107): n is a, c, g, or t
  misc_feature (3109)..(3112): n is a, c, g, or t
  misc_feature (3114)..(3114): n is a, c, g, or t
  misc_feature (3118)..(3118): n is a, c, g, or t
  misc_feature (3122)..(3123): n is a, c, g, or t
  misc_feature (3125)..(3125): n is a, c, g, or t
  misc_feature (3127)..(3130): n is a, c, g, or t
  misc_feature (3132)..(3137): n is a, c, g, or t
  misc_feature (3140)..(3144): n is a, c, g, or t
  misc_feature (3147)..(3150): n is a, c, g, or t
  misc_feature (3153)..(3153): n is a, c, g, or t
  misc_feature (3156)..(3156): n is a, c, g, or t
  misc_feature (3158)..(3159): n is a, c, g, or t
  misc_feature (3162)..(3163): n is a, c, g, or t
  misc_feature (3166)..(3167): n is a, c, g, or t
  misc_feature (3173)..(3174): n is a, c, g, or t
  misc_feature (3176)..(3177): n is a, c, g, or t
  misc_feature (3181)..(3185): n is a, c, g, or t
  misc_feature (3188)..(3191): n is a, c, g, or t
  misc_feature (3193)..(3195): n is a, c, g, or t
  misc_feature (3197)..(3197): n is a, c, g, or t
  misc_feature (3199)..(3201): n is a, c, g, or t
  misc_feature (3205)..(3205): n is a, c, g, or t
  misc_feature (3208)..(3210): n is a, c, g, or t
  misc_feature (3212)..(3213): n is a, c, g, or t
  misc_feature (3215)..(3218): n is a, c, g, or t
  misc_feature (3222)..(3225): n is a, c, g, or t
  misc_feature (3228)..(3233): n is a, c, g, or t
  misc_feature (3235)..(3236): n is a, c, g, or t
  misc_feature (3238)..(3241): n is a, c, g, or t
  misc_feature (3243)..(3244): n is a, c, g, or t
  misc_feature (3248)..(3248): n is a, c, g, or t
  misc_feature (3251)..(3251): n is a, c, g, or t
  misc_feature (3253)..(3254): n is a, c, g, or t
  misc_feature (3256)..(3256): n is a, c, g, or t
  misc_feature (3259)..(3260): n is a, c, g, or t
  misc_feature (3263)..(3263): n is a, c, g, or t
  misc_feature (3265)..(3265): n is a, c, g, or t
  misc_feature (3271)..(3275): n is a, c, g, or t
  misc_feature (3280)..(3285): n is a, c, g, or t
  misc_feature (3287)..(3288): n is a, c, g, or t
  misc_feature (3293)..(3295): n is a, c, g, or t
  misc_feature (3297)..(3298): n is a, c, g, or t
  misc_feature (3302)..(3302): n is a, c, g, or t
  misc_feature (3307)..(3316): n is a, c, g, or t
  misc_feature (3318)..(3322): n is a, c, g, or t
  misc_feature (3324)..(3325): n is a, c, g, or t
  misc_feature (3327)..(3335): n is a, c, g, or t
  misc_feature (3338)..(3338): n is a, c, g, or t
  misc_feature (3340)..(3342): n is a, c, g, or t
  misc_feature (3345)..(3345): n is a, c, g, or t
  misc_feature (3349)..(3350): n is a, c, g, or t
  misc_feature (3352)..(3356): n is a, c, g, or t
  misc_feature (3358)..(3362): n is a, c, g, or t
  misc_feature (3364)..(3368): n is a, c, g, or t
  misc_feature (3373)..(3374): n is a, c, g, or t
  misc_feature (3376)..(3385): n is a, c, g, or t
  misc_feature (3388)..(3388): n is a, c, g, or t
  misc_feature (3391)..(3393): n is a, c, g, or t
  misc_feature (3396)..(3396): n is a, c, g, or t
  misc_feature (3402)..(3402): n is a, c, g, or t
  misc_feature (3404)..(3404): n is a, c, g, or t
  misc_feature (3407)..(3409): n is a, c, g, or t
  misc_feature (3411)..(3411): n is a, c, g, or t
  misc_feature (3415)..(3416): n is a, c, g, or t
  misc_feature (3418)..(3426): n is a, c, g, or t
  misc_feature (3430)..(3433): n is a, c, g, or t
  misc_feature (3435)..(3435): n is a, c, g, or t
  misc_feature (3438)..(3447): n is a, c, g, or t
  misc_feature (3450)..(3455): n is a, c, g, or t
  misc_feature (3458)..(3461): n is a, c, g, or t
  misc_feature (3466)..(3466): n is a, c, g, or t
  misc_feature (3470)..(3472): n is a, c, g, or t
  misc_feature (3474)..(3480): n is a, c, g, or t
  misc_feature (3483)..(3490): n is a, c, g, or t
  misc_feature (3493)..(3494): n is a, c, g, or t
  misc_feature (3497)..(3497): n is a, c, g, or t
  misc_feature (3505)..(3505): n is a, c, g, or t
  misc_feature (3508)..(3509): n is a, c, g, or t
  misc_feature (3512)..(3513): n is a, c, g, or t
  misc_feature (3516)..(3518): n is a, c, g, or t
  misc_feature (3523)..(3523): n is a, c, g, or t
  misc_feature (3527)..(3531): n is a, c, g, or t
  misc_feature (3535)..(3539): n is a, c, g, or t
  misc_feature (3542)..(3546): n is a, c, g, or t
  misc_feature (3552)..(3552): n is a, c, g, or t
  misc_feature (3558)..(3560): n is a, c, g, or t
  misc_feature (3562)..(3563): n is a, c, g, or t
  misc_feature (3566)..(3566): n is a, c, g, or t
  misc_feature (3569)..(3569): n is a, c, g, or t
  misc_feature (3571)..(3572): n is a, c, g, or t
  misc_feature (3575)..(3575): n is a, c, g, or t
  misc_feature (3581)..(3581): n is a, c, g, or t
  misc_feature (3584)..(3587): n is a, c, g, or t
  misc_feature (3590)..(3596): n is a, c, g, or t
  misc_feature (3600)..(3600): n is a, c, g, or t
  misc_feature (3603)..(3611): n is a, c, g, or t
  misc_feature (3614)..(3617): n is a, c, g, or t
  misc_feature (3620)..(3620): n is a, c, g, or t
  misc_feature (3624)..(3624): n is a, c, g, or t
  misc_feature (3627)..(3633): n is a, c, g, or t
  misc_feature (3636)..(3639): n is a, c, g, or t
  misc_feature (3644)..(3646): n is a, c, g, or t
  misc_feature (3651)..(3665): n is a, c, g, or t
  misc_feature (3668)..(3668): n is a, c, g, or t
  misc_feature (3680)..(3680): n is a, c, g, or t
  misc_feature (3683)..(3685): n is a, c, g, or t
  misc_feature (3688)..(3688): n is a, c, g, or t
  misc_feature (3692)..(3697): n is a, c, g, or t
  misc_feature (3702)..(3705): n is a, c, g, or t
  misc_feature (3708)..(3708): n is a, c, g, or t
  misc_feature (3711)..(3711): n is a, c, g, or t
  misc_feature (3714)..(3714): n is a, c, g, or t
  misc_feature (3717)..(3721): n is a, c, g, or t
  misc_feature (3724)..(3727): n is a, c, g, or t
  misc_feature (3729)..(3731): n is a, c, g, or t
  misc_feature (3735)..(3735): n is a, c, g, or t
  misc_feature (3738)..(3742): n is a, c, g, or t
  misc_feature (3746)..(3746): n is a, c, g, or t
  misc_feature (3749)..(3750): n is a, c, g, or t
  misc_feature (3759)..(3759): n is a, c, g, or t
  misc_feature (3764)..(3775): n is a, c, g, or t
  misc_feature (3777)..(3778): n is a, c, g, or t
  misc_feature (3780)..(3784): n is a, c, g, or t
  misc_feature (3788)..(3790): n is a, c, g, or t
  misc_feature (3792)..(3803): n is a, c, g, or t
  misc_feature (3806)..(3809): n is a, c, g, or t
  misc_feature (3813)..(3815): n is a, c, g, or t
  misc_feature (3818)..(3818): n is a, c, g, or t
  misc_feature (3821)..(3824): n is a, c, g, or t
  misc_feature (3827)..(3841): n is a, c, g, or t
  misc_feature (3846)..(3846): n is a, c, g, or t
  misc_feature (3849)..(3860): n is a, c, g, or t
  misc_feature (3863)..(3865): n is a, c, g, or t
  misc_feature (3868)..(3871): n is a, c, g, or t
  misc_feature (3881)..(3883): n is a, c, g, or t
  misc_feature (3886)..(3892): n is a, c, g, or t
  misc_feature (3897)..(3898): n is a, c, g, or t
  misc_feature (3901)..(3906): n is a, c, g, or t
  misc_feature (3912)..(3917): n is a, c, g, or t
  misc_feature (3922)..(3926): n is a, c, g, or t
  misc_feature (3933)..(3934): n is a, c, g, or t
  misc_feature (3939)..(3940): n is a, c, g, or t
  misc_feature (3943)..(3943): n is a, c, g, or t
  misc_feature (3955)..(3957): n is a, c, g, or t
  misc_feature (3970)..(3970): n is a, c, g, or t
  misc_feature (3973)..(3973): n is a, c, g, or t
  misc_feature (3982)..(3982): n is a, c, g, or t
  misc_feature (3986)..(3990): n is a, c, g, or t
  misc_feature (3993)..(3996): n is a, c, g, or t
  misc_feature (4000)..(4000): n is a, c, g, or t
tacaatccgtaaagaaggctggcgttctatcatgattaactacaatcccgagactgtttctacagactatgatatgtgcgatcgtctttattttgatgagcttacattcgagcgagttatggatattatagagttagagaatcctcatggtgtcgttgttagtacgggaggccagattcctaacaacttagcgatgaagttagatgctcagaatgttcctattcttggtacgaaagcacaggatattgatggtgcagaagatcgtgcaaagttctctgctatgctgaccgaaaatggtattaatcaacctgantggagtgctttgacgagtatggaagatatcgatgagttcattaaacgagttggattccctgtnctcgtgcgtccttcttatgtcttatcgggtgctgccatgaatgtttgttctaacgaagaagaacttaaacgcttcctacaattggcagcaaatgtaagtgaagatcancccgttgtcgtttctaaattcatcgaacacgctaaggaaatagagatggatgccgttgcaaagaacggagagatactcgcttatgccatcagtgagcatatagagtttgcgggagttcactcgggtgacgccacgattcagttccctccacagaaactatacgtagaaacagttagacgcgttaagcgaattagtcgtcagattgctaagcaattgcatatcaacggaccattcaacatccagttcatggcncgcgataatgacatacttgttattgaatgtaaccttcgtgcaagtcgttcattcccatttgtaagtaaggttttgaagataaatcttattgagttggccacaagagtaatgttaggactgcctgttgaaaagccnaataagaacttntttgaccttgattatgttggaatcaaagccagccagttctcatttaatcgtttacagaaagcggatcctgtattgggtgttgacatgagttctacgggagaagttggctgtttggctgatgatacgaacgctgcactattaaagagtatgttagccgtagggcaaagaattcctaaaaagacgatactcctttctacaggtggagcaaagcagaaggtggagatgcttgatgcggcgcgtcaactggtagaaaatggctatgaactctatgcaacaggaggtacaagtaagttccttgatgaaaatggtataagcaatacacgagcttattggccttctgaagcagggcaaactccccaagctttagatttgttgcatgagcataagattgatatggtggttaatattccaaagaatcttactgtacatgagttgacaaatgggtacaaagtgagacgcgcggctatagatcttaatgtaccattaatcacgaatagtcgtttagccagtgcctttataaacgctttctgcacattaaaacttgacgacatagacatcaagtcatggaatgaatattaaaaaataacaacgaaaagaggcattccnggggttctgttagaactttgggngtgcctttttctttatcaaattttngagtgaaagaaaaggtgttnttttgttaacaatattttgcagtttntaaattactaataatcagtaacttaataaaaagttacagacggagtaaaaaaaagtagttaaaagatgaatgtgaattaaaaaaaatagttacctttgcatcgttttaataaacaaatgattgttttacagatttaaaaagcaaagaaaatgaagaaattagttttagcactcgtagctgttgcagctatctcattcgcatcttgtggtaacaaaactgcagcaaatgcaaacaatggtgattcagactctgtagctcaggttgacactgctgatactgctgctgttgatactgctgctgctgacactgcaaagtaattttgcaaacgagtagaaaaatgagagattgccgctgaactttaattgttcagcggttttttttgtttcatttctgagctgagagagtggatctcttggnatggttcattgattttctttgtaaaatctattatgaatgaaattgcgtaatgaattccaacatgngttntctgcatantgtatgtcgaattcattctatttaggtttattgtttttgatagtactatataaggtttgaaagctgaatttgtgttantgatgattttgattctttcataaattgatttctacttcacaaatnaaaactatcttttttcttgnttatccttttncngttttgtaaaatatngcctnatnttctatcacttctattccattnnnnttatnataannaaannncattnnaantaatntttnggcattctattataanttnatattgaatttnttttttataannaattttnttnngnnnnnanntaanncnntttnnnnttntntttnaatnaaattnnnnnnnaaaaaggnannttttntnntnnnntttnannnnnnttnttnntnattttnttntttntgnnaaganananngaaggnntttatttaagnnnttgattnatnnnnnnttatanttcnntaanaagtnnngtttntttnaantnaaattntntnnngntttgaaaatntnnnntttntaantnntttnnnaaatttnnntanannttngnaancntnntttnnttannntnnntttnnngnanaatnaantnnnnnnnnnnnttaantttnnnnnntttnangnttnaatnnntnannaanaannttnnnannaaanttnaanannnnnttaannannnnnnnaannangnnnnnnnnnaannnnnncgnnnnnnaaangnccnntnnttntnannaaaagnnnatnttnnnaannttnnnttttcccnnnnttnnnnnnngntnnnnnttntttnnttaannnntnnnnnnnttnttnncnnnatttnttttnnnttttnttnnnnnnannccnttntttgnncnnnnggnnnnnnntnntnannnnntnnnntngggnnnnttnncttaannttnnannnnnttnngnaanttnntnnnnnnnaatttnancnnnnnntttttnnngnttnnnnnnntnccatttnngaanccnntnaannnnnnnnnngncnnnnnnncnannncnannnnanggantttnntncnnnnannnnnnatnnnnnaannnncgnaancnnggnnggnnaaaatnncnnattnnnnnttnnnnannncntnnntttnttnnntnntnnnnaagnnnnttnnnnnngnnannnntnntttnttntnnanttnnttnantttttnnnnnttccnnnnnntnnaaaannnanntccnttccnnnnnnnnnngnnnnnanncnnnnnnnnnttnannnccnaaannannnnntnnnnnannnnnttttnncnnnnnnnnnnttnttnnnttnggaaancnaannntnaaannannnnnnnnntttnnnntnccnnnnnnnnnnaannnnnnaannnnttggnaaannncnnnnnnnttnnnnnnnnggnnaanaaattttnggnnttnnttnnnaaaantttnnnnncccnnnnnaannnnnttaaantttaannngnnaanttnannggnaaattnttnnnnaannnnnnngggnttnnnnnnnnnggnnnnttntttnaannnnnnnaannnnccccnnnccttnnnnnnnnnnnnnnnaanttggtttaattnttnnnaanaaannnnnnttggnnnnccnccnccnaannnnnttnnnngnnntttnttnnnnnaatnggnnttaaggttnaaaannnnnnnnnnnngnngnnnnntttnnngnnnnnnnnnnnnaannnntttnnnttnaannnnttnnnnnnnnnnnnnnnaaaanccnnnnnnnnnnnnccnnnttnnnnaaaaaggaannnggnnnnnnnggccnnccnnnnnntttttnnnnnnaaaannnnnaattttnnaaaannttnttggttggtttnnnttttttttttaanttnggggccaanaaannnnnaannnntttn

SEQ ID NO: 224 - DNA, 4000 bp, Escherichia coli
  misc_feature (1932)..(1932): n is a, c, g, or t
  misc_feature (1939)..(1939): n is a, c, g, or t
  misc_feature (1943)..(1943): n is a, c, g, or t
  misc_feature (1954)..(1955): n is a, c, g, or t
  misc_feature (1963)..(1963): n is a, c, g, or t
  misc_feature (1975)..(1976): n is a, c, g, or t
  misc_feature (1984)..(1984): n is a, c, g, or t
  misc_feature (1989)..(1989): n is a, c, g, or t
  misc_feature (3618)..(3618): n is a, c, g, or t
  misc_feature (3623)..(3623): n is a, c, g, or t
  misc_feature (3628)..(3628): n is a, c, g, or t
  misc_feature (3633)..(3633): n is a, c, g, or t
  misc_feature (3674)..(3674): n is a, c, g, or t
  misc_feature (3705)..(3705): n is a, c, g, or t
  misc_feature (3734)..(3734): n is a, c, g, or t
  misc_feature (3737)..(3740): n is a, c, g, or t
  misc_feature (3743)..(3743): n is a, c, g, or t
  misc_feature (3745)..(3745): n is a, c, g, or t
  misc_feature (3748)..(3750): n is a, c, g, or t
  misc_feature (3752)..(3752): n is a, c, g, or t
  misc_feature (3756)..(3756): n is a, c, g, or t
  misc_feature (3760)..(3762): n is a, c, g, or t
  misc_feature (3764)..(3766): n is a, c, g, or t
  misc_feature (3768)..(3769): n is a, c, g, or t
  misc_feature (3772)..(3772): n is a, c, g, or t
  misc_feature (3776)..(3776): n is a, c, g, or t
  misc_feature (3780)..(3782): n is a, c, g, or t
  misc_feature (3786)..(3788): n is a, c, g, or t
  misc_feature (3791)..(3791): n is a, c, g, or t
  misc_feature (3793)..(3794): n is a, c, g, or t
  misc_feature (3796)..(3796): n is a, c, g, or t
  misc_feature (3798)..(3799): n is a, c, g, or t
  misc_feature (3801)..(3801): n is a, c, g, or t
  misc_feature (3804)..(3805): n is a, c, g, or t
  misc_feature (3809)..(3809): n is a, c, g, or t
  misc_feature (3812)..(3817): n is a, c, g, or t
  misc_feature (3822)..(3823): n is a, c, g, or t
  misc_feature (3825)..(3826): n is a, c, g, or t
  misc_feature (3828)..(3829): n is a, c, g, or t
  misc_feature (3831)..(3831): n is a, c, g, or t
  misc_feature (3833)..(3837): n is a, c, g, or t
  misc_feature (3841)..(3841): n is a, c, g, or t
  misc_feature (3844)..(3844): n is a, c, g, or t
  misc_feature (3848)..(3848): n is a, c, g, or t
  misc_feature (3851)..(3852): n is a, c, g, or t
  misc_feature (3857)..(3862): n is a, c, g, or t
  misc_feature (3864)..(3864): n is a, c, g, or t
  misc_feature (3866)..(3866): n is a, c, g, or t
  misc_feature (3868)..(3870): n is a, c, g, or t
  misc_feature (3872)..(3874): n is a, c, g, or t
  misc_feature (3881)..(3882): n is a, c, g, or t
  misc_feature (3884)..(3884): n is a, c, g, or t
  misc_feature (3886)..(3893): n is a, c, g, or t
  misc_feature (3895)..(3900): n is a, c, g, or t
  misc_feature (3903)..(3907): n is a, c, g, or t
  misc_feature (3909)..(3910): n is a, c, g, or t
  misc_feature (3912)..(3912): n is a, c, g, or t
  misc_feature (3915)..(3916): n is a, c, g, or t
  misc_feature (3918)..(3918): n is a, c, g, or t
  misc_feature (3922)..(3924): n is a, c, g, or t
  misc_feature (3926)..(3926): n is a, c, g, or t
  misc_feature (3930)..(3930): n is a, c, g, or t
  misc_feature (3935)..(3937): n is a, c, g, or t
  misc_feature (3939)..(3942): n is a, c, g, or t
  misc_feature (3945)..(3945): n is a, c, g, or t
  misc_feature (3948)..(3948): n is a, c, g, or t
  misc_feature (3951)..(3951): n is a, c, g, or t
  misc_feature (3953)..(3954): n is a, c, g, or t
  misc_feature (3958)..(3958): n is a, c, g, or t
  misc_feature (3965)..(3965): n is a, c, g, or t
  misc_feature (3967)..(3968): n is a, c, g, or t
  misc_feature (3970)..(3970): n is a, c, g, or t
  misc_feature (3974)..(3974): n is a, c, g, or t
  misc_feature (3976)..(3977): n is a, c, g, or t
  misc_feature (3979)..(3980): n is a, c, g, or t
  misc_feature (3988)..(3989): n is a, c, g, or t
  misc_feature (3991)..(3991): n is a, c, g, or t
  misc_feature (3995)..(3996): n is a, c, g, or t
  misc_feature (4000)..(4000): n is a, c, g, or t
acaaatttttcatatccaacggggtaaacataattcctccaccaaccactcaggtttttaaaaatcattgtttttcgtagtttgtagcttttgtaatgcttcattattcctaaatatgagttcatgctgctttggaaggattgttgttcttcttttgtcggcttatggtcacgggctattgggttttgtttttctatggcattgtaaaagttacctttggtgcggttggctatgtaaattcggtttggtaaaatgaccgttccaagaaattttacgcctttgctgtaatgctgcaaataaattttcttaggatggattgtaacgtgtaattccgtttgcagatactccgccaattttggaatgagtttcttcaaatactccttatcttcatgcactatcacaaaatcgtcaacatagcgtccgtaatgccgtatttttaaatcgtgttttacaaaatggtcgaaactgtccatataaaaattggcaaatacctgactggtaaggttgcctattggcaaaccgcattggggttggctgtgaaaaaggcttttgttcaggggcaaattgttccagtcgcttttattgcctttaatgatgcaattttttgtagggtcgttgaatattacttgcttgcaaagttttattatcaaatctttgtcggtttcattatatttctctttgataaaatgttcaagttttgcaaaaagtatgtttttgtttatgctcataaaaaagccctgcaagtcgagttttagtatgtagcaatctttggtatagtttgccgagcattggcggataaatctatcaatacgcccgatgccaaaatgcgtgcctttgcccactctgcaactgtaactatcgtgtataaactgtttttcaaacagatggtttaatttaccgatgattaaatgatgaactactctatctttgaaatcagcagcaaaaatctctctctttacaggtttatctacaataaacgcaatggaacgacctatttggtatgtaccgctgtttatttcttcacatagttgcactaaattattttcgtagtcaatttcaaacgccaacgcattagctgtatttcgtttgtttttgcgacattcaaaataagcagtgaatagttcttcaagttcaattttcgctggttgtatgtcaaataatgataactgcatatttcttttttctttttttaaaaaacactgacaggcttttttcctgccagtgttaaaattgttttgctgaagaatcccgaacggcacgcacactataagtatttgtcttattgttgttgttcgtgttgccgttgttgaagttgaagttgaatgcgtttgttgcattgtactccgtactactccaatagttggcatttgcaaccaagttttgatgcttttgccgattggcatggcatacaattttaccccgtacaactggggtctggttgccctttttcaacaaaaccttgctcgccttttaccaccttagcaataaaagttccggctatgcagggttggcattgcgccaccctacaatttgtttgccgatactatccattaattggcttaactctgcctgcttttttatcgatagtatcttcatatcaacacaaaggcgtatctcaaattttaacaactcaaaatcatctaaaaatgcttcaagatacacccttttttcttttgctttattggctatatagatactccttaccaattgtatgctgtctcgcttcatatcttgccccaaagtatgcttatactcccgtggaaaatctttggtataatcaaaaatcttcaacacgagtttatacacatctttaaaaacaggtaaatcataatacaaagccattcttcaaaaataaaatcgaccgcttcgcggtaaatagttaaatagataaatagttaaaaagcccgaacggcacgcacactataagtatcngtcttanggtngtggtacgtgnngccgtagncgaagtcgaagnngaatgcgnttgtngcactgtactccgtactactccaatagatggcagtacttgaaagcaaagtagctcccacatcatttaaccctttattagcgtgaaaacgattgtgccataaaatagaaagttcgtctattgaaggtagataccaatccgctcctaaactggtaacccatgtttttgcagggctgttggtcatcaagttcatgttataaacaccatcccaactacgggttgcatcggttgtgcttgttgtgctttgccattgagccgttgtttctgtttttgaaacaattaaaccgtgttgattgccattagcatctaaatagatataaaatacaatgccacctaaagtatcttgtcctaagtagaaatcgtttgaagcaccaccgcctgttgcacttatggtattaccaactatggtaatgttagtgccggctattaattggtcttgtttattgttccagttggtggtatctgttcctgttattccactggctaccgatgccccaaaaattgggtcggtttcagtataactgtcaagtttattgttccaattagcagtgtcggttgctgtaataccactggctaccgatgctccaaaaattgggtcggtttcggttattgttcctgtaactgtttccgctgtttttgcatgcaaggcataaggcacacttaataattgactaacgcttgtaatggtgtagtttgctccaccgtttaaatcgatttctgttttaatgaaataaggtccatttgcccagtcaatagtggtaaaatttccacttacaacggttcctgctccaatttcaatacttactaatccattggcgttggttgttgggaattgtctttctacatacatcgccgtaccgtttgatgaaccttgcaatatgcttatttgcataccaacagtttgatttgttactaattggttactactgttacggattactgcctgatagctcattttttcaggtgattgagcgaacacacttgccgttaataatacggctactaaaattgttaataattttctcattgttttgtcctccttaatttttaatgattttaaacgtttttacttctttgtttccttgtgttacttttacaaaataattggcaggaacaagattgctcataacaatgcttgtttggttgccggtgattttttcgctttgtaaaagttttccgctcatatcatacagttggaatgataaatttgaaatttcaaactcatcaatacgcaatgtaagataatcggtagttgggttgggataagccgtaaccgaaagcgtaatgcctttggcttcttctaatccggttactaccgaaatttcgtagggttgttgtacgccttgtgccaccgaaccatttgtccctgtgttggtggtgtaaacaacctgtcctacggaatagcttacagatcctccgctacccgaagcatctccgcctgtggcgttaacgcttgtttgagcctgtagtcctgtcagtccaagtcctaacaagagtatggcacttaattttaactttttgtgtcgcatttttgacctcctttttgatttgttaatactcattttatttatctgtttttgatactgcttcatgctgttgctgggttttctccactgaatgctaacggctgngggtntggcnagtgngggagagcgtgttacgttttcgtcccccgacgaaaacgccngagcgggcgaaaccgctccgaagttccaatntcaacccacattggctacaccccttgttngcnnnnggnanttnnntntttngttnnntnnncnntcnttcnatannntttnnngcntnntntnncngtnncatnttnnnnnntgcgnnanngnntngnnnnntatntgncaanatnngcttnnnnnntngntnnntnnnttttgcnnangnnnnnnnnannnnnnggnnnnngnntnganntntgcnnngntttntattnnncnnnnttntanttncnnccantcttggntnnantttntnnannttattcgnntnttanntttn

SEQ ID NO: 225 - DNA, 4000 bp, Escherichia coli
  misc_feature (40)..(40): n is a, c, g, or t
  misc_feature (45)..(45): n is a, c, g, or t
  misc_feature (47)..(50): n is a, c, g, or t
  misc_feature (53)..(53): n is a, c, g, or t
  misc_feature (55)..(56): n is a, c, g, or t
  misc_feature (60)..(60): n is a, c, g, or t
  misc_feature (65)..(66): n is a, c, g, or t
  misc_feature (69)..(69): n is a, c, g, or t
  misc_feature (74)..(75): n is a, c, g, or t
  misc_feature (86)..(87): n is a, c, g, or t
  misc_feature (91)..(92): n is a, c, g, or t
  misc_feature (101)..(101): n is a, c, g, or t
  misc_feature (170)..(170): n is a, c, g, or t
  misc_feature (232)..(232): n is a, c, g, or t
  misc_feature (254)..(254): n is a, c, g, or t
  misc_feature (303)..(303): n is a, c, g, or t
  misc_feature (442)..(442): n is a, c, g, or t
  misc_feature (499)..(499): n is a, c, g, or t
  misc_feature (796)..(796): n is a, c, g, or t
  misc_feature (838)..(838): n is a, c, g, or t
  misc_feature (862)..(862): n is a, c, g, or t
  misc_feature (1163)..(1163): n is a, c, g, or t
  misc_feature (1238)..(1238): n is a, c, g, or t
  misc_feature (1259)..(1259): n is a, c, g, or t
  misc_feature (1313)..(1313): n is a, c, g, or t
  misc_feature (1361)..(1361): n is a, c, g, or t
  misc_feature (1487)..(1487): n is a, c, g, or t
  misc_feature (1511)..(1511): n is a, c, g, or t
  misc_feature (1556)..(1556): n is a, c, g, or t
  misc_feature (1640)..(1640): n is a, c, g, or t
  misc_feature (1787)..(1787): n is a, c, g, or t
  misc_feature (1989)..(1989): n is a, c, g, or t
  misc_feature (1998)..(1998): n is a, c, g, or t
  misc_feature (2002)..(2002): n is a, c, g, or t
  misc_feature (2028)..(2028): n is a, c, g, or t
  misc_feature (2030)..(2030): n is a, c, g, or t
  misc_feature (3001)..(3001): n is a, c, g, or t
  misc_feature (3127)..(3127): n is a, c, g, or t
  misc_feature (3334)..(3334): n is a, c, g, or t
  misc_feature (3337)..(3337): n is a, c, g, or t
  misc_feature (3364)..(3364): n is a, c, g, or t
  misc_feature (3433)..(3433): n is a, c, g, or t
  misc_feature (3664)..(3664): n is a, c, g, or t
  misc_feature (3673)..(3673): n is a, c, g, or t
  misc_feature (3709)..(3709): n is a, c, g, or t
  misc_feature (3745)..(3745): n is a, c, g, or t
actgtgaaaaaagctttgatgagatgataaatttaaaaanagaanannnnatnannttanctggnntanagatnnaagatgagctnntaannagcatcaanatatcaattagtggctacgatgaaagcagcgatagcttggactttgatctaaatttactatctcttagngtgccatatagatacgctatatcaaatggttgttttgagatgagtatctttttaaaagaagncaaagaagtggttgagaaattnttatccacttttagttataaatttgaggcaaatagtggcaaggagcgcnacttgatcgttttcgtaaatgagtcaaaaatttacgagcaaacctatatgtgatataaggaaatatggttatgaatgtggttttttttactcaaaatggttcgcttaataatctttggcgagggtatttttcagatgangatgtgaaatttactcacaataaaaaggatttttttgcaaatttaaacgacgaggtngatatcgtcggtatcgatacaaatgcttttaaagatagccttgatgaaaatattaaaaccattcatgaaagttttccaaatataaaatgtctaatccttgcaaacgaaccaaaatttagtgaaggcaaacatctgctggctcttggtgtcaaaggatatgcaaactcacacatgagaaaaacacactttgaagatgcctttgagacgattttaaatggcaaagtttggctttatccagaatttatccaagcgatgatcggagaactaactggctcatatataaataatgaaagtganactttagagaaaaagtctgatctaagcgagcttagctcacgngaaaaagagatcgcaaacttaatntaccaaggtctaacaaacaatgaaatttcagagcaaacaggcattactttaaggacggtaaaggcgcacactacgtcgatttacagcaagctaaatgtgaaagatagaataggtcttgtgcttttgatgaagcagctgcatgcgtaaaattttgcttcttttcttttttgtctcttctctttttgcaaataattttgaaatttctccaaaaaatatatctcaatgtaaaaatcaaatttgcaaaaatatcctaaatcactatgcaaattttatgaaaaaaatagaacacgaaagctttatnagaaagctagagctcataaattcatacttaaattctttgatgccaagatatgatgatttttacaatacaaatgtngatgtgtggagcactaggggngagtttttaaggcgaggtggcggagactgcgaagagtacgcgatatcaaagcgngatagcctaaaagatcttggcgtggataatcaaaaatgccttctagtngttcaggaaaaaaatacaaaaaaatatcatatggtgctagctgtttgggaaaatttacacaaagagcctttgatactggataatctaagctttagagttttgccactttcgaagcgctacgacttngtgccagagtattgcttgatggangggaaatattttaagataaaaaaagatggcataaatttagagccngtaaatataagaatgcaaacttacgaaaatttgataaaaaaggaaaaagaagagaaattttggaagaattaatcttccaagtcnatgtctattttttcaacatttgttgtaatatctttagtatttttctcaatgttgtgtttatttttctcgattagtgatctgttttgacctataaggtctctattttctttgataccatcactgttttgctcgatcattttgcttagngtcgctatctttttttcatagcggatcattaagaagtagatcacgtaaattagcagtaaaattaccgcccaaggtaaaaattgcatattaaatcctttgtaatttttcgtaattatagaaattttagcttttaaaaaaaataaaactatgaaaatatgaaattttatatatgtaaaatttatctttgttttttggtaaaagnggctcagtntagngggtgtttttgaaattttttataaantntatagatttttgattgcaaaaaaattagataaaatatttttcaaaatctccttgacttttattttattttgggctataattgccacttcacaaaacaggtgctggtgtagctcagttggtagagctactgccttgtaagcagtgggtcggcggttcaagtccgttcaccagctccattttgtaacagtgtttgaccagaaaataccaaaataacttattaatgtttaaggtgagatactcaagcggccaacgagggcagactgtaaatctgctgactatgtcttccgtggttcgaatccacgtctcaccaccattgttatgcgggagtagctcagttggctagagcatcagccttccaagctgagggtcgcgggttcgagccccgtttcccgctccaaaatttgggaaagtaaactgggagctgtatctagattttactaaacacagttattccatctttattttcatgaatttttagttgtttgtatgttgattaaaatcatctcagccaagcgtttttcgctcatatggctcagaggtagagcacttccttggtaaggaagaggtcgcgggttcaagtcccgctatgagctccactggtttatatgattttatattactatacgaatttgaattagataaagacacatatcataacggaggaaaagatggctaaagaaaaattttcacgcaacaagccacacgtaaacataggcactatcggtcacgttgaccatggtaaaactactttaacagctgcaatatctgctgttctttcacgcaaaggtcttgctgagctaaaagattatgataatattgataatgctccagaagagaaagagcgtggtattacaattgctacttcacacattgagtatgagacagaaaaacgtcactatgctcacgttgactgcccaggccacgccgactatgtaaaaaacatgattacaggtgctgctcaaatggacggngctattctagttgtttctgcagcagacggcccaatgccacaaacaagagagcacatcttgctatctcgccaagttggtgttccttatatcgttgttttcatgaacaaagcagatatggttgatgangctgagttacttgaactagttgaaatggaaattcgcgaactacttaacgagtacaacttcccaggtgatgatactccaatagtttctggttcagcacttaaagctcttgaagaggcaaaagctggacaagatggcgaatggtcagcaaaaattatggaactaatggatgcggttgatagctatatcccaactccagttcgtgctacnganaaagatcttcttatgccaatcgaagangttttctcaatttcaggtcgtggtacagttgtaacaggtagaattgagaaaggtgttgttaaagttggngacacaatagaaatcgttggtatcaaacctacacaaacaacaacagttactggtgttgagatgtttagaaaagagatggatcaaggtgaagctggcgataacgttggtgttcttcttcgtggtactaaaaaagaagacgttgaacgtggtatggttctttgcaaacctaaatcaattactcctcacacaaaatttgagggtgaggtttatattctaactaaagaagagggnggtcgccanactcctttctttaacaactatagaccacaattctangtaagaacaactgacgttactggttctattacattnccagaaggcacagagatggttatgccaggtgataacgtaagaatttctgttgagcttatcgctccagttgcacttgaagaaggtactcgttttgctatccgtgaaggtggtagaactgttggttcaggtgttgtttcaaaaatacttggttaatttataaaattatgccaaaggggaaaccctttggctttctataaggaatatatatgagaattaaaatcggtttaaaatgctctgagtgtggtgatatcaatt

SEQ ID NO: 226 - DNA, 4000 bp, Escherichia coli
  misc_feature (1943)..(1943): n is a, c, g, or t
  misc_feature (1948)..(1948): n is a, c, g, or t
  misc_feature (1959)..(1959): n is a, c, g, or t
  misc_feature (1962)..(1963): n is a, c, g, or t
  misc_feature (1965)..(1966): n is a, c, g, or t
  misc_feature (1972)..(1972): n is a, c, g, or t
  misc_feature (1978)..(1978): n is a, c, g, or t
  misc_feature (1980)..(1981): n is a, c, g, or t
  misc_feature (1986)..(1987): n is a, c, g, or t
  misc_feature (1992)..(1993): n is a, c, g, or t
ccccgttccttatccttgctttgagctgttcccggctcttataccgtttctttattatcagccttgagaacttaccatccatcatgatgtatttccaccattccttgtgtagcatatacatcaccttcttgcggatattgtagctttcaaaatgaatcatcataccgaggtatgaattgatggactgaacaaagtgttccaagttctcaagtgctttcccttcctcggccagcttgttgtacttctgtatgctatcgtacatcttacctcgcgtcctgttgctgatatacgttcgccccggcaatatcattgccccgacaaacagcacaccgttccgtacaggctggatgtatattttctttgggtgtaaccgtacaagcagctgctcggcgaggaacagcctcatttcgggcacaagtttggcaaaatcctctttcgttggaagcagtatcgttatatcatcgacaaagcgaatataacaatcaatttgcttgacttccttaatccaatggtcgaacacgctaccgaggaagttagcgttgagttgggagggcaaattgcctatagcgcatcctttacctttaggctgtccgaacagagttttcctcggtggtatattgtcccacaattcaacagggcttttgcggatacaatcatcctgcggacaatggaatgttatcacacgtgtaatgtataacagacattccaaatcatcacccttgtagttgtcccggatgaagatgtcgagcatttcgtacagaagggctttatccatactcataaaatagccctcaaggtcaaaatgacctacccaccaattcgggtgttcatccaccatcttacgcacggccttcacagctgacagcgtaccctcgcccttacgacagttctttgatacgttaccctgtgcagtgaatcgttcctcgtacataggattcactctcaaagcccaccaatggtggattatacggtcagcaaaatcagcagcaaagacttctcgataaacaggccacttgacaacaaagcatttggacgttccgggatagtatctgccagtacggacttcgttccacaggcgtttgagttccgtttgataggtgcaaaagaaagtaagacaatccttacttgacatcttttcccttatacagtcctcaaaagcagctacaattgacgaaaaaggtatgtcataggtgacaggttcacttgcggaagacacaacgggacaacacacagaacgaaccctatttgtattattcctattgttgttgttcgaattaccgttgttcatatttacgttccacgaagacaccgaagtctgtattcacttttgtttctttcctcgtttttaggcaaggggaatacccaaataaaccttgtttcactgctcactcctaaccagcgtaccaattaggattccggctgacgggctaacgctgacttgcgccaacccgtggcttgcgctcctatctctccagcaagggagagaatatcacagaacttgccctcgtcaattatacgacggtctcggcataacctaatcatcaattgcagactgccaaacttgatagagaactcttccaataacgacactcgccgggcttgcgacatatttgcggcctgtatcagttcgcaacattctaacgcaaccatcatcatacgttcaccaaaggcatatttgaaagccttcggaaagtgttcccttgcatccaatataagattgagcaaggtgtacatttgtttatatatttgtaaatcttgtgcgagtgccatatcacatctttttcgaatcggcggcaaagatactgaaaatgcgccaaaaatcgacaaaaaaatcccccttacgggggaaagaaataaagaattaaagaggtaaagagataaagaggtacaaggtttatcctgcggaagacacaacgggacaacacacagaacgaaccctaccngtatnattcctaccgntgnngnncgaacnaccgtngnncatanntacgnnccacgaagacaccgaatcgtactctgtggaactccagtaccaatcaccaacaattgtgccaccagcaaagtatttggtaaggaatgcgtttatctcagtcttgaactcacaaatcaagcgcagttccgttacgctgggtagataccattgcattgtgtcgtagctgttggccttgtagttccatgctgcttcagcagctggtgcgcccgttatattctgcgagtcggtctttccggctgtctgctcaatgatggcttttgtatcttcatatccagtgttcacatcaaatagtccagtgttcccggctgcatagttcttcacgttcttaaagtccgttccataacctccgaacttgaacgtataaccacccgaagcattgacacaatcggcagcagcgacaatgaactctctttttcgggcacgtacactgacaccgagcttgctgtactgtgccttaccgttcgctgacagcgcactccattcgtcacctgtgaagtaagccagactgccgtccgaaatctttatacaagcgatacggaggtcacgcaggcctcctgcccatttaatgtactctgccatctcggacaacggtgtgttgtatgttacttccgaaaatcccaactcctgaagagcctttacttggtcttccttgttaatgcgaagcaatatcgcgtctttgtttgcactcatatcatttgggttttaatgttagacttcctcacagaccgcacggacacggttcttgacttccttatattgtgcaccggagatgtatccataatggaatgacaatccgaatgcgtattcactggtgtactctgtactgctccaataataatggtttgtagtggccttacaaagcaaactctcggaactccaaaagtattccaacgcctcttgtatttcggtcttgcacttgtagatgataagtaacacaccaagaccgggaagatgccagtcgctggtgtcttcgataccgtcatactcttctgtgtatgccttatatgctttggcggcttctgctgccggagcacctgtcacaccctcattgcctgttatgccggacaaggatgcaaggataagctctgtattctcagctccggcaaaatcattataggcagcaccacaagtgcgctggtcgaggtcttcaacgttcttacggttgccccatgacatggtaacgtttccgtccccatcgtaacagtcacccggtgcgaggacgaatgaatgaccataagcacggacacggagacctcgcttgatgaacttcattttattctcgttggtcagactgtcccattcatctttggtaaagtaccaatagctcttgtcactgtaccgttgtactgcaaggcatatatcaagcaggccaccagcccacttgatacgctttgcaaattccgaggcacgactggcttctgtaacatcagtcatacccacagcattgaatgctgccacctgtgcctgcttgtttctgcgtagcagggttacgctttgttctttcgtgctcatattatgaattgattaggtcgttaatatctgcattctcgttggcatatccggcaaggtattcctcataggtctcaccgttgtagtaaaggagatgctcatcaatgttgtcgagtgtaacatcatccacttcctcctcaccaccgtagccttcactgttaacttcatcgatgaggtcaatgtacgcttctatgacaacaaggattgttagttctgaaatcccgttctctatcgcttctatttcgtagtcctcaaggattacagtcagttgatacgtgccgttgatgactggcttgcttaccttgtttccgtcagcatcctgtccggcgacaccacgctcgatgatagccaacagttcggatgcatcccccttcaatgtttgccctacaatacgaagcagggtcaataccgcactcgctgactgtgaggcaagcacatcggtcagcatacggatagcatccaatttggggctggtctctatacgcaaacgctgtactg

SEQ ID NO: 227 - DNA, 4000 bp, Escherichia coli
  misc_feature (65)..(65): n is a, c, g, or t
  misc_feature (127)..(127): n is a, c, g, or t
  misc_feature (160)..(160): n is a, c, g, or t
  misc_feature (906)..(906): n is a, c, g, or t
  misc_feature (1427)..(1427): n is a, c, g, or t
  misc_feature (1659)..(1659): n is a, c, g, or t
  misc_feature (1752)..(1752): n is a, c, g, or t
  misc_feature (1766)..(1766): n is a, c, g, or t
  misc_feature (1987)..(1987): n is a, c, g, or t
  misc_feature (2903)..(2903): n is a, c, g, or t
  misc_feature (3580)..(3580): n is a, c, g, or t
cggcgatgtcacgtgctggatttgctctaaacctcattggagccgtccttgtgacaacactcgcnctccttcttattcaagctctctttttgtagtgtttccttgagtttcactgactagaaatagnggtagaaaaaaatctccaaaaatttttatattncattgtcgtatttaagaagagttttaatgaaaactatttcaagatcagtagaacaaaaatagtggttcctaaatattttctaagagagttctgacctttctggtttccatctaagctttgggttgcgggcggccgtgatttcatctgggcgagaaacgacaggcatatgaggggcattgtgaaaaacttccggtttggtctctgcgagttcagctatttttttcatggttacgataaagtcatcgagtgtttcctttgattcagtttcagtcggctcgatcatcaatgcacccttgacgaccaaaggaaagtaaactgtgggaggatgaaacccatagtcgatgagcatttttgcgatatccatagtactcactttgtttttgagttgaagcttgtcgttgaatacgcactcatgcagactgggtccgttatagggtagatgatagtgtttatagagcgaggctttgatatagttggcgttgagaaccgccatttctgctacctgtttaattccttctggtcctagcgatctgatgtaggtataggctcgaacgaggatgccaaaattcccataaaaagctttcatttttccaatactatcagggcggtcatggttaagcgtgtatttcccgtcagcatgttcgatgataggctttggaagaaaaggtgatagtttttcggcgacccctataggaccagctccgggtcctccccctccgtgaggtgtggaaaatgttttatgtagnttaaagtgtaaaacatctacacccatgcggttcaattttgtttttcccattatcgcatttaggtttgccccatcacagtaaaccaggccccctttactgtgaacaatttcactgatttttaatatgtcagtttcaaatattcctagagtatttggattggtcagcattatggctgcagtttcttcatccattatcgactctaattttttgggatcgatgaggccacgttcgtcggactgtatttgaataacgctgtatccacataacgctgcgctagctggattagttccatgggcagagtcgggcaggatgactttttttcgctgtgtcccttgagtcgaatgatacgcatgaatcatgagcatgcctgccaattcaccgtgtgctccggctgcaggttgcaggcttacatgcgccataccgcttatttctttgaggtattcttgcagttcaaacataagttgaaggcttccctgcgaaagagtctcaggtgtgtatggatggtgctgtgcaaatccggnaaggttggcggtttcgttgttgacctttggattgtatttcatcgtgcaggagccaagcgggtaaaaattggtgtctatactaaagttccattgtgagagccttgtgaagtgtcgaacaacatcgagttccgttagttcgggaaggttgtcgatgggattacgaatttctgtggcaggaagaattgcttcaagttccacttcagggacatcacattttgggagtgagtaggcngtgcgacccggggatcccatttcaaagagtaacggttcgttaaaaaccagtcctttgattcctgttagcgaattgtgtaatgcctgaggtttnttcatcatgggtcnctaagtgatagtacctgtgaaattttttatgcgtatgtagtgttaagtaattttaaaatatacttacagcggtctaatttaaaatagttaggttacttgccaatggagaaatttcttaaaaaacaggttaacagaacaagtggatattatatagttttgcgagcctgggtgttagttagtaattggttgatttgatctaccactatttttggtgagagaanatccgagtttttttcttcgagaatgatatgaggagtattggttggtccccatcgtgctgtttcgccatgtttgaagatcactgccacaggtgtttctactgccgaagcaaaatgcattatgcctgtgtgattgcaaaacagcaggtcgcttttttttatagctagcgctaactcttttatcgaaagaactggcaaacgatcaatggttgagtttgcctgtttattgatacggtctattaatggttcttcgcctggaccacaaatgaataaaacttctccttttttcgaactggatagtttttcagctacgacttgaaagttttcgactttccatccccattttccgatacgtgttcctggttttattagtatgagtgggagttctgggtatttgcgtagtgcgtttagtatcgtggagacctttttttcctctgcttcattgaaatacaggcgtggagattttgaaatttttgtcaatcccgcatagcttagcagttcaaggttatttaagctttcgtggcgagattggttgtctataggtaaacggatatcgtagagccagattgtttcatcgtgggcgtaacttatcttatattgagctttactgattagagcaagaaacgaagcaatgacgctaaactttttatttaatgtaaatgcgatatcaaacctattgcataggagttgtttgatgatggttccgaggtttttggggctaaaggggattattttgtctacatttgggttgtcagtcaggataggcatgttgctgcggttcactattacacttactcgaagatgcggaaatgattttttgatggattcgtaaacgggtgttgataaaacgacgtctcccagacgatcggttcttattaccaatatagaagaggcagatgtgaaatttataggaagaggnggagatttttttttaccaaaaaaaaatccaatgatagcccacagagtatgctttgcgagacgttctattttgcgagccagttcggccatggtttttttcgccaagtggcagtgcgtttaaggcaatggttgtgcttgatcgatgagcatgataggaatgtcatcctggatgagatattttagtttgcatgcgttgcagtcaagcccgtcttcttcgggagttaactctaattctcctttgcattttgggcaaaccaggatttctaaaagttctttgtcaaaagccattgaattacctttatgtttaatgagttgagtgttgaggagagattagcatcttaatatgtccggaggctatttttttcgtagcatcaaacatgttttgcacggttactttattcatgcattcggttgtccctaaaggacactgacgtttccagcagaaactacaatttaatttatgaaaaactgcttcatggttttttgagtaggccccgttgcggtttggatcagttggtccccatgccgaaaccgttgggatgcctaatgcccagcaaatatgaaacggtcccgagtcgcttcccacaaataaagagagttttttatatagtccaatagactcggcaatcgtggtcgcaggtgctatccacgacttttgtttcatgctctcggcgatantgcggaccatttcttcttctcctggtccccaggtcaggaggatagagaagcccagctcttctgttagtttgtcggctaatcgggcgtaccgttctatgctccacagtttggttgggaacccggctcctggattgattccagctatgggcttttcggtgagcttgctatttttcaccatgaaagctttagaaataatttcatccttctcaccgatgggtaggggaaactctatttgaggatgaaaatctcccaagatggaaagctgtgatagacaacggtctactatatgactatcggtagaaatatatttactacgttgattattaaaccaggcatttattttttctcggcagttactgcgatgaaacccagctctattgggtgcgctcgtcatgctagcaatgaacccagttttaatga

SEQ ID NO: 228 - DNA, 4000 bp, Escherichia coli
  misc_feature (37)..(37): n is a, c, g, or t
  misc_feature (121)..(121): n is a, c, g, or t
  misc_feature (600)..(600): n is a, c, g, or t
  misc_feature (911)..(911): n is a, c, g, or t
  misc_feature (1173)..(1173): n is a, c, g, or t
  misc_feature (1392)..(1392): n is a, c, g, or t
  misc_feature (1988)..(1988): n is a, c, g, or t
  misc_feature (1999)..(1999): n is a, c, g, or t
  misc_feature (2005)..(2005): n is a, c, g, or t
  misc_feature (2238)..(2238): n is a, c, g, or t
  misc_feature (2274)..(2275): n is a, c, g, or t
  misc_feature (2277)..(2277): n is a, c, g, or t
  misc_feature (2279)..(2281): n is a, c, g, or t
  misc_feature (2284)..(2284): n is a, c, g, or t
  misc_feature (2287)..(2288): n is a, c, g, or t
  misc_feature (2290)..(2291): n is a, c, g, or t
  misc_feature (2293)..(2293): n is a, c, g, or t
  misc_feature (2295)..(2297): n is a, c, g, or t
  misc_feature (2299)..(2301): n is a, c, g, or t
  misc_feature (2304)..(2306): n is a, c, g, or t
  misc_feature (2308)..(2308): n is a, c, g, or t
  misc_feature (2310)..(2315): n is a, c, g, or t
  misc_feature (2317)..(2317): n is a, c, g, or t
  misc_feature (2319)..(2320): n is a, c, g, or t
  misc_feature (2322)..(2322): n is a, c, g, or t
  misc_feature (2324)..(2324): n is a, c, g, or t
  misc_feature (2327)..(2334): n is a, c, g, or t
  misc_feature (2337)..(2340): n is a, c, g, or t
  misc_feature (2342)..(2345): n is a, c, g, or t
  misc_feature (2347)..(2347): n is a, c, g, or t
  misc_feature (2350)..(2350): n is a, c, g, or t
  misc_feature (2352)..(2354): n is a, c, g, or t
  misc_feature (2356)..(2356): n is a, c, g, or t
  misc_feature (2358)..(2358): n is a, c, g, or t
  misc_feature (2363)..(2366): n is a, c, g, or t
  misc_feature (2369)..(2369): n is a, c, g, or t
  misc_feature (2373)..(2375): n is a, c, g, or t
  misc_feature (2377)..(2377): n is a, c, g, or t
  misc_feature (2379)..(2382): n is a, c, g, or t
  misc_feature (2385)..(2385): n is a, c, g, or t
  misc_feature (2387)..(2387): n is a, c, g, or t
  misc_feature (2389)..(2389): n is a, c, g, or t
  misc_feature (2392)..(2395): n is a, c, g, or t
  misc_feature (2397)..(2399): n is a, c, g, or t
  misc_feature (2401)..(2401): n is a, c, g, or t
  misc_feature (2403)..(2403): n is a, c, g, or t
  misc_feature (2406)..(2408): n is a, c, g, or t
  misc_feature (2414)..(2414): n is a, c, g, or t
  misc_feature (2416)..(2422): n is a, c, g, or t
  misc_feature (2426)..(2432): n is a, c, g, or t
  misc_feature (2434)..(2439): n is a, c, g, or t
  misc_feature (2441)..(2444): n is a, c, g, or t
  misc_feature (2446)..(2446): n is a, c, g, or t
  misc_feature (2448)..(2450): n is a, c, g, or t
  misc_feature (2452)..(2455): n is a, c, g, or t
  misc_feature (2457)..(2459): n is a, c, g, or t
  misc_feature (2461)..(2463): n is a, c, g, or t
  misc_feature (2466)..(2466): n is a, c, g, or t
  misc_feature (2469)..(2470): n is a, c, g, or t
  misc_feature (2474)..(2475): n is a, c, g, or t
  misc_feature (2477)..(2480): n is a, c, g, or t
  misc_feature (2482)..(2482): n is a, c, g, or t
  misc_feature (2485)..(2486): n is a, c, g, or t
  misc_feature (2489)..(2489): n is a, c, g, or t
  misc_feature (2497)..(2497): n is a, c, g, or t
  misc_feature (2501)..(2502): n is a, c, g, or t
  misc_feature (2504)..(2506): n is a, c, g, or t
  misc_feature (2509)..(2509): n is a, c, g, or t
  misc_feature (2512)..(2514): n is a, c, g, or t
  misc_feature (2516)..(2518): n is a, c, g, or t
  misc_feature (2520)..(2521): n is a, c, g, or t
  misc_feature (2523)..(2523): n is a, c, g, or t
  misc_feature (2525)..(2525): n is a, c, g, or t
  misc_feature (2527)..(2530): n is a, c, g, or t
  misc_feature (2533)..(2533): n is a, c, g, or t
  misc_feature (2535)..(2537): n is a, c, g, or t
  misc_feature (2539)..(2542): n is a, c, g, or t
  misc_feature (2545)..(2545): n is a, c, g, or t
  misc_feature (2548)..(2551): n is a, c, g, or t
  misc_feature (2555)..(2555): n is a, c, g, or t
  misc_feature (2558)..(2558): n is a, c, g, or t
  misc_feature (2560)..(2560): n is a, c, g, or t
  misc_feature (2562)..(2565): n is a, c, g, or t
  misc_feature (2569)..(2570): n is a, c, g, or t
  misc_feature (2577)..(2577): n is a, c, g, or t
  misc_feature (2580)..(2581): n is a, c, g, or t
  misc_feature (2583)..(2583): n is a, c, g, or t
  misc_feature (2588)..(2590): n is a, c, g, or t
  misc_feature (2592)..(2592): n is a, c, g, or t
  misc_feature (2594)..(2594): n is a, c, g, or t
  misc_feature (2598)..(2599): n is a, c, g, or t
  misc_feature (2602)..(2602): n is a, c, g, or t
  misc_feature (2607)..(2607): n is a, c, g, or t
  misc_feature (2609)..(2610): n is a, c, g, or t
  misc_feature (2612)..(2612): n is a, c, g, or t
  misc_feature (2616)..(2617): n is a, c, g, or t
  misc_feature (2619)..(2623): n is a, c, g, or t
  misc_feature (2625)..(2627): n is a, c, g, or t
  misc_feature (2629)..(2630): n is a, c, g, or t
  misc_feature (2638)..(2639): n is a, c, g, or t
  misc_feature (2643)..(2644): n is a, c, g, or t
  misc_feature (2647)..(2648): n is a, c, g, or t
  misc_feature (2653)..(2653): n is a, c, g, or t
  misc_feature (2655)..(2657): n is a, c, g, or t
  misc_feature (2660)..(2660): n is a, c, g, or t
  misc_feature (2662)..(2662): n is a, c, g, or t
  misc_feature (2665)..(2667): n is a, c, g, or t
  misc_feature (2670)..(2670): n is a, c, g, or t
  misc_feature (2672)..(2672): n is a, c, g, or t
  misc_feature (2676)..(2676): n is a, c, g, or t
  misc_feature (2678)..(2678): n is a, c, g, or t
  misc_feature (2680)..(2681): n is a, c, g, or t
  misc_feature (2683)..(2684): n is a, c, g, or t
  misc_feature (2686)..(2686): n is a, c, g, or t
  misc_feature (2691)..(2691): n is a, c, g, or t
  misc_feature (2693)..(2694): n is a, c, g, or t
  misc_feature (2697)..(2697): n is a, c, g, or t
  misc_feature (2699)..(2699): n is a, c, g, or t
  misc_feature (2702)..(2702): n is a, c, g, or t
  misc_feature (2705)..(2705): n is a, c, g, or t
  misc_feature (2707)..(2707): n is a, c, g, or t
  misc_feature (2710)..(2710): n is a, c, g, or t
  misc_feature (2713)..(2714): n is a, c, g, or t
  misc_feature (2716)..(2718): n is a, c, g, or t
  misc_feature (2720)..(2723): n is a, c, g, or t
  misc_feature (2726)..(2728): n is a, c, g, or t
  misc_feature (2730)..(2731): n is a, c, g, or t
  misc_feature (2735)..(2739): n is a, c, g, or t
  misc_feature (2745)..(2746): n is a, c, g, or t
  misc_feature (2748)..(2749): n is a, c, g, or t
  misc_feature (2753)..(2757): n is a, c, g, or t
  misc_feature (2759)..(2761): n is a, c, g, or t
  misc_feature (2764)..(2765): n is a, c, g, or t
  misc_feature (2767)..(2769): n is a, c, g, or t
  misc_feature (2773)..(2778): n is a, c, g, or t
  misc_feature (2780)..(2780): n is a, c, g, or t
  misc_feature (2782)..(2782): n is a, c, g, or t
  misc_feature (2784)..(2784): n is a, c, g, or t
  misc_feature (2788)..(2789): n is a, c, g, or t
  misc_feature (2791)..(2791): n is a, c, g, or t
  misc_feature (2793)..(2793): n is a, c, g, or t
  misc_feature (2796)..(2797): n is a, c, g, or t
  misc_feature (2801)..(2801): n is a, c, g, or t
  misc_feature (2803)..(2803): n is a, c, g, or t
  misc_feature (2805)..(2806): n is a, c, g, or t
  misc_feature (2809)..(2811): n is a, c, g, or t
  misc_feature (2815)..(2820): n is a, c, g, or t
  misc_feature (2825)..(2825): n is a, c, g, or t
  misc_feature (2827)..(2829): n is a, c, g, or t
  misc_feature (2831)..(2834): n is a, c, g, or t
  misc_feature (2839)..(2839): n is a, c, g, or t
  misc_feature (2841)..(2842): n is a, c, g, or t
  misc_feature (2844)..(2844): n is a, c, g, or t
  misc_feature (2847)..(2849): n is a, c, g, or t
  misc_feature (2851)..(2851): n is a, c, g, or t
  misc_feature (2856)..(2858): n is a, c, g, or t
  misc_feature (2860)..(2862): n is a, c, g, or t
  misc_feature (2866)..(2869): n is a, c, g, or t
  misc_feature (2874)..(2877): n is a, c, g, or t
  misc_feature (2879)..(2880): n is a, c, g, or t
  misc_feature (2886)..(2887): n is a, c, g, or t
  misc_feature (2891)..(2891): n is a, c, g, or t
  misc_feature (2894)..(2896): n is a, c, g, or t
  misc_feature (2898)..(2899): n is a, c, g, or t
  misc_feature (2905)..(2905): n is a, c, g, or t
  misc_feature (2908)..(2908): n is a, c, g, or t
  misc_feature (2911)..(2911): n is a, c, g, or t
  misc_feature (2915)..(2916): n is a, c, g, or t
  misc_feature (2920)..(2921): n is a, c, g, or t
  misc_feature (2924)..(2924): n is a, c, g, or t
  misc_feature (2926)..(2927): n is a, c, g, or t
  misc_feature (2929)..(2929): n is a, c, g, or t
  misc_feature (2934)..(2934): n is a, c, g, or t
  misc_feature (2936)..(2938): n is a, c, g, or t
  misc_feature (2942)..(2942): n is a, c, g, or t
  misc_feature (2945)..(2945): n is a, c, g, or t
  misc_feature (2947)..(2948): n is a, c, g, or t
  misc_feature (2950)..(2950): n is a, c, g, or t
  misc_feature (2953)..(2955): n is a, c, g, or t
  misc_feature (2957)..(2957): n is a, c, g, or t
  misc_feature (2959)..(2961): n is a, c, g, or t
  misc_feature (2963)..(2963): n is a, c, g, or t
  misc_feature (2965)..(2973): n is a, c, g, or t
  misc_feature (2977)..(2979): n is a, c, g, or t
  misc_feature (2983)..(2989): n is a, c, g, or t
  misc_feature (2993)..(2993): n is a, c, g, or t
  misc_feature (2996)..(2996): n is a, c, g, or t
  misc_feature (3000)..(3001): n is a, c, g, or t
  misc_feature (3004)..(3004): n is a, c, g, or t
  misc_feature (3010)..(3012): n is a, c, g, or t
  misc_feature (3014)..(3014): n is a, c, g, or t
  misc_feature (3016)..(3019): n is a, c, g, or t
  misc_feature (3021)..(3021): n is a, c, g, or t
  misc_feature (3023)..(3024): n is a, c, g, or t
  misc_feature (3027)..(3027): n is a, c, g, or t
  misc_feature (3030)..(3030): n is a, c, g, or t
  misc_feature (3032)..(3032): n is a, c, g, or t
  misc_feature (3034)..(3034): n is a, c, g, or t
  misc_feature (3037)..(3038): n is a, c, g, or t
  misc_feature (3041)..(3041): n is a, c, g, or t
  misc_feature (3043)..(3045): n is a, c, g, or t
  misc_feature (3047)..(3049): n is a, c, g, or t
  misc_feature (3051)..(3055): n is a, c, g, or t
  misc_feature (3057)..(3061): n is a, c, g, or t
  misc_feature (3063)..(3063): n is a, c, g, or t
  misc_feature (3065)..(3066): n is a, c, g, or t
  misc_feature (3068)..(3068): n is a, c, g, or t
  misc_feature (3075)..(3075): n is a, c, g, or t
  misc_feature (3077)..(3077): n is a, c, g, or t
  misc_feature (3079)..(3082): n is a, c, g, or t
  misc_feature (3086)..(3086): n is a, c, g, or t
  misc_feature (3088)..(3089): n is a, c, g, or t
  misc_feature (3092)..(3092): n is a, c, g, or t
  misc_feature (3094)..(3095): n is a, c, g, or t
  misc_feature (3097)..(3100): n is a, c, g, or t
  misc_feature (3103)..(3104): n is a, c, g, or t
  misc_feature (3106)..(3109): n is a, c, g, or t
  misc_feature (3111)..(3111): n is a, c, g, or t
  misc_feature (3113)..(3114): n is a, c, g, or t
  misc_feature (3116)..(3116): n is a, c, g, or t
  misc_feature (3118)..(3121): n is a, c, g, or t
  misc_feature (3124)..(3127): n is a, c, g, or t
  misc_feature (3130)..(3135): n is a, c, g, or t
  misc_feature (3140)..(3143): n is a, c, g, or t
  misc_feature (3145)..(3147): n is a, c, g, or t
  misc_feature (3152)..(3152): n is a, c, g, or t
  misc_feature (3156)..(3156): n is a, c, g, or t
  misc_feature (3158)..(3166): n is a, c, g, or t
  misc_feature (3169)..(3170): n is a, c, g, or t
  misc_feature (3172)..(3172): n is a, c, g, or t
  misc_feature (3175)..(3179): n is a, c, g, or t
  misc_feature (3181)..(3184): n is a, c, g, or t
  misc_feature (3187)..(3187): n is a, c, g, or t
  misc_feature (3189)..(3191): n is a, c, g, or t
  misc_feature (3193)..(3194): n is a, c, g, or t
  misc_feature (3196)..(3199): n is a, c, g, or t
  misc_feature (3203)..(3209): n is a, c, g, or t
  misc_feature (3211)..(3212): n is a, c, g, or t
  misc_feature (3214)..(3219): n is a, c, g, or t
  misc_feature (3222)..(3225): n is a, c, g, or t
  misc_feature (3227)..(3230): n is a, c, g, or t
  misc_feature (3232)..(3236): n is a, c, g, or t
  misc_feature (3239)..(3239): n is a, c, g, or t
  misc_feature (3242)..(3245): n is a, c, g, or t
  misc_feature (3248)..(3251): n is a, c, g, or t
  misc_feature (3253)..(3255): n is a, c, g, or t
  misc_feature (3257)..(3257): n is a, c, g, or t
  misc_feature (3259)..(3259): n is a, c, g, or t
  misc_feature (3261)..(3262): n is a, c, g, or t
  misc_feature (3264)..(3265): n is a, c, g, or t
  misc_feature (3267)..(3271): n is a, c, g, or t
  misc_feature (3273)..(3273): n is a, c, g, or t
  misc_feature (3278)..(3279): n is a, c, g, or t
  misc_feature (3282)..(3284): n is a, c, g, or t
  misc_feature (3287)..(3290): n is a, c, g, or t
  misc_feature (3292)..(3292): n is a, c, g, or t
  misc_feature (3294)..(3296): n is a, c, g, or t
  misc_feature (3298)..(3300): n is a, c, g, or t
  misc_feature (3302)..(3302): n is a, c, g, or t
  misc_feature (3304)..(3304): n is a, c, g, or t
  misc_feature (3306)..(3308): n is a, c, g, or t
  misc_feature (3310)..(3310): n is a, c, g, or t
  misc_feature (3312)..(3313): n is a, c, g, or t
  misc_feature (3318)..(3319): n is a, c, g, or t
  misc_feature (3321)..(3321): n is a, c, g, or t
  misc_feature (3323)..(3326): n is a, c, g, or t
  misc_feature (3329)..(3330): n is a, c, g, or t
  misc_feature (3332)..(3334): n is a, c, g, or t
  misc_feature (3336)..(3337): n is a, c, g, or t
  misc_feature (3339)..(3343): n is a, c, g, or t
  misc_feature (3345)..(3347): n is a, c, g, or t
  misc_feature (3349)..(3349): n is a, c, g, or t
  misc_feature (3351)..(3354): n is a, c, g, or t
  misc_feature (3357)..(3361): n is a, c, g, or t
  misc_feature (3363)..(3363): n is a, c, g, or t
  misc_feature (3367)..(3370): n is a, c, g, or t
  misc_feature (3372)..(3375): n is a, c, g, or t
  misc_feature (3377)..(3378): n is a, c, g, or t
  misc_feature (3380)..(3384): n is a, c, g, or t
  misc_feature (3386)..(3386): n is a, c, g, or t
  misc_feature (3388)..(3391): n is a, c, g, or t
  misc_feature (3393)..(3393): n is a, c, g, or t
  misc_feature (3395)..(3406): n is a, c, g, or t
  misc_feature (3408)..(3408): n is a, c, g, or t
  misc_feature (3410)..(3412): n is a, c, g, or t
  misc_feature (3414)..(3416): n is a, c, g, or t
  misc_feature (3419)..(3429): n is a, c, g, or t
  misc_feature (3432)..(3435): n is a, c, g, or t
  misc_feature (3437)..(3438): n is a, c, g, or t
  misc_feature (3440)..(3440): n is a, c, g, or t
  misc_feature (3442)..(3449): n is a, c, g, or t
  misc_feature (3451)..(3455): n is a, c, g, or t
  misc_feature (3457)..(3457): n is a, c, g, or t
  misc_feature (3459)..(3459): n is a, c, g, or t
  misc_feature (3461)..(3463): n is a, c, g, or t
  misc_feature (3465)..(3470): n is a, c, g, or t
  misc_feature (3473)..(3478): n is a, c, g, or t
  misc_feature (3480)..(3481): n is a, c, g, or t
  misc_feature (3483)..(3488): n is a, c, g, or t
  misc_feature (3490)..(3492): n is a, c, g, or t
  misc_feature (3494)..(3499): n is a, c, g, or t
  misc_feature (3501)..(3510): n is a, c, g, or t
  misc_feature (3512)..(3516): n is a, c, g, or t
  misc_feature (3518)..(3529): n is a, c, g, or t
  misc_feature (3531)..(3532): n is a, c, g, or t
  misc_feature (3534)..(3535): n is a, c, g, or t
  misc_feature (3537)..(3547): n is a, c, g, or t
  misc_feature (3549)..(3551): n is a, c, g, or t
  misc_feature (3553)..(3553): n is a, c, g, or t
  misc_feature (3555)..(3559): n is a, c, g, or t
  misc_feature (3561)..(3564): n is a, c, g, or t
  misc_feature (3567)..(3568): n is a, c, g, or t
  misc_feature (3570)..(3570): n is a, c, g, or t
  misc_feature (3572)..(3581): n is a, c, g, or t
  misc_feature (3583)..(3583): n is a, c, g, or t
  misc_feature (3585)..(3590): n is a, c, g, or t
  misc_feature (3592)..(3596): n is a, c, g, or t
  misc_feature (3598)..(3598): n is a, c, g, or t
  misc_feature (3600)..(3603): n is a, c, g, or t
  misc_feature (3605)..(3610): n is a, c, g, or t
  misc_feature (3612)..(3615): n is a, c, g, or t
  misc_feature (3617)..(3618): n is a, c, g, or t
  misc_feature (3620)..(3620): n is a, c, g, or t
  misc_feature (3622)..(3636): n is a, c, g, or t
  misc_feature (3638)..(3639): n is a, c, g, or t
  misc_feature (3641)..(3642): n is a, c, g, or t
  misc_feature (3644)..(3644): n is a, c, g, or t
  misc_feature (3646)..(3647): n is a, c, g, or t
  misc_feature (3649)..(3655): n is a, c, g, or t
  misc_feature (3657)..(3660): n is a, c, g, or t
  misc_feature (3662)..(3665): n is a, c, g, or t
  misc_feature (3667)..(3667): n is a, c, g, or t
  misc_feature (3670)..(3675): n is a, c, g, or t
  misc_feature (3679)..(3681): n is a, c, g, or t
  misc_feature (3683)..(3687): n is a, c, g, or t
  misc_feature (3689)..(3693): n is a, c, g, or t
  misc_feature (3695)..(3699): n is a, c, g, or t
  misc_feature (3701)..(3709): n is a, c, g, or t
  misc_feature (3711)..(3715): n is a, c, g, or t
  misc_feature (3717)..(3721): n is a, c, g, or t
  misc_feature (3723)..(3733): n is a, c, g, or t
  misc_feature (3736)..(3736): n is a, c, g, or t
  misc_feature (3739)..(3742): n is a, c, g, or t
  misc_feature (3746)..(3750): n is a, c, g, or t
  misc_feature (3752)..(3758): n is a, c, g, or t
  misc_feature (3760)..(3760): n is a, c, g, or t
  misc_feature (3762)..(3763): n is a, c, g, or t
  misc_feature (3766)..(3769): n is a, c, g, or t
  misc_feature (3773)..(3776): n is a, c, g, or t
  misc_feature (3779)..(3783): n is a, c, g, or t
  misc_feature (3785)..(3785): n is a, c, g, or t
  misc_feature (3787)..(3790): n is a, c, g, or t
  misc_feature (3793)..(3796): n is a, c, g, or t
  misc_feature (3798)..(3805): n is a, c, g, or t
  misc_feature (3808)..(3815): n is a, c, g, or t
  misc_feature (3817)..(3819): n is a, c, g, or t
  misc_feature (3821)..(3832): n is a, c, g, or t
  misc_feature (3834)..(3839): n is a, c, g, or t
  misc_feature (3841)..(3856): n is a, c, g, or t
  misc_feature (3858)..(3858): n is a, c, g, or t
  misc_feature (3860)..(3873): n is a, c, g, or t
  misc_feature (3875)..(3879): n is a, c, g, or t
  misc_feature (3881)..(3886): n is a, c, g, or t
  misc_feature (3888)..(3888): n is a, c, g, or t
  misc_feature (3890)..(3892): n is a, c, g, or t
  misc_feature (3894)..(3897): n is a, c, g, or t
  misc_feature (3901)..(3902): n is a, c, g, or t
  misc_feature (3906)..(3907): n is a, c, g, or t
  misc_feature (3910)..(3912): n is a, c, g, or t
  misc_feature (3914)..(3931): n is a, c, g, or t
  misc_feature (3933)..(3937): n is a, c, g, or t
  misc_feature (3940)..(3944): n is a, c, g, or t
  misc_feature (3947)..(3956): n is a, c, g, or t
  misc_feature (3958)..(3958): n is a, c, g, or t
  misc_feature (3960)..(3965): n is a, c, g, or t
  misc_feature (3967)..(3975): n is a, c, g, or t
  misc_feature (3977)..(3978): n is a, c, g, or t
  misc_feature (3980)..(3981): n is a, c, g, or t
  misc_feature (3987)..(3992): n is a, c, g, or t
  misc_feature (3996)..(4000): n is a, c, g, or t
catcgcataaggcgacaaacgctgtgcaccacgatantcacgacccgtaccatatggcaggaagttatattcgtatgcaaagcctacatcaaccaatgaattgtcgaatgtatagggagcngaggcaaaacgtggatagtaagtcttgacatcagccgatgaacctttcatctttccaaacgatacgttcatctttaatcccatataaggactgagattatatcttgccagcaccgttcccatcggctgtaggtctttaaacaacgactcgttaaagtcgcctaagtaacccatcataccaacaccggcgcctatctccatcttatactccggatccgactgcgcccatagaggcgtagcagcaaggaaaaggaggaggttgatgaagatacgtttcattgttgtcctgtttgaatagcttattcagccaatcgactaaggttcaatgcccagcctactcgattgagtctaccacgccaaacctttgtaccactgattacccagaggtattcgtcgctatcaactgttgctgcaaaagctgttgcagcctgtacacctgttggataagtgaagctcttatcactcttccatgtgataccnccatcacgagagagaagcatagaagccaacttaccactgctattaagacctaatgcaagggctgccttatcatagtttacaactgaaagactcttgtaaagagggagctggaacttgtcagcattgctctctacataactccactgctcattctgacgataagaaagtttcgtccatgcagcattctttgtaccgcttgccagtgtaccaacaagcagtacgcgatacaagtcagatgaaactgctgtaagtgaagaaccaatattgcttactggaaggagtgaagcattgctatctaatgactcgttagnccaagtaacaccattgttctttgaagccaacaacgtacctgacgttgatagcgcaaacaactctgctggtgacgctgccaccaactgcttcaaactgctatttgtagccactgtagtccaactgctgccgtctgtagagctataaaccgtaccattgtcgataacgaagagcttagtaccctgcactgccacactcttataagcatttgcagtgaaggtcttgctgagctttgtccagctgttgccattgtcctttgacgcngcataaacaacagtctgactgccattcgttccgaatacaaacaccttgctacccgcactaacagccttcattgctgtgaacgaagcgaaattgctgttcgcctgcagtgcctgccagctaaacacgttgcccttctgcttgtgaacattcacagaaaccttgtaatctctgtactcacttcccttgtttgagtaaacacggaaaacgcgtggagtgctnaagtcaatagaatcattactgctgtaataagtgaacttctcctctgtagttgacttgataacaacagttccgctattctttgccacaatcttagccaaagcacttgctggctttgtaccatatggcaaagagtcaggattataaatcaaaccctgtgcctgatcgatatagaacttaaccttagcaccattgaagttgctaacataagtactatcgctaccattcttggcaacggtatcacgcacttgctttaattgtcccaaagaaaagctcaaaatagccgtgtctttgtaacttacactatttttctcgtcgtcgtccttaagacaagatgttattgtcaaagtagccaccattaaagctacgagagtatatatcttattacgcatcagatactaataattgaatttagctgcaaatttaatcagaattcttcagaatcaacgtctttaacgaggttaattatgtaaaatatcgaaaataactgcgtttttttaagtttgtttagtaagtattgccaaagtaacgataaacttgaagaaaaatgacctataaatcacatctgataaacttctgctatcttccttaccttcacntgaacttttcnactganactattgtcttttcacacgccttttctcgacttaaaaccttatcattcttctacttttctacgcctttatttgtctacttattttacattacatcacactaccatttgccctcattgcgaaaaaaaatcgtataagaagcaaaaaagaccctaacaatactgagaagtgttttttatttgttacttttgctgatataataactaaaaatatgaatacatcaaagaagataacngtacagagtacagaaatatctgtgctgataggaaannanannnacnacnntnncntnnnannnatnnnanannnnnnanannangnaannnnnnnntannnnannnngnacngnnnangnacaannnncanaatnnnanannnnggngnanggnnnnannntnanaannntaattntnnnnnnnccgnnnnnnntnnnnnnannnntngnnnannnntnnncnnnttnacnntaanngnnnngnaannganacaaaagncaanngnnntangtnnnannncnnangntnnnnggnannntnnnnctnacnnnnacanggntntnnnntttnnttttggnatnngnctaannncnanattnnaantttananngnaaannannnnnannngnnaaaagaannaganngcnntccgntnnngtnanagnnnaangnaaancnannannanccaanannaantntanacntnatnctnntnnnannnnaannntnnttannnnnaaaatnnannttannnnnannnagnntnnnattnnnnnngnancngaanntnanatnntaantntnnttnnntttnnnnnnaaagnannngnnnnggctnanncnaannngnatttnnnannnaaannnntaaannnnanngaaacnncaancannnannagttantantantatnnaatnnggnanntnctaantnnnaaangananngnaannngnannnanannnnnnnnntttnnnattnnnnnnnaaanggnaaannaanagttannngnannnnanannaanaanananaannaanannnannnannnnntnnnnnanannanaaagaananannnnaatnannatngnnannnnttnnannnntnannantnnnnttnnnnttnnnnnnctacnnnnannnaaatnaatntnnnnnnnnnctnntnctnnnnntnnnngtnannntnntnnnncctnnnnnnncnngnnnnnngcnnnngnnnngnnnnngcngannnngannnngnnngntncnnannannnnncncattnnccnnnatnnnnantnnnannntnanannnanannaaaannanannnnaanncnnnannannnnnannnanannnngannnnnanggannnngnnnntnnannnnnanannnntntnnnnnnnnnnnnantnnnannnatnnnnnnnnnnntannnntnngncnnnnnnnnannnnnananannnannnnnnggnnnnnnannannnnnnannnannnnnntnnnnnnnnnnannnnnannnnnnnnnnnnanngnnannnnnnnnnnntnnnantnnnnntnnnnatnnanannnnnnnnnntnannnnnnannnnnantnnnnannnnnncnnnncnncncnnnnnnnnnnnnnnncnncnncncnncnnnnnnntnnnntnnnncnccnnnnnntctnnntnnnnntnnnnntnnnnntnnnnnnnnntnnnnntnnnnntnnnnnnnnnnnaanaannnnaaannnnnannnnnnntntnnatnnnnaaannnnaannnnnanannnnaannnnannnnnnnnaannnnnnnntnnntnnnnnnnnnnnnannnnnnannnnnnnnnnnnnnnntnannnnnnnnnnnnnnannnnnannnnnnanannnannnnaaannaaanntannntnnnnnnnnnnnnnnnnnntnnnnnttnnnnntannnnnnnnnntntnnnnnntnnnnnnnnnannannaaaaannnnnncccnnnnn

SEQ ID NO: 229 - DNA, 4000 bp, Escherichia coli
  misc_feature (1)..(6): n is a, c, g, or t
  misc_feature (10)..(11): n is a, c, g, or t
  misc_feature (15)..(17): n is a, c, g, or t
  misc_feature (474)..(474): n is a, c, g, or t
  misc_feature (579)..(579): n is a, c, g, or t
  misc_feature (586)..(586): n is a, c, g, or t
  misc_feature (591)..(591): n is a, c, g, or t
  misc_feature (600)..(600): n is a, c, g, or t
  misc_feature (654)..(654): n is a, c, g, or t
  misc_feature (719)..(719): n is a, c, g, or t
  misc_feature (724)..(725): n is a, c, g, or t
  misc_feature (746)..(746): n is a, c, g, or t
  misc_feature (748)..(750): n is a, c, g, or t
  misc_feature (761)..(761): n is a, c, g, or t
  misc_feature (782)..(782): n is a, c, g, or t
  misc_feature (788)..(788): n is a, c, g, or t
  misc_feature (797)..(797): n is a, c, g, or t
  misc_feature (806)..(806): n is a, c, g, or t
  misc_feature (881)..(881): n is a, c, g, or t
  misc_feature (887)..(887): n is a, c, g, or t
  misc_feature (964)..(964): n is a, c, g, or t
  misc_feature (1262)..(1262): n is a, c, g, or t
  misc_feature (1265)..(1265): n is a, c, g, or t
  misc_feature (1334)..(1334): n is a, c, g, or t
  misc_feature (1385)..(1385): n is a, c, g, or t
  misc_feature (1397)..(1397): n is a, c, g, or t
  misc_feature (1652)..(1652): n is a, c, g, or t
  misc_feature (1655)..(1655): n is a, c, g, or t
  misc_feature (1691)..(1691): n is a, c, g, or t
  misc_feature (1739)..(1739): n is a, c, g, or t
  misc_feature (1956)..(1956): n is a, c, g, or t
  misc_feature (1962)..(1963): n is a, c, g, or t
  misc_feature (1973)..(1973): n is a, c, g, or t
  misc_feature (1977)..(1978): n is a, c, g, or t
  misc_feature (1980)..(1981): n is a, c, g, or t
  misc_feature (1984)..(1984): n is a, c, g, or t
  misc_feature (1986)..(1987): n is a, c, g, or t
  misc_feature (1992)..(1992): n is a, c, g, or t
  misc_feature (2025)..(2025): n is a, c, g, or t
  misc_feature (2063)..(2063): n is a, c, g, or t
  misc_feature (2114)..(2114): n is a, c, g, or t
  misc_feature (2230)..(2230): n is a, c, g, or t
  misc_feature (2235)..(2235): n is a, c, g, or t
  misc_feature (2426)..(2426): n is a, c, g, or t
  misc_feature (2516)..(2518): n is a, c, g, or t
  misc_feature (2660)..(2660): n is a, c, g, or t
  misc_feature (2666)..(2666): n is a, c, g, or t
  misc_feature (2694)..(2694): n is a, c, g, or t
  misc_feature (2723)..(2723): n is a, c, g, or t
  misc_feature (2732)..(2732): n is a, c, g, or t
  misc_feature (2750)..(2751): n is a, c, g, or t
  misc_feature (2781)..(2781): n is a, c, g, or t
  misc_feature (2829)..(2829): n is a, c, g, or t
  misc_feature (3450)..(3450): n is a, c, g, or t
nnnnnngccnnccannntgtagcgcgacaaaatttttgagaaactcggacagcgaaaatgagaaaaaatagcggatttcttagaagtaattctaagcccgcccgcttgcggcgacggcccccagaatggggagcggcccccgcaggagggcgggcgttatagggcccccggagaagcggcacacgccgccctccggggccgttttcattgtgggtggccggttactcgccctcgggctccccgggcccgtcctgggcttcctggggggcttcctgggccggttccggctcctggtattcctcccagccgtaaacgcccggctcccagacgttggaggctgcgctggagacccacctcttgccgttgtgggtcaccttcgccccctggtcgtaggcgtcatgcgccccgataggctgaatccactccgggaactcctccagggggttgccgatgcgcgtccacatggagggcgtngccgagggcttggtattctggccagcgtccttgacgtcgtggatggagcgatagagctggccctcgtcctggacgatgtcgcccgccttgccccgccagttttcntcccacngggtnaagaggtcngggtactcggagatcgttgtctcgtcgagctgctgctcctgggccatcttgacnaacatgatctccgcgacggcctgggcggagctgctccggcgagccgcccggttcaattccccganagacnncttcggggtcagatactgcangnnnctcattcgtangcacctccaaagccagaaatngaaacntcgccctcntagccctcnttcttggtgatggtgaagcggatgttgacgccccacttgtccgccgtcttggtcttgttggtgaagttatagacncggttnatcgccaccatgggggtgatgtcctcccaggtgggctcggcgtcgaaggcgttgttacaagcctccaccagagccgncgcgccctcgatatgccatgtcggggtgaccagcaccttggatgcggcctcgtccgtctcctccggctcattgagctggaaacagatgacgctctccttcttggagaatgtccagacccgcaccgaggtggcgaagttgccgtccacggcctccacccggagctggtggttgccattggtaagcatgagccacctctcccgagtgagctcgatggtctcctcttgccccagggtagcctgatagctcctgatctgcacgtcgtccacgaactcggtgacgaccacgttgtcgccctcnatntcggtgacggtgtacttctcggcgaagctgcctgtcttgtggcccagggccatatcctggccggagatngccggtgcgctgttggtgcgtttgaaggtgagcctccggtagctggtgccncccttgccgtcngtgaccatgatggtgatggtgttgacggagttgaggtcgagggtgtagagcttctcagaggtgatcgccacgccaaggggctcgcccttgggggcgttgttgatcgtgcggatggtctcatcgttgagctgctccgtcacggtgagggtgtcgccgtccgcgtcgttgacggtataatcgtaggtgaagcccaggtttttatctcccaggttgccatcgacgccgctgatggtgggtgcgctgttggttctggtnaangtccacgtcctggtggccgtcccgcccttgccgtcngtgaccacgaccttcacggtatgcgtcccaagggacaattcatcgacngggacggaaatggtatatacaaaatttcgcgtcgggccgaacgacttcgtcgttcggccatcgatcgactccgtcgccgttagcacgtcgccggagtcggggtcgtcgacgctgtactgtatcgtgaagttggtgttcttatcacccagattgcggtcactgtcagagatcagagggtcagtgttcaggatttcaaggacggggcgaaaaccgacgnacacgnnccgatacgtngcanngnngtngnnccagnagcgggccgacacccagccgcgaaccgcacgantcgacgaatttccagaatatacctcttgacaccaagantagcagcccatccaattccagaactgattgtgggcactcgtcttgtcggcngcggcgagggaggcgtccaggtcggacgatgtgggggccgggaggccggtgataacctcctcgcgggtgatgaacctgtcccactcgttattggtgggcgagcctcccgcatatgngtcgnttcccctataagtgctgccacccgtcagaacgcggcacttataggtcgccccgtcgatggtgacggtcttgccggtgatgtagccctgttcgttcagatcgttccaggaaacagagaccaggatgttccggtcgcagatcaggagggtcttgctgccgtccttgatcttgtgccactggagcttgttggcntccgctgccggggtgctgccgagtgtgtagtttgccatgctcccgctcatttgcgggatgtcgccgacgccgcagccgctatacggctcnnngtcaggacgccagggctttgtgggccttttcagtatcgtaccgttgttgtaaaatccgccgagcttgacgaggccgagatattgcgccataaggtagctctccttccactttgatgaagcggtagggcgcgaatatcttcgncgccanattgtaggcacttgcccagcgggcaaanccgagccaggagttgacttcttgctgtanctccttgcncgtcttcttgccctcccnnagcttcgcaatcatagccttgacccgtcgnttctgcttccgcttggattgcgtccgaagctccaggtgcgtggctttnattttgtagccgtaggcgttcacgccctgccgcaaatagaatattttcgtcttgctgttgagatcaagatgcagcttgtctttgacgaactgcttgatcttcgcaagccactccctcgcggtctctttgttcggcgcaatgatgacggcgtcgtcggcgtatcgcctatagagctttgccccgaggaagcggatgcagaactgatcgagctcattgagggtaatatttgcgaagtcctgggagctgacattccccagggggacgcccttttctccttcagggctggagtcgatcactttgcaaagaaggcgataaaagcggaggaggtcttcgtaacgctccgggtgcttctttcgtagcttcttgaaccgcttcgccaggagccttttcaagacttggcggtcgatagaatagaaaaactttttcacgtcgatctttatgacggcagcttcgtcgccccacttcatccgggcgaccctcatgtcgtgctgcacatccagcgcggcccggatgggccctttcccgtaaagacacgcataggagcggtctacaaatacgggccggtagatgtcctgcaaggcttcatggacggtagtctgcacgatcttgtcccggagcttnggaatgtggaggctgcgctcctttggctccgtgatcgtcctgtgacgataggagccagggatatactccttctttcgttgatctgggtctggccgcgctttgatcgccgtgagctcacgccatagttggacattattcacttcggagaagaggtcgtataagaccgcctcccgagtgtatttccgctgccctcggagcgcgtttttatagctggccccgatagtatcccacccaaccatctcctcgtatggtctgagcggcataattggcggaattatagggtgcttgaccttctgcgctgtctttactaaaatggggaatttcgtcattgtggcatcctttccttttgagaacggcttggcacctatgacgcgggttgttacccacattgtagacctccccccaccttcccaatacgagagggccgggcagagcttggtcactgtttttacgccgtcaaagacaaggcgaaggattacctctcccttgaagtataacaaggactcgccagtaaagccgtagccgtaccagacgaaataaacctacaagg

SEQ ID NO: 230 - DNA, 4000 bp, Escherichia coli
  misc_feature (316)..(316): n is a, c, g, or t
  misc_feature (439)..(439): n is a, c, g, or t
  misc_feature (2349)..(2349): n is a, c, g, or t
tccgcagacgacgatgcgcggattcgcgataccaaattttgcagtgagatcggcgtcgagaatgtcgattatctgcgtgagggactcctgcgtgattgctgcaggcacctcggcgagcggaagatgagtagtcgccaaggccacgcgaagaccttcggttgcgagcatcataacagtcaggtcacagccgcagcgctctgctagaaattcggtatggccgctaaatgctatgcctgagtcattgataacacctttgtgcacggggcctgtgacaaaggcatcgaagtcgccggcaagggttgcatcggttgcaatncgcagtgtctctaaaacgtaagcagcgttacgacggtcgagttctcccgcgtgcacagggacgattaacgacacgggtaaaatgctcaaagtgccgggttgggtagggcgctcaggcgtcgangcgtcgaaagggaagagcgttaggcttaaaccaagatcggctgcgcggtcgcgaaggagttgtggatcggcgacaacaaccagctctgtgtcagcaggcggctgctgacagagctgaatgcaaagatcggggccaatgcccgcgggctcccccggggtgagcgcgattcgttgagtcacttaggcgctccaaactagtcgattaactcgacgaaggcgtcttcgcgaatttcgataagccagttctcgagttcgagctcgaactttcgattgcgcagcgcgttagccgcttgattgcgcgtgaactcgcggctgaggtcttgcaaacggcgaccttcgacacgggcaacgtgccagcctacctgagagcgaaaaggctcgcttacgccatcgatttcgagtgcatcaactacctgttccatctcgggcggcatgccgccttcgtttacccagtcgaggtcaccgccgcccacgaccgacgacgcgtcgtcggaattttggcgcgcaattgttgcaaagtcttcgccgtcgaggatgcgctggtgaattttgcgggcttcggcttctgtctgctcctcgtttcggatttcgtttggcgacagcatgatatggcgcacgcgagtctgatttacaaactgctcagtacctccctgcatgtcaacgagctggattatatgcaggccattgcctgcctcgataggcccctcgacttggcctatttccatgtcgaccacgatgtcggcgaaaaggctcggcagctgtttggctttgcgccagcccaattcggcgccgccgatttcgatcgcggtattctgccgtgctgcggcgcgtgccgcagcaagcgggaaatcatcgtcgatgcgggagattaaatcagccgcaaggcgctgcttctctgctttgatttcaggggtatcggcagcgctgaacgggataagcagatcgtcgacaaagtagtcggctgccatcagttcgcgccccatttcggagttaaggaaattgtcgatttcttgctctgtaattttgatgcggcgattaaccatcccgcgctgcaattcttgcatggtcatctgcttgcgtacttgctcgcgagtttgcagatagacgccgttttcttcgagcgcatcgacatactgatcgaaggtgaggttattgttgcttgccatattgccgagcacgcgattgatcgtgtcatcgtcgtagcggatgctgacgcggttagcgagttgcatctgaatattctcaacgatgagcgcctccattatgtcggattcgaactgctctaggtcgtctggcagcggctggccattgcgctgcgctgccgccgtaatttcgacaatgcgctcatcgagttcactttttagcactacgtcgtcgtcgacaatggcgataattttgtcgagcagcacacgctgcgcactcgcgaaaggtgcagcgagaagcaggaggagaagcgcgccaataacgaagaggacgcggcgattcacattgttatcattcatagggtaaccatttgtaaagtagtctcgcaggctttctgatctcgtaggcagcctagtgtaccgtattggcggttgctacgcggccgcaatttagcgctcagcgtcgtagccttgaatcccttcggtgagaaggctgtctaggccgccgcctgtgaggttgcctaagcctactaaggtgaactgaacgaaaacgccgcggttgggctcaaaattgcgcacaaacagctcgttttcgttaatccattcgcgggcaactaggcgaattttcgcacagcagttgctgtattcgaccccggcaaagctctctaggttccgcgcattgctgtgatcgtagttccagcgcgccagtatcttccaatttgtcgcgagaggccagactgccgaaaaatcggtctgccgtatatgcggntcgattgcgccatctatcgctggcggcaacacgagattcggcgagctgacgaggttgcgctcgcggtaggcaaggttaactaagtgcgacgcgtcgcggcggtagcgaacctgcgcgcgtccttcgatcacctgctgtgtctcctcgtcccactgcacatcggtaatgaagcgccagcggtcgtttggtgcgtaaaaggcctcggcggcgatggctgagccgtcggcagtggttgagtaacgtggcgcccagttttggagaggattggcgaggtcaacgaggcgatcttcaaagtaggttatctgacccaggcttgcgcgggcgcgctcgcggcctgtgttgtcgagcagtcttgtggtaatcgctgcacttacttgtcgggcgttgcttaccctatcgccgccggcgaagcgctcgtcgcgaaacagttgggcgaaactaaaattgagttcggacgagtcgaagagcgggatgtcgccttgctcagcaaagccactgtcgagagcgaaaatgcgtggctctagtgtctgtgtccaaccctttcgcgtggcgcgttcgaaaataaggccggtgtcgaggctattcaccgacacgccgaagtcgggtgcctcggccgtgccaagcgcctgtttgtcgaggctgtagctacgctgcagatatttgcttttggcgcgaacaaaccagcccgggcgctcgatgctccagcttacctctggttcgagattcactcgggtgccggtaacaagggctccggcatcgattttggcttggcttagcaatccttcttcgagggtgcgatcgaaggctgttgcctcgcctgcaaaggctgctcggaaaccggcgccaagggggatctgtgaagccagtgtgaactgaggtaagcgatcgaagggcttgttaatgtcgagcgctgcggcaaacggatcgataatctgcaggcgttgggcattaatccccgcgcgcagatagtcgtttctgaaatctatgcgagcctggcgattgaggtgtgtttggctagaaagattgaggccgccgttaccaaaatcgaagaaatagtcattgtcgctcaccgcattatagtcgacataagttgagaatccgcgaccaaaacgtccctgatgctcgaagccaacaaaccatcgatcttcttgcgagggtgactccgaaccgagggtgtcggcggtggcggggtcgaagaatttatcgccggccaaatgcgagacgttgagagtattcatcgacgtttcggcgagataacggaactcagctccaagcattacgccacgatcgctcagcaggcgcgggcttaatgtcgcatccatctgtggcgcgagattaaggtagtaaggcacctcgatatctactccgccggtacggctagagccaatactgggcggcaatagtccgctgaggcgttgatcgccgatggggaactgcaccgtgccagggtaataaaaaaccggaatatcgcgaatgcgcaggctcatcgccttcgcacgaccgcggccgattgcttgatcgagttcgaaggcgttcgcacgcagcacccaaaactcattgcctggctcgcagcggctaaattcgccgttgtcgagcatgatgaggccggtggctgagtcgtagtcgattgtctgcgcagcgccatgaatgc

SEQ ID NO: 231 - DNA, 4000 bp, Escherichia coli
  misc_feature (1)..(463): n is a, c, g, or t
  misc_feature (514)..(520): n is a, c, g, or t
  misc_feature (522)..(524): n is a, c, g, or t
  misc_feature (526)..(528): n is a, c, g, or t
  misc_feature (532)..(534): n is a, c, g, or t
  misc_feature (536)..(536): n is a, c, g, or t
  misc_feature (539)..(540): n is a, c, g, or t
  misc_feature (542)..(546): n is a, c, g, or t
  misc_feature (548)..(550): n is a, c, g, or t
  misc_feature (552)..(562): n is a, c, g, or t
  misc_feature (564)..(566): n is a, c, g, or t
  misc_feature (568)..(571): n is a, c, g, or t
  misc_feature (573)..(573): n is a, c, g, or t
  misc_feature (576)..(579): n is a, c, g, or t
  misc_feature (581)..(581): n is a, c, g, or t
  misc_feature (583)..(583): n is a, c, g, or t
  misc_feature (585)..(590): n is a, c, g, or t
  misc_feature (592)..(607): n is a, c, g, or t
  misc_feature (609)..(609): n is a, c, g, or t
  misc_feature (613)..(614): n is a, c, g, or t
  misc_feature (616)..(617): n is a, c, g, or t
  misc_feature (619)..(619): n is a, c, g, or t
  misc_feature (622)..(622): n is a, c, g, or t
  misc_feature (625)..(625): n is a, c, g, or t
  misc_feature (627)..(633): n is a, c, g, or t
  misc_feature (635)..(635): n is a, c, g, or t
  misc_feature (638)..(643): n is a, c, g, or t
  misc_feature (645)..(650): n is a, c, g, or t
  misc_feature (652)..(654): n is a, c, g, or t
  misc_feature (657)..(662): n is a, c, g, or t
  misc_feature (666)..(666): n is a, c, g, or t
  misc_feature (668)..(669): n is a, c, g, or t
  misc_feature (671)..(672): n is a, c, g, or t
  misc_feature (675)..(677): n is a, c, g, or t
  misc_feature (679)..(679): n is a, c, g, or t
  misc_feature (681)..(685): n is a, c, g, or t
  misc_feature (687)..(689): n is a, c, g, or t
  misc_feature (691)..(691): n is a, c, g, or t
  misc_feature (905)..(908): n is a, c, g, or t
  misc_feature (911)..(912): n is a, c, g, or t
  misc_feature (915)..(919): n is a, c, g, or t
  misc_feature (921)..(921): n is a, c, g, or t
  misc_feature (923)..(927): n is a, c, g, or t
  misc_feature (929)..(930): n is a, c, g, or t
  misc_feature (933)..(933): n is a, c, g, or t
  misc_feature (935)..(935): n is a, c, g, or t
  misc_feature (937)..(941): n is a, c, g, or t
  misc_feature (945)..(949): n is a, c, g, or t
  misc_feature (951)..(956): n is a, c, g, or t
  misc_feature (958)..(960): n is a, c, g, or t
  misc_feature (962)..(969): n is a, c, g, or t
  misc_feature (971)..(971): n is a, c, g, or t
  misc_feature (973)..(974): n is a, c, g, or t
  misc_feature (977)..(979): n is a, c, g, or t
  misc_feature (982)..(982): n is a, c, g, or t
  misc_feature (984)..(984): n is a, c, g, or t
  misc_feature (986)..(987): n is a, c, g, or t
  misc_feature (990)..(992): n is a, c, g, or t
  misc_feature (994)..(1000): n is a, c, g, or t
  misc_feature (1002)..(1007): n is a, c, g, or t
  misc_feature (1009)..(1010): n is a, c, g, or t
  misc_feature (1012)..(1013): n is a, c, g, or t
  misc_feature (1015)..(1015): n is a, c, g, or t
  misc_feature (1017)..(1021): n is a, c, g, or t
  misc_feature (1023)..(1026): n is a, c, g, or t
  misc_feature (1028)..(1032): n is a, c, g, or t
  misc_feature (1034)..(1035): n is a, c, g, or t
  misc_feature (1037)..(1042): n is a, c, g, or t
  misc_feature (1044)..(1047): n is a, c, g, or t
  misc_feature (1050)..(1052): n is a, c, g, or t
  misc_feature (1054)..(1056): n is a, c, g, or t
  misc_feature (1058)..(1061): n is a, c, g, or t
  misc_feature (1063)..(1063): n is a, c, g, or t
  misc_feature (1065)..(1068): n is a, c, g, or t
  misc_feature (1070)..(1070): n is a, c, g, or t
  misc_feature (1075)..(1080): n is a, c, g, or t
  misc_feature (1082)..(1089): n is a, c, g, or t
  misc_feature (1093)..(1094): n is a, c, g, or t
  misc_feature (1096)..(1097): n is a, c, g, or t
  misc_feature (1100)..(1104): n is a, c, g, or t
  misc_feature (1106)..(1106): n is a, c, g, or t
  misc_feature (1109)..(1111): n is a, c, g, or t
  misc_feature (1113)..(1114): n is a, c, g, or t
  misc_feature (1116)..(1117): n is a, c, g, or t
  misc_feature (1119)..(1121): n is a, c, g, or t
  misc_feature (1123)..(1124): n is a, c, g, or t
  misc_feature (1126)..(1128): n is a, c, g, or t
  misc_feature (1130)..(1132): n is a, c, g, or t
  misc_feature (1134)..(1137): n is a, c, g, or t
  misc_feature (1139)..(1145): n is a, c, g, or t
  misc_feature (1148)..(1152): n is a, c, g, or t
  misc_feature (1157)..(1159): n is a, c, g, or t
  misc_feature (1161)..(1162): n is a, c, g, or t
  misc_feature (1164)..(1165): n is a, c, g, or t
  misc_feature (1167)..(1168): n is a, c, g, or t
  misc_feature (1171)..(1172): n is a, c, g, or t
  misc_feature (1174)..(1174): n is a, c, g, or t
  misc_feature (1176)..(1178): n is a, c, g, or t
  misc_feature (1180)..(1181): n is a, c, g, or t
  misc_feature (1183)..(1183): n is a, c, g, or t
  misc_feature (1185)..(1185): n is a, c, g, or t
  misc_feature (1187)..(1188): n is a, c, g, or t
  misc_feature (1191)..(1203): n is a, c, g, or t
  misc_feature (1205)..(1209): n is a, c, g, or t
  misc_feature (1211)..(1213): n is a, c, g, or t
  misc_feature (1215)..(1216): n is a, c, g, or t
  misc_feature (1218)..(1221): n is a, c, g, or t
  misc_feature (1223)..(1223): n is a, c, g, or t
  misc_feature (1225)..(1226): n is a, c, g, or t
  misc_feature (1228)..(1228): n is a, c, g, or t
  misc_feature (1231)..(1232): n is a, c, g, or t
  misc_feature (1234)..(1234): n is a, c, g, or t
  misc_feature (1237)..(1238): n is a, c, g, or t
  misc_feature (1240)..(1240): n is a, c, g, or t
  misc_feature (1242)..(1243): n is a, c, g, or t
  misc_feature (1246)..(1246): n is a, c, g, or t
  misc_feature (1248)..(1250): n is a, c, g, or t
  misc_feature (1252)..(1252): n is a, c, g, or t
  misc_feature (1254)..(1259): n is a, c, g, or t
  misc_feature (1261)..(1274): n is a, c, g, or t
  misc_feature (1276)..(1290): n is a, c, g, or t
  misc_feature (1292)..(1292): n is a, c, g, or t
  misc_feature (1294)..(1297): n is a, c, g, or t
  misc_feature (1299)..(1299): n is a, c, g, or t
  misc_feature (1301)..(1302): n is a, c, g, or t
  misc_feature (1304)..(1312): n is a, c, g, or t
  misc_feature (1315)..(1315): n is a, c, g, or t
  misc_feature (1317)..(1325): n is a, c, g, or t
  misc_feature (1327)..(1333): n is a, c, g, or t
  misc_feature (1335)..(1340): n is a, c, g, or t
  misc_feature (1342)..(1344): n is a, c, g, or t
  misc_feature (1346)..(1348): n is a, c, g, or t
  misc_feature (1351)..(1354): n is a, c, g, or t
  misc_feature (1356)..(1358): n is a, c, g, or t
  misc_feature (1360)..(1366): n is a, c, g, or t
  misc_feature (1368)..(1379): n is a, c, g, or t
  misc_feature (1381)..(1381): n is a, c, g, or t
  misc_feature (1385)..(1392): n is a, c, g, or t
  misc_feature (1394)..(1394): n is a, c, g, or t
  misc_feature (1396)..(1401): n is a, c, g, or t
  misc_feature (1403)..(1408): n is a, c, g, or t
  misc_feature (1410)..(1412): n is a, c, g, or t
  misc_feature (1415)..(1416): n is a, c, g, or t
  misc_feature (1419)..(1419): n is a, c, g, or t
  misc_feature (1421)..(1422): n is a, c, g, or t
  misc_feature (1426)..(1427): n is a, c, g, or t
  misc_feature (1429)..(1433): n is a, c, g, or t
  misc_feature (1436)..(1436): n is a, c, g, or t
  misc_feature (1438)..(1438): n is a, c, g, or t
  misc_feature (1440)..(1440): n is a, c, g, or t
  misc_feature (1442)..(1448): n is a, c, g, or t
  misc_feature (1450)..(1452): n is a, c, g, or t
  misc_feature (1454)..(1455): n is a, c, g, or t
  misc_feature (1459)..(1460): n is a, c, g, or t
  misc_feature (1463)..(1463): n is a, c, g, or t
  misc_feature (1465)..(1468): n is a, c, g, or t
  misc_feature (1470)..(1471): n is a, c, g, or t
  misc_feature (1473)..(1473): n is a, c, g, or t
  misc_feature (1475)..(1491): n is a, c, g, or t
  misc_feature (1493)..(1494): n is a, c, g, or t
  misc_feature (1496)..(1496): n is a, c, g, or t
  misc_feature (1498)..(1499): n is a, c, g, or t
  misc_feature (1503)..(1507): n is a, c, g, or t
  misc_feature (1509)..(1509): n is a, c, g, or t
  misc_feature (1512)..(1523): n is a, c, g, or t
  misc_feature (1525)..(1527): n is a, c, g, or t
  misc_feature (1531)..(1538): n is a, c, g, or t
  misc_feature (1540)..(1540): n is a, c, g, or t
  misc_feature (1542)..(1552): n is a, c, g, or t
  misc_feature (1554)..(1559): n is a, c, g, or t
  misc_feature (1561)..(1561): n is a, c, g, or t
  misc_feature (1563)..(1565): n is a, c, g, or t
  misc_feature (1567)..(1570): n is a, c, g, or t
  misc_feature (1574)..(1576): n is a, c, g, or t
  misc_feature (1578)..(1580): n is a, c, g, or t
  misc_feature (1582)..(1582): n is a, c, g, or t
  misc_feature (1584)..(1594): n is a, c, g, or t
  misc_feature (1597)..(1598): n is a, c, g, or t
  misc_feature (1600)..(1612): n is a, c, g, or t
  misc_feature (1616)..(1619): n is a, c, g, or t
  misc_feature (1621)..(1626): n is a, c, g, or t
  misc_feature (1629)..(1631): n is a, c, g, or t
  misc_feature (1634)..(1637): n is a, c, g, or t
  misc_feature (1639)..(1650): n is a, c, g, or t
  misc_feature (1652)..(1654): n is a, c, g, or t
  misc_feature (1656)..(1660): n is a, c, g, or t
  misc_feature (1663)..(1665): n is a, c, g, or t
  misc_feature (1667)..(1673): n is a, c, g, or t
  misc_feature (1675)..(1679): n is a, c, g, or t
  misc_feature (1681)..(1687): n is a, c, g, or t
  misc_feature (1690)..(1692): n is a, c, g, or t
  misc_feature (1694)..(1694): n is a, c, g, or t
  misc_feature (1697)..(1703): n is a, c, g, or t
  misc_feature (1706)..(1706): n is a, c, g, or t
  misc_feature (1710)..(1711): n is a, c, g, or t
  misc_feature (1713)..(1713): n is a, c, g, or t
  misc_feature (1715)..(1720): n is a, c, g, or t
  misc_feature (1722)..(1728): n is a, c, g, or t
  misc_feature (1730)..(1732): n is a, c, g, or t
  misc_feature (1735)..(1736): n is a, c, g, or t
  misc_feature (1738)..(1738): n is a, c, g, or t
  misc_feature (1740)..(1742): n is a, c, g, or t
  misc_feature (1744)..(1744): n is a, c, g, or t
  misc_feature (1746)..(1746): n is a, c, g, or t
  misc_feature (1748)..(1750): n is a, c, g, or t
  misc_feature (1753)..(1756): n is a, c, g, or t
  misc_feature (1758)..(1763): n is a, c, g, or t
  misc_feature (1766)..(1767): n is a, c, g, or t
  misc_feature (1769)..(1777): n is a, c, g, or t
  misc_feature (1780)..(1781): n is a, c, g, or t
  misc_feature (1784)..(1785): n is a, c, g, or t
  misc_feature (1789)..(1789): n is a, c, g, or t
  misc_feature (1791)..(1793): n is a, c, g, or t
  misc_feature (1795)..(1796): n is a, c, g, or t
  misc_feature (1798)..(1798): n is a, c, g, or t
  misc_feature (1801)..(1802): n is a, c, g, or t
  misc_feature (1804)..(1807): n is a, c, g, or t
  misc_feature (1809)..(1811): n is a, c, g, or t
  misc_feature (1813)..(1813): n is a, c, g, or t
  misc_feature (1972)..(1972): n is a, c, g, or t
  misc_feature (1975)..(1975): n is a, c, g, or t
  misc_feature (1980)..(1980): n is a, c, g, or t
  misc_feature (1995)..(1996): n is a, c, g, or t
  misc_feature (1998)..(1999): n is a, c, g, or t
  misc_feature (2025)..(2026): n is a, c, g, or t
  misc_feature (2029)..(2029): n is a, c, g, or t
  misc_feature (2034)..(2034): n is a, c, g, or t
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaccgccccgtatgggtgcgcgccattcttcccgctcatatcatccccttgnnnnnnncnnngnnngacnnntngcnncnnnnngnnngnnnnnnnnnnncnnncnnnntntgnnnngnanannnnnngnnnnnnnnnnnnnnnncncatnnanntnacnttntnnnnnnncngcnnnnnntnnnnnngnnncgnnnnnngtcncnnanngcnnncngnnnnnannntnggtctatgagcattttctcgatggaattgcagcggcacaagcagaatatgtcgaagtcaaacggagtgatgtcatctcgctgggcggcattgacttccgagtcctcaacccagcaaacaataaccatcctgatctcaacgaaaactctgtggttttacagtttacgtatggtcagaccacctttttaatgatgggagacagcggcgcagatacnnnngcnnccnnnnngncnnnnngnntgncntnnnnngcannnnntnnnnnngnnngnnnnnnnngntnnacnnntgncncnncannngnnnnnnnannnnnngnncnncngnnnnnannnntnnnnncnncnnnnnncnnnnacnnntnnngnnnncngnnnncncagannnnnncnnnnnnnncaanngnnggnnnnncngtnnntnngnnannnannannngnnngnnnntnnnnnnngcnnnnntgaannnanntnnanncannancnnnanngntntnnccnnnnnnnnnnnnntnnnnntnnngnntnnnncncnnangcnncnagnntntnncgngnnngngnnnnnntnnnnnnnnnnnnnngnnnnnnnnnnnnnnnangnnnncntnncnnnnnnnnnatntnnnnnnnnnannnnnnncnnnnnngnnnannncannnntnnngnnnnnnnannnnnnnnnnnngngccnnnnnnnncngnnnnnngnnnnnngnnntcnnggncnngganngnnnnngcnanancnnnnnnngnnncnnggannatngnnnnanntngnnnnnnnnnnnnnnnnnanncnanncatnnnnngnaannnnnnnnnnnntnnntgannnnnnnnangnnnnnnnnnnngnnnnnntngnnngnnnngatnnncnnnanannnnnnnnnnnagnnannnnnnnnnnnnncaannnngnnnnnngannnggnnnnannnnnnnnnnnnannngnnnnngtnnncnnnnnnntnnnnnannnnnnngannntncannnnnnnaanaaannancnnnnnnannnnnnnannnttnngncnnngngntnnnctnnnnannnnnntanntnnnnnnnnncannttnntttntnnncnngntcnntnnnngnnnanttttcgcacgaccctgcttcgcagggaggttgtcttctaaagaactttgttgtcttgcgcaatcagagtacaaagactccagagccccagagtacagagcgccagagatcagagtcgtcatgatggaagaactggggagaccacaactcggaaaccgtngtncctgnacctgtagcctgggnngnnccagtagcggaaggcgcaacgcgcgnngtnggatncatcgaagaaggaaccgccgcgaagtgaacgagactctacttttttactgaggtcttccctgccatcacttgcgagatatggatagtctttatattcgctgcgcgtccattcccagacattgccgctcatgtcctgcaaaccgtaaggacttcggccctgcgggaaacaacccagggccgaagtggttccaattcctgtttctgccatattcgcaaaattcgagttgaactttccttcccaggggtattccctggcatccaaaccgcgtgaggccttctcccattcggcttcgctgggcagggtaattttcaatttgcgattgacgattaacgattgcagattatcgtctgtgtaaatagcgtcattcttgatatcgtacacctgcaacttgcaaccctggccctgagcggagccgaaggattcaacttttaactgttcttcgagccagcgcgtaaaggccagcgcttcataccaggaaacgcccacaaccggatgattggagaaattgaagggcgcaccattatcgtccggcgcgtttctggccgcatcgtcccacctgcccttaaaacctgccgcgttccaatacccagcctgttttgcttcctgccagtatttttcctgtctgtatccttcggctttcacaaactggtcaaactgcgcgttggagatgggaaagcgagagatgtgatactcaggcagtttaactttgtgttcttcctttccttcgcccatcctaaattcaccggcgggcacacagcagaaaactaatttctcgatttgcaaaacttcttcacgcgggtcgcccaggctcgccaggacgcgcccggcttcggcgcgctcgaggggaggtaacgcgtcgctgcccaaaatatttaccagtccaggcaggaggcggtttagataggcagatccgccgttgggatgtgtatcgcgctcggtgacttcctttcccaccagcgcaacgatctgccccgcccacagtcggacgcgctcgcattgttcgccctttccatttggcttgtccagttgataagcaagatccagcaattcgttttcaccacggcggttgtagtacatttcctcgaatgccatccgcgcggcaagatcccaactgtcaccttctgccgcgtggtcgtggaaggtgcgcacgcggtcacgctgtcccgcaaggaaggagccagccaggtattcctgaaaggtgcgatgcggaaaactgtacgaggtgggcctggccaattcaccgccgtagccaaccagaagcccggcgcgttgatccacgtagtccaaaaaatcggcggccaatttcacatcaccaagatgttcatctttttcgagcaaatccagcgcgtccttccgcagaagcgtacccgttccgccttgcccggcgctggcgcgatgcgcctgatatgcgagggcttccatcacggcacgcagttttaaatcgtttttgagaaattcagccagggcggcatcgcccactttatgtttttgccagcggcgcaggagcacttccacagccaggtgatataagcgcacgcgctcacgcggcaagcctacctcacgctggtggatgatcgccatcgtggtcaggagcatcgggttgctggaaagttcgcgcatatcggcttccagcgcggcgcgggacagatcgtccatgcgcgctttggtttgctcttcattgaattttccgagttcgtgctgggtgttgtaccagtgctgaataaagttgccgatctgttcttcgttgaaaggcgcgagcgtgcggctggtaaagttgggcaaaacagaatcgcccacatacgagcgcacccggcaggtgaggatcacacgctggagatgatattgtttgagcaaggcatccactgcctggcgaacgcggacgcgcaggtcatgcggaacttcgtcaaggccatccagcacgagcaggcaatgcccgctttgcagggcttcatgcaaagtaccgca

SEQ ID NO: 232 - DNA, 4000 bp, Escherichia coli
  misc_feature (289)..(289): n is a, c, g, or t
  misc_feature (1760)..(1760): n is a, c, g, or t
ttttttggacttcatttaggtcttggcatattttatagtattttattgtttatattgttgattagttatgattataaaaaataagagtttttatgaaaaatttgttgactggtggaatgattttaaaaaagacaagccattaataactggaagtgctaatgatatgatttattccatatctattttactttttgtgcttttagctgcgttttatgaccccttgtggagaccttttttacattactattttccagattcaattccattaatggattaccaaccgtacacnccttaattattcacatatcagaccgctatatatctaaacaaaaaaacccccggtaactcgagggcttacttttgggtggaagaccggattcgaaccggcgacctcctgaaccacaatcaggcgttctaaccaactgaactacaaccaccatttaatcaggcgcaaatttatattattttatctaatatttctaataaaatacttgatattaaaagttagaaaaaaaattcttaaataagatgtatttaatatttattatattcaatatcaaataattatctgtttatggatttaaactctatatctctatgtttgatgatttttttttacttattcgcaggaattagtcattttaaaaatcctaaattttttctaaaaataacaccaaaatgggtttacagacctgatttagtgaacattataattggcattattgaaataggactagcacttggtcttgttttaaaaacaacaagatcaatatctgccattggaataatattattattaataatagtatttcccgcaaacttatatcatttacaaatttcaattaaaaagaaaaaaaatataattggaacaataattcgattaccaattcagggattactaatttattgggcttatatatttatataagactttgcagatcgtttatcccaattgacttattagatgtaaaaccttcagcatgatctacatttattaacctgcctaaatcagcagatctgttgatcacgttattaataaaatttttactgctaatcaatgtttcaggctcattactatttgggtcaaaaaactgactggaatatgattttatagcattagtcttagtatcaatatgtccagaaatgtctactaaaaaatcaggaatagaatttttccactgaatgtaatgataaacgttttttggacgccactccgtttgagacaaaccgttaagtttagttacaacttttcttaaaccacttagaaagcaagcattacttactagatttgctccttttgggtggtcaatatgccgatcatcttgtgcattacacaaaactatctctggtctgtattttcttaaaatcttaattatttctagctgatgaaactcatcattaataaagaaaccatctctaaaatttaaattctctcttgtttcaactccaagtatttttgaagcagcattagattcagaatctcttgtttgaacatctcctcttgttcctaattcacctctagttaagtcaataattcctactttctttccgttgtgaatctccttggctattgtaccaccacatccaagctctacatcatcaggatgagcaccaaacgcaagtatatctaattttatatctttcatattttttcaaaagcttgattaagatcggcaataatgtctttagaatcttcaattccaactgaaaatcttaacaaaccatcaaaaatacctaaattttctctctctgcttttgtnatttttgaatgagaagttagtgaaggagaacataatgtagattctactccaccaagactcattgcagattttactaattttaattttctagtaaataatattgcagtatttaaatctgataattcaaaggatagcattccaccaaaacctctcatttgtttcttagaaagttcataatcaggatgagattttaaaccagggtaaaaaactgatttaaccttatctactttagaaagatgttctgcaacaagagcagcattttcattttgtttatttactcttagagataatgttttaatacttctctccaaaagccaaactgtatactcacttaaatttccaccataattgattgaagattcaactattttattaatatttgattgacttgaagctaatgcaccggctaatatatcactgtgtccacccagatattttgttgcactatggataactatatttataccataatctgctgggttttgattaattggactagaaaatgtattatcaattatagaaataagatcgtattttattgaaagatttgaaatagcttttagatccataactttcaaaagaggattacttggagattcaataaaaattattttagtattatctttaatttcagtctcataatcatcaattaaaaaactatctacaagactgtattcaatattaaacttgttaaattcttttataactaagtttaatgtaccaccatatattgaagattgaaaaattacatggtcacctgattttataaaactaaacaaggacgtataaattgctgctattcctgaactaaacaacagagctgattcacaattttcaagatcagcaattttttttgataaagctatttgatttggagtgttaaagtatcttggatacttatcatcctcgacgtctacaaaatcgtaagccgttgaggggaaaagtggagatgttgcacccttaaatcgatcgtcaattaattctcctgaatgaacacattttgtacttactccatttttatttttcatttaactaagttttaatccactggataaccgagggatcatctggctttgtccttggtgaaattattttttcaaggtaaccattttcattaattaaatatttttgaaaattccattttacagaggaatctttataaccatttttattcttgctagttaaaaatttatataatggatgcatgtcagatcctttaacagagattttttccatcattggaaatgatactccataatttttttcgcaaaatgctgcaatttcatcattcgaaccaggttcttgccataaaaaattatttgctggaaaaccaataattacaaaattgtctgatttatattcattatacattttttcaagaatttcatattgatatgttaaaccacacttcgaagcagtattaactaccataactttctttccttttaagctagacatgctgaaagtatttccgtttaaatcagttaatttaaattgatgaatagtttctttgacagaattagctgaaggttcctgagcattgcaagaaaacgtaaaaagtcccataaataaaaaaattaattttttcatataatatatctcacaaaactcatgccataatgatattatactatttctgctgatagaccagcttgtaataatttagtacacataggttttaaatcagagtatgaaccagattttacactacatttacctttataatgtacaattaaagaacactgttcggcttgttctaaagtatgatcacaaacacttattaaggtattaataacatgatcaaatgtgtttacatcgtcattgtaaagaatgatttcattttcatgcattaaatcagtctcagaaagatgtttttcagaaattttttcttttgttcccaaaatcactctaatttacaaaataaataacttagctattagcttttattatttcaataaaatcgtttgcatttaaagctgctcctccaataagaccaccatctacatcttttttattaaaaatttcaactgcatttgatggttttacacttcctccatataatatggatacactattagctatttctcgactaaacttttctgaaatataattcctaacaaactcgtgtatctcctgagcttgatctgctgatgctgtttctcctgttccaatggcccaaactggttcatatgctaaaacaattttgtttaaagattttgaattcaatttcatgactgtgt

SEQ ID NO: 233 - DNA, 4000 bp, Escherichia coli
  misc_feature (2)..(2): n is a, c, g, or t
  misc_feature (6)..(8): n is a, c, g, or t
  misc_feature (10)..(10): n is a, c, g, or t
  misc_feature (12)..(15): n is a, c, g, or t
  misc_feature (17)..(17): n is a, c, g, or t
  misc_feature (20)..(21): n is a, c, g, or t
  misc_feature (23)..(25): n is a, c, g, or t
  misc_feature (27)..(28): n is a, c, g, or t
  misc_feature (30)..(30): n is a, c, g, or t
  misc_feature (32)..(47): n is a, c, g, or t
  misc_feature (49)..(49): n is a, c, g, or t
  misc_feature (51)..(69): n is a, c, g, or t
  misc_feature (71)..(75): n is a, c, g, or t
  misc_feature (77)..(86): n is a, c, g, or t
  misc_feature (88)..(89): n is a, c, g, or t
  misc_feature (91)..(102): n is a, c, g, or t
  misc_feature (104)..(106): n is a, c, g, or t
  misc_feature (108)..(122): n is a, c, g, or t
  misc_feature (124)..(125): n is a, c, g, or t
  misc_feature (129)..(129): n is a, c, g, or t
  misc_feature (132)..(139): n is a, c, g, or t
  misc_feature (141)..(143): n is a, c, g, or t
  misc_feature (148)..(148): n is a, c, g, or t
  misc_feature (150)..(150): n is a, c, g, or t
  misc_feature (154)..(154): n is a, c, g, or t
  misc_feature (156)..(156): n is a, c, g, or t
  misc_feature (158)..(164): n is a, c, g, or t
  misc_feature (166)..(166): n is a, c, g, or t
  misc_feature (169)..(169): n is a, c, g, or t
  misc_feature (186)..(186): n is a, c, g, or t
  misc_feature (193)..(193): n is a, c, g, or t
  misc_feature (199)..(199): n is a, c, g, or t
  misc_feature (201)..(201): n is a, c, g, or t
  misc_feature (204)..(204): n is a, c, g, or t
  misc_feature (213)..(213): n is a, c, g, or t
  misc_feature (218)..(218): n is a, c, g, or t
  misc_feature (220)..(220): n is a, c, g, or t
  misc_feature (223)..(223): n is a, c, g, or t
  misc_feature (234)..(234): n is a, c, g, or t
  misc_feature (237)..(237): n is a, c, g, or t
  misc_feature (244)..(246): n is a, c, g, or t
  misc_feature (254)..(255): n is a, c, g, or t
  misc_feature (265)..(265): n is a, c, g, or t
  misc_feature (279)..(279): n is a, c, g, or t
  misc_feature (286)..(288): n is a, c, g, or t
  misc_feature (300)..(301): n is a, c, g, or t
  misc_feature (303)..(303): n is a, c, g, or t
  misc_feature (307)..(309): n is a, c, g, or t
  misc_feature (312)..(313): n is a, c, g, or t
  misc_feature (315)..(316): n is a, c, g, or t
  misc_feature (318)..(319): n is a, c, g, or t
  misc_feature (325)..(327): n is a, c, g, or t
  misc_feature (339)..(339): n is a, c, g, or t
  misc_feature (342)..(342): n is a, c, g, or t
  misc_feature (345)..(345): n is a, c, g, or t
  misc_feature (348)..(349): n is a, c, g, or t
  misc_feature (351)..(352): n is a, c, g, or t
  misc_feature (354)..(354): n is a, c, g, or t
  misc_feature (356)..(357): n is a, c, g, or t
  misc_feature (360)..(360): n is a, c, g, or t
  misc_feature (372)..(372): n is a, c, g, or t
  misc_feature (375)..(376): n is a, c, g, or t
  misc_feature (378)..(378): n is a, c, g, or t
  misc_feature (394)..(394): n is a, c, g, or t
  misc_feature (397)..(397): n is a, c, g, or t
  misc_feature (399)..(402): n is a, c, g, or t
  misc_feature (404)..(405): n is a, c, g, or t
  misc_feature (409)..(409): n is a, c, g, or t
  misc_feature (417)..(417): n is a, c, g, or t
  misc_feature (419)..(420): n is a, c, g, or t
  misc_feature (422)..(422): n is a, c, g, or t
  misc_feature (429)..(429): n is a, c, g, or t
  misc_feature (431)..(431): n is a, c, g, or t
  misc_feature (438)..(438): n is a, c, g, or t
  misc_feature (441)..(442): n is a, c, g, or t
  misc_feature (444)..(445): n is a, c, g, or t
  misc_feature (448)..(448): n is a, c, g, or t
  misc_feature (462)..(462): n is a, c, g, or t
  misc_feature (465)..(465): n is a, c, g, or t
  misc_feature (469)..(470): n is a, c, g, or t
  misc_feature (474)..(474): n is a, c, g, or t
  misc_feature (480)..(480): n is a, c, g, or t
  misc_feature (484)..(484): n is a, c, g, or t
  misc_feature (486)..(486): n is a, c, g, or t
  misc_feature (490)..(490): n is a, c, g, or t
  misc_feature (498)..(498): n is a, c, g, or t
  misc_feature (522)..(522): n is a, c, g, or t
  misc_feature (528)..(528): n is a, c, g, or t
  misc_feature (540)..(540): n is a, c, g, or t
  misc_feature (559)..(559): n is a, c, g, or t
  misc_feature (589)..(589): n is a, c, g, or t
  misc_feature (604)..(604): n is a, c, g, or t
  misc_feature (649)..(649): n is a, c, g, or t
  misc_feature (679)..(679): n is a, c, g, or t
  misc_feature (730)..(730): n is a, c, g, or t
  misc_feature (855)..(855): n is a, c, g, or t
  misc_feature (870)..(870): n is a, c, g, or t
  misc_feature (925)..(925): n is a, c, g, or t
  misc_feature (927)..(927): n is a, c, g, or t
  misc_feature (1049)..(1049): n is a, c, g, or t
  misc_feature (1177)..(1177): n is a, c, g, or t
  misc_feature (1815)..(1815): n is a, c, g, or t
  misc_feature (1829)..(1829): n is a, c, g, or t
  misc_feature (1881)..(1881): n is a, c, g, or t
  misc_feature (1930)..(1930): n is a, c, g, or t
  misc_feature (1939)..(1940): n is a, c, g, or t
  misc_feature (1951)..(1951): n is a, c, g, or t
  misc_feature (1957)..(1957): n is a, c, g, or t
  misc_feature (1966)..(1966): n is a, c, g, or t
  misc_feature (1972)..(1972): n is a, c, g, or t
  misc_feature (1979)..(1979): n is a, c, g, or t
  misc_feature (1981)..(1982): n is a, c, g, or t
  misc_feature (1984)..(1985): n is a, c, g, or t
  misc_feature (1987)..(1987): n is a, c, g, or t
  misc_feature (1996)..(1996): n is a, c, g, or t
  misc_feature (2002)..(2003): n is a, c, g, or t
  misc_feature (2013)..(2013): n is a, c, g, or t
  misc_feature (2196)..(2196): n is a, c, g, or t
  misc_feature (2203)..(2203): n is a, c, g, or t
  misc_feature (2206)..(2206): n is a, c, g, or t
  misc_feature (2208)..(2216): n is a, c, g, or t
  misc_feature (2218)..(2218): n is a, c, g, or t
  misc_feature (2220)..(2221): n is a, c, g, or t
  misc_feature (2223)..(2225): n is a, c, g, or t
  misc_feature (2228)..(2228): n is a, c, g, or t
  misc_feature (2230)..(2232): n is a, c, g, or t
  misc_feature (2235)..(2238): n is a, c, g, or t
  misc_feature (2240)..(2241): n is a, c, g, or t
  misc_feature (2244)..(2244): n is a, c, g, or t
  misc_feature (2249)..(2249): n is a, c, g, or t
  misc_feature (2251)..(2252): n is a, c, g, or t
  misc_feature (2254)..(2257): n is a, c, g, or t
  misc_feature (2262)..(2262): n is a, c, g, or t
  misc_feature (2264)..(2265): n is a, c, g, or t
  misc_feature (2267)..(2267): n is a, c, g, or t
  misc_feature (2270)..(2273): n is a, c, g, or t
  misc_feature (2275)..(2282): n is a, c, g, or t
  misc_feature (2285)..(2285): n is a, c, g, or t
  misc_feature (2287)..(2292): n is a, c, g, or t
  misc_feature (2294)..(2298): n is a, c, g, or t
  misc_feature (2300)..(2300): n is a, c, g, or t
  misc_feature (2302)..(2302): n is a, c, g, or t
  misc_feature (2304)..(2304): n is a, c, g, or t
  misc_feature (2306)..(2310): n is a, c, g, or t
  misc_feature (2312)..(2313): n is a, c, g, or t
  misc_feature (2315)..(2316): n is a, c, g, or t
  misc_feature (2319)..(2324): n is a, c, g, or t
  misc_feature (2326)..(2326): n is a, c, g, or t
  misc_feature (2331)..(2331): n is a, c, g, or t
  misc_feature (2334)..(2337): n is a, c, g, or t
  misc_feature (2339)..(2344): n is a, c, g, or t
  misc_feature (2346)..(2351): n is a, c, g, or t
  misc_feature (2355)..(2355): n is a, c, g, or t
  misc_feature (2357)..(2362): n is a, c, g, or t
  misc_feature (2365)..(2365): n is a, c, g, or t
  misc_feature (2367)..(2380): n is a, c, g, or t
  misc_feature (2384)..(2386): n is a, c, g, or t
  misc_feature (2388)..(2389): n is a, c, g, or t
  misc_feature (2391)..(2393): n is a, c, g, or t
  misc_feature (2395)..(2398): n is a, c, g, or t
  misc_feature (2400)..(2405): n is a, c, g, or t
  misc_feature (2408)..(2412): n is a, c, g, or t
  misc_feature (2414)..(2417): n is a, c, g, or t
  misc_feature (2419)..(2419): n is a, c, g, or t
  misc_feature (2421)..(2421): n is a, c, g, or t
  misc_feature (2423)..(2430): n is a, c, g, or t
  misc_feature (2433)..(2433): n is a, c, g, or t
  misc_feature (2435)..(2438): n is a, c, g, or t
  misc_feature (2440)..(2442): n is a, c, g, or t
  misc_feature (2444)..(2447): n is a, c, g, or t
  misc_feature (2449)..(2451): n is a, c, g, or t
  misc_feature (2453)..(2456): n is a, c, g, or t
  misc_feature (2458)..(2463): n is a, c, g, or t
  misc_feature (2470)..(2475): n is a, c, g, or t
  misc_feature (2477)..(2481): n is a, c, g, or t
  misc_feature (2483)..(2483): n is a, c, g, or t
  misc_feature (2485)..(2485): n is a, c, g, or t
  misc_feature (2488)..(2489): n is a, c, g, or t
  misc_feature (2491)..(2491): n is a, c, g, or t
  misc_feature (2494)..(2494): n is a, c, g, or t
  misc_feature (2497)..(2497): n is a, c, g, or t
  misc_feature (2499)..(2499): n is a, c, g, or t
  misc_feature (2503)..(2505): n is a, c, g, or t
  misc_feature (2507)..(2507): n is a, c, g, or t
  misc_feature (2509)..(2510): n is a, c, g, or t
  misc_feature (2512)..(2516): n is a, c, g, or t
  misc_feature (2519)..(2524): n is a, c, g, or t
  misc_feature (2526)..(2527): n is a, c, g, or t
  misc_feature (2529)..(2529): n is a, c, g, or t
  misc_feature (2532)..(2532): n is a, c, g, or t
  misc_feature (2534)..(2535): n is a, c, g, or t
  misc_feature (2537)..(2540): n is a, c, g, or t
  misc_feature (2543)..(2544): n is a, c, g, or t
  misc_feature (2546)..(2546): n is a, c, g, or t
  misc_feature (2548)..(2551): n is a, c, g, or t
  misc_feature (2553)..(2556): n is a, c, g, or t
  misc_feature (2558)..(2558): n is a, c, g, or t
  misc_feature (2561)..(2561): n is a, c, g, or t
  misc_feature (2563)..(2563): n is a, c, g, or t
  misc_feature (2565)..(2566): n is a, c, g, or t
  misc_feature (2569)..(2571): n is a, c, g, or t
  misc_feature (2573)..(2573): n is a, c, g, or t
  misc_feature (2576)..(2576): n is a, c, g, or t
  misc_feature (2578)..(2581): n is a, c, g, or t
  misc_feature (2583)..(2585): n is a, c, g, or t
  misc_feature (2589)..(2592): n is a, c, g, or t
  misc_feature (2596)..(2601): n is a, c, g, or t
  misc_feature (2603)..(2603): n is a, c, g, or t
  misc_feature (2607)..(2610): n is a, c, g, or t
  misc_feature (2615)..(2615): n is a, c, g, or t
  misc_feature (2617)..(2619): n is a, c, g, or t
  misc_feature (2621)..(2621): n is a, c, g, or t
  misc_feature (2625)..(2627): n is a, c, g, or t
  misc_feature (2629)..(2629): n is a, c, g, or t
  misc_feature (2631)..(2631): n is a, c, g, or t
  misc_feature (2634)..(2635): n is a, c, g, or t
  misc_feature (2638)..(2641): n is a, c, g, or t
  misc_feature (2643)..(2658): n is a, c, g, or t
  misc_feature (2660)..(2660): n is a, c, g, or t
  misc_feature (2662)..(2662): n is a, c, g, or t
  misc_feature (2665)..(2684): n is a, c, g, or t
  misc_feature (2686)..(2692): n is a, c, g, or t
  misc_feature (2697)..(2697): n is a, c, g, or t
  misc_feature (2699)..(2704): n is a, c, g, or t
  misc_feature (2706)..(2711): n is a, c, g, or t
  misc_feature (2713)..(2721): n is a, c, g, or t
  misc_feature (2723)..(2725): n is a, c, g, or t
  misc_feature (2728)..(2730): n is a, c, g, or t
  misc_feature (2732)..(2737): n is a, c, g, or t
  misc_feature (2739)..(2745): n is a, c, g, or t
  misc_feature (2747)..(2753): n is a, c, g, or t
  misc_feature (2755)..(2757): n is a, c, g, or t
  misc_feature (2759)..(2765): n is a, c, g, or t
  misc_feature (2767)..(2768): n is a, c, g, or t
  misc_feature (2770)..(2770): n is a, c, g, or t
  misc_feature (2772)..(2775): n is a, c, g, or t
  misc_feature (2777)..(2780): n is a, c, g, or t
  misc_feature (2782)..(2790): n is a, c, g, or t
  misc_feature (2794)..(2794): n is a, c, g, or t
  misc_feature (2796)..(2796): n is a, c, g, or t
  misc_feature (2799)..(2801): n is a, c, g, or t
  misc_feature (2803)..(2806): n is a, c, g, or t
  misc_feature (2809)..(2815): n is a, c, g, or t
  misc_feature (2817)..(2817): n is a, c, g, or t
  misc_feature (2822)..(2822): n is a, c, g, or t
  misc_feature (2825)..(2833): n is a, c, g, or t
  misc_feature (2835)..(2838): n is a, c, g, or t
  misc_feature (2840)..(2844): n is a, c, g, or t
  misc_feature (2846)..(2846): n is a, c, g, or t
  misc_feature (2849)..(2853): n is a, c, g, or t
  misc_feature (2856)..(2860): n is a, c, g, or t
  misc_feature (2862)..(2864): n is a, c, g, or t
  misc_feature (2868)..(2880): n is a, c, g, or t
  misc_feature (2882)..(2888): n is a, c, g, or t
  misc_feature (2890)..(2894): n is a, c, g, or t
  misc_feature (2896)..(2896): n is a, c, g, or t
  misc_feature (2900)..(2900): n is a, c, g, or t
  misc_feature (2902)..(2910): n is a, c, g, or t
  misc_feature (2912)..(2912): n is a, c, g, or t
  misc_feature (2914)..(2916): n is a, c, g, or t
  misc_feature (2919)..(2919): n is a, c, g, or t
  misc_feature (2921)..(2922): n is a, c, g, or t
  misc_feature (2924)..(2932): n is a, c, g, or t
  misc_feature (2934)..(2934): n is a, c, g, or t
  misc_feature (2937)..(2939): n is a, c, g, or t
  misc_feature (2941)..(2944): n is a, c, g, or t
  misc_feature (2946)..(2946): n is a, c, g, or t
  misc_feature (2948)..(2948): n is a, c, g, or t
  misc_feature (2950)..(2950): n is a, c, g, or t
  misc_feature (2952)..(2953): n is a, c, g, or t
  misc_feature (2957)..(2963): n is a, c, g, or t
  misc_feature (2967)..(2968): n is a, c, g, or t
  misc_feature (2970)..(2973): n is a, c, g, or t
  misc_feature (2975)..(2977): n is a, c, g, or t
  misc_feature (2979)..(2982): n is a, c, g, or t
  misc_feature (2985)..(2986): n is a, c, g, or t
  misc_feature (2988)..(2995): n is a, c, g, or t
  misc_feature (2997)..(2999): n is a, c, g, or t
  misc_feature (3002)..(3003): n is a, c, g, or t
  misc_feature (3006)..(3010): n is a, c, g, or t
  misc_feature (3012)..(3014): n is a, c, g, or t
  misc_feature (3016)..(3016): n is a, c, g, or t
  misc_feature (3018)..(3019): n is a, c, g, or t
  misc_feature (3021)..(3025): n is a, c, g, or t
  misc_feature (3027)..(3027): n is a, c, g, or t
  misc_feature (3029)..(3030): n is a, c, g, or t
  misc_feature (3032)..(3032): n is a, c, g, or t
  misc_feature (3034)..(3034): n is a, c, g, or t
  misc_feature (3036)..(3036): n is a, c, g, or t
  misc_feature (3038)..(3038): n is a, c, g, or t
  misc_feature (3040)..(3040): n is a, c, g, or t
  misc_feature (3042)..(3049): n is a, c, g, or t
  misc_feature (3053)..(3056): n is a, c, g, or t
  misc_feature (3058)..(3060): n is a, c, g, or t
  misc_feature (3063)..(3073): n is a, c, g, or t
  misc_feature (3075)..(3075): n is a, c, g, or t
  misc_feature (3078)..(3079): n is a, c, g, or t
  misc_feature (3081)..(3082): n is a, c, g, or t
  misc_feature (3084)..(3085): n is a, c, g, or t
  misc_feature (3087)..(3093): n is a, c, g, or t
  misc_feature (3097)..(3097): n is a, c, g, or t
  misc_feature (3099)..(3103): n is a, c, g, or t
  misc_feature (3105)..(3110): n is a, c, g, or t
  misc_feature (3112)..(3112): n is a, c, g, or t
  misc_feature (3117)..(3117): n is a, c, g, or t
  misc_feature (3119)..(3120): n is a, c, g, or t
  misc_feature (3122)..(3122): n is a, c, g, or t
  misc_feature (3124)..(3124): n is a, c, g, or t
  misc_feature (3127)..(3127): n is a, c, g, or t
  misc_feature (3130)..(3131): n is a, c, g, or t
  misc_feature (3133)..(3137): n is a, c, g, or t
  misc_feature (3139)..(3147): n is a, c, g, or t
  misc_feature (3150)..(3151): n is a, c, g, or t
  misc_feature (3154)..(3156): n is a, c, g, or t
  misc_feature (3158)..(3158): n is a, c, g, or t
  misc_feature (3162)..(3164): n is a, c, g, or t
  misc_feature (3166)..(3168): n is a, c, g, or t
  misc_feature (3170)..(3171): n is a, c, g, or t
  misc_feature (3175)..(3180): n is a, c, g, or t
  misc_feature (3182)..(3184): n is a, c, g, or t
  misc_feature (3187)..(3196): n is a, c, g, or t
  misc_feature (3198)..(3202): n is a, c, g, or t
  misc_feature (3206)..(3207): n is a, c, g, or t
  misc_feature (3209)..(3215): n is a, c, g, or t
  misc_feature (3217)..(3217): n is a, c, g, or t
  misc_feature (3221)..(3223): n is a, c, g, or t
  misc_feature (3225)..(3255): n is a, c, g, or t
  misc_feature (3257)..(3257): n is a, c, g, or t
  misc_feature (3260)..(3264): n is a, c, g, or t
  misc_feature (3267)..(3268): n is a, c, g, or t
  misc_feature (3270)..(3270): n is a, c, g, or t
  misc_feature (3272)..(3273): n is a, c, g, or t
  misc_feature (3275)..(3275): n is a, c, g, or t
  misc_feature (3278)..(3283): n is a, c, g, or t
  misc_feature (3286)..(3288): n is a, c, g, or t
  misc_feature (3290)..(3291): n is a, c, g, or t
  misc_feature (3293)..(3293): n is a, c, g, or t
  misc_feature (3295)..(3295): n is a, c, g, or t
  misc_feature (3298)..(3300): n is a, c, g, or t
  misc_feature (3302)..(3305): n is a, c, g, or t
  misc_feature (3307)..(3308): n is a, c, g, or t
  misc_feature (3310)..(3310): n is a, c, g, or t
  misc_feature (3312)..(3312): n is a, c, g, or t
  misc_feature (3314)..(3315): n is a, c, g, or t
  misc_feature (3317)..(3317): n is a, c, g, or t
  misc_feature (3321)..(3325): n is a, c, g, or t
  misc_feature (3328)..(3333): n is a, c, g, or t
  misc_feature (3336)..(3336): n is a, c, g, or t
  misc_feature (3338)..(3349): n is a, c, g, or t
  misc_feature (3351)..(3353): n is a, c, g, or t
  misc_feature (3356)..(3356): n is a, c, g, or t
  misc_feature (3358)..(3359): n is a, c, g, or t
  misc_feature (3361)..(3373): n is a, c, g, or t
  misc_feature (3375)..(3381): n is a, c, g, or t
  misc_feature (3383)..(3383): n is a, c, g, or t
  misc_feature (3386)..(3388): n is a, c, g, or t
  misc_feature (3390)..(3394): n is a, c, g, or t
  misc_feature (3396)..(3398): n is a, c, g, or t
  misc_feature (3400)..(3407): n is a, c, g, or t
  misc_feature (3409)..(3410): n is a, c, g, or t
  misc_feature (3413)..(3417): n is a, c, g, or t
  misc_feature (3419)..(3419): n is a, c, g, or t
  misc_feature (3421)..(3424): n is a, c, g, or t
  misc_feature (3426)..(3427): n is a, c, g, or t
  misc_feature (3430)..(3435): n is a, c, g, or t
  misc_feature (3438)..(3439): n is a, c, g, or t
  misc_feature (3441)..(3443): n is a, c, g, or t
  misc_feature (3445)..(3445): n is a, c, g, or t
  misc_feature (3447)..(3451): n is a, c, g, or t
  misc_feature (3455)..(3457): n is a, c, g, or t
  misc_feature (3459)..(3462): n is a, c, g, or t
  misc_feature (3464)..(3468): n is a, c, g, or t
  misc_feature (3470)..(3471): n is a, c, g, or t
  misc_feature (3473)..(3475): n is a, c, g, or t
  misc_feature (3479)..(3482): n is a, c, g, or t
  misc_feature (3484)..(3487): n is a, c, g, or t
  misc_feature (3490)..(3492): n is a, c, g, or t
  misc_feature (3494)..(3495): n is a, c, g, or t
  misc_feature (3497)..(3498): n is a, c, g, or t
  misc_feature (3501)..(3502): n is a, c, g, or t
  misc_feature (3504)..(3504): n is a, c, g, or t
  misc_feature (3506)..(3506): n is a, c, g, or t
  misc_feature (3508)..(3512): n is a, c, g, or t
  misc_feature (3515)..(3515): n is a, c, g, or t
  misc_feature (3518)..(3519): n is a, c, g, or t
  misc_feature (3521)..(3526): n is a, c, g, or t
  misc_feature (3528)..(3535): n is a, c, g, or t
  misc_feature (3537)..(3548): n is a, c, g, or t
  misc_feature (3550)..(3551): n is a, c, g, or t
  misc_feature (3553)..(3553): n is a, c, g, or t
  misc_feature (3555)..(3559): n is a, c, g, or t
  misc_feature (3561)..(3562): n is a, c, g, or t
  misc_feature (3564)..(3565): n is a, c, g, or t
  misc_feature (3567)..(3567): n is a, c, g, or t
  misc_feature (3569)..(3570): n is a, c, g, or t
  misc_feature (3573)..(3581): n is a, c, g, or t
  misc_feature (3583)..(3584): n is a, c, g, or t
  misc_feature (3586)..(3592): n is a, c, g, or t
  misc_feature (3594)..(3595): n is a, c, g, or t
  misc_feature (3597)..(3602): n is a, c, g, or t
  misc_feature (3604)..(3604): n is a, c, g, or t
  misc_feature (3606)..(3607): n is a, c, g, or t
  misc_feature (3609)..(3610): n is a, c, g, or t
  misc_feature (3612)..(3612): n is a, c, g, or t
  misc_feature (3614)..(3614): n is a, c, g, or t
  misc_feature (3616)..(3616): n is a, c, g, or t
  misc_feature (3619)..(3619): n is a, c, g, or t
  misc_feature (3622)..(3624): n is a, c, g, or t
  misc_feature (3626)..(3633): n is a, c, g, or t
  misc_feature (3635)..(3637): n is a, c, g, or t
  misc_feature (3639)..(3641): n is a, c, g, or t
  misc_feature (3643)..(3647): n is a, c, g, or t
  misc_feature (3650)..(3652): n is a, c, g, or t
  misc_feature (3654)..(3659): n is a, c, g, or t
  misc_feature (3663)..(3664): n is a, c, g, or t
  misc_feature (3668)..(3673): n is a, c, g, or t
  misc_feature (3676)..(3676): n is a, c, g, or t
  misc_feature (3678)..(3679): n is a, c, g, or t
  misc_feature (3681)..(3682): n is a, c, g, or t
  misc_feature (3684)..(3685): n is a, c, g, or t
  misc_feature (3687)..(3687): n is a, c, g, or t
  misc_feature (3689)..(3690): n is a, c, g, or t
  misc_feature (3692)..(3696): n is a, c, g, or t
  misc_feature (3698)..(3699): n is a, c, g, or t
  misc_feature (3701)..(3701): n is a, c, g, or t
  misc_feature (3705)..(3708): n is a, c, g, or t
  misc_feature (3711)..(3713): n is a, c, g, or t
  misc_feature (3715)..(3716): n is a, c, g, or t
  misc_feature (3718)..(3721): n is a, c, g, or t
  misc_feature (3723)..(3724): n is a, c, g, or t
  misc_feature (3728)..(3732): n is a, c, g, or t
  misc_feature (3734)..(3738): n is a, c, g, or t
  misc_feature (3741)..(3744): n is a, c, g, or t
  misc_feature (3746)..(3746): n is a, c, g, or t
  misc_feature (3748)..(3764): n is a, c, g, or t
  misc_feature (3767)..(3769): n is a, c, g, or t
  misc_feature (3772)..(3774): n is a, c, g, or t
  misc_feature (3776)..(3778): n is a, c, g, or t
  misc_feature (3780)..(3793): n is a, c, g, or t
  misc_feature (3796)..(3798): n is a, c, g, or t
  misc_feature (3800)..(3800): n is a, c, g, or t
  misc_feature (3802)..(3802): n is a, c, g, or t
  misc_feature (3804)..(3808): n is a, c, g, or t
  misc_feature (3810)..(3811): n is a, c, g, or t
  misc_feature (3814)..(3814): n is a, c, g, or t
  misc_feature (3817)..(3819): n is a, c, g, or t
  misc_feature (3821)..(3825): n is a, c, g, or t
  misc_feature (3827)..(3829): n is a, c, g, or t
  misc_feature (3831)..(3832): n is a, c, g, or t
  misc_feature (3834)..(3834): n is a, c, g, or t
  misc_feature (3836)..(3836): n is a, c, g, or t
  misc_feature (3838)..(3841): n is a, c, g, or t
  misc_feature (3843)..(3845): n is a, c, g, or t
  misc_feature (3847)..(3847): n is a, c, g, or t
  misc_feature (3849)..(3858): n is a, c, g, or t
  misc_feature (3860)..(3865): n is a, c, g, or t
  misc_feature (3867)..(3867): n is a, c, g, or t
  misc_feature (3869)..(3875): n is a, c, g, or t
  misc_feature (3877)..(3879): n is a, c, g, or t
  misc_feature (3882)..(3882): n is a, c, g, or t
  misc_feature (3884)..(3901): n is a, c, g, or t
  misc_feature (3904)..(3906): n is a, c, g, or t
  misc_feature (3908)..(3912): n is a, c, g, or t
  misc_feature (3914)..(3916): n is a, c, g, or t
  misc_feature (3918)..(3924): n is a, c, g, or t
  misc_feature (3926)..(3929): n is a, c, g, or t
  misc_feature (3931)..(3935): n is a, c, g, or t
  misc_feature (3937)..(3939): n is a, c, g, or t
  misc_feature (3941)..(3941): n is a, c, g, or t
  misc_feature (3943)..(3946): n is a, c, g, or t
  misc_feature (3948)..(3948): n is a, c, g, or t
  misc_feature (3950)..(3955): n is a, c, g, or t
  misc_feature (3957)..(3964): n is a, c, g, or t
  misc_feature (3967)..(3967): n is a, c, g, or t
  misc_feature (3969)..(3971): n is a, c, g, or t
  misc_feature (3973)..(3974): n is a, c, g, or t
  misc_feature (3977)..(3985): n is a, c, g, or t
  misc_feature (3989)..(3997): n is a, c, g, or t
  misc_feature (3999)..(3999): n is a, c, g, or t
tntttnnngngnnnntntgnngnnncnnanannnnnnnnnnnnnnnngngnnnnnnnnnnnnnnnnnnnannnnngnnnnnnnnnngnncnnnnnnnnnnnntnnngnnnnnnnnnnnnnnnannatanaannnnnnnngnnnatatntntgtntntnnnnnnnanaanattgaattatcatggantatatgnaacatncnaanttttatgcnatgtntnatnaaattagaaanaangaagctnnngaattacnnttagcattgnaagctcatggtggngaatttnnntggattgatgannanaacnnngannannanntatatnnnccgcctataatnttngtnaanntnnangnnggncctatggatgtngtnntncataaggtatggttgnatnannnntnnattnaattatcngnntntgataangnatggggnaannanntanatattgaattgganganattnntccnggacancttncntatnttattgantacatgcctgttacagacaaggtnaaatcngtggcaataaangatgattaatatggggcanaaaaagacgattgattattggagacacccnaccaaaagggaaatnaagttcggtgagggagctattcattggttaacagtggatattganaaagttcagaagccagacggaagtttgaanaaatggtttattcatacagacggactaaggtacaatcgaccatagttaaantgatgtctgtaaagcaaaggctgttctaacaaaatagagcagccttttgtgttaaacaatggttaaagtggacaactattcacaccatataaaactataaaatctattcacattaaaacagtaanaaatatgccattganaattgagaatatcaagttggcaggaaccaaatttgatggtcgcgctaagttgtcncnagaacaacgccaggctattcagattttggcccgtgaaggatatagccaaagaagactggccgctatgttcaatgttagtaagcggcttatacaatctatactatctcctcctgttcgcaagnactctaaacaatatccaacagaatattggacagagttaaaacggaagtatcgaaaaaagaaaattgatttatataaaaatggaaagatcaagtttaataacaagttgaaaaataaatgaaacgcaagngtatcaagtatgtagctaacattgattttggctatcgttcaattactgatgcaaagcaacatataaaaatattcttgaaatcgcttctttcgcaaataggtttacacccaggaatagactatatcgtaacagctaatcatttgcgaattagacatgtgaaaaatattacaggaaaaataaccaccacacttaaagagatattcccagtattcaatttttattggaagactccaaggctattggtgtggttctaaaatcaatattaataataatttacaagtatggaaaagtattctatttcggttttaggagccgacaagaaacagtatgaaatcgcagatttcagagcaagaggtatgaattatactaatgctattggcattatcgtaacaacagaatttatgagccgtattttggcgtttgacacttggcaagaacaatggggaaatactgataggatcttaacggaagagcagaatgaatccgttgctatgcaaactttctccggacttgatctaaccaaacgtattgtagaagcacaaactgatattgatggaatgactgccgccaaacgctgctggaactatcaaaaaggtggcctccagtggtatttgccttgtttgatggagctaggagtnctttgcgcatatcntgatgagataaacaaagcaatgaaagaaattggatgtcccgatgaatgtttncttcctacagaagattctgatgaaacctgggtctggagtagcagtgagngcagtcagnncggcagctggnacgtgnactttagtnatggcnacttcancnncnncngcaagtacnacagtnncatggtgagngcggttgcagcatttcagccttcgccgagcctgttgacaggcgaggcaaaaagtaacgattgtctgcatagtgacgaagctcttataaacatgttacgtgaacgtggttataaaggcgaattgactaagaccttgactatttaatattatcgccacccatatttgatatggtatgggtggcanaatattnttnannnnnnnnnananntnnnaanannntannnnannatncacananngnnnngtgtntnngngannnntnnnnnnnnatntnnnnnnannnnntntntntnnnnnanncnnttnnnnnntntatanaannnntnnnnnntnnnnnnaaanannnnnnttntnnnnnnnnnnnnnnagannngnnannntnnnnannnnnnagnnnnnannnnananannnnnnnnaanannnntnnnannnncnnnannnntnnnnnnatataannnnnnannnnnananatnntnttntananatannngngnngnnnnnatnnnnnncnntnaananngnnnngannanannnntnnnnanatntncnnctnnntntcntnnnntnnngaannnnacannnnnntntctnnnnttttntnnnanaaannngngngtnnaannnnannnnnnnnnnnnnnnncncnaannnnnnnnnnnnnnnnnnnngnnnnnnngtgcncnnnnnnannnnnnannnnnnnnngnnnctnnnannnnnntnnnnnnnannnnnnncnnngnnnnnnntnnanannnngnnnntnnnnnnnnnatananaannntnnnnttnnnnnnnanaaaanatnnnnnnnnntnnnngnnnnntnttnnnnnaannnnnannntatnnnnnnnnnnnnngnnnnnnntnnnnnanaaanannnnnnnnntntnnnaananncnnnnnnnnnanaannngnnnntntntntnnagannnnnnngcgnnannnntnnnannnnatnngnnnnnnnngnnnacnngannnnnannntntnnannnnnananntntntntntntnnnnnnnnagannnntnnnatnnnnnnnnnnnanatnntnnannannnnnnnaaanannnnnannnnnntntatananntntnttntgnngnnnnngnnnnnnnnncannggnnnanaaannncnnntnnagannnnnnannntgnnnnnnnnnnannnnntgtnnannnnnnnanaaannngnnnnnnnnnnnnnnnnnnnnnnnnnnnnnnncnctnnnnnttnnanannanatnnnnnnacnnnanntntntcnnntnnnntnncncntnnanaaannnnnagnnnnnnatncnnnnnnnnnnnnannnttntnngnnnnnnnnnnnnntnnnnnnntntcnnnannnnnannngnnnnnnnncnngannnnnanannnnannacnnnnnnagnncnnntntnnnnntatnnngnnnntnnnnncnnannntatnnnnannnngannntnnannagnntntntnnnnnggnganntnnnnnngnnnnnnnnannnnnnnnnnnngnnanannnnnanntnntntnngannnnnnnnnanngnnnnnnntnntnnnnnnananntnngnananaanatnnnannnnnnnnannntnnngnnnnnacnnntnnnnnnaganntttnnnnnnatntnngnnanngngnntnnnnntnntntttnnnnagnnnanncnnnntnnaaannnnnannnnnaannnnanannnnnnnnnnnnnnnnngannngtnnnannntnnnnnnnnnnnnnnaannntntntnnnnncnnaanacnnntnnnnnannntnntntntnnnnannntntnnnnnnnnnntnnnnnntntnnnnnnngnnnaanannnnnnnnnnnnnnnnnntannncnnnnngnnnannnnnnnannnnannnnncnnngngnnnngngnnnnnntnnnnnnnnatntnnncnnaannnnnnnnnggtnnnnnnnnnana

SEQ ID NO: 234 - DNA, 4000 bp, Escherichia coli
  misc_feature (1)..(21): n is a, c, g, or t
  misc_feature (23)..(83): n is a, c, g, or t
  misc_feature (85)..(115): n is a, c, g, or t
  misc_feature (117)..(118): n is a, c, g, or t
  misc_feature (120)..(120): n is a, c, g, or t
  misc_feature (122)..(122): n is a, c, g, or t
  misc_feature (125)..(147): n is a, c, g, or t
  misc_feature (150)..(163): n is a, c, g, or t
  misc_feature (165)..(171): n is a, c, g, or t
  misc_feature (173)..(176): n is a, c, g, or t
  misc_feature (178)..(180): n is a, c, g, or t
  misc_feature (182)..(187): n is a, c, g, or t
  misc_feature (189)..(206): n is a, c, g, or t
  misc_feature (208)..(219): n is a, c, g, or t
  misc_feature (221)..(222): n is a, c, g, or t
  misc_feature (225)..(227): n is a, c, g, or t
  misc_feature (229)..(230): n is a, c, g, or t
  misc_feature (232)..(233): n is a, c, g, or t
  misc_feature (235)..(238): n is a, c, g, or t
  misc_feature (240)..(248): n is a, c, g, or t
  misc_feature (251)..(255): n is a, c, g, or t
  misc_feature (257)..(258): n is a, c, g, or t
  misc_feature (260)..(263): n is a, c, g, or t
  misc_feature (266)..(269): n is a, c, g, or t
  misc_feature (271)..(272): n is a, c, g, or t
  misc_feature (274)..(274): n is a, c, g, or t
  misc_feature (277)..(277): n is a, c, g, or t
  misc_feature (279)..(279): n is a, c, g, or t
  misc_feature (282)..(282): n is a, c, g, or t
  misc_feature (284)..(284): n is a, c, g, or t
  misc_feature (286)..(289): n is a, c, g, or t
  misc_feature (291)..(291): n is a, c, g, or t
  misc_feature (293)..(295): n is a, c, g, or t
  misc_feature (297)..(297): n is a, c, g, or t
  misc_feature (299)..(302): n is a, c, g, or t
  misc_feature (304)..(305): n is a, c, g, or t
  misc_feature (307)..(308): n is a, c, g, or t
  misc_feature (310)..(323): n is a, c, g, or t
  misc_feature (325)..(329): n is a, c, g, or t
  misc_feature (333)..(333): n is a, c, g, or t
  misc_feature (336)..(337): n is a, c, g, or t
  misc_feature (339)..(339): n is a, c, g, or t
  misc_feature (341)..(347): n is a, c, g, or t
  misc_feature (349)..(349): n is a, c, g, or t
  misc_feature (352)..(357): n is a, c, g, or t
  misc_feature (359)..(364): n is a, c, g, or t
  misc_feature (366)..(366): n is a, c, g, or t
  misc_feature (369)..(369): n is a, c, g, or t
  misc_feature (372)..(378): n is a, c, g, or t
  misc_feature (380)..(380): n is a, c, g, or t
  misc_feature (382)..(388): n is a, c, g, or t
  misc_feature (390)..(393): n is a, c, g, or t
  misc_feature (395)..(395): n is a, c, g, or t
  misc_feature (397)..(414): n is a, c, g, or t
  misc_feature (416)..(416): n is a, c, g, or t
  misc_feature (418)..(424): n is a, c, g, or t
  misc_feature (426)..(430): n is a, c, g, or t
  misc_feature (433)..(448): n is a, c, g, or t
  misc_feature (450)..(450): n is a, c, g, or t
  misc_feature (452)..(453): n is a, c, g, or t
  misc_feature (455)..(458): n is a, c, g, or t
  misc_feature (461)..(469): n is a, c, g, or t
  misc_feature (471)..(471): n is a, c, g, or t
  misc_feature (473)..(481): n is a, c, g, or t
  misc_feature (483)..(495): n is a, c, g, or t
  misc_feature (497)..(500): n is a, c, g, or t
  misc_feature (502)..(504): n is a, c, g, or t
  misc_feature (511)..(519): n is a, c, g, or t
  misc_feature (521)..(527): n is a, c, g, or t
  misc_feature (530)..(531): n is a, c, g, or t
  misc_feature (533)..(534): n is a, c, g, or t
  misc_feature (537)..(542): n is a, c, g, or t
  misc_feature (545)..(546): n is a, c, g, or t
  misc_feature (549)..(555): n is a, c, g, or t
  misc_feature (557)..(557): n is a, c, g, or t
  misc_feature (559)..(568): n is a, c, g, or t
  misc_feature (570)..(572): n is a, c, g, or t
  misc_feature (574)..(575): n is a, c, g, or t
  misc_feature (577)..(579): n is a, c, g, or t
  misc_feature (581)..(584): n is a, c, g, or t
  misc_feature (586)..(586): n is a, c, g, or t
  misc_feature (588)..(592): n is a, c, g, or t
  misc_feature (595)..(595): n is a, c, g, or t
  misc_feature (597)..(597): n is a, c, g, or t
  misc_feature (600)..(600): n is a, c, g, or t
  misc_feature (602)..(603): n is a, c, g, or t
  misc_feature (605)..(605): n is a, c, g, or t
  misc_feature (607)..(615): n is a, c, g, or t
  misc_feature (617)..(623): n is a, c, g, or t
  misc_feature (625)..(631): n is a, c, g, or t
  misc_feature (633)..(633): n is a, c, g, or t
  misc_feature (636)..(636): n is a, c, g, or t
  misc_feature (638)..(643): n is a, c, g, or t
  misc_feature (646)..(647): n is a, c, g, or t
  misc_feature (649)..(652): n is a, c, g, or t
  misc_feature (654)..(655): n is a, c, g, or t
  misc_feature (657)..(666): n is a, c, g, or t
  misc_feature (669)..(672): n is a, c, g, or t
  misc_feature (674)..(676): n is a, c, g, or t
  misc_feature (678)..(686): n is a, c, g, or t
  misc_feature (688)..(698): n is a, c, g, or t
  misc_feature (700)..(703): n is a, c, g, or t
  misc_feature (705)..(709): n is a, c, g, or t
  misc_feature (711)..(712): n is a, c, g, or t
  misc_feature (715)..(715): n is a, c, g, or t
  misc_feature (717)..(717): n is a, c, g, or t
  misc_feature (721)..(721): n is a, c, g, or t
  misc_feature (726)..(726): n is a, c, g, or t
  misc_feature (728)..(728): n is a, c, g, or t
  misc_feature (730)..(732): n is a, c, g, or t
  misc_feature (734)..(736): n is a, c, g, or t
  misc_feature (738)..(743): n is a, c, g, or t
  misc_feature (745)..(749): n is a, c, g, or t
  misc_feature (751)..(751): n is a, c, g, or t
  misc_feature (755)..(759): n is a, c, g, or t
  misc_feature (761)..(766): n is a, c, g, or t
  misc_feature (768)..(774): n is a, c, g, or t
  misc_feature (776)..(778): n is a, c, g, or t
  misc_feature (781)..(783): n is a, c, g, or t
  misc_feature (785)..(785): n is a, c, g, or t
  misc_feature (787)..(787): n is a, c, g, or t
  misc_feature (789)..(794): n is a, c, g, or t
  misc_feature (796)..(796): n is a, c, g, or t
  misc_feature (798)..(811): n is a, c, g, or t
  misc_feature (813)..(814): n is a, c, g, or t
  misc_feature (816)..(816): n is a, c, g, or t
  misc_feature (818)..(824): n is a, c, g, or t
  misc_feature (828)..(828): n is a, c, g, or t
  misc_feature (830)..(833): n is a, c, g, or t
  misc_feature (839)..(839): n is a, c, g, or t
  misc_feature (841)..(842): n is a, c, g, or t
  misc_feature (845)..(845): n is a, c, g, or t
  misc_feature (847)..(847): n is a, c, g, or t
  misc_feature (849)..(849): n is a, c, g, or t
  misc_feature (854)..(854): n is a, c, g, or t
  misc_feature (856)..(857): n is a, c, g, or t
  misc_feature (860)..(861): n is a, c, g, or t
  misc_feature (863)..(863): n is a, c, g, or t
  misc_feature (873)..(874): n is a, c, g, or t
  misc_feature (877)..(877): n is a, c, g, or t
  misc_feature (879)..(880): n is a, c, g, or t
  misc_feature (883)..(883): n is a, c, g, or t
  misc_feature (889)..(889): n is a, c, g, or t
  misc_feature (893)..(894): n is a, c, g, or t
  misc_feature (900)..(902): n is a, c, g, or t
  misc_feature (919)..(919): n is a, c, g, or t
  misc_feature (1100)..(1100): n is a, c, g, or t
  misc_feature (1238)..(1238): n is a, c, g, or t
  misc_feature (2004)..(2004): n is a, c, g, or t
  misc_feature (2016)..(2016): n is a, c, g, or t
  misc_feature (2118)..(2119): n is a, c, g, or t
  misc_feature (2121)..(2121): n is a, c, g, or t
  misc_feature (2128)..(2130): n is a, c, g, or t
  misc_feature (2136)..(2136): n is a, c, g, or t
  misc_feature (2139)..(2142): n is a, c, g, or t
  misc_feature (2144)..(2144): n is a, c, g, or t
  misc_feature (2149)..(2151): n is a, c, g, or t
  misc_feature (2153)..(2153): n is a, c, g, or t
  misc_feature (2156)..(2157): n is a, c, g, or t
  misc_feature (2159)..(2162): n is a, c, g, or t
  misc_feature (2164)..(2164): n is a, c, g, or t
  misc_feature (2166)..(2166): n is a, c, g, or t
  misc_feature (2168)..(2169): n is a, c, g, or t
  misc_feature (2171)..(2174): n is a, c, g, or t
  misc_feature (2176)..(2176): n is a, c, g, or t
  misc_feature (2178)..(2183): n is a, c, g, or t
  misc_feature (2185)..(2185): n is a, c, g, or t
  misc_feature (2188)..(2195): n is a, c, g, or t
  misc_feature (2197)..(2197): n is a, c, g, or t
  misc_feature (2199)..(2206): n is a, c, g, or t
  misc_feature (2208)..(2208): n is a, c, g, or t
  misc_feature (2210)..(2212): n is a, c, g, or t
  misc_feature (2214)..(2216): n is a, c, g, or t
  misc_feature (2220)..(2224): n is a, c, g, or t
  misc_feature (2227)..(2227): n is a, c, g, or t
  misc_feature (2232)..(2233): n is a, c, g, or t
  misc_feature (2235)..(2243): n is a, c, g, or t
  misc_feature (2245)..(2245): n is a, c, g, or t
  misc_feature (2247)..(2247): n is a, c, g, or t
  misc_feature (2249)..(2249): n is a, c, g, or t
  misc_feature (2251)..(2251): n is a, c, g, or t
  misc_feature (2253)..(2255): n is a, c, g, or t
  misc_feature (2257)..(2260): n is a, c, g, or t
  misc_feature (2262)..(2262): n is a, c, g, or t
  misc_feature (2265)..(2269): n is a, c, g, or t
  misc_feature (2271)..(2274): n is a, c, g, or t
  misc_feature (2276)..(2290): n is a, c, g, or t
  misc_feature (2292)..(2297): n is a, c, g, or t
  misc_feature (2299)..(2300): n is a, c, g, or t
  misc_feature (2303)..(2320): n is a, c, g, or t
  misc_feature (2322)..(2323): n is a, c, g, or t
  misc_feature (2325)..(2359): n is a, c, g, or t
  misc_feature (2361)..(2361): n is a, c, g, or t
  misc_feature (2363)..(2366): n is a, c, g, or t
  misc_feature (2368)..(2368): n is a, c, g, or t
  misc_feature (2370)..(2378): n is a, c, g, or t
  misc_feature (2380)..(2384): n is a, c, g, or t
  misc_feature (2386)..(2388): n is a, c, g, or t
  misc_feature (2390)..(2407): n is a, c, g, or t
  misc_feature (2409)..(2413): n is a, c, g, or t
  misc_feature (2415)..(2430): n is a, c, g, or t
  misc_feature (2433)..(2439): n is a, c, g, or t
  misc_feature (2442)..(2472): n is a, c, g, or t
  misc_feature (2474)..(2489): n is a, c, g, or t
  misc_feature (2491)..(2492): n is a, c, g, or t
  misc_feature (2494)..(2497): n is a, c, g, or t
  misc_feature (2499)..(2500): n is a, c, g, or t
  misc_feature (2502)..(2508): n is a, c, g, or t
  misc_feature (2510)..(2510): n is a, c, g, or t
  misc_feature (2513)..(2519): n is a, c, g, or t
  misc_feature (2522)..(2523): n is a, c, g, or t
  misc_feature (2525)..(2528): n is a, c, g, or t
  misc_feature (2530)..(2542): n is a, c, g, or t
  misc_feature (2544)..(2547): n is a, c, g, or t
  misc_feature (2549)..(2550): n is a, c, g, or t
  misc_feature (2552)..(2557): n is a, c, g, or t
  misc_feature (2561)..(2577): n is a, c, g, or t
  misc_feature (2579)..(2580): n is a, c, g, or t
  misc_feature (2583)..(2585): n is a, c, g, or t
  misc_feature (2587)..(2588): n is a, c, g, or t
  misc_feature (2590)..(2594): n is a, c, g, or t
  misc_feature (2596)..(2598): n is a, c, g, or t
  misc_feature (2600)..(2610): n is a, c, g, or t
  misc_feature (2612)..(2625): n is a, c, g, or t
  misc_feature (2627)..(2646): n is a, c, g, or t
  misc_feature (2649)..(2652): n is a, c, g, or t
  misc_feature (2654)..(2660): n is a, c, g, or t
  misc_feature (2662)..(2674): n is a, c, g, or t
  misc_feature (2676)..(2682): n is a, c, g, or t
  misc_feature (2685)..(2705): n is a, c, g, or t
  misc_feature (2707)..(2707): n is a, c, g, or t
  misc_feature (2709)..(2729): n is a, c, g, or t
  misc_feature (2731)..(2752): n is a, c, g, or t
  misc_feature (2754)..(2765): n is a, c, g, or t
  misc_feature (2767)..(2767): n is a, c, g, or t
  misc_feature (2769)..(2771): n is a, c, g, or t
  misc_feature (2773)..(2775): n is a, c, g, or t
  misc_feature (2777)..(2779): n is a, c, g, or t
  misc_feature (2781)..(2786): n is a, c, g, or t
  misc_feature (2788)..(2790): n is a, c, g, or t
  misc_feature (2792)..(2799): n is a, c, g, or t
  misc_feature (2801)..(2806): n is a, c, g, or t
  misc_feature (2808)..(2812): n is a, c, g, or t
  misc_feature (2814)..(2827): n is a, c, g, or t
  misc_feature (2829)..(2829): n is a, c, g, or t
  misc_feature (2831)..(2831): n is a, c, g, or t
  misc_feature (2833)..(2839): n is a, c, g, or t
  misc_feature (2842)..(2847): n is a, c, g, or t
  misc_feature (2849)..(2865): n is a, c, g, or t
  misc_feature (2867)..(2879): n is a, c, g, or t
  misc_feature (2882)..(2887): n is a, c, g, or t
  misc_feature (2889)..(2890): n is a, c, g, or t
  misc_feature (2892)..(2894): n is a, c, g, or t
  misc_feature (2896)..(2898): n is a, c, g, or t
  misc_feature (2900)..(2909): n is a, c, g, or t
  misc_feature (2911)..(2912): n is a, c, g, or t
  misc_feature (2915)..(2915): n is a, c, g, or t
  misc_feature (2917)..(2918): n is a, c, g, or t
  misc_feature (2921)..(2922): n is a, c, g, or t
  misc_feature (2924)..(2932): n is a, c, g, or t
  misc_feature (2934)..(2940): n is a, c, g, or t
  misc_feature (2942)..(2958): n is a, c, g, or t
  misc_feature (2960)..(2965): n is a, c, g, or t
  misc_feature (2967)..(2979): n is a, c, g, or t
  misc_feature (2981)..(2983): n is a, c, g, or t
  misc_feature (2985)..(2987): n is a, c, g, or t
  misc_feature (2989)..(2993): n is a, c, g, or t
  misc_feature (2996)..(2999): n is a, c, g, or t
  misc_feature (3002)..(3012): n is a, c, g, or t
  misc_feature (3014)..(3019): n is a, c, g, or t
  misc_feature (3021)..(3032): n is a, c, g, or t
  misc_feature (3034)..(3046): n is a, c, g, or t
  misc_feature (3049)..(3074): n is a, c, g, or t
  misc_feature (3077)..(3077): n is a, c, g, or t
  misc_feature (3079)..(3081): n is a, c, g, or t
  misc_feature (3083)..(3083): n is a, c, g, or t
  misc_feature (3085)..(3086): n is a, c, g, or t
  misc_feature (3088)..(3090): n is a, c, g, or t
  misc_feature (3092)..(3095): n is a, c, g, or t
  misc_feature (3097)..(3097): n is a, c, g, or t
  misc_feature (3099)..(3100): n is a, c, g, or t
  misc_feature (3102)..(3110): n is a, c, g, or t
  misc_feature (3112)..(3116): n is a, c, g, or t
  misc_feature (3119)..(3130): n is a, c, g, or t
  misc_feature (3133)..(3133): n is a, c, g, or t
  misc_feature (3136)..(3136): n is a, c, g, or t
  misc_feature (3138)..(3142): n is a, c, g, or t
  misc_feature (3146)..(3152): n is a, c, g, or t
  misc_feature (3154)..(3173): n is a, c, g, or t
  misc_feature (3175)..(3183): n is a, c, g, or t
  misc_feature (3185)..(3185): n is a, c, g, or t
  misc_feature (3187)..(3192): n is a, c, g, or t
  misc_feature (3194)..(3194): n is a, c, g, or t
  misc_feature (3196)..(3213): n is a, c, g, or t
  misc_feature (3215)..(3218): n is a, c, g, or t
  misc_feature (3220)..(3230): n is a, c, g, or t
  misc_feature (3233)..(3234): n is a, c, g, or t
  misc_feature (3236)..(3241): n is a, c, g, or t
  misc_feature (3243)..(3244): n is a, c, g, or t
  misc_feature (3246)..(3247): n is a, c, g, or t
  misc_feature (3249)..(3252): n is a, c, g, or t
  misc_feature (3255)..(3271): n is a, c, g, or t
  misc_feature (3273)..(3276): n is a, c, g, or t
  misc_feature (3278)..(3278): n is a, c, g, or t
  misc_feature (3280)..(3288): n is a, c, g, or t
  misc_feature (3291)..(3296): n is a, c, g, or t
  misc_feature (3298)..(3298): n is a, c, g, or t
  misc_feature (3300)..(3304): n is a, c, g, or t
  misc_feature (3306)..(3319): n is a, c, g, or t
  misc_feature (3321)..(3329): n is a, c, g, or t
  misc_feature (3331)..(3335): n is a, c, g, or t
  misc_feature (3337)..(3338): n is a, c, g, or t
  misc_feature (3340)..(3347): n is a, c, g, or t
  misc_feature (3349)..(3355): n is a, c, g, or t
  misc_feature (3358)..(3362): n is a, c, g, or t
  misc_feature (3364)..(3367): n is a, c, g, or t
  misc_feature (3369)..(3374): n is a, c, g, or t
  misc_feature (3376)..(3380): n is a, c, g, or t
  misc_feature (3382)..(3383): n is a, c, g, or t
  misc_feature (3385)..(3392): n is a, c, g, or t
  misc_feature (3395)..(3434): n is a, c, g, or t
  misc_feature (3436)..(3437): n is a, c, g, or t
  misc_feature (3439)..(3440): n is a, c, g, or t
  misc_feature (3442)..(3453): n is a, c, g, or t
  misc_feature (3455)..(3457): n is a, c, g, or t
  misc_feature (3459)..(3462): n is a, c, g, or t
  misc_feature (3464)..(3466): n is a, c, g, or t
  misc_feature (3469)..(3470): n is a, c, g, or t
  misc_feature (3472)..(3473): n is a, c, g, or t
  misc_feature (3475)..(3478): n is a, c, g, or t
  misc_feature (3480)..(3482): n is a, c, g, or t
  misc_feature (3484)..(3486): n is a, c, g, or t
  misc_feature (3489)..(3500): n is a, c, g, or t
  misc_feature (3502)..(3504): n is a, c, g, or t
  misc_feature (3506)..(3507): n is a, c, g, or t
  misc_feature (3509)..(3513): n is a, c, g, or t
  misc_feature (3515)..(3530): n is a, c, g, or t
  misc_feature (3532)..(3555): n is a, c, g, or t
  misc_feature (3557)..(3572): n is a, c, g, or t
  misc_feature (3574)..(3574): n is a, c, g, or t
  misc_feature (3576)..(3576): n is a, c, g, or t
  misc_feature (3578)..(3583): n is a, c, g, or t
  misc_feature (3585)..(3588): n is a, c, g, or t
  misc_feature (3590)..(3591): n is a, c, g, or t
  misc_feature (3593)..(3596): n is a, c, g, or t
  misc_feature (3599)..(3603): n is a, c, g, or t
  misc_feature (3605)..(3605): n is a, c, g, or t
  misc_feature (3607)..(3609): n is a, c, g, or t
  misc_feature (3611)..(3627): n is a, c, g, or t
  misc_feature (3629)..(3641): n is a, c, g, or t
  misc_feature (3644)..(3653): n is a, c, g, or t
  misc_feature (3655)..(3656): n is a, c, g, or t
  misc_feature (3658)..(3660): n is a, c, g, or t
  misc_feature (3662)..(3662): n is a, c, g, or t
  misc_feature (3664)..(3668): n is a, c, g, or t
  misc_feature (3670)..(3674): n is a, c, g, or t
  misc_feature (3676)..(3676): n is a, c, g, or t
  misc_feature (3678)..(3681): n is a, c, g, or t
  misc_feature (3683)..(3684): n is a, c, g, or t
  misc_feature (3686)..(3686): n is a, c, g, or t
  misc_feature (3688)..(3693): n is a, c, g, or t
  misc_feature (3695)..(3702): n is a, c, g, or t
  misc_feature (3704)..(3707): n is a, c, g, or t
  misc_feature (3710)..(3712): n is a, c, g, or t
  misc_feature (3715)..(3719): n is a, c, g, or t
  misc_feature (3721)..(3721): n is a, c, g, or t
  misc_feature (3723)..(3723): n is a, c, g, or t
  misc_feature (3725)..(3731): n is a, c, g, or t
  misc_feature (3733)..(3739): n is a, c, g, or t
  misc_feature (3742)..(3745): n is a, c, g, or t
  misc_feature (3747)..(3752): n is a, c, g, or t
  misc_feature (3754)..(3761): n is a, c, g, or t
  misc_feature (3763)..(3780): n is a, c, g, or t
  misc_feature (3782)..(3786): n is a, c, g, or t
  misc_feature (3788)..(3788): n is a, c, g, or t
  misc_feature (3790)..(3805): n is a, c, g, or t
  misc_feature (3808)..(3824): n is a, c, g, or t
  misc_feature (3826)..(3833): n is a, c, g, or t
  misc_feature (3835)..(3846): n is a, c, g, or t
  misc_feature (3848)..(3879): n is a, c, g, or t
  misc_feature (3881)..(3881): n is a, c, g, or t
  misc_feature (3883)..(3935): n is a, c, g, or t
  misc_feature (3937)..(4000): n is a, c, g, or t
nnnnnnnnnnnnnnnnnnnnntnnnnnnnnnnnnnnnnnnnnnnnnnnnnnnnnnnnnnnnnnnnnnnnnnnnnnnnnnnnnntnnnnnnnnnnnnnnnnnnnnnnnnnnnnnnntnntnanttnnnnnnnnnnnnnnnnnnnnnnnttnnnnnnnnnnnnnngnnnnnnntnnnncnnntnnnnnncnnnnnnnnnnnnnnnnnntnnnnnnnnnnnntnnttnnntnntnntnnnncnnnnnnnnnaannnnnanntnnnnttnnnnannanttncnttnantnnnncntnnncnannnntnntnnannnnnnnnnnnnnncnnnnntttnaanncnannnnnnngnttnnnnnnannnnnncnttnccnnnnnnntncnnnnnnntnnnnantnnnnnnnnnnnnnnnnnntncnnnnnnntnnnnnaannnnnnnnnnnnnnnntnanncnnnnaannnnnnnnncnannnnnnnnntnnnnnnnnnnnnngnnnncnnnttttttnnnnnnnnncnnnnnnnggnntnnaannnnnnaannaannnnnnncntnnnnnnnnnncnnnannannncnnnncntnnnnnttncnccnanncnannnnnnnnngnnnnnnncnnnnnnntnccnannnnnnaannannnntnnannnnnnnnnnttnnnntnnntnnnnnnnnnannnnnnnnnnntnnnntnnnnnannacngnaaanttttngntnnnannnannnnnnannnnntnaaannnnntnnnnnnannnnnnntnnnttnnnantncnnnnnngntnnnnnnnnnnnnnntnntntnnnnnnntttncnnnntttttncnnccntncnaaaantnnatnnantgtatatctnnccntnnatnagttanaaannataaannnaaaaaaagatcgggganttctccccgaccttcttatcttctctagaaaaattacttaagagtgatcttagcgccttcagcctcaagcttagccttgatatcatcagcctcagccttggaagcaccttccttaagaacctttggagctgcctcaacgaggtccttagcttccttaagtccaagaccggtagcctcacgnacaaccttgataaccttgatcttgtttggtcctacatcagtaagctcaacgtcgaactcagtcttctcttcctcagctgcgcctgcacctgcaccagcgcctgctgctgcaactactacacctgctgctgcggaaacnccgaattcctcttcgcaagcctttaccaaatcatttaattccattacggaaagttccttaattgctgcaataaactcttcaacagttaactttgccattgtattatcctccattatttttattttttgaaaatgtcacggaataaattccgtattaagctgctttacgctgcttctccgccgtccttctgtgcaatctgattaagcacacgtgcgaaattgctgacaggggacttgatggatccgagaagtcttccaagaagctcttctctggatggaatctctgccaatgcctgaactgcctttgcatcgtagaactttccttccactactgcacccttaaactctaactttggtgctgtttttgcaaactttgcaaaaattcttgctgccgctgtagcatcgtccttagatactgccaaagcagtaggtccatctaatactacgtctaactgagcaaaatctgtaccctctgcggctctcttgattaaggtgttcttgaaaaccttgtactgtacaccggcttctcttaatgctttacgaagctctgtgtcctgtgctacggtaagaccacgatagtctacaacagtagcggcaacagcaccgtccaaaagggccttaatctcgtcgatgatcggctgctttaattcaacctttgccattccttgctttcctccttctgtaatttttctagaaagtattaacggaaacgagaggctttcttcttcaaagtatccggaaaatgcaagacacaaactcgcataaanccgttacttcantttagaagaataaaaaatcccttgccaaagacaagggatgaacgcacataataggataaatcctagctctttcctcggcgggcgatttctctttacatcctnncnttcttannntcgcanaannnntncaaannnanttnnannnntnananncnnnntntnnnnnntnaannnnnnnnanannnnnnnntntnnnannnaaannnnnaanaaaanncnnnnnnnnntnanananannntnnnnanaannnnntnnnnannnnnnnnnnnnnnntnnnnnntnnaannnnnnnnnnnnnnnnnngnntnnnnnnnnnnnnnnnnnnnnnnnnnnnnnnnnnnntntnnnnanannnnnnnnntnnnnntnnncnnnnnnnnnnnnnnnnnnannnnncnnnnnnnnnnnnnnnnaannnnnnnaannnnnnnnnnnnnnnnnnnnnnnnnnnnnnntnnnnnnnnnnnnnnnnannannnntnncnnnnnnntnatnnnnnnnttnnannnnannnnnnnnnnnnntnnnntnntnnnnnnaaannnnnnnnnnnnnnnnnannttnnncnntnnnnnannncnnnnnnnnnnnannnnnnnnnnnnnnannnnnnnnnnnnnnnnnnnnaannnntnnnnnnnannnnnnnnnnnnnannnnnnnaannnnnnnnnnnnnnnnnnnnncntnnnnnnnnnnnnnnnnnnnnntnnnnnnnnnnnnnnnnnnnnnntnnnnnnnnnnnntntnnntnnnannntnnnnnntnnncnnnnnnnntnnnnnnannnnngnnnnnnnnnnnnnntncntnnnnnnnaannnnnnannnnnnnnnnnnnnnnnannnnnnnnnnnnnaannnnnntnntnnntnnntnnnnnnnnnnanncananntannannnnnnnnntnnnnnnntnnnnnnnnnnnnnnnnnannnnnnannnnnnnnnnnnntnnnannntnnnnnaannnntcnnnnnnnnnnntnnnnnnannnnnnnnnnnnannnnnnnnnnnnnttnnnnnnnnnnnnnnnnnnnnnnnnnntgntnnntntnntnnntnnnntntnntnnnnnnnnntnnnnnttnnnnnnnnnnnnttntcntnnnnntcannnnnnntnnnnnnnnnnnnnnnnnnnnannnnnnnnncntnnnnnntntnnnnnnnnnnnnnnnnnntnnnntnnnnnnnnnnntanntnnnnnntnnanntnnnntannnnnnnnnnnnnnnnntnnnntntnnnnnnnnntannnnnntntnnnnntnnnnnnnnnnnnnnannnnnnnnntnnnnntnntnnnnnnnntnnnnnnnttnnnnncnnnncnnnnnntnnnnntnntnnnnnnnntcnnnnnnnnnnnnnnnnnnnnnnnnnnnnnnnnnnnnnnnntnntnntnnnnnnnnnnnntnnngnnnntnnnganntnntnnnngnnntnnnccnnnnnnnnnnnnannncnntnnnnncnnnnnnnnnnnnnnnntnnnnnnnnnnnnnnnnnnnnnnnncnnnnnnnnnnnnnnnncngnannnnnngnnnntnncnnnntcnnnnntntnnncnnnnnnnnnnnnnnnnntnnnnnnnnnnnnntcnnnnnnnnnntnntnnncntnnnnntnnnnntncnnnncnncntnnnnnncnnnnnnnncnnnntcnnnctnnnnntncncnnnnnnntnnnnnnnctnnnncnnnnnntnnnnnnnntnnnnnnnnnnnnnnnnnntnnnnncntnnnnnnnnnnnnnnnnctnnnnnnnnnnnnnnnnntnnnnnnnntnnnnnnnnnnnntnnnnnnnnnnnnnnnnnnnnnnnnnnnnnnnntncnnnnnnnnnnnnnnnnnnnnnnnnnnnnnnnnnnnnnnnnnnnnnnnnnnnnntnnnnnnnnnnnnnnnnnnnnnnnnnnnnnnnnnnnnnnnnnnnnnnnnnnnnnnnnnnnnnnnn

SEQ ID NO: 235 - DNA, 4000 bp, Escherichia coli
  misc_feature (1987)..(1988): n is a, c, g, or t
  misc_feature (1993)..(1993): n is a, c, g, or t
  misc_feature (1996)..(1996): n is a, c, g, or t
  misc_feature (2005)..(2006): n is a, c, g, or t
  misc_feature (2021)..(2021): n is a, c, g, or t
  misc_feature (2026)..(2026): n is a, c, g, or t
  misc_feature (2032)..(2032): n is a, c, g, or t
  misc_feature (2035)..(2035): n is a, c, g, or t
  misc_feature (2044)..(2044): n is a, c, g, or t
  misc_feature (2047)..(2047): n is a, c, g, or t
  misc_feature (2053)..(2054): n is a, c, g, or t
  misc_feature (2059)..(2060): n is a, c, g, or t
  misc_feature (2062)..(2062): n is a, c, g, or t
ccgcgcttcatttatagcaacagcggcataggactaccgcgtcgtgattccatttgtactgtgttaggcattagtaattatacagcctttgccgtaaggattactattatttgtgatagaacgagcacgcagaccgggtacgtttgcgggcgtaatacattcgtaaagaacagttccggcggcaatgctatggatagcaactactacccgtaccgtatgaacaacaacgcgggaaacgaaaccggaaagtggaacatggcggcgggcgacatacgcgagtttcttttagtttgggacggaagcagcggatattacgcctatttattgaacataagagaataagccatgcatcacggcgcaaggcattaaatagaagtgttgtaacgccgaatttcacggcttcggctaaacaaacacttcacgagtatttcacgacgtattaaactaatacgataagaaagtatttttgtaacgacttaaaattaagcgtatggaaaatagaaacggcgatttagtgagcgcgcaaatttcggtagccgggaacgtggatttttccggtggcaacttccgaatggatacgcctttttgcttaaaaaacgatggcgaagcggcggtagtattggaagtaaacctttggggaatgcccgaaggcgaatttataagcacgcgctttgaaacgggatggaaccccgaaattatcagagagataaaagaaacgagttcagcaaccgccctaatttggggctattaaaaattataattatgggtttaattattgcagcgggcaacacaaagcccgcgtttccttatgattactattatggcgttaagattaacgtaaatgtagcagatacaaagctggaacgggtaggaagaccggaactacatgtttcgctcccggttcaatcccttatgcggcgttgtctgcttaacgatgcggggaaggttgtaacctacctacatgctactaacagtacgaagacggacaccggggcagcggcagaccttaccggagcttccggcatggtaatggtagaaataccgaagcactaccgtaagtttgagtttgacggtactacgtttacctgccttatttcgcaataccagctaccgggctttatcgaagtaccaaagatgtaccgtagcgcatacgaagccacgatagaccgaactttatcagctactcccaaacttgccagcgtggtaaatactacggcggctttccggggcggaaataataatacggcatgggacggaacttatagaaccctattaggtcgcccggctaccgccacatcgctaaccaacttccgaaaatacgcacgaaacagaggtgcagtaggattgaacggcgcgggctggaactgcgatttatacgcggcacaaaacgcgacctattggctttatgtggttgaatacgccaaccttaactgccagcttgattttaacgcgcagcctacaagcgaaggctacaagcagggcggattaagtgcgggcgttacgacgcttaacagtacgaagtggaacacattcaacagctactacccgtttgtcccctgcggtactacaaattcattaggcaacgcttcgggcgtagtcgaatttaccatgccggacgaatacgatacgggcgtagtagttaaagtaaaagtaccttcataccggggaatagaaaacccgttcgggcatatttggagttggacggatggatgcaaatgcgctattgaatcggatgcggacggcggcgtaagttctttctatacttgcgacaacccggcaaactaccaagataccaactatgacaattacgtaaaacgcggcgaacttccacgtaaggaaggttatgttaagcgcatgatgataggcgaatacggggaaaatatgcctacggaagtgggcgcaggttctactacctactttgccgactacttctataccaacataccagccagcggcgtagcacaaaggggtgtcttgttcggcggtnntgcgnatnacggcgcgnntgccgggctttcgtncgcgnatacgnatnacgcggctncgnatacgnntgcgnntntcggctctcggctttgctttatccccgccgcgtaacacgtcacgaaacggaatgtttaacaattaaaaatacaagaaaatgacttcaaacaataatagcacagatgatggtagcctttcgttcttgaacattcaaccggacgaagcgaacaaacattttaactgcccggaaaccacgcaacagaaactaatcaatttgcagttttggttaattgatttcatcgaagacgtgaaaacgaaattcggtgcgaaccgcttcctcgtgaaaattaagttcaagaaagatgaccccgaaagcgaagcgaagaagttcttcacaaattccagcgagataaaatacattttacaggagataaagaagcgtaacgcctttccgcgaaaggtaactatgcgggcttcgggaacgcgctattattttgagtaagaagattttcacggttgtttgtccttcgggtgtcttgttcggcggtaatgcgaataacagcgcgaatgccgggctttcgtacgcgaatacgaataacacggctacgaatacgaatgcgaatatcggctctcagctatactgattttttgtaaagctaataaggacaaagaccgcgccgaaaggcggaaaagattaatcattaacggggtttggtagggaaaccgaagaacaccatttaatcagcaaagaaacaactatgaaaaggttaggcaacctttacgataaaataataagtttggataatttgcgccttgcggacgaacgcgcccgcaagggcaaactacgttcttacggcgtgaagttgcacgaccgtaacaaggaagccaaccttttatctttgcacgaagcactaaaggcaggaacttataggacttcggaatatagtaccttcacaatatacgagcctaaagaacgcgagattttccgtttgccatactttcccgaccggattgtacatcacgccgtaatgaacattttagaacctatatgggtgtctattttcacggcggacacttatagttgcataaaagggcgtggcatacaagcggcggcaaataagttaaggcgcgttatagacagagataaggcaggctgcgcgtattgcttgaaaatagacatacgcaaattttacccttccatagatcacaccgtactaaagtccattgttcgccggaagattaaggacacacggctactcaatcttttggacgaaataatagacagtgcggaaggcttaccgattggcaactaccttagccaatatttagcgaatcttgtacttacctacttcgaccattgggtaaaggaagtaaagcgggtaaggtactatttcagatacgccgacgacattgtagtattgcatagcgacaaaaagacgcttcacgctttgctggcagagtttgaaagctacttggcggctaacgtaaagctggaaatcaaacagaacaaacaagtctttccggtggcacacgaccaccgcgacagcttcgggcgtggtattgatttcttgggctatgtattctatttgaacgaaacacggcttaggaagcgtatcaaacagaacctttgccgtaagatagctaaattacggaaacggaagaaaccgttaagcgaggatgaatttaagcagacgttagccgcgtggtggggttgggctaaatacagcgacagcgaatatttaattaacaaattaaacaaaattacaccttatgaaatcaagttcagacgttagacccgcgattattttaccgttgggtaatggttcttaccactataactacaacatagtggaagaaaaggtagaagacccggaaacgggcgaaaagaccgtttacaactacgatacggtgcaggtttggcagaagccggactacgaaaaccttacgcgtgcggttatccgtagcgaaatagacgaaaccgaagaattttctttgattaacgactattacgccgcac

SEQ ID NO: 236 - DNA, 4000 bp, Escherichia coli
  misc_feature (1602)..(1602): n is a, c, g, or t
  misc_feature (1666)..(1666): n is a, c, g, or t
  misc_feature (1987)..(1987): n is a, c, g, or t
  misc_feature (2182)..(2183): n is a, c, g, or t
  misc_feature (2185)..(2186): n is a, c, g, or t
  misc_feature (2188)..(2191): n is a, c, g, or t
  misc_feature (2193)..(2194): n is a, c, g, or t
  misc_feature (2197)..(2197): n is a, c, g, or t
  misc_feature (2199)..(2202): n is a, c, g, or t
  misc_feature (2204)..(2204): n is a, c, g, or t
  misc_feature (2206)..(2207): n is a, c, g, or t
  misc_feature (2209)..(2209): n is a, c, g, or t
  misc_feature (2211)..(2211): n is a, c, g, or t
  misc_feature (2213)..(2214): n is a, c, g, or t
  misc_feature (2216)..(2220): n is a, c, g, or t
  misc_feature (2222)..(2224): n is a, c, g, or t
  misc_feature (2226)..(2230): n is a, c, g, or t
  misc_feature (2232)..(2234): n is a, c, g, or t
  misc_feature (2236)..(2240): n is a, c, g, or t
  misc_feature (2242)..(2259): n is a, c, g, or t
  misc_feature (2261)..(2261): n is a, c, g, or t
  misc_feature (2263)..(2265): n is a, c, g, or t
  misc_feature (2268)..(2274): n is a, c, g, or t
  misc_feature (2276)..(2276): n is a, c, g, or t
  misc_feature (2278)..(2285): n is a, c, g, or t
  misc_feature (2287)..(2300): n is a, c, g, or t
  misc_feature (2302)..(2304): n is a, c, g, or t
  misc_feature (2306)..(2307): n is a, c, g, or t
  misc_feature (2309)..(2313): n is a, c, g, or t
  misc_feature (2315)..(2317): n is a, c, g, or t
  misc_feature (2319)..(2320): n is a, c, g, or t
  misc_feature (2324)..(2324): n is a, c, g, or t
  misc_feature (2326)..(2326): n is a, c, g, or t
  misc_feature (2329)..(2331): n is a, c, g, or t
  misc_feature (2333)..(2334): n is a, c, g, or t
  misc_feature (2340)..(2340): n is a, c, g, or t
  misc_feature (2342)..(2343): n is a, c, g, or t
  misc_feature (2345)..(2358): n is a, c, g, or t
  misc_feature (2360)..(2360): n is a, c, g, or t
  misc_feature (2362)..(2366): n is a, c, g, or t
  misc_feature (2368)..(2369): n is a, c, g, or t
  misc_feature (2371)..(2374): n is a, c, g, or t
  misc_feature (2376)..(2376): n is a, c, g, or t
  misc_feature (2378)..(2387): n is a, c, g, or t
  misc_feature (2390)..(2393): n is a, c, g, or t
  misc_feature (2397)..(2400): n is a, c, g, or t
  misc_feature (2402)..(2406): n is a, c, g, or t
  misc_feature (2408)..(2408): n is a, c, g, or t
  misc_feature (2411)..(2413): n is a, c, g, or t
  misc_feature (2416)..(2426): n is a, c, g, or t
  misc_feature (2428)..(2428): n is a, c, g, or t
  misc_feature (2430)..(2430): n is a, c, g, or t
  misc_feature (2432)..(2432): n is a, c, g, or t
  misc_feature (2437)..(2437): n is a, c, g, or t
  misc_feature (2439)..(2440): n is a, c, g, or t
  misc_feature (2442)..(2446): n is a, c, g, or t
  misc_feature (2448)..(2451): n is a, c, g, or t
  misc_feature (2453)..(2460): n is a, c, g, or t
  misc_feature (2464)..(2472): n is a, c, g, or t
  misc_feature (2475)..(2476): n is a, c, g, or t
  misc_feature (2479)..(2479): n is a, c, g, or t
  misc_feature (2481)..(2483): n is a, c, g, or t
  misc_feature (2487)..(2490): n is a, c, g, or t
  misc_feature (2492)..(2492): n is a, c, g, or t
  misc_feature (2496)..(2499): n is a, c, g, or t
  misc_feature (2503)..(2503): n is a, c, g, or t
  misc_feature (2505)..(2506): n is a, c, g, or t
  misc_feature (2508)..(2509): n is a, c, g, or t
  misc_feature (2516)..(2520): n is a, c, g, or t
  misc_feature (2523)..(2523): n is a, c, g, or t
  misc_feature (2525)..(2525): n is a, c, g, or t
  misc_feature (2528)..(2529): n is a, c, g, or t
  misc_feature (2533)..(2537): n is a, c, g, or t
  misc_feature (2542)..(2545): n is a, c, g, or t
  misc_feature (2547)..(2547): n is a, c, g, or t
  misc_feature (2549)..(2555): n is a, c, g, or t
  misc_feature (2557)..(2565): n is a, c, g, or t
  misc_feature (2567)..(2567): n is a, c, g, or t
  misc_feature (2570)..(2571): n is a, c, g, or t
  misc_feature (2574)..(2574): n is a, c, g, or t
  misc_feature (2577)..(2577): n is a, c, g, or t
  misc_feature (2580)..(2585): n is a, c, g, or t
  misc_feature (2587)..(2587): n is a, c, g, or t
  misc_feature (2589)..(2590): n is a, c, g, or t
  misc_feature (2593)..(2595): n is a, c, g, or t
  misc_feature (2597)..(2601): n is a, c, g, or t
  misc_feature (2603)..(2605): n is a, c, g, or t
  misc_feature (2609)..(2610): n is a, c, g, or t
  misc_feature (2613)..(2614): n is a, c, g, or t
  misc_feature (2622)..(2625): n is a, c, g, or t
  misc_feature (2627)..(2630): n is a, c, g, or t
  misc_feature (2632)..(2632): n is a, c, g, or t
  misc_feature (2634)..(2634): n is a, c, g, or t
  misc_feature (2636)..(2639): n is a, c, g, or t
  misc_feature (2641)..(2641): n is a, c, g, or t
  misc_feature (2643)..(2646): n is a, c, g, or t
  misc_feature (2648)..(2649): n is a, c, g, or t
  misc_feature (2652)..(2652): n is a, c, g, or t
  misc_feature (2655)..(2656): n is a, c, g, or t
  misc_feature (2659)..(2659): n is a, c, g, or t
  misc_feature (2661)..(2662): n is a, c, g, or t
  misc_feature (2668)..(2668): n is a, c, g, or t
  misc_feature (2670)..(2674): n is a, c, g, or t
  misc_feature (2676)..(2676): n is a, c, g, or t
  misc_feature (2678)..(2681): n is a, c, g, or t
  misc_feature (2683)..(2685): n is a, c, g, or t
  misc_feature (2689)..(2689): n is a, c, g, or t
  misc_feature (2691)..(2692): n is a, c, g, or t
  misc_feature (2694)..(2694): n is a, c, g, or t
  misc_feature (2700)..(2703): n is a, c, g, or t
  misc_feature (2706)..(2706): n is a, c, g, or t
  misc_feature (2708)..(2711): n is a, c, g, or t
  misc_feature (2714)..(2714): n is a, c, g, or t
  misc_feature (2717)..(2721): n is a, c, g, or t
  misc_feature (2724)..(2724): n is a, c, g, or t
  misc_feature (2728)..(2728): n is a, c, g, or t
  misc_feature (2731)..(2733): n is a, c, g, or t
  misc_feature (2735)..(2736): n is a, c, g, or t
  misc_feature (2739)..(2740): n is a, c, g, or t
  misc_feature (2743)..(2748): n is a, c, g, or t
  misc_feature (2750)..(2751): n is a, c, g, or t
  misc_feature (2753)..(2755): n is a, c, g, or t
  misc_feature (2758)..(2761): n is a, c, g, or t
  misc_feature (2763)..(2765): n is a, c, g, or t
  misc_feature (2767)..(2767): n is a, c, g, or t
  misc_feature (2770)..(2776): n is a, c, g, or t
  misc_feature (2778)..(2783): n is a, c, g, or t
  misc_feature (2785)..(2788): n is a, c, g, or t
  misc_feature (2790)..(2795): n is a, c, g, or t
  misc_feature (2797)..(2798): n is a, c, g, or t
  misc_feature (2800)..(2807): n is a, c, g, or t
  misc_feature (2809)..(2809): n is a, c, g, or t
  misc_feature (2811)..(2821): n is a, c, g, or t
  misc_feature (2823)..(2825): n is a, c, g, or t
  misc_feature (2827)..(2829): n is a, c, g, or t
  misc_feature (2831)..(2834): n is a, c, g, or t
  misc_feature (2836)..(2837): n is a, c, g, or t
  misc_feature (2839)..(2840): n is a, c, g, or t
  misc_feature (2842)..(2842): n is a, c, g, or t
  misc_feature (2844)..(2851): n is a, c, g, or t
  misc_feature (2855)..(2862): n is a, c, g, or t
  misc_feature (2864)..(2865): n is a, c, g, or t
  misc_feature (2867)..(2867): n is a, c, g, or t
  misc_feature (2869)..(2876): n is a, c, g, or t
  misc_feature (2878)..(2881): n is a, c, g, or t
  misc_feature (2884)..(2892): n is a, c, g, or t
  misc_feature (2894)..(2895): n is a, c, g, or t
  misc_feature (2899)..(2900): n is a, c, g, or t
  misc_feature (2903)..(2904): n is a, c, g, or t
  misc_feature (2906)..(2912): n is a, c, g, or t
  misc_feature (2914)..(2930): n is a, c, g, or t
  misc_feature (2932)..(2937): n is a, c, g, or t
  misc_feature (2940)..(2949): n is a, c, g, or t
  misc_feature (2951)..(2951): n is a, c, g, or t
  misc_feature (2953)..(2961): n is a, c, g, or t
  misc_feature (2964)..(2967): n is a, c, g, or t
  misc_feature (2969)..(2971): n is a, c, g, or t
  misc_feature (2973)..(2981): n is a, c, g, or t
  misc_feature (2983)..(2984): n is a, c, g, or t
  misc_feature (2987)..(2987): n is a, c, g, or t
  misc_feature (2989)..(2998): n is a, c, g, or t
  misc_feature (3000)..(3001): n is a, c, g, or t
  misc_feature (3003)..(3005): n is a, c, g, or t
  misc_feature (3007)..(3009): n is a, c, g, or t
  misc_feature (3013)..(3019): n is a, c, g, or t
  misc_feature (3021)..(3022): n is a, c, g, or t
  misc_feature (3024)..(3025): n is a, c, g, or t
  misc_feature (3027)..(3027): n is a, c, g, or t
  misc_feature (3029)..(3030): n is a, c, g, or t
  misc_feature (3033)..(3034): n is a, c, g, or t
  misc_feature (3039)..(3039): n is a, c, g, or t
  misc_feature (3041)..(3042): n is a, c, g, or t
  misc_feature (3044)..(3052): n is a, c, g, or t
  misc_feature (3054)..(3058): n is a, c, g, or t
  misc_feature (3060)..(3061): n is a, c, g, or t
  misc_feature (3063)..(3067): n is a, c, g, or t
  misc_feature (3069)..(3071): n is a, c, g, or t
  misc_feature (3074)..(3075): n is a, c, g, or t
  misc_feature (3077)..(3078): n is a, c, g, or t
  misc_feature (3080)..(3086): n is a, c, g, or t
  misc_feature (3088)..(3089): n is a, c, g, or t
  misc_feature (3093)..(3103): n is a, c, g, or t
  misc_feature (3106)..(3107): n is a, c, g, or t
  misc_feature (3110)..(3113): n is a, c, g, or t
  misc_feature (3115)..(3119): n is a, c, g, or t
  misc_feature (3121)..(3123): n is a, c, g, or t
  misc_feature (3125)..(3125): n is a, c, g, or t
  misc_feature (3128)..(3129): n is a, c, g, or t
  misc_feature (3131)..(3142): n is a, c, g, or t
  misc_feature (3145)..(3146): n is a, c, g, or t
  misc_feature (3149)..(3155): n is a, c, g, or t
  misc_feature (3157)..(3157): n is a, c, g, or t
  misc_feature (3160)..(3163): n is a, c, g, or t
  misc_feature (3165)..(3179): n is a, c, g, or t
  misc_feature (3181)..(3183): n is a, c, g, or t
  misc_feature (3187)..(3196): n is a, c, g, or t
  misc_feature (3199)..(3200): n is a, c, g, or t
  misc_feature (3203)..(3207): n is a, c, g, or t
  misc_feature (3209)..(3213): n is a, c, g, or t
  misc_feature (3215)..(3218): n is a, c, g, or t
  misc_feature (3220)..(3228): n is a, c, g, or t
  misc_feature (3231)..(3239): n is a, c, g, or t
  misc_feature (3241)..(3244): n is a, c, g, or t
  misc_feature (3246)..(3258): n is a, c, g, or t
  misc_feature (3260)..(3271): n is a, c, g, or t
  misc_feature (3273)..(3283): n is a, c, g, or t
  misc_feature (3286)..(3291): n is a, c, g, or t
  misc_feature (3294)..(3294): n is a, c, g, or t
  misc_feature (3296)..(3297): n is a, c, g, or t
  misc_feature (3299)..(3305): n is a, c, g, or t
  misc_feature (3309)..(3310): n is a, c, g, or t
  misc_feature (3312)..(3312): n is a, c, g, or t
  misc_feature (3315)..(3317): n is a, c, g, or t
  misc_feature (3319)..(3326): n is a, c, g, or t
  misc_feature (3328)..(3328): n is a, c, g, or t
  misc_feature (3332)..(3335): n is a, c, g, or t
  misc_feature (3338)..(3342): n is a, c, g, or t
  misc_feature (3344)..(3359): n is a, c, g, or t
  misc_feature (3361)..(3368): n is a, c, g, or t
  misc_feature (3370)..(3370): n is a, c, g, or t
  misc_feature (3372)..(3379): n is a, c, g, or t
  misc_feature (3381)..(3403): n is a, c, g, or t
  misc_feature (3405)..(3412): n is a, c, g, or t
  misc_feature (3417)..(3421): n is a, c, g, or t
  misc_feature (3423)..(3473): n is a, c, g, or t
  misc_feature (3475)..(3479): n is a, c, g, or t
  misc_feature (3482)..(3491): n is a, c, g, or t
  misc_feature (3494)..(3499): n is a, c, g, or t
  misc_feature (3501)..(3504): n is a, c, g, or t
  misc_feature (3506)..(3512): n is a, c, g, or t
  misc_feature (3514)..(3514): n is a, c, g, or t
  misc_feature (3516)..(3520): n is a, c, g, or t
  misc_feature (3522)..(3524): n is a, c, g, or t
  misc_feature (3526)..(3527): n is a, c, g, or t
  misc_feature (3530)..(3533): n is a, c, g, or t
  misc_feature (3535)..(3536): n is a, c, g, or t
  misc_feature (3538)..(3541): n is a, c, g, or t
  misc_feature (3543)..(3545): n is a, c, g, or t
  misc_feature (3547)..(3547): n is a, c, g, or t
  misc_feature (3549)..(3549): n is a, c, g, or t
  misc_feature (3553)..(3556): n is a, c, g, or t
  misc_feature (3559)..(3559): n is a, c, g, or t
  misc_feature (3561)..(3570): n is a, c, g, or t
  misc_feature (3573)..(3579): n is a, c, g, or t
  misc_feature (3582)..(3586): n is a, c, g, or t
  misc_feature (3589)..(3590): n is a, c, g, or t
  misc_feature (3592)..(3595): n is a, c, g, or t
  misc_feature (3597)..(3598): n is a, c, g, or t
  misc_feature (3600)..(3601): n is a, c, g, or t
  misc_feature (3603)..(3605): n is a, c, g, or t
  misc_feature (3607)..(3611): n is a, c, g, or t
  misc_feature (3614)..(3616): n is a, c, g, or t
  misc_feature (3618)..(3618): n is a, c, g, or t
  misc_feature (3620)..(3622): n is a, c, g, or t
  misc_feature (3625)..(3625): n is a, c, g, or t
  misc_feature (3627)..(3629): n is a, c, g, or t
  misc_feature (3632)..(3636): n is a, c, g, or t
  misc_feature (3638)..(3644): n is a, c, g, or t
  misc_feature (3646)..(3648): n is a, c, g, or t
  misc_feature (3650)..(3667): n is a, c, g, or t
  misc_feature (3670)..(3688): n is a, c, g, or t
  misc_feature (3690)..(3700): n is a, c, g, or t
  misc_feature (3702)..(3707): n is a, c, g, or t
  misc_feature (3709)..(3716): n is a, c, g, or t
  misc_feature (3718)..(3752): n is a, c, g, or t
  misc_feature (3754)..(3786): n is a, c, g, or t
  misc_feature (3788)..(3854): n is a, c, g, or t
  misc_feature (3856)..(3877): n is a, c, g, or t
  misc_feature (3879)..(3880): n is a, c, g, or t
  misc_feature (3882)..(3887): n is a, c, g, or t
  misc_feature (3889)..(3890): n is a, c, g, or t
  misc_feature (3892)..(3920): n is a, c, g, or t
  misc_feature (3922)..(3971): n is a, c, g, or t
  misc_feature (3973)..(3989): n is a, c, g, or t
  misc_feature (3991)..(3995): n is a, c, g, or t
  misc_feature (3997)..(4000): n is a, c, g, or t
aacgaaagaatttctttttctgttcctaacaccatcaccgttttaccttgagtttgcatatcggcaattttttcttttttatcgcttgaaatgcttccgtgtaattcctcaaaaagattttgacttcccacataatacatttcattatttattttggctttaacgcctttacctgtaatggattgaaaatcctctactgttacttcattgaattttaatccattttcttctgcttttcgcataatcgctgaagcaagagggtgctgcgatcctttttcaatggctgatgttatggttattaattcattttcatttctaccatatgtcacaatgtctgttacagctggaatccctttggttaatgttcctgttttatcaaaggctatcgcttttaagtgtcctgctgcttctaaatggataccacctttaattaatacaccatttttcgctgcatttcctattgctgtaaccacagcaactggagttgagactactaaggcacaaggacaaccaaccactaatacagctaatccttgataaatccattggctccagtctccgccaaataatggtggaactactgcaattaaaagagctagtatgacaatagctggtgtatagtattttgcaaatttatcgacaaacgcttgagagggggcccgttctgcttgggcttcttctaccaagtgaatgatttttgaaagagtggtatcttcaactcgttttgttactttaacctcaagtaacccttcttcattcaaggttcctgcaaatacttcatcatttgtgattttcgttactggaacactttcacctgtaatcgcagcctgatttaatgtcgatgtacctttaaccactattccatccattgctaacttttgaccgggcttaactatcatgatgtctccaacttgaatctcatcaacatgaatcatcatttcttcattgcctcgtcgaattaacgcttcttttggggcaatatccattaaagattcaatagattgacgtgctttatccattgaataacgctctaatgcttcactaatcgcaaataggataacaacggttgccccttcaccccattcaccaataattgcagctcctataatggcaatagtcataagcgtattcatatcgaaatttaatctgcttaaatttttgagacctttaataaataacgaatatccaccgattaaaatggacgctgcataaccaattgtcggtagaacatgctcttcaccatactgctctcctaagaaccagctaactacaagtaaaagagctgatatatataccttaatgttttctttctgcttccaaaaaggttctccttctaccctttgttctttttcatctcgaatttttaaattttcaaatgctcctgctttttctaattcttcaatggttgtcgtccctttaacataaactttagatgctccgaaatttactttcgcatcctgaacaccgggaagttctttaacattattttcaaaaatggctgcacagttagtacaagtaaatccttgaacacgataggctttcatttcttcttcgaactgttttgctttcccactagacattgatcttcacctctttcttaantgccaatgcaatcatcataatttgtctgatatgctcatcatctaatgaataaaatgcaagtttnccctcttttcgaaacttaacaatcccttgcttatggagcgttcgcaggtgatgagaggcatttgcaaccgtaacacctataatatttgcaatatcacacacacacagttcgtcatcttgacacaatgcataggtaatttttgctctatttttatctgcaatagcttttaacatttgggcaacactagaaatatctactgtctgtaaattaccttgtattcgattgaccttttcttcgtcataacaataaatttcacaagtatcttttttaatcatattctcacctcaatatcattcaagtatttgcttgaacatagtatcncccttttcattaattaagtcaagtgtttttttgagtgaataaaaaaattcataaaaaaagacttggagtacccaattctaataacaaaataaccaatctgcataagactttaagtacataacattattagtattgaacttgttgaggaggtgctctatgaatcagcttgaatttcagcgtaatcacctacaaatnnannannnnannganannnncnannantntnnannnnncnnntnnnnntnnncnnnnntnnnnnnnnnnnnnnnnnntntnnntgnnnnnnncntnnnnnnnntnnnnnnnnnnnnnnannntnncnnnnncnnnannaagnanaannntnnagatancnntnnnnnnnnnnnnnntntnnnnntnngnnnntnannnnnnnnnncannnntctnnnntnnnnnanatnnnaannnnnnnnnnnananantccananntnnnnntnnnncnnnnnnnnactnnnnnnnnnaannctntnnntaannnntnaaannnnactntnnanngaaactnnnnnatntntannaaannnnntttcnnnnanannnnnnncnnnnnnnnntnttnnttnctnttnnnnnnanannccnnnannnnncnnntatnngtnnaagaaaannnnannnnantnannnnanannnngnngtnatnnaanannccactncnnnnntntnnnntnnnattntnnanttaaannnnccntnnnnttnaannnnntanattnttnnnannaannttnnnnnnannannnaannnngnnnanttnnnnnnntnnnnnnannnnannnnnntnnannnnnnnntncnnnnnnnnnnntnnnannntnnnngnnannantnnnnnnnnaatnnnnnnnncnntnannnnnnnntnnnnttnnnnnnnnntnncctnntanntnnnnnnnannnnnnnnnnnnnnnnntnnnnnnttnnnnnnnnnntnannnnnnnnnttnnnnannnannnnnnnnnannttntnnnnnnnnnnanntnnntnnnttannnnnnntnnanntnannaannttgtntnncnnnnnnnnntnnnnngnntnnnnnannnaanngnntnnnnnnntnnattnnnnnnnnnnnaannttnnnnannnnntnnncnatnntnnnnnnnnnnnnttnnttnnnnnnnanttnnnncnnnnnnnnnnnnnnncnnnaaannnnnnnnnnatnnaannnnntnnnnntnnnntnnnnnnnnnttnnnnnnnnntnnnntnnnnnnnnnnnnnannnnnnnnnnnntnnnnnnnnnnnttnnnnnnaancnntnnnnnnntttnntnttnnnannnnnnnntnaaannnnttnnnnnannnnnnnnnnnnnnnntnnnnnnnnangnnnnnnnnannnnnnnnnnnnnnnnnnnnnnntnnnnnnnnaaaannnnntnnnnnnnnnnnnnnnnnnnnnnnnnnnnnnnnnnnnnnnnnnnnnnnnnnnannnnnccnnnnnnnnnnaannnnnnannnntnnnnnnnanannnnnannnannaannnnanntnnnntnnnantncaannnntanannnnnnnnnnaannnnnnnaannnnnaannannnnannannannngnnnnnccnnncncnnnttnannnccnnnnncnnnnnnntnnncnnnnnnnnnnnnnnnnnnaannnnnnnnnnnnnnnnnnntnnnnnnnnnnntnnnnnntnnnnnnnnannnnnnnnnnnnnnnnnnnnnnnnnnnnnnnnnnncnnnnnnnnnnnnnnnnnnnnnnnnnnnnnnnnnannnnnnnnnnnnnnnnnnnnnnnnnnnnnnnnnnnnnnnnnnnnnnnnnnnnnnnnnnnnnnnnnnnannnnnnnnnnnnnnnnnnnnnntnnannnnnnannannnnnnnnnnnnnnnnnnnnnnnnnnnnntnnnnnnnnnnnnnnnnnnnnnnnnnnnnnnnnnnnnnnnnnnnnnnnnnntnnnnnnnnnnnnnnnnnannnnnannnn

SEQ ID NO: 237 - DNA, 4000 bp, Escherichia coli
  misc_feature (1989)..(1990): n is a, c, g, or t
  misc_feature (2519)..(2519): n is a, c, g, or t
  misc_feature (2593)..(2593): n is a, c, g, or t
  misc_feature (2598)..(2598): n is a, c, g, or t
  misc_feature (2622)..(2622): n is a, c, g, or t
  misc_feature (2683)..(2683): n is a, c, g, or t
  misc_feature (2742)..(2742): n is a, c, g, or t
  misc_feature (2744)..(2744): n is a, c, g, or t
  misc_feature (2746)..(2746): n is a, c, g, or t
  misc_feature (2752)..(2754): n is a, c, g, or t
  misc_feature (2756)..(2757): n is a, c, g, or t
  misc_feature (2759)..(2759): n is a, c, g, or t
  misc_feature (2761)..(2762): n is a, c, g, or t
  misc_feature (2764)..(2765): n is a, c, g, or t
  misc_feature (2767)..(2769): n is a, c, g, or t
  misc_feature (2771)..(2775): n is a, c, g, or t
  misc_feature (2779)..(2780): n is a, c, g, or t
  misc_feature (2782)..(2782): n is a, c, g, or t
  misc_feature (2784)..(2786): n is a, c, g, or t
  misc_feature (2788)..(2792): n is a, c, g, or t
  misc_feature (2795)..(2797): n is a, c, g, or t
  misc_feature (2801)..(2807): n is a, c, g, or t
  misc_feature (2809)..(2814): n is a, c, g, or t
  misc_feature (2816)..(2817): n is a, c, g, or t
  misc_feature (2820)..(2822): n is a, c, g, or t
  misc_feature (2827)..(2828): n is a, c, g, or t
  misc_feature (2831)..(2833): n is a, c, g, or t
  misc_feature (2836)..(2836): n is a, c, g, or t
  misc_feature (2840)..(2843): n is a, c, g, or t
  misc_feature (2846)..(2849): n is a, c, g, or t
  misc_feature (2851)..(2855): n is a, c, g, or t
  misc_feature (2857)..(2857): n is a, c, g, or t
  misc_feature (2861)..(2863): n is a, c, g, or t
  misc_feature (2865)..(2867): n is a, c, g, or t
  misc_feature (2869)..(2869): n is a, c, g, or t
  misc_feature (2872)..(2872): n is a, c, g, or t
  misc_feature (2874)..(2874): n is a, c, g, or t
  misc_feature (2876)..(2877): n is a, c, g, or t
  misc_feature (2881)..(2889): n is a, c, g, or t
  misc_feature (2893)..(2895): n is a, c, g, or t
  misc_feature (2897)..(2898): n is a, c, g, or t
  misc_feature (2901)..(2901): n is a, c, g, or t
  misc_feature (2903)..(2905): n is a, c, g, or t
  misc_feature (2907)..(2909): n is a, c, g, or t
  misc_feature (2911)..(2914): n is a, c, g, or t
  misc_feature (2916)..(2917): n is a, c, g, or t
  misc_feature (2920)..(2921): n is a, c, g, or t
  misc_feature (2924)..(2927): n is a, c, g, or t
  misc_feature (2929)..(2932): n is a, c, g, or t
  misc_feature (2935)..(2937): n is a, c, g, or t
  misc_feature (2939)..(2941): n is a, c, g, or t
  misc_feature (2944)..(2944): n is a, c, g, or t
  misc_feature (2947)..(2948): n is a, c, g, or t
  misc_feature (2951)..(2955): n is a, c, g, or t
  misc_feature (2958)..(2960): n is a, c, g, or t
  misc_feature (2964)..(2965): n is a, c, g, or t
  misc_feature (2967)..(2972): n is a, c, g, or t
  misc_feature (2975)..(2975): n is a, c, g, or t
  misc_feature (2977)..(2979): n is a, c, g, or t
  misc_feature (2982)..(2987): n is a, c, g, or t
  misc_feature (2989)..(2989): n is a, c, g, or t
  misc_feature (2992)..(2993): n is a, c, g, or t
  misc_feature (2995)..(3000): n is a, c, g, or t
  misc_feature (3006)..(3006): n is a, c, g, or t
  misc_feature (3008)..(3011): n is a, c, g, or t
  misc_feature (3014)..(3014): n is a, c, g, or t
  misc_feature (3016)..(3016): n is a, c, g, or t
  misc_feature (3018)..(3023): n is a, c, g, or t
  misc_feature (3025)..(3026): n is a, c, g, or t
  misc_feature (3030)..(3030): n is a, c, g, or t
  misc_feature (3033)..(3034): n is a, c, g, or t
  misc_feature (3036)..(3036): n is a, c, g, or t
  misc_feature (3040)..(3051): n is a, c, g, or t
  misc_feature (3053)..(3057): n is a, c, g, or t
  misc_feature (3059)..(3060): n is a, c, g, or t
  misc_feature (3062)..(3065): n is a, c, g, or t
  misc_feature (3067)..(3067): n is a, c, g, or t
  misc_feature (3070)..(3070): n is a, c, g, or t
  misc_feature (3072)..(3073): n is a, c, g, or t
  misc_feature (3076)..(3082): n is a, c, g, or t
  misc_feature (3085)..(3090): n is a, c, g, or t
  misc_feature (3096)..(3096): n is a, c, g, or t
  misc_feature (3100)..(3100): n is a, c, g, or t
  misc_feature (3108)..(3111): n is a, c, g, or t
  misc_feature (3113)..(3113): n is a, c, g, or t
  misc_feature (3116)..(3121): n is a, c, g, or t
  misc_feature (3125)..(3127): n is a, c, g, or t
  misc_feature (3134)..(3138): n is a, c, g, or t
  misc_feature (3141)..(3144): n is a, c, g, or t
  misc_feature (3148)..(3148): n is a, c, g, or t
  misc_feature (3150)..(3151): n is a, c, g, or t
  misc_feature (3153)..(3154): n is a, c, g, or t
  misc_feature (3156)..(3157): n is a, c, g, or t
  misc_feature (3159)..(3160): n is a, c, g, or t
  misc_feature (3162)..(3162): n is a, c, g, or t
  misc_feature (3166)..(3166): n is a, c, g, or t
  misc_feature (3169)..(3169): n is a, c, g, or t
  misc_feature (3172)..(3173): n is a, c, g, or t
  misc_feature (3175)..(3175): n is a, c, g, or t
  misc_feature (3177)..(3178): n is a, c, g, or t
  misc_feature (3181)..(3181): n is a, c, g, or t
  misc_feature (3184)..(3185): n is a, c, g, or t
  misc_feature (3187)..(3187): n is a, c, g, or t
  misc_feature (3190)..(3191): n is a, c, g, or t
  misc_feature (3194)..(3195): n is a, c, g, or t
  misc_feature (3197)..(3197): n is a, c, g, or t
  misc_feature (3199)..(3199): n is a, c, g, or t
  misc_feature (3201)..(3202): n is a, c, g, or t
  misc_feature (3207)..(3209): n is a, c, g, or t
  misc_feature (3212)..(3212): n is a, c, g, or t
  misc_feature (3214)..(3215): n is a, c, g, or t
  misc_feature (3218)..(3218): n is a, c, g, or t
  misc_feature (3221)..(3230): n is a, c, g, or t
  misc_feature (3235)..(3236): n is a, c, g, or t
  misc_feature (3239)..(3239): n is a, c, g, or t
  misc_feature (3241)..(3241): n is a, c, g, or t
  misc_feature (3243)..(3244): n is a, c, g, or t
  misc_feature (3246)..(3246): n is a, c, g, or t
  misc_feature (3257)..(3257): n is a, c, g, or t
  misc_feature (3271)..(3271): n is a, c, g, or t
  misc_feature (3287)..(3287): n is a, c, g, or t
  misc_feature (3291)..(3291): n is a, c, g, or t
  misc_feature (3293)..(3293): n is a, c, g, or t
  misc_feature (3295)..(3296): n is a, c, g, or t
  misc_feature (3301)..(3301): n is a, c, g, or t
  misc_feature (3328)..(3328): n is a, c, g, or t
  misc_feature (3330)..(3330): n is a, c, g, or t
  misc_feature (3333)..(3334): n is a, c, g, or t
  misc_feature (3337)..(3337): n is a, c, g, or t
  misc_feature (3340)..(3340): n is a, c, g, or t
  misc_feature (3347)..(3347): n is a, c, g, or t
  misc_feature (3351)..(3352): n is a, c, g, or t
  misc_feature (3358)..(3358): n is a, c, g, or t
  misc_feature (3364)..(3367): n is a, c, g, or t
  misc_feature (3378)..(3378): n is a, c, g, or t
  misc_feature (3399)..(3399): n is a, c, g, or t
  misc_feature (3406)..(3407): n is a, c, g, or t
  misc_feature (3412)..(3412): n is a, c, g, or t
  misc_feature (3418)..(3418): n is a, c, g, or t
  misc_feature (3425)..(3425): n is a, c, g, or t
  misc_feature (3427)..(3427): n is a, c, g, or t
  misc_feature (3440)..(3440): n is a, c, g, or t
  misc_feature (3448)..(3448): n is a, c, g, or t
  misc_feature (3475)..(3475): n is a, c, g, or t
  misc_feature (3511)..(3511): n is a, c, g, or t
  misc_feature (3520)..(3520): n is a, c, g, or t
  misc_feature (3529)..(3529): n is a, c, g, or t
  misc_feature (3531)..(3531): n is a, c, g, or t
  misc_feature (3694)..(3694): n is a, c, g, or t
  misc_feature (3698)..(3698): n is a, c, g, or t
tcagctaaaagtaatgcgtctccttagctcagctggatagcgcagccgacttctaatcggcaggtcgagggttcgaatccttcaggggacgccaactttataatgctccttctcgtcgaaaatcagcagacaataaatcgtagcttacgtcagtgtccgaaattcggagggggtagctcaaccctgcaaaaggagaccaaggcgcaaattgccatgatgttcttaaatatccctgccaccgtcgccgcgtgtaaggctggccttattcgcttccgcccgcgaatgggtggacgccgacatccaaactggactctcatgcgtccgcgcttatcattgggcagctgctaaaaacgttgaaatccgagtgtttaaatttcaaacgagttattaattttatccagaatagcttttgcctgaaggccgtccgagccccgtttttcgtcaaaatattttgggatggaattgaaagcccttaaaagcccgccattcattaagtattctggaaaagtcttatttcttagcctctggcttccaagttcaaccgacttaacattggctttagaccattttttggtggcaggtttcggtaacttttgtccaacgacaaacaggatgttggagttctctaaaaactcaatttcgaagtactcttccaaaagcgcagtcagtgatagagatgtataataggcaagatgtgccgcgaaaaaatggtttgttggtgaggttttcttactctcaagattcggcacctccaccactaaatgacccccatcatttaaagtttcatacatttttttaataacgtttcgtggttgagcaaggtgctcaagaacgtggaataaggtgatagtgttaaatttttgtttctgtgaaatggcagacagatcttttacttctagtggtacttggtacgcatcacgtccaaattcgagataaccaatgtttagatcgatgccgctggctttgaacccattggccgttgccaaatatgtaaactcacctccgccggcgccaacatccaggagtgatgatccggtttgcacgaagggcttcatcttttgaagtcgctcggcagccattttcccagcacgatagatgtgctttggtttgggctgcgaaatattcttgtattttttgcgataggctattgagtaaaattcagacaattcgtcagcagttggcatttgtgcggtctgaactgtgccgcaggtttggcagcaagcaattctaattggctcagaggttttggcgtcctttaagttgcgatggcacgccgtagatccgctgcaaattagacatgagaaattcaagagcgccttcattcagttaaaacctctcaaaaactacttgataggctaaatgatatcgacagaccttttgtcccaaaaccatttttcaagtctaagtcttgataggcaagccgggtatttaaaactatttggtctaaaggcttcgtgattgatatttcagctgttgtccctttcttgcgtgtgctggaaagccgatgcgacggaaggttatctctattaagatcgattttggaggctgcaaggtcgatgtttagcccgctcacttcatgctttacgtacaggcttaatgccttgctctcagtgtcgatggaatggcccataacacgcccatggtgtgtatagcctgacgtgtagtgcccatttcgatacgcggtgttgggcccgcaccatccgccttctgtcctgtccaccgtagtatcggccgcttcgatcgtgataatgagcggccggccttgcaaacgggcctctttttctattccaaaaagtttcgagtagcaggacggcagacctccagattcatcttcgccatatccttgtaaataaaaacgataggagcgatcactaaaactaggcgtgtaagatgcactaaaaccaccgagctggttgtagtcgaattcatcggaatggttttcaccggaaagcattttcaagaaaccattaggcgagctgttgaaatttnnccccccccattgcgcggtgcggaagagcccaagatccagatctctagttggggaaaatttgaaacgtgcgccaaaaagcattgcaccgggaacacccctggcctgctctaattgcccgttgaaggtctccgcctctatcggaccaaagtatttcaacagcggcacgtctaaagcaaaatcggtgcggtagcgcaaatataccgatggaacaggccgagcattctgagacaaaatgagcgaattgtaacgggacggagaccagtgtcggccttttttgcccaccccaaacaaccaattctgggatttatattcaatgtaggaaccatcccacattatatccccgtcggttgccgtagcagataaatttgcataaagatcttcgactgtgaataatttttggagtttaactccgctatcgtcgcgacgccaaatactggggctgtcacctgaatttaattgcaaagtcacctcatttgcagaggataaactttgctctttttgcagttcgcttgctgataatttaacagcngacaaatttaaaattaaggctattaaaagggacaaaaaaaatggcttgggaaagaacatattcataataacatnttctnccgtttagtttcatttcgagacgnattacatccgttgacattattacgcaagcccttcgcaaaaatactcggaacgtcgctttcngattacacttcaattgttgcgaacaatgtttagccttatattactacgcttcaacatgngntntttttnnntnnananntnntnnntnnnnntttnncnannntnnnnnaannntttnnnnnnntnnnnnnannaannntaatnntgnnnacnccannnnaannnntnnnnnanactnnnannnangangnannaaannnnnnnnncgannntnnaanannncnnngnnnntnnttnntannnntnnnngcnnntnnnttnttnnttnnnnntgnnngtgnntnnnnnntcntnnnggnnnnnnantanncnnnnnntgcggntnnnnaantnannnnnncnnctanttnnanaatnnnnnnnnnnnngnnnnncnncnnnncnctngnnggnnnnnnnggnnnnnnggccancttngctggatnnnngngcnnnnnngctnnntcaactnnnnnaannnntatngnnanngnnannantttnatngannancnngangcnnanttnnatnncnangnngaccnnnacntnnacncannnnnnnnnnacgcnntcnancnncnttggaagtccntcataaagcgtgcnatcggctggcaaaaancttncncnnacccncaagaggccatgtggcagggcatcgtngnaanntanacnaaaagtnttgnnctggangaaacnnnngacggggctgntaaaattgtgaccacgcatgngaacccnnagcgngcggcngaaattncnaacacaattatgnatgaaatnatctccactttagaaaataagagaaanactgaacaggacgcgcagctgtcctacctgtccaanacattggcnaaggccctnantgacttggaggcgtcacagtctagtctcaagcaattcgccctagagaacagcgcactgcccctagaaagttttgccgccaggtctttgcagcttgatggattgcgtgaacaactgagccgaaccaccgagctgcatgatgcggttgtcgtgctttcgtcaatnctgnagaataagacaacagatcaggagagttatctggcgctgcgcaagcagtttcccatcgttgatcaagttgagttccgccgggtcttgggacaaaatgaaattatcggctcctggagttggccggaggctagctctgtggacgcagttgttgatacgttgactgaacgcaaaagtagactgcagtcgcaaataaatgcggcgcagatagatgcggagcgcgaaggtctggccctagaaacttacgcgaaattggagcgtgaagctaaaattgccgaggcgacctacaccgtaatgattgagcaa

SEQ ID NO: 238 - DNA, 4000 bp, Escherichia coli
  misc_feature (1)..(30): n is a, c, g, or t
  misc_feature (32)..(44): n is a, c, g, or t
  misc_feature (46)..(46): n is a, c, g, or t
  misc_feature (48)..(70): n is a, c, g, or t
  misc_feature (72)..(72): n is a, c, g, or t
  misc_feature (74)..(77): n is a, c, g, or t
  misc_feature (79)..(102): n is a, c, g, or t
  misc_feature (104)..(142): n is a, c, g, or t
  misc_feature (144)..(178): n is a, c, g, or t
  misc_feature (180)..(187): n is a, c, g, or t
  misc_feature (189)..(194): n is a, c, g, or t
  misc_feature (196)..(211): n is a, c, g, or t
  misc_feature (213)..(303): n is a, c, g, or t
  misc_feature (305)..(323): n is a, c, g, or t
  misc_feature (326)..(345): n is a, c, g, or t
  misc_feature (347)..(354): n is a, c, g, or t
  misc_feature (356)..(365): n is a, c, g, or t
  misc_feature (367)..(394): n is a, c, g, or t
  misc_feature (396)..(396): n is a, c, g, or t
  misc_feature (399)..(426): n is a, c, g, or t
  misc_feature (428)..(474): n is a, c, g, or t
  misc_feature (476)..(495): n is a, c, g, or t
  misc_feature (497)..(502): n is a, c, g, or t
  misc_feature (504)..(505): n is a, c, g, or t
  misc_feature (507)..(508): n is a, c, g, or t
  misc_feature (510)..(510): n is a, c, g, or t
  misc_feature (512)..(519): n is a, c, g, or t
  misc_feature (521)..(529): n is a, c, g, or t
  misc_feature (531)..(532): n is a, c, g, or t
  misc_feature (536)..(536): n is a, c, g, or t
  misc_feature (538)..(551): n is a, c, g, or t
  misc_feature (553)..(567): n is a, c, g, or t
  misc_feature (569)..(586): n is a, c, g, or t
  misc_feature (588)..(589): n is a, c, g, or t
  misc_feature (591)..(594): n is a, c, g, or t
  misc_feature (596)..(605): n is a, c, g, or t
  misc_feature (608)..(620): n is a, c, g, or t
  misc_feature (622)..(626): n is a, c, g, or t
  misc_feature (629)..(631): n is a, c, g, or t
  misc_feature (633)..(642): n is a, c, g, or t
  misc_feature (645)..(651): n is a, c, g, or t
  misc_feature (653)..(655): n is a, c, g, or t
  misc_feature (657)..(658): n is a, c, g, or t
  misc_feature (662)..(662): n is a, c, g, or t
  misc_feature (664)..(669): n is a, c, g, or t
  misc_feature (673)..(673): n is a, c, g, or t
  misc_feature (675)..(679): n is a, c, g, or t
  misc_feature (684)..(684): n is a, c, g, or t
  misc_feature (688)..(689): n is a, c, g, or t
  misc_feature (692)..(692): n is a, c, g, or t
  misc_feature (698)..(698): n is a, c, g, or t
  misc_feature (700)..(700): n is a, c, g, or t
  misc_feature (707)..(707): n is a, c, g, or t
  misc_feature (709)..(709): n is a, c, g, or t
  misc_feature (711)..(711): n is a, c, g, or t
  misc_feature (714)..(715): n is a, c, g, or t
  misc_feature (717)..(720): n is a, c, g, or t
  misc_feature (722)..(723): n is a, c, g, or t
  misc_feature (725)..(725): n is a, c, g, or t
  misc_feature (727)..(728): n is a, c, g, or t
  misc_feature (730)..(731): n is a, c, g, or t
  misc_feature (734)..(734): n is a, c, g, or t
  misc_feature (736)..(738): n is a, c, g, or t
  misc_feature (741)..(742): n is a, c, g, or t
  misc_feature (744)..(745): n is a, c, g, or t
  misc_feature (749)..(749): n is a, c, g, or t
  misc_feature (752)..(753): n is a, c, g, or t
  misc_feature (757)..(763): n is a, c, g, or t
  misc_feature (765)..(768): n is a, c, g, or t
  misc_feature (770)..(778): n is a, c, g, or t
  misc_feature (784)..(785): n is a, c, g, or t
  misc_feature (788)..(789): n is a, c, g, or t
  misc_feature (792)..(792): n is a, c, g, or t
  misc_feature (812)..(812): n is a, c, g, or t
  misc_feature (880)..(880): n is a, c, g, or t
  misc_feature (967)..(967): n is a, c, g, or t
  misc_feature (985)..(985): n is a, c, g, or t
  misc_feature (994)..(994): n is a, c, g, or t
  misc_feature (1272)..(1272): n is a, c, g, or t
  misc_feature (1714)..(1714): n is a, c, g, or t
  misc_feature (2038)..(2038): n is a, c, g, or t
  misc_feature (2047)..(2047): n is a, c, g, or t
  misc_feature (2230)..(2230): n is a, c, g, or t
  misc_feature (2329)..(2330): n is a, c, g, or t
  misc_feature (2348)..(2352): n is a, c, g, or t
  misc_feature (2354)..(2354): n is a, c, g, or t
  misc_feature (2357)..(2359): n is a, c, g, or t
  misc_feature (2377)..(2377): n is a, c, g, or t
  misc_feature (2412)..(2415): n is a, c, g, or t
  misc_feature (2443)..(2443): n is a, c, g, or t
  misc_feature (2530)..(2533): n is a, c, g, or t
  misc_feature (2535)..(2536): n is a, c, g, or t
  misc_feature (2539)..(2539): n is a, c, g, or t
  misc_feature (2542)..(2542): n is a, c, g, or t
  misc_feature (2545)..(2545): n is a, c, g, or t
  misc_feature (2548)..(2548): n is a, c, g, or t
  misc_feature (2552)..(2552): n is a, c, g, or t
  misc_feature (2555)..(2555): n is a, c, g, or t
  misc_feature (2558)..(2561): n is a, c, g, or t
  misc_feature (2563)..(2563): n is a, c, g, or t
  misc_feature (2948)..(2948): n is a, c, g, or t
  misc_feature (2959)..(2959): n is a, c, g, or t
  misc_feature (2990)..(2990): n is a, c, g, or t
  misc_feature (3017)..(3017): n is a, c, g, or t
  misc_feature (3023)..(3023): n is a, c, g, or t
  misc_feature (3027)..(3027): n is a, c, g, or t
  misc_feature (3147)..(3147): n is a, c, g, or t
  misc_feature (3169)..(3169): n is a, c, g, or t
  misc_feature (3188)..(3188): n is a, c, g, or t
  misc_feature (3192)..(3192): n is a, c, g, or t
  misc_feature (3213)..(3213): n is a, c, g, or t
  misc_feature (3217)..(3217): n is a, c, g, or t
  misc_feature (3219)..(3219): n is a, c, g, or t
  misc_feature (3224)..(3224): n is a, c, g, or t
  misc_feature (3226)..(3226): n is a, c, g, or t
  misc_feature (3229)..(3229): n is a, c, g, or t
  misc_feature (3231)..(3231): n is a, c, g, or t
  misc_feature (3233)..(3233): n is a, c, g, or t
  misc_feature (3244)..(3244): n is a, c, g, or t
  misc_feature (3246)..(3247): n is a, c, g, or t
  misc_feature (3257)..(3257): n is a, c, g, or t
  misc_feature (3260)..(3260): n is a, c, g, or t
  misc_feature (3262)..(3262): n is a, c, g, or t
  misc_feature (3265)..(3265): n is a, c, g, or t
  misc_feature (3270)..(3270): n is a, c, g, or t
  misc_feature (3436)..(3436): n is a, c, g, or t
  misc_feature (3485)..(3486): n is a, c, g, or t
  misc_feature (3537)..(3538): n is a, c, g, or t
  misc_feature (3723)..(3723): n is a, c, g, or t
  misc_feature (3731)..(3732): n is a, c, g, or t
  misc_feature (3734)..(3738): n is a, c, g, or t
  misc_feature (3740)..(3744): n is a, c, g, or t
  misc_feature (3747)..(3747): n is a, c, g, or t
  misc_feature (3750)..(3760): n is a, c, g, or t
  misc_feature (3762)..(3769): n is a, c, g, or t
  misc_feature (3772)..(3799): n is a, c, g, or t
  misc_feature (3801)..(3801): n is a, c, g, or t
  misc_feature (3804)..(3812): n is a, c, g, or t
  misc_feature (3815)..(3816): n is a, c, g, or t
  misc_feature (3818)..(3826): n is a, c, g, or t
  misc_feature (3828)..(3831): n is a, c, g, or t
  misc_feature (3833)..(3847): n is a, c, g, or t
  misc_feature (3849)..(3852): n is a, c, g, or t
  misc_feature (3854)..(3859): n is a, c, g, or t
  misc_feature (3861)..(3884): n is a, c, g, or t
  misc_feature (3886)..(3891): n is a, c, g, or t
  misc_feature (3893)..(3893): n is a, c, g, or t
  misc_feature (3895)..(3896): n is a, c, g, or t
  misc_feature (3898)..(3920): n is a, c, g, or t
  misc_feature (3922)..(3939): n is a, c, g, or t
  misc_feature (3941)..(3944): n is a, c, g, or t
  misc_feature (3946)..(3948): n is a, c, g, or t
  misc_feature (3950)..(3961): n is a, c, g, or t
  misc_feature (3963)..(3971): n is a, c, g, or t
  misc_feature (3973)..(3973): n is a, c, g, or t
  misc_feature (3975)..(3986): n is a, c, g, or t
  misc_feature (3988)..(4000): n is a, c, g, or t
nnnnnnnnnnnnnnnnnnnnnnnnnnnnnnannnnnnnnnnnnncntnnnnnnnnnnnnnnnnnnnnnnntngnnnngnnnnnnnnnnnnnnnnnnnnnnnnannnnnnnnnnnnnnnnnnnnnnnnnnnnnnnnnnnnnnngnnnnnnnnnnnnnnnnnnnnnnnnnnnnnnnnnnntnnnnnnnnannnnnncnnnnnnnnnnnnnnnntnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngnnnnnnnnnnnnnnnnnnnagnnnnnnnnnnnnnnnnnnnngnnnnnnnngnnnnnnnnnnannnnnnnnnnnnnnnnnnnnnnnnnnnngnggnnnnnnnnnnnnnnnnnnnnnnnnnnnntnnnnnnnnnnnnnnnnnnnnnnnnnnnnnnnnnnnnnnnnnnnnnnntnnnnnnnnnnnnnnnnnnnntnnnnnnanntnntntnnnnnnnnannnnnnnnnanntttnannnnnnnnnnnnnntnnnnnnnnnnnnnnngnnnnnnnnnnnnnnnnnntnntnnnnannnnnnnnnnttnnnnnnnnnnnnnannnnnttnnnannnnnnnnnnttnnnnnnngnnngnntttnannnnnnaaantnnnnnaaaanaagnnaantaaaananaccagtnantnttnnannnncnngnannannaanannnttnntnnaganacnnctannnnnnntnnnncnnnnnnnnngggatnngannttnaaaagggttcaggttttaangttataggatcaagcgaataagtgcatatggtggatgccttggcgattacaggcgatgaaggacgtgntagcctgcgtaaagtttcggggagctggcaaataagctttgatccggaaatgtccgaatggggaaacccacccgcaagggtaaccgntcctgaatatataggganatggtggcnaaccgagtgaactgaaacatctaagtagctcgaggaaaagaaatcaaccgagattccgtaagtagtggcgagcgaacatggaatagcctgttatttttagcacatgcgatagtagaacggaatggaaagtccggccatagagggtgatagccccttatacgaaatcccgtgtgtggaactagggtaacgacaagtagggcggggcacgagaaaccttgtctgaacatggggggaccatcctccaaggctaaatactcgtaatcgaccgatagtgaacnagtaccgtgagggaaaggcgaaaagaaccccgggaggggagtgaaatagatcctgaaaccgtatgcatacaaacagtgggagcggacttgttccgtgactgcgtaccttttgtataatgggtcagcgacttacattcagtagcaagcttaaccgataggggaggcgtagcgaaagcgagtccgaatagggcgtctagttgctgggtgtagacccgaaaccaagtgatctatccatggccaggatgaaggtgccgtaacaggtactggaggtccgaacccacaaatgttgaaaaatttggggatgagctgtggataggggtgaaaggctaaacaaacttggaaatagctggttctctccgaaaactatttaggtagtgcctcgtatatcattctcgggggtagagcactgttatggctagggggttcataagaacttaccaanccattgcaaactccgaatactgagaaatgcaattacgggagacagaccatgggtgctaacgtccgtggtcaagagggaaacaacccagaccgacagctaaggtcccaaatgacgtgctaagtggaaaacgaagtgggaaggcatagacagccaggatgttggcttagaagcagccatcatttaaagaaagcgtaatagctcactggtcgagtcgtcctgcgcggaagatgtaacggggctaagcacgtaaccgaagcttcggatgctgcattcttcggaatgtatgcatggtaggagagcgttctgtaggcctgcgaaggtgtnctgtgaggnatgctggaggtatcagaagtgcgaatgctgacatgagtagcgataaagggagtgaaaagctccctcgccgaaaacccaaggtttcctgcgcaacgttcatcggcgcagggtgagtcggcccctaaggtgaggcagagatgcgtagctgatgggaaacaggttaatattcctgtacctgtatanaatgcgatgtggggacggagaaggttaggtcagccgggtgttggatgtcccggttcaagcgtgtaggcagattctttaggcaaatccggagagtcaatnntgaggcgtgataacgagnnnnntngtnnntgaagtgattgataccangcttccaagaaaagccactaagcttcagttgtatnnnnaccgtaccgcaaaccgacacaggtgggnaggatgagaattctaaggcgcttgagagaacccgggagaaggaactcggcaaattagcaccgtaacttcgggagaaggtgcgccccnnnngnntgnagnganttnctcntgnagnnnnanggggttgcagtgaaaaggtggctgcgactgtttaataaaaacacagcactctgcaaacacgaaagtggacgtatagggtgtgacgcctgcccggtgctggaagattaaatgatggggtgcaagctcttgattgaagtcccagtaaacggcggccgtaactataacggtcctaaggtagcgaaattccttgtcgggtaagttccgacccgcacgaatggcgtaacgatggccacactgtctcctctcgggactcagcgaagttgaaatgtttgtgaagatgcaatctacccgcggctagacggaaagaccccatgaacctttactgtagctttacattggactttgacaagatttgtgtaggataggtgggagactatgaagcggngtcgctagatntcgtggagtcaaccttgaaataccaccctgntgttgttgaggttctaacctaggtccntaatcnggantggggaccgtgtatggtgggcagtttgactggggcggtctcctcccaaagagtaacggaggagtgcgaaggtaacctaggtacggtcggaaatcgtactgatagtgcaatggcataaggntgcttgactgcgagacggacangtcgagcaggtgcgaaagnaggncatagtgatccggtggttctntatngnagggncntcncncnacggataaaangnnctctgggganaanangcngattnctcccaagagttcatatcgacgggggagtttggcacctcgatgtcggctcatcacatcctggggctgtagccggtcccaagggtatggctgttcgccatttaaagtggtacgtgagctgggtttaaaacgtcgtgagacagtttggtccctatctgccgtgggcgntggaaatttgaagggacctgctcctagtacgagaggaccggagtggacnnatctctggtggaccggttatcacgccagtggtatagccgggtagctaaatnnggaagagataaacgctgaaagcatctaagcgtgaaactcgccttgagatgagatttccctgggggtttaacccccctaaagagtcgttcgagaccaggacgttgataggacggatgtggaagcgcagtaatgcgttaagctgaccgttactaattgctcgtgaggcttgatcctataaccttaanacttgaannannnnnannnnntgnttnnnnnnnnnnnannnnnnnnaannnnnnnnnnnnnnnnnnnnnnnnnnnnangannnnnnnnnttnntnnnnnnnnntnnnnannnnnnnnnnnnnnnannnngnnnnnnannnnnnnnnnnnnnnnnnnnnnnntnnnnnnanannannnnnnnnnnnnnnnnnnnnnnnannnnnnnnnnnnnnnnnncnnnncnnncnnnnnnnnnnnngnnnnnnnnncnannnnnnnnnnnngnnnnnnnnnnnnn

SEQ ID NO: 239 - DNA, 4000 bp, Escherichia coli
  misc_feature (854)..(854): n is a, c, g, or t
  misc_feature (873)..(873): n is a, c, g, or t
  misc_feature (876)..(876): n is a, c, g, or t
  misc_feature (1202)..(1202): n is a, c, g, or t
  misc_feature (1933)..(1933): n is a, c, g, or t
  misc_feature (1937)..(1937): n is a, c, g, or t
  misc_feature (1939)..(1939): n is a, c, g, or t
  misc_feature (1945)..(1946): n is a, c, g, or t
  misc_feature (1957)..(1957): n is a, c, g, or t
  misc_feature (1961)..(1961): n is a, c, g, or t
  misc_feature (1966)..(1967): n is a, c, g, or t
  misc_feature (1987)..(1988): n is a, c, g, or t
  misc_feature (1997)..(1997): n is a, c, g, or t
  misc_feature (2005)..(2005): n is a, c, g, or t
  misc_feature (2253)..(2253): n is a, c, g, or t
  misc_feature (2283)..(2283): n is a, c, g, or t
  misc_feature (2286)..(2286): n is a, c, g, or t
  misc_feature (2290)..(2293): n is a, c, g, or t
  misc_feature (2338)..(2338): n is a, c, g, or t
  misc_feature (2528)..(2528): n is a, c, g, or t
  misc_feature (2544)..(2544): n is a, c, g, or t
  misc_feature (3801)..(3801): n is a, c, g, or t
gaattgaatgactccattagcttgtcaaaatcaataaccccagaatcatatcttttgagttttgtttttgtatttttaagaaaccttttaacagtgctttttctgactagtctatgagcattaaaaatcctgtagccgagaaaatcaattcctaattcaattggaaagatgttggctttttttggatgaagtgttaatttcattgaagcaaaaaatgttttgatattttcttttacttcatgcaagtattgttttgactcatgcaatatgacaaaatcatccatatatctaacataatactttattttcagttcatattttatgtactcatctaatttgttcagataaatattggcaaataattgagaagttaaattgccaattggaattcctttttgttgagaactttgtatttttggttcttgacaattagaaaaattagatttttctgagtctgtactgtctattatgctgtctaacaactgcaataattttttgtctgcaattttttctcttagaatttttttcagaatttcatgatttacacttggaaagtattttgaaacatcgcattttaagacataatatttattgccagcttttcttatgaatttttgaattctatttgcacttgcatgagtaccttttccctttctacaagcataagaatcatagataaatcttttttcaaatattggctcaattatattgcatacagcatgatggattattctgtccctgaaaggcagggcagagattttcctttcttttggctcaaaaataataaaatgcctgtattttcctgttttaaaagtctggttttttaattcatcttgcagtttaagcaattcatnttctaaattataagtaaanctnagaacttctgctacatcattctttcctcttcttgcttttagaaaagcattatgaagattttcatatttgcagacttcctgaaacaaatttttatgtgttttcatatcatcctcttttttattataaaaaaccagcagggttcaatcagcattttgcttcatcttactaaccactggtttttgatttagtatttggctttacagcctggatttggattgatgtagtctcattgcactgttcattatctccgtaaagatatgaatctggcttttggactattgcagcagcgaaagccaatgttgttgttcgtattcgtgggggcattnttcagattcgcacaaaaagggcctgcattagccccattattccaattgccaccgcgtttcacagcgcgctgctaatcacaatccaacccattcctatgaaggaatatcagtatattttttgtaccaacctcccagcattctgccgatttcatttatcaagttagagccatattcatattgagcaaaactaataaactgcaagtccttggaaagcctgaaaaagattcttaatttatccagttcaataattgctttttgcagtgattcttttttatcaaaatcgttgtttgattgaatgatgctttccaaaaaatttagggaagtgttttctattttttgtgccattgtgtatttttcagatttagggaatttattcagcaaggtatgaacccatttgataaattcgtatgttttgtggaaaatcttcatatcttcaatcattgtaatacctctttgaatgtgataaattctgataaattgagaaaaaagtgctttgcccccttccaattgtgaaaggcagactctttttttcctgtatttcattttttcctgtctcttgccttttattttttaaattccccattttgttcaaatactcttcagttatcattttctctttctccctttttcatattttttcttcacctatttttttcgcgcgccccttcgggctttttggattaccagattccagacgccagattaactactgcagcagcgaaagccaatgntgtngntcgtanncgtgggggcantatncaganncgcacaaaaagggcctgcannagccccatnaccccaancgccaccgcgtagcacagcgcgccctgttgttgtagttggaaaataagttccatcatttccatatattgcagttgctgctcctgttgttgtctgccatcctcctgttgaatttgcatatttccatcctgcagtgccatcaggatttgtaacatcaactgtttcattagtccactcccaaacatttcctgtttggtcatagacgccttctgatgaataacagccagaaggacagccatttttattgcancctgtctggcatgcttctccgcttccaggnctnttannnnaacaataagtacttgagccagtcacacaataataagggcttacancaaggtttgttgctaaattgtaatattctccttgcatattagcagctccaagccattcttcatctgtgcataaatgtttttctgcattactgcaagctgttcttgcttttatctggctaatataaacccagactgttttgtttaaagcagagccagcttttccacctgcagcaataagagtgtcagtatntgcagcagattgaggnggtgttgcttctgagccatctgaattcaaagcatgggcttcatacttgtcaatgcaatatccattcaacttgttgatgtaagccatgccttctgggcattggattctttgctcatgccaggttaaattttgataagaagagtttcctccagtatctaatatcttgcttgtgtagtttccagaatcataagagagattaagctgaactgcattatttgttgtattatattcagtttggttgtatgttccttcatcaaaatctgcttgtgttaaggtttgaaaaagcgatgcaacactataaactaagccagttaaattaaatcttgaagaagtaacattagcattttctggaagagcgagataatctgtctgatttcctgcttctgtaaaagtcaaaaccttagaagattctcctccgaataaagtgtttagaactactgcacctgcaatagaaataataacagagagaaataagattatgaaaattgttaaaactctctttttattgcttcttttctgcttcgcccccccaattggaaggtcagggtttttatttatcctctttttttggtttggcatttttatcacttgtttaattatagttgtggtggtttaataaattttttcttttatttttgttctgattttttcaatcttttctgaatccaacccactaagcaaagttttgcatttcaatatgaactttttaacatttgattcatcttctaatacaatatttttaagataatattgcgcctgaatcctgtctccttttaatttttttaaatactccgtctcatctatatcaaaaccaaataattccatcagctctaaactgcaatcatgaatttcacatcttattccgcatcgcattagcaaggcataaaaggcattataacacgcataataagcagttattaatttccattttcctttagcagaaaaaacattttctaaagtttcatctgcttcttttacataagattcgcttaaatggggctttagctcaattaatttaatccctttattctgcttcaagcaccactttattttatcttctttcatattctctcctccaaaaaatatctacaatttttgaaacctcgccaaataaaacatgatttttcattatctctattgataaaggatttttggattttagtatcctggcaaattcaatataagacacatgatgttcattaatttgtataatctgtttttgttttattttcttaatttcctctttattacacctgcntaaaattacaatatctaggtcggattctttactgaaactatcggaagcataggagccaaaaataatcaaactttcgcaatatttcaagatttcatttattactacagggatttcttttatttttaactgaaactgcagggctttttgattttcaataaagtttaagattatttttgttgtttgtttttcaagatcaaaa

SEQ ID NO: 240 - DNA, 4000 bp, Escherichia coli
  misc_feature (25)..(25): n is a, c, g, or t
  misc_feature (77)..(77): n is a, c, g, or t
  misc_feature (394)..(394): n is a, c, g, or t
  misc_feature (476)..(476): n is a, c, g, or t
  misc_feature (478)..(478): n is a, c, g, or t
  misc_feature (488)..(488): n is a, c, g, or t
  misc_feature (573)..(573): n is a, c, g, or t
  misc_feature (575)..(575): n is a, c, g, or t
  misc_feature (589)..(589): n is a, c, g, or t
  misc_feature (591)..(592): n is a, c, g, or t
  misc_feature (1981)..(1981): n is a, c, g, or t
  misc_feature (1990)..(1990): n is a, c, g, or t
  misc_feature (2508)..(2508): n is a, c, g, or t
  misc_feature (2517)..(2517): n is a, c, g, or t
  misc_feature (2524)..(2525): n is a, c, g, or t
  misc_feature (3404)..(3406): n is a, c, g, or t
  misc_feature (3409)..(3411): n is a, c, g, or t
  misc_feature (3413)..(3413): n is a, c, g, or t
  misc_feature (3415)..(3415): n is a, c, g, or t
  misc_feature (3418)..(3420): n is a, c, g, or t
  misc_feature (3422)..(3424): n is a, c, g, or t
  misc_feature (3426)..(3428): n is a, c, g, or t
  misc_feature (3431)..(3441): n is a, c, g, or t
  misc_feature (3443)..(3443): n is a, c, g, or t
  misc_feature (3445)..(3445): n is a, c, g, or t
  misc_feature (3448)..(3450): n is a, c, g, or t
  misc_feature (3453)..(3458): n is a, c, g, or t
  misc_feature (3462)..(3462): n is a, c, g, or t
  misc_feature (3466)..(3466): n is a, c, g, or t
  misc_feature (3468)..(3470): n is a, c, g, or t
  misc_feature (3472)..(3473): n is a, c, g, or t
  misc_feature (3475)..(3475): n is a, c, g, or t
  misc_feature (3478)..(3478): n is a, c, g, or t
  misc_feature (3482)..(3484): n is a, c, g, or t
  misc_feature (3486)..(3487): n is a, c, g, or t
  misc_feature (3489)..(3492): n is a, c, g, or t
  misc_feature (3495)..(3495): n is a, c, g, or t
  misc_feature (3497)..(3499): n is a, c, g, or t
  misc_feature (3502)..(3504): n is a, c, g, or t
  misc_feature (3506)..(3516): n is a, c, g, or t
  misc_feature (3518)..(3520): n is a, c, g, or t
  misc_feature (3522)..(3523): n is a, c, g, or t
  misc_feature (3526)..(3529): n is a, c, g, or t
  misc_feature (3531)..(3531): n is a, c, g, or t
  misc_feature (3533)..(3534): n is a, c, g, or t
  misc_feature (3536)..(3544): n is a, c, g, or t
  misc_feature (3547)..(3547): n is a, c, g, or t
  misc_feature (3549)..(3550): n is a, c, g, or t
  misc_feature (3552)..(3558): n is a, c, g, or t
  misc_feature (3560)..(3563): n is a, c, g, or t
  misc_feature (3566)..(3567): n is a, c, g, or t
  misc_feature (3569)..(3576): n is a, c, g, or t
  misc_feature (3578)..(3582): n is a, c, g, or t
  misc_feature (3585)..(3598): n is a, c, g, or t
  misc_feature (3600)..(3601): n is a, c, g, or t
  misc_feature (3603)..(3606): n is a, c, g, or t
  misc_feature (3609)..(3613): n is a, c, g, or t
  misc_feature (3615)..(3615): n is a, c, g, or t
  misc_feature (3618)..(3619): n is a, c, g, or t
  misc_feature (3621)..(3621): n is a, c, g, or t
  misc_feature (3623)..(3626): n is a, c, g, or t
  misc_feature (3630)..(3634): n is a, c, g, or t
  misc_feature (3636)..(3636): n is a, c, g, or t
  misc_feature (3639)..(3639): n is a, c, g, or t
  misc_feature (3641)..(3641): n is a, c, g, or t
  misc_feature (3643)..(3649): n is a, c, g, or t
  misc_feature (3652)..(3652): n is a, c, g, or t
  misc_feature (3654)..(3655): n is a, c, g, or t
  misc_feature (3658)..(3662): n is a, c, g, or t
  misc_feature (3664)..(3665): n is a, c, g, or t
  misc_feature (3667)..(3668): n is a, c, g, or t
  misc_feature (3670)..(3674): n is a, c, g, or t
  misc_feature (3677)..(3677): n is a, c, g, or t
  misc_feature (3679)..(3679): n is a, c, g, or t
  misc_feature (3682)..(3682): n is a, c, g, or t
  misc_feature (3685)..(3686): n is a, c, g, or t
  misc_feature (3688)..(3693): n is a, c, g, or t
  misc_feature (3695)..(3695): n is a, c, g, or t
  misc_feature (3697)..(3699): n is a, c, g, or t
  misc_feature (3701)..(3702): n is a, c, g, or t
  misc_feature (3704)..(3704): n is a, c, g, or t
  misc_feature (3706)..(3706): n is a, c, g, or t
  misc_feature (3708)..(3708): n is a, c, g, or t
  misc_feature (3710)..(3712): n is a, c, g, or t
  misc_feature (3715)..(3715): n is a, c, g, or t
  misc_feature (3717)..(3717): n is a, c, g, or t
  misc_feature (3719)..(3721): n is a, c, g, or t
  misc_feature (3723)..(3723): n is a, c, g, or t
  misc_feature (3725)..(3726): n is a, c, g, or t
  misc_feature (3728)..(3731): n is a, c, g, or t
  misc_feature (3733)..(3736): n is a, c, g, or t
  misc_feature (3738)..(3738): n is a, c, g, or t
  misc_feature (3740)..(3741): n is a, c, g, or t
  misc_feature (3743)..(3744): n is a, c, g, or t
  misc_feature (3747)..(3747): n is a, c, g, or t
  misc_feature (3749)..(3749): n is a, c, g, or t
  misc_feature (3751)..(3751): n is a, c, g, or t
  misc_feature (3756)..(3756): n is a, c, g, or t
  misc_feature (3854)..(3860): n is a, c, g, or t
  misc_feature (3862)..(3867): n is a, c, g, or t
  misc_feature (3869)..(3870): n is a, c, g, or t
  misc_feature (3872)..(3878): n is a, c, g, or t
  misc_feature (3881)..(3887): n is a, c, g, or t
  misc_feature (3889)..(3901): n is a, c, g, or t
  misc_feature (3904)..(3907): n is a, c, g, or t
  misc_feature (3909)..(3918): n is a, c, g, or t
  misc_feature (3920)..(3920): n is a, c, g, or t
  misc_feature (3922)..(3923): n is a, c, g, or t
  misc_feature (3925)..(3926): n is a, c, g, or t
  misc_feature (3929)..(3934): n is a, c, g, or t
  misc_feature (3936)..(3937): n is a, c, g, or t
  misc_feature (3939)..(3946): n is a, c, g, or t
  misc_feature (3949)..(3951): n is a, c, g, or t
  misc_feature (3953)..(3953): n is a, c, g, or t
  misc_feature (3955)..(3955): n is a, c, g, or t
  misc_feature (3957)..(3967): n is a, c, g, or t
  misc_feature (3969)..(3970): n is a, c, g, or t
  misc_feature (3972)..(3976): n is a, c, g, or t
  misc_feature (3979)..(3980): n is a, c, g, or t
  misc_feature (3983)..(3987): n is a, c, g, or t
  misc_feature (3989)..(3989): n is a, c, g, or t
  misc_feature (3992)..(3996): n is a, c, g, or t
  misc_feature (3999)..(4000): n is a, c, g, or t
aaaagaaactaacaaggattccccnagtagcggcgagcgaagcgggaagagctcaacttgaaaatcgggcaacagcncgagttgtagtctagaggcagttggttagtggaaggatcccggacctaagtaccaatgaaatttgtcgccagagagggtgaaagccccgtacgtcctggagtccgacccgtgtaatcagctaccgcagagtcgggttgcttgggagtgcagccttaagtgggaggtaaacttcttctaaagctaaatactaacgggagaccgatagcgaacaagtaccgtgagggaaagatgaaaagaactttgaaaagagtaattaaacagggcctgaaactgttaagaggaaaagcgttggaaaccaaccgcgcgtggagtattnaacaaagcgaaagccgagtgcagagcttcatgcatgtcagtatcagctggcgctgtggtagacgccgtcgtgcgagatgtcntnccttcggggnggatccacgataaagccaccatcgcgccgactgaggtgaacagccgcacgcttagcgaccggggtctgtcctggcaatcgataangntatccttcgggtananntaatcggttgtcatgatgggttaccagagatctgtgcggcagggatactggcgaaatggttttcaatgacccgtcttgaaacacggaccaaggagtctaacacatatgcgagcagtagggtggaaaacccggatgcgcaatgaaagtgaacggtgggatccgcaaggtgcaccatcgaccgacctgccgcaaggctggtttgagtaggagcatatttgttgggacccgaaagatggtgaactatgcctgaatagggtgaagccagaggaaactctggtggaggctcgtagcgatactgacgtgcaaatcgttcgtcaaatttgggtataggggcgaaagactaatcgaaccatctagtagctggttcccaccgaagtttcccccaggatagctggaactcgtacaagttttgtcaggtaaagcgaatgattaggagcctcgggggcgtaatgccctcgactcattctcaaacttttaataggcaagaaaattcggttacttcattgaaccgggttattgaattggagttcttagtgggccatttttggtaagcagaactggcgatgcgggatgaaccgaaagctgggttaaggtgctaaactgctggctcatttagaccccataaaaggtgttggttcatttagacagcaggacggtggccatggaagtcggaatccgctaaggagtgtgtaacaactcacctgccgaatggactagccctgaaaatggatagcgcttaagccggcgacctagacccagccgtcagcacaaatgcgatgtgctgacgagtaggtgggcgtggaggccgtaccgcagccttgggcgtgagcccgggtgaaacggcctctagtgcagatcttggtggaagtagcaaatattcaaatgagaactttgaaggccgaagtggagaaaggttccacgcgaacagcatttgaacgtgggttagtcggtcctaagagatagggaaattccatatcaagggcgcacttgtgcgccgcctatcgaaagggaaactggttaatattccagtaccagactatggatattgtatggtaacatgaaagaactcggtgacgctggcgagtgccctgggaagagttgtcttttctttttaacagcctaccgccctggaatcagattgcctggagatagggctcaatggctggcaaagcaccttgcttcatgaggtgtccggtgcgcactcgacggtccttgaaaaactgagggaaaggtttattttctagtctggccgtactcataaccgcatcaggtctccaaggtgaatagcctctggtccatagaaaaatgtagataagggaagtcggcaaaatggatccgtaacttcgggaaaaggattggctctaagggctgggcattcggggctttgcncttgaacgnaattgatagtttgggctctccgagaacaggcttgacgcttcgcgaaggggctttgctaggcttgccgaccggtgctatgaacagctaacttagaactgtaacggacaaggggaatccgactgtttaattaaaacaaagcattgtgaaggcgttaaaacgtgttgacacaatgtgatttctgcccagtgctctgaatgtcaaagtgaaggaattcaaccaagcgcgggtaaacggcgggagtaactatgactctcttaaggtagccaaatgcctcgtcatctaattagtgacgcgcatgaatggattaacgagattcccactgtccctatctactatctagcgaaaccacagccaagggaacgggcttggaagaatcagcggggaaagaagaccctgttgagcttgactctagtccgacattgtgaaatgacttagaaggtgtagaataagtgggagcgcaagcaacagtgaaataccactacttttaatgttattttacttaccccgttaagtagaancgaggcgcnagcctcnncttctggatttaagcccttcggggtgatctacgcgggagacactgtcagatggggagtttggctggggcggcacatctgtaaaacgataacgcaggtgtcctaaggtgagctcaatgagaacagaaatctcatgtagaacaaaagggtaaaagctcacttgattttgattttcagtatgaatacaaaccgtgaaagcgtggcctatcgatcctttagcccgtggaagtttcacgctagaggtgtcagaaaagttaccacagggataactggcttgtggcagccaagcgttcatagcgacgttgctttttgatccttcgatgtcggctcttcctatcattgcgaagcagaattcgccaagtgttggattgttcacccactaatagggaacgtgagctgggtttagaccgtcgtgagacaggttagttttaccctactgatgaaaggttgtcgcaatagtaatccagcttagtacgagaggaaccgctggttcagataattggtcttttcacttggctgaaaagccattggtgagaagctaccatctgtaggattatgactgaacgcctctaagtcagaatccatgctagaaagcggcaacgttagctccttcgttgcgtaaatataggcttcggccctagaccagaagacgttcggatggctgcctcaatagcagtcacctgcgccacatgacaactcagaacgggagctatacagatcatttgaagacgacttaaactgtgagtgggtattgtaagagtcaagagtagacttgtttctacgattctctgagattcagcccatttcaccgatcggttcggaaacgaacacaaaacctccttcgcatttacaaatgtgaggggtttggtttatattgaacnnncannncngngcnnncnnnannnagnnnnnnnnnnncncngtnnnaannnnnngggntttntnnntnntntgncccnnncnncnnnngantnnnccnnncnnnnnnnnnnngnnntnnggnnnntntnnannnnnnnnngcngnncnnnnnnntnnnnganntnnnnnnnncnnnnnccnnnnnnnnnnnnnntnncnnnnttnnnnncnaanncncnnnngacnnnnncnccngnannnnnnnctncnngtnnnnngnntnngnnnnnatncnccncanncnnnnnncncnnnanncnangncnnngtngntnnntnanncnnnncnnnncntnncnngcncncnaggancctttccatatgcctgtgcttctcccccagcttctgccatgtccccgatcccccgcagctcaaatttagcctttttgccgtagttgctaatctgctgnnnnnnngnnnnnngnnannnnnnnacnnnnnnngnnnnnnnnnnnnnggnnnngnnnnnnnnnngngnngnngcnnnnnnanngnnnnnnnngcnnngngncnnnnnnnnnnntnntnnnnnccnnttnnnnntntgnnnnnacnn

SEQ ID NO: 241 - DNA, 4000 bp, Escherichia coli
  misc_feature (156)..(156): n is a, c, g, or t
  misc_feature (195)..(195): n is a, c, g, or t
  misc_feature (363)..(363): n is a, c, g, or t
  misc_feature (389)..(389): n is a, c, g, or t
  misc_feature (437)..(437): n is a, c, g, or t
  misc_feature (439)..(439): n is a, c, g, or t
  misc_feature (1012)..(1012): n is a, c, g, or t
  misc_feature (1076)..(1076): n is a, c, g, or t
  misc_feature (1078)..(1079): n is a, c, g, or t
  misc_feature (1081)..(1081): n is a, c, g, or t
  misc_feature (1120)..(1121): n is a, c, g, or t
  misc_feature (1175)..(1175): n is a, c, g, or t
  misc_feature (1312)..(1312): n is a, c, g, or t
  misc_feature (1487)..(1488): n is a, c, g, or t
  misc_feature (1730)..(1730): n is a, c, g, or t
  misc_feature (1874)..(1874): n is a, c, g, or t
  misc_feature (1932)..(1932): n is a, c, g, or t
  misc_feature (1941)..(1941): n is a, c, g, or t
  misc_feature (1952)..(1952): n is a, c, g, or t
  misc_feature (1961)..(1961): n is a, c, g, or t
  misc_feature (1989)..(1989): n is a, c, g, or t
  misc_feature (1994)..(1995): n is a, c, g, or t
  misc_feature (1997)..(1998): n is a, c, g, or t
  misc_feature (2001)..(2001): n is a, c, g, or t
  misc_feature (2012)..(2012): n is a, c, g, or t
  misc_feature (2018)..(2019): n is a, c, g, or t
  misc_feature (2022)..(2022): n is a, c, g, or t
  misc_feature (2479)..(2479): n is a, c, g, or t
agccactgagcaggagcagatcgccatccagcgcgcggcggacctcgccgtcgcgacgaaggcggcgcaggacaacgagtcgcgagcgatcgcgcaagagcgcctttcgacgcagaagacgaacgacgtgttgtcgttgtcggcttcgaaggattnggaggagctagtcgctcgcgcggagaagttgtggccggngcatccggagatgatttcggagtacgagaaatggttggccgaagcacgcgcgctgatcgatggtcgtccggcagatcctgcgcacgacatcaagaagcgaccgagcctcgaagagcacaaggcgaagctggcggatctgcgagggcgcgcgacgaagcagagcgaggnagaagccaaggccgcgcgcgagtcgnacccacgcttcgaggagctgacggcgaagcgggcggagctgacttggngntcgcgcatgctcgagctggagccgtggccgaatgaggcggaggtcgaagcgcaactggcgaaagaaaccctcccgacggacgcgaacgggctgaacacgctggcctggccgttggtcgattcggacaagcccgtgtacggcaacgaagtgagaggtctcttgctcgccaagcgcgcggttgccgcagccacggactcggagcgctcaggcattcgcgacagcctggcctgggcgaacttccgccttggtcgcctggacgaagccgttgcggaagaagagcgcgcggtggacgaagctccggcggacaagacgaaggaattcgagggctacgtcgcgaagatggaaaaggccgtcgaacgctggaagggcgaggctgcgcttgcagcgcgtcgcacggagcgcgacgcgctgcttgcggaggtcagcgacctcgatcgcgtggtgagcgaacggcggacgtgggccttcgagaaacccgaagacgcttggtggcaagtccagctttcgaagttggtgtcggatctggaagcgttgcgcgatcccaagaccggactgatgggcgacacgttggcngagcccttcggctggggggttcgcaagcgctacgagttcgcgaagacgattgcggagcgcagcntnnanggtcccgaggcgcagcagcgctgggctgaggcgattgcnncgatcgcgtcctcgccgaagtacggcgggctgcagatgacgccgcagctgggtntggttccgattggcgaggatccggaatcacacttgtgggagttcgcgcacctgcagacaggcgagccggcgatgcgtggcgcagacgggaagctggtgctttcacaagagacagggcttgtcttcgtgttgattccnggtgggacgttttggatgggcgcgcagaaaaaagacccaacgggccagaacttcgacgcaggagccggatccgatgagtcgccggtacacgaagtggaactcagcgcgtacttcttgtcgaagtacgagatgacgcagggtcagtggcagcggatcgcggcgcgcaatccgagcnnctatggaccgagtgcgaacttcgccggtcatcagcacaacttgttgcacccggtggagcaagtgagctgggacgagagcatgggcctgatggcgcggctgggtttgtcgttgccgagtgaagcgcagtgggagaacggttgtcgtggtgggacggcgacgtcgtggtggacgggtcaagagcgcgagagtctgcgtgggaaggtgaacatcgcggacaagacggcctcagatgcgggcgcgncatggggcgatatcaaggactggccagatcttgttgacggctgggtgttgcacgccgcggttgggagtttcccagcgaacccgttcgggctggacgaggtgcacggcaacgtctgggagtggtgcgctgacggctacgacggtngtttctacgccaagagcccgaagactgacccatttgcgccgattgcaggctccgcctnccgcgtganccgcggcggcngcttcaacnatgccgcttcgaatgcgcgctcggcganccgcnncnncancacgccggagnaccgcnncancaacctcggcttgcgtcccgccagggcatcacttctttctgcttcaccacttcaccaatcagggaagtgactttgggccgtttcgaggcgcacggccgaccggcgtgcgaagccgccgaaggaggccgagcgccggcgcatttgcatgtgtgcgactttttgtgcagattttcgattttcaggtggcgttggggacgggaggcggggcagggagcaaggcaatgggtttttgcgcccattccccagtcccatgcgcatcaaactgctgaccttccgctactccgccacgctcggcggtttcgacgatacggccctcgctgacttcacgcgcgacaaggaagtgatcgcgtttcgcgaacacttctacgcggtgaacgagacaccgcacctgacgtgcatcgttcattaccaggaagcgatcgtgccacgcgcagcgctggacacagcacgcgagatngctccgcgtccggtgtcgaacacgccgcgtttccaacgccgcgacggtgcgcccgatccttgcgaaggcatgaacgacagcgagcgagcgctattcaaccacttgcgcgagtggcgctcgacgcaggcgcgcgaagagggcgttccgccctacctgttgctgacgaacaggcaactcgtcgcggtcatccgcaagcggccggaatccttgacggcgctcgggcatctcgacggcatcggaccaggcaaggtcgagcgctacggtgcggccatcctgcgcgcgctgcacggcggcagtgcagggtccgctgcaagcgccgatcccgcaccggaggccgccccgaagctgacggatgccgccgagatcgaagtcgtcgaactcgccgcagccgaggtcgtcgcatgagcgcgccctcgttccgtccgccggcgcgcgaggccggtccagagcttttgtgcctgcagaagtgggaggaaacgctcggatggctgctcgagcacacggccaagtggccgaagtcggcgcgcttcagcctggtgcagaaggtggatcggcacgcgctcgacgtgctcgagatgctggtcgtcgcgcgctacgaaccgggcgcgcgcaagaagcacctgcgcgagatcaacctgcgcctggagctgctgcgttatctgctgcgcatcgctcgcgcgcgcaacgtgatgccggcgacgggcttcgagactgccatgcgcggactcgacgaactggggcggatggtccacggctggcgcgtcgcgatcggcgaacgcggcgcgctggatccgggcacagtcgaggccgaacttgttgcggcggggacggagacatgagcggctcgcagtgggacgagatcacctccttcgccaacttgtgcgccgcggcccgacgtgcggcgctgggcaagcggggcgtgcgcggggccgcgcgcttcctggagcggctggaacccgaggcgctggccttgcagcgcgagctgctcgggtggagctggcggccctcggttccgacgacgttcgtgatccacgatcccaagacgcgcgagatcacggcggcgccgtttcgcgaccgcgtcgtgcatcatgcgttgatcgatccgctcgaagcgctcttcgacgccgcgctcgtgccacagactttcgcctgccgacgtggcaaaggcatgcaccgcgcgcttgggcatgcacgcgctctggtgcgcagccactcgcatttcctgaaactcgatgtcgaagcctgcttcgcttcgatcgagcacgaaatcgtcctgaaaaccctgcgcgaactcgatctggagcaagaggtgttgcggctttccgcgcgcatcctcggcggagcgggcggccggctcgggatcggcctgccgatcggcaatctgaccagccagtggttcgcgaacctcgtcctgggccgtctcgatcgcttcgtgcttgctcttccgggcatccgaggctacgcgcgctacatggacgactgcgtgctgttcgcggacgacaagcaggtgctgcgcgacgc

SEQ ID NO: 242 - DNA, 4000 bp, Escherichia coli
  misc_feature (203)..(203): n is a, c, g, or t
  misc_feature (1969)..(1969): n is a, c, g, or t
  misc_feature (1971)..(1971): n is a, c, g, or t
  misc_feature (1974)..(1976): n is a, c, g, or t
  misc_feature (1984)..(1984): n is a, c, g, or t
  misc_feature (1986)..(1986): n is a, c, g, or t
  misc_feature (1988)..(1988): n is a, c, g, or t
  misc_feature (1991)..(1991): n is a, c, g, or t
  misc_feature (1996)..(1996): n is a, c, g, or t
  misc_feature (1998)..(2000): n is a, c, g, or t
  misc_feature (2002)..(2002): n is a, c, g, or t
  misc_feature (2005)..(2006): n is a, c, g, or t
  misc_feature (2008)..(2008): n is a, c, g, or t
  misc_feature (3965)..(3965): n is a, c, g, or t
ctatttcgtagttccaggtctgttcgggcttgtagacggtggcggattttgcatccggattctctcccgcatcggggaagtatttgcccaccagctctttgtaggcatccggcacgttgggcataatcgcctctttgctttgccgcatcatgtcattcttcaaactggattgcagcaggtcggagaacatctgcacgttgtancctcccgaacggtaacctttgctgaccgttgcatacacatttcctctgtttcgcgcaaagtcatactgcaaagcaaacttgggcaacagctgaagataatccttatcaatgtttccttggtagcgcgactctacggtcagcgccgtctccggcatcatctctatttcgcggatgacgacgtcgccccgcttcatttctcccttgatgcccaccttgtagtccaggctggtgccggagttgtaatccatcttcatacgctcataatccaggcgtaacccggcagtgaacgacactcctttcagcccgaataaatctctgaaggtggattgatgaaagagtgccccattcagcagcggagtgttgaaactgcccccgatgggcatggtccggctgctgatgcccagtgagggcaggatattcatactcatggatggtcccatctctacttgtatttgcgatgggatgacactgcccaacatctggttcagcatccccattccggcttccctgaaagtgacgggagcttccgtattcagccattggtagaagccgaaggcgccggtggtccattgccagcggctgccgcttttactcttcaagatgatttcctcgctcagtgcgtgggagcgttgtttctgttgcagggtatagatgtcgttggcggtgaagtcttggtctatgtccatgcagtcctttagaaactggtagccggtgaccatgctcaacgtgaagtgctgtgcctggtattccaggttcagacccgtgttcagcaggttgcggtagtagttgctacgggcgttattggagatttttccgatgtagggcttcagcggctcgctctgtgcttcgggggccaggctgccttggtagaaatacgggtagccaccctggtcgctgtattcgtagttgatgtttaggtccaccttccagttgtccgaggggaggtagatggcgcggatgcgtccgcctgccgattgccccttgtccgctttctcgtccctcaccgtgttgcggaagaatcctccttgataatcgtaaaaacctccggtggaaaaggcgaaccgttccgaaaggcggtgatagtgggtcagcgaggtattataggcattgtacgtacctgcccccatgcggaagtccgtcccctggtaggagaagggcgatttggtgtgcaccttaatcaatccgcccatggcattgcgcccgtagagcgtgccctgcggaccgcgtagcacgtcgatgcgctctacgtcggcatagctgaagtcgaaggctgacttgtctatataaggtatattgtctacataaagtcctacggagggagtgttgatgcgcgagccgatgccgcggatatagactgccgaagtcagtcgcgagccgtagtcggggataaacatattgggcactacggatgtcagattcttgatggagttcacctgtgcgttctgcatgtcctgctgcgaaagcagggtgacggcggcgggctgctcgcgcagtttccggttttctttgggggcggcaatgacggttatttcctctacatccaccactttcaaggtgtctgcctcttcggcaagtacgttgccggttgccaggaggcagaagataccggtcaaaattctatatctattcataaactggttttttagcgcctgcaaagtaaagggattcttgcggaagggacaatcctcatttattaggatttcgttcctggagtgctaatcttaaatcgttccatcatgcggaaaatatcgttcctccgtgggggnanaannnttcccccncngnggnacgantnnntnttnncncattagcacactaattggggcgaagtttttctgaaaagacttcgcttctgatgtatccggttgtaggattatattctgtccgcttccacatatccgtgcatcacggcatagatagtcagcccggacacggacttgatacccagcttctcggtgatattcttgcggtgtgagatgacggtggtcaggctgatgttcagtttgtcggcaatctccttgttgatgagacctttggtaatcagcaccagcacttctatttcgcgggcggaaaggtcgtgcccggcggctgtatttattgccatatccgagtgtctggcgggtgccggctttccgtggttttgtctgtattggtttccgtattggcgcagctgcagaatgttttttgccagattttgttcgtcctgatagatgtttagcgtcggcatgcccgacagttgggggacggtttcaccattgaccagcacaatggttttgggcttgcgctccagaaagaaagcggtatgctcgaagtaaatctgtgaagagatgaaataatgcacatacatgtcaggcgtatcatccatcagttcgccaaaggaacggaaagagcggatgatggctgtcgggatgatttcctccagcaagttctgcagtcccagacaggagagggtgttggagtcgacgattgctatttcaggagtcattctcgtttttttgtttctgcaaaaatacggattattttttagggtttgtctgtgcggggctgcaaaatgaaaaattctcctatgcagaactattctccctctccttttggggaacggggagtgtctcctttcgcatattggctggggctgacattgaaatatttcttaaagacttcccggaagtatttcccatcgcagaaaccggttctttctgctacttcagtcacggaatatttcccttctttcaacagctcggcagcatgtttcaaacggatattccgtacgaaatctgccggtgcctggccggtcagcgctttcagtttactgtagaaactggtacggctcatattcaggagcgagcacaatacgtccactgtgaaatcgggattatccatgttctcctcgatatgtctctttacattcgacatgaatttccagtcgagactgttggagcaagtggtagttgtggagggctcttcttctgtattgatttccaaattcgcatatctcttgcgcagcaatgcgcggttggcaagcagattggcaatgctggctttcagtatgtttatgctgaaaggttttacaatatattcgtccgcaccgatatggagtccttcgagaatgttcttttcatctcccagtgccgtcagcagtactaccgggatgtgggatgtttcaatatcgttcttgatggcgatgcataattcgtcgcctcgcatttccggcatcatgatgtcggaaagaatcagttccggccagaattgttttacaatggtcagcgcttccttgccgttgttgcatacttgtacattgtaaatcggagagaacgactggaagagatagttgcgcagctcgtcattgtcttctacaatcaagatgcgatgcagtttgtcattgtcttcagtccggagttctccggcaagtttcaaaggaacggtggggacatccggttcatagaaggtcttcttatccttaacggacagagtgaagttcttgaactgttctttctctttgggaaggatgattctgacagtactgccttggcattcggtgctctcaatgtatatttttccattgtgcaggcttaccagcttccgcaccagcatcagaccgataccgcttcccgttattttggagttgatggcatttgttccacggaagtgcatcttgaacagttttctttgttctttggcgggaattcctattccattatctttgacttccagtctccaggagcttttcatgtcataaacagaaatgagtatatcgccattttngggagtatacttcagagcattggatatgacatttt

SEQ ID NO: 243 - DNA, 4000 bp, Escherichia coli
  misc_feature (3)..(4): n is a, c, g, or t
  misc_feature (22)..(22): n is a, c, g, or t
  misc_feature (102)..(102): n is a, c, g, or t
  misc_feature (139)..(139): n is a, c, g, or t
  misc_feature (676)..(676): n is a, c, g, or t
  misc_feature (1027)..(1027): n is a, c, g, or t
  misc_feature (1253)..(1253): n is a, c, g, or t
  misc_feature (1295)..(1295): n is a, c, g, or t
  misc_feature (1955)..(1955): n is a, c, g, or t
  misc_feature (1974)..(1974): n is a, c, g, or t
  misc_feature (1984)..(1985): n is a, c, g, or t
  misc_feature (2274)..(2274): n is a, c, g, or t
  misc_feature (3791)..(3791): n is a, c, g, or t
aanntttagaccaagaatcatntgactcggtagccacaaagtatattccactttaatattaaacaaaacactaatacttaaaaacagaaaaagcttttatgnagtatttcactccataaaagcttctatatattttganaaattacagatcttgtaagatctaaagttaattctagtcttctgctaactcaggagcaggaatgattacctgacctctatagtacatagctccatcatgccagtacgctctgtgcatttggtgcgcttcaccagtcactttacagatagatatctgtggtgctgtagctttgtagtgagttcttctttttgcttttctctgcttagaaattttactctttggatgtgccatttctattttttttattgaagtgtaaaatgtatcacttcgttgttattaataattctgacctttattggtccagatttaaatcgtttaaggtatcccaaataggatttgttttgacttcacctccgtctccatcagcttctttttcgaaacggctgaggatttcttcattgcaattcgcattagggtcagactcacaagtctttatcataggtattgacaaatgtatgtattcatatatatactgagccacattaagcctatctagcctcggatgaatgtatataatctcatctgtagattccatancttcttcactatacttagcatgcaggatatatttaccatgtataggtaagataatatcttccatacatctatcacaatcagtaataacggtaccttctagactaaagtctagcacagccatatgcgaccttttatcaagctcaagagttatagcaactttacctttttttacttgcgaattttcatactcagtaaagaaagcattgtcaacttcgaatttcaattgatgaagaccaactttcaatcctataaaaggaatggaaaaatgatctaggacttccatagttattgaactttttcaatttggagtgcaaagataagttttgttctggaaaaatcaagggtttggangattttagagctatcgctatctttatttgtggcctataaccatataatgtaacctcaaatgagccctatcttgaaaatctcactagtgcagcccaataacaaactacgcccaatttagaccttgtagatagcctaatagctgatattaaagacactaatctcatcgttttaccagagatgcggaatactggcttctctatgactcctcagccagtagcaactattntgtatggtatcgtggtgcaacagatagaaatttgggcatctnaaaaattagtaattgttggtggaaatgtgattgtcgaagctaatggaagatactacaatagattcctactagttgatagtaacggtccaattgctttttatgataagagacttctatttaccttagctggagagcagaaagcttactctgcaaataatgagcgaatcacttacgcttatgttgacagggatattaacctcaatgtatgttatgatcttaggtttcgaatttgaagtcgaaatactgatagatatgatgttctaatctatgtggccaattgacgttctccaaggcaccttgcatgcagggcgcttcttcaaactagagcaatagaaaatcaatgttatgtaataggttgtattagagtaggtactgatactgatactaatggacagacatatttaggtggatcagctatgatagattatagaggcagcgagctgccagaattgagagacaaacaaagtattgcaagtgttgagactaacaaatcagaccttttggatttccggtcgaaattagattttctgtcaaatagaaatgaatttagtattgtcatcccagattcaggattctcattattgaaatatatcttcattttcagggttttatttaaaagtagtctaaacgaaagtggctcaattgttgatgtattaaaantaataataatatgtaagcngttgttaaannaataaatagctcaataccaaagatgctgagttattagaacatacaataattaagcttactaactaacgatacttaattgttcgtgataaaacttatttcaattagttcaataacactacaatgataaaaaacggtcttatgcgcttttcgctacttggagcattattaatcttcttgatgacagcctgtagtacaccaagatatagtcacaatggaagtcgtagctcatctagcaaaacgaagaaatacgccaaaaaaactcgaaaaccctatattgacaaggcaaaanccaatagatcaactacaaatagaaaagcttcagtagctaaggtcgacaaactcgatcttaggctcaacgtagtagcttccgctgaaaaatttctcggtctcagatataaatggggaggaaaaacaccaaaatctggatttgactgctcaggatttacaagttttgtaatgcaagaaaatggtgtaaacgtacaaggagcctcttatcatcaatcaaaactaggaaaaaaagtttctaagtctaaagttgcccctggagatctaatattcttcggaaaaggctcaaaggtttctcacgtagccatagttaaagctaatactggtaattcactagaggtaatacacagtaccagtggatcaggagtgagagtagatgacattaataactcaaattattggaataagagatacctttacgcccggcaagtcataaattaggcggaacaataacagtcttcagtcatatatatgttataattcaagaagtcaattgaactttaagagatgtggagcaagttaattcaatgggttttggatatttttgccaaccctaacagcaaatcaagtaattcaatgatgaatatcattctctttggtcctccaggatcaggtaaaggaacacaagctaacagtatagcaaagaaatataatctgctgcacatttctacaggagatctttttagatacgaaattggcaattctactgaactaggtcaactagctaagtcttatataaataagggagaactggtacccgatgatgtaactattggaatgctcaaaaacaaagtagatgcttatccagatgtggcaggatatatttttgatggtttcccgaggaatgtgtatcaatctgaagaattggatcgtttcttagataaaaaaggtcagacagtgaatgcgttactacaacttgatgtagatgatgaagagatcgtgaaaagaattcttaatagaggaaagacatcaggaagagaagatgataatgatgagatgataatacgcaatcgtatttctatcttcaatgatgagacctctccggtatacaattactacgataaatctggaaagtcaacaagcataaatggtataggtagcttagaagaaattttctctagactaagtgttgctatagacgcagccaagtagtaatacacatacattaggaaggtcaactgatcgtctattttaacaataagtaaaatcaactgacgattttctaaacgatcaatagtacaacacaataatatgtctcagcaaaacttcgtcgactatgtaaagatgcatgtcaaatctggtaacggaggcgctggatctaactatatgtttcgtgacaactataccgctaaaggggggcctgatggtggtgatggtggccgtggtggtcatattgtccttagaggtaatgagcagctatggacactactttcactaagattccgaaagcacgtaaaagctggacatggaggaaatggaggaaagtcacgtagttttggagcctttggtgaagatgtaatnctagacgtaccactaggtactgtagcaagagattttgaaactggagaagtccactttgagatcactgagcacggagaagagcaaataatgatgctaggtggaaaaggtggtagaggtaacgttcacttcaaatcatctacaaatcaaaatcctaattactgtcaacctggcctcaacggtgaggaagcatggaaagtattagagttgaa

SEQ ID NO: 244 - DNA, 4000 bp, Escherichia coli
  misc_feature (3)..(3): n is a, c, g, or t
  misc_feature (447)..(447): n is a, c, g, or t
  misc_feature (723)..(723): n is a, c, g, or t
  misc_feature (863)..(863): n is a, c, g, or t
  misc_feature (1329)..(1329): n is a, c, g, or t
  misc_feature (1926)..(1926): n is a, c, g, or t
  misc_feature (1946)..(1946): n is a, c, g, or t
  misc_feature (1952)..(1952): n is a, c, g, or t
  misc_feature (1954)..(1955): n is a, c, g, or t
  misc_feature (1963)..(1963): n is a, c, g, or t
  misc_feature (1976)..(1976): n is a, c, g, or t
  misc_feature (1988)..(1988): n is a, c, g, or t
  misc_feature (1990)..(1990): n is a, c, g, or t
  misc_feature (2002)..(2002): n is a, c, g, or t
  misc_feature (2008)..(2008): n is a, c, g, or t
  misc_feature (2015)..(2015): n is a, c, g, or t
  misc_feature (2771)..(2771): n is a, c, g, or t
  misc_feature (2927)..(2927): n is a, c, g, or t
  misc_feature (3869)..(3869): n is a, c, g, or t
  misc_feature (3972)..(3972): n is a, c, g, or t
atnagagctcagatctcaatgtagcacaggcattatctacaggaggctcctctggagctatcacaatggatatagctgtaaaggatgaggtagaaagccctcattatgagggagtaggcgttggaatggcgtttacaaaaatcattacccacgatattaacagcaaagcaactaacagcggtaatactactgtagcaagccctgtaaacacagctacagttattacaataaattaaagaaaaggagtgtgataaaatgggtgcttttaagagtgcagtaatcacaaaaaaaggacaggaactcttagcaaaagtggtagcaggtactactaagctggagtttactaagatcaaggtatccgatactaagttatctggagatctggcaagtatgacaggtatcggtactatcaaacaggaggaaaaggtagcctctgtagtgagaaanaatggatctaatgttacagtatccgctagtttctctaatcagaccttagggcagggttattatgtaagaaacttaggactttatgcaaatgatccacaggctggagagatcctctacagtatctcagtggcagatgagagtaccgctacagcggattatatgcctccatttaatggtatcggtgtaagctcccttatggtggatcttgtaacagcggtatctaatgcctctagcgtaaaggtaaacgtagatcctaccgctggagccacagtagcncagatcgttaatttacaggagcagattgacgatgttaagagctttgtaggctatgagagctccgatgtatacggtgtggagattgattttcctaataggcggtttaccagaattgcaggagcagaaaatcttaccgctgnagctgattttgataagctcaatccgtggggcggtagaaagagatgtatcttagctgatgatggtacagtacttgcatacagaggagaaacaggatacacagaggcaggagctactactgtagagcttaaaaagacagtagacggagcagaaaaaacctatgctagtggtactaaggtacaggtaatggtagaacagcctgtattttatgttaaggctgtacctgtaagctctaagaacgctaccagcggtaagggtaagcagtacactaagggtagattttatatcagccctacacctaaggcaggatttacagctcctagagccttttacgataatcacggtatcgtacaggataagatctatctctcagcgtttgagggctgtatttatgatacagatgctaaaaagtatcttacagcggatgagcaggtagcggattttgctacagatatgctctcatctatngcaggtgctaagccagccagtggacttacacagaacctcacaagagcgaatgtgagaaagctctgtgctaacagaggtgcaggctgggaaagtcatagtatttttgctatggcggttacagagtggctccttatgattgagtatgctagtttagatgctcagcgtaaagtaggtagaggcgtttgtgattttaccgatgatggtaaaactaatatggctgtagtaacaggtgctacctctggattaggtaatggatctggtattgatcctaacggtggtgtagatggtaagtgctcagtatcttacagaggagaggaaaatctctggggcaatatctggacttggctggataaggtaaatatcttagctaaaggacagaatgaggtatttgtgcatgagatcggagctacagtagcagatgatactaccacaggatacaagagcttaggctatcactggagccatagtaacggttatcaaagtgcctttggtattgatccagagcatccagagttacttatccctacagaggctagtggatcggatgtattcacaggtaactttgtatggcagaattacacctacaacggtttcttnattgctatattgggcggtanatggantnntggctctngttgcggtttcgntctgcatggtantnatgcctctggtnatcgcnatcgtantgtcggcggtcgcttgctgtatgtgcctcaaacaaaggttgcttaaatctttgaggaaaaataaataaaatcaaaaagggtaataggaggagctggaaagctcttttttattaccctttttgtcggtagctgataaggtttcttaattactaaattaggcagtaaatggaataatggctctaattgcagtttcaatctgaatggtaataatacctctggtaatcgcaatcgtaatatcagcagtcacttactatatgtgcatataaaaataaaagaaaatcagagaaatatgtgttcactgtgacacttattttacattaagtgagtaacagctaccgtggctcttgccagaacataaaactcctctatgaggagcggtaaaaaatagctaagagggtgcttatgtgcggagaaatccgtaaaccatgttagcctagcaagctaagaactgattgttatgtgaacgatagcacaggggtactacagcaggtagttagctccctcttatgcacatacaaaattatgataaggtgggtgccaaaacacatgaaagatactggagatttattttctaagatatgcgatatggataatcttagaaaagcccacaagaacgcaaagagaggtaaagggtggtatgcagaggtaaagcgtatagaaaaagatctggatcattacctaaggaggctacaggaaaatctaatagaacacaggtatcatacctcagactatgaaacttttgtaagaaaagagggnagtaaggagagggagatttataagttaccgtactatccagaccgtatatgtcaatgggctatcttacaggttatagagccctacttacttaattccatgacaaaagatacctatagtgcaatccctaacagagggatccagcctattatcaatcanttacgagggtataagaaaaagattaagaaagatggaaaagtagtagcggagaagtggatacccagtattttagtatcagatccagaggctacaaagtattgcttaaagctggatgtaagaaagtattatcccagcattgtacacgatgtactaaaggctaagtatagagagctctttaaggatgaggagcttatctggttaatggatgagatcatagatagtattagtacttgtccagccacagaggaaaatatagagatcctccagaggctaggtgtggcggtaaatattatcatagacgataacggtagagagtttgtggatggcgtaggtattcctattggaaactatgttagccagtatgacggtaattttaatctatctgtagtagatcactggctcaaagaggttaagggcgttaagtactactttagatacatggatgatatggttattttcggtagcagtaaagaggaattacacaaactcaaaagagagttagatgagtttatggcggtaaatcttaagcaggtgcttaagcataactggcaggtatttcctactaaggtaagaggtgtagattttgtaggctatagatttttcggagaatataccttactcagaaaatcgacttgcaaaacatttaagcgtaggatgcttagcatctccagtaaaagagaaaacaatgtgagccctacttatagtgagtggtgctcatttaatagctatgtgggctggctacagcattgtgatagctttaggctataccagaaatatgtagagcctaatgtagaatatatgcacaattattacttaaaggaggtaaaaggtaatgcagaaatttgtaaacgtaagaactacagcggagagcgtaaagcctcttgagattgatgattaccatgtatatgtaaatacaggtatcaaagagatccatgaggaggntaaggagggagatcttagctctgggtttgatgggtttgaaattgaaacacaggagatctatgagaaagatgagtacatccagctcatggcagagaaaaacagntccttagaggagcaggctacagatttac

SEQ ID NO: 245 - DNA, 4000 bp, Escherichia coli
  misc_feature (748)..(748): n is a, c, g, or t
  misc_feature (760)..(760): n is a, c, g, or t
  misc_feature (872)..(872): n is a, c, g, or t
  misc_feature (2584)..(2584): n is a, c, g, or t
  misc_feature (3313)..(3313): n is a, c, g, or t
  misc_feature (3454)..(3454): n is a, c, g, or t
aaacgtgcgcagatcctcggccgtttcgaattctacgaggcgtgcggcccgctggtcgacgccgaaactgttgcgcccgcgcaggctgatttggtgaaattctcgaatcatggtatgcaaagttagaaattatttttaactttgagattcaaacctgaataactcaatggtgtggctgatctgcatactgctgtccttgcttgcgctgatccgtttttttggcggcgattcccggcgcaaacgtcggaggcaccgcaggtttggcaatcggtgaccatgtaaacgataacagaatatgttcgacgaaaaagatttgcagcaaatccgggagcacggactcactcccgaacaggcggagacccagttggagaatttccgccgcggattccctttcctgaatgtcgtgcgggccgcatcgccgggcgacggcgtgctggttgtcggcgcggcggaggccgatgccgccgtggaacgctatgaaaaagagtctgccggactgggggtggtgaagttcgtgcccgcttcgggggccgccacgcgcatgttcaaggagctgttcgagttcgtcaacgacggcaaacgcggcaagggcatcgacacgctgctggaaaatatcgggaagttcgccttctggcccgaacttcgcgccgtgctgcccgccggggccgacgaccgtgcgatcgtgaatgccatcgtcggcgacgggctgaactacggccgcaagcccaagggcctggtcaccttccangcctatcccganggggcgcgcaaggccgtcgaggagcacctggtcgaaggggcggcctacgccgcggccggaggcgtcgtgcgcatccatttcaccgtctcgcccgagcacgtcgcgggcttcnaggagctgctcgccgcaaaggtccccctttacgaaaagcggttcggcgtccgttacgagatctcgttctcggtgcagaaaccttcgaccgacaccctcgccgtgaatcccgacaacacgcctttccggcaggacgacggcacgctgctgttccgtcccgcgggccacggggcgctgatcgaaaacctgaacgagatcgacgccgacctgatcttcatcaagaacatcgacaacgtgacgaccgatgcccgccgcggggacacggtccgttataaaaaggtgcttgcaggggttctgctcgacctccaggggcgcgccttcgagtacctcaaggccctcgaagtgggcggcgccgagctggaacccatcgccgaattcatcgagaaacagctctgcgtgaaactccccgccgagtacgattcggcgctgctgcgcgccgtgttggaccgtccgatccgcgtctgcggcatggtccgcaacgagggcgagccgggcggcggcccgttctgggtcgggaaccccgacggcacggagtcgcttcagatcgccgagtcgagccagatcgcgcccgacgacctgccgctgatgcagtcggccacgcacttcaatccggtggacctcgtctgcggcgtgcgcgattcgaaggggtgcaagttcgatctgcgccggtacaccgatcccgcgacgggattcatctcgtcgaaatcctccggcggccgcgatctgcgcgcgcaggagcttccgggactctggaacggtgcgatggcgaagtggaacacggtcttcgtcgacgttcccgtcacgacattctctccggtgaaggtggtgcaggatcttctgcgcccccagcaccaataggtttaaggttttgcgggtgtctttcgcccgtcttgtccgggccggccggggaatgcgtttgtatctcccggccggcccggatcgtgtcgcgccgaagccggactgcccttattgcagatgcaggaccagtctgtcgagtccgaagaaacactccgtgaatccgggagccggggcgacggcctctatcgtcagcgtgtttccgcccttgcggatctgtccgttgccgaacgcaacctctttggcgatcagttccggggcatgtcccgggcctgcggcggccgccattgcggtgcggcgggcctgcggttatacatctgctccatttgtgccggaaatttgtcaaaataggataaattgctgttcagtatccccgattgtagataatcttttttatatttgtgcgttaaaaccgaaaaacaataatcaaaactaaataacgctatggaaaacaaacttcaacagttgacgcagaagctctacgacgaggggctggagaaagggcgcgccgaggccgacaagctggtggccgacgccaaggccgaggcccggaagatcgtcgccgaggcccgcgccgaggccgaagagatcgtcaaaaaggcggaggccaaggccgaggacgtttcgaagaacaccatgaccgagatttcgctggccggcaagcaggccgtcggcagaatcaagtcggagatcgcctcgctgatcatcgccaaggctacggcccggggcgtgaaggaggccgtcgtggacccggcgttcatcaaggagatgctcgtcgccgtagctaaaaactggaacggttccgattcgggcaaggtcgaattgcaggccctgctgcccgagggcgagcgcaagaanctcgacgcggcgttcgaggagagtgcgaaggagctgctcgccgccggtgtcgaggtgggctggtcgaaggaggtgaagaccggcttcaaggtgggcgccaaggagggcggctactacatttcgttcgccgacgccgacatcgaagcgctgttggcagagtacctgcgcgacaaggtgttccaattgttgttcaaggcgtaaggcatgtttgcgacccaatattattgtctggtagcctccctgaaggagtacgcgctcgacgccgacaccaagggcttcgacgcccgggccatcgtctccgggattctggaggaggtgaaccgcggcgacgcccgcgaggtgcggctcctgtacggctactacgactgtgagaatatcgccgccctgcgtgcggggcgctcggcgcacaatccgctgggcaacttcacgcgcgaggagctggcggaggagctgaaagctccgaagcggcttcccgaggcggttgcccgcgtggtgagggcctatgccgatcccgagggcgaggacgccgagacggtcgacacgtcgcggcgtttcgagaaggagctgttcggggcctactacgccgcctgcggaaaggccgggagccgcttcctgcgcgagtggtccgctttcgaccggaacctgcgcaacgtttcggcggccgtcacggcgcgcgccgcagggcgtgcggtcgaggaggtcgtcgtgggcggcggcgatgtcgccgancagttgcagcgcagttctgcggccgatttcgggcttcggggcgaacttccctatatcgacgcggtgatcgcggcggtgaacgacgaggccaacctcgtggagaaggagcacaagatcgacctgatccgctggaacgaagcngcggagctggcgaccttcgactatttcgacgtcaacgccatcctttcctacctggtgcggatcaacatcgtcgcccgctggacgctgctcgacgctgcgcgcggccgcgagatgttcgcccgcctgcttgccgaactggacggcaaggagctgattaataaggaataaacaataaaaacatacaatgaaaactacaggacgtgtaaacggtatcatctccaacatcgtgatcgtcaaggccgacggacccgtgggtcagaacgagatctgctatgtctggacgggcgataccaaaatgatggccgaggtcatcaaggtcataggcgacgcggcctatgtccaggtttttgacagcacccgcggtctgaagatcggcgaccgggtcgaattcgagggtcacatgctcgaagtcacgctggctccgggccttttgtcgcgcaactacgacggtcttcagaacgacctcgaaaagatggacggtctgttcatcgcccgcggttcgatcaccgatccggtcgactacgatgccgagtgggaattttcgcc

SEQ ID NO: 246 - DNA, 4000 bp, Escherichia coli
  misc_feature (709)..(709): n is a, c, g, or t
  misc_feature (948)..(948): n is a, c, g, or t
  misc_feature (1564)..(1564): n is a, c, g, or t
  misc_feature (1988)..(1988): n is a, c, g, or t
  misc_feature (2954)..(2954): n is a, c, g, or t
  misc_feature (3298)..(3298): n is a, c, g, or t
  misc_feature (3300)..(3300): n is a, c, g, or t
  misc_feature (3515)..(3515): n is a, c, g, or t
  misc_feature (3521)..(3521): n is a, c, g, or t
  misc_feature (3535)..(3535): n is a, c, g, or t
  misc_feature (3586)..(3586): n is a, c, g, or t
  misc_feature (3613)..(3613): n is a, c, g, or t
  misc_feature (3629)..(3629): n is a, c, g, or t
  misc_feature (3638)..(3638): n is a, c, g, or t
  misc_feature (3644)..(3644): n is a, c, g, or t
  misc_feature (3649)..(3649): n is a, c, g, or t
  misc_feature (3661)..(3661): n is a, c, g, or t
  misc_feature (3667)..(3667): n is a, c, g, or t
  misc_feature (3998)..(3998): n is a, c, g, or t
gcagctcctgagctggtcgtcggcgtcgcgtccgattcgaacaagcgctgccgcaacctctgctcgtagttgggcgcccgcatcacgttcgcgggcgctggcggtggcgtcggacaagcgaccggtatgacaggcggcgaggtcgttgcgcaaccggagactgccagcacgcaggccagcaaccacctctgtttccacttcggccgcacgctctcgatcttgttcatgctgttctcccagcgaggccatcgccccggtctgtaccgcctgccgttcgcgcgctgcgcgctcggcctgcattgcctcggcatgctgcagcgacgcaacctctgcctttgcggcatcgctgcgatcgccacgccagccccagcctgccgcgaacatcaccgacgaccacagcaccagcagcgcaatcgcgatcaatgtgcgtggcatccctcactgctccgccaggcagcgggcatgacgctgttgctgccgttgccatacgccccaacacaccttgttgggctgtccgttgacccgggtcgagcagtcgtagccccctgcccgcttccacagcagcagcgcatcgcacgcttggcggtactcacctcgcaggagatgccggcgcgtggatgatccattccagttgccgatcccatactggtaaaggaagtcgacataggtgtcgtactcaccctgtgtcagcgcgacgcccggcaacgangcgcggaactgcgattcctcgcgcgccaggtgcgcttccacggtgcgcagcgcacggacgggcgtagtccggtctccgagccggaccggcgtgccgtcctcgcgccgggtcgagccaaaaccataggtaggccgatcattgcgggtcggcaccaccgccgcgtcggtatagccctcatgctcgacaatggcgatcaggcctgcggcactgaggaccagcgcggcaaccaggcggcgcancggcaacgctgtgggcggcgtactcattcgcgtcccttccgccgccactcgcgcagccagcgccagcacaggtaagcgatctgtgcggcgagatagatgatggtcaggaccaccaccaggcggtccagggtgatgccggcggcaagtgcaccggcaacggttaccggcggagccgatttggccgccgctgcgcccactgcgctgaagatttcttctttcatggaaagtccaggatttgatgctggccacgacataccgaggtggccgggagaggtgcccgcctcgctgccggctgggcgcgagggttcatccggtcgggagacgggcgaaagttgagcccaccgctcatgcggcctgggcgatgccttccatccagccgcgcacgcgctggaagcccagctcgaccaggttcaggtaatgccggttggagaccggtcgctgcccgcagttggcgagcagcagattggcggtctcgaagcgctcgaccttgcgacggccgcgaccgcagtagtagccacgcagtgcgcaggccatcgccacgttgtcacgggcaactgcggtgatgatgtcttcgatctgctgcgccagcaggtccgtctccagtggcttgtacccntgcgcacggccgggcatgtcgccgccatgctcgatcaatacggccagcaggttgcgtgattggaagcccaggtattcgcagtcgcgatgcagggcgtattccccgccccagtgctccagacggctgcggacgtattcgccgaacgtatcaagctgcatggtgggcttctccctggatggacgacggacccggcgcgaacacatccgggcgcaggaattcacgacggaccgcaccggccgtggccagctcgatgcgtcggcacagacgggcgccaggcaacttgtggccgcgggcgatcatgtagagggtccgcagcgcacagccggtctggtgggccagacggcgcatcacggggcaactgggggtgccgtagcccccttgggagatggcgtagtcgatgaggttcatggccccacattaccgncccggtaatgccaagtcaataccgttttggtcatttgctggattggtaatgcagagcaccatttgcagatggacgccagtaccgcccgcaccctcaacatgcgcctccgcgttgccgctgccggcggcccggccgaatgggcccgcctgttcggcggcacccgctgggcgcagccccaggtcagccagtggatttcggagagcaacccgaagagcatcggccatcgtctggcacgcgatctcgagtcggcaatgcaactcccgcacggcacgcttgatcgtgccgatcaggacgttgagatgtcgcttcagtctcaatctacgggactggatttcgagaagatgagcgctgcggtcaaggtgctttcgcactacctggagctggtcggcgatccaccggaatggatctacgatcctgtgctgctggagaccgcattcatggtcgtggacgagttcggtcagccttcggccccggacaatgtgctcgacctgacgaagcttctggcaaaacggatcagggaggcgaaggatgactcacacgcgactcgaggagctcgcacagcggttggccgctaggacgcaggaactgcgcggcggtcgcaacccgacacctgccttgcgggtggtggccggtgaggcacatgcagccccgggagaacggcggatggacgccatcatgcgcgagtggcattgccgcatgatccgcaacgtacgccggcgctggggggagccgatgcagcatgtgatcgaccaggcctgttgcggggtggtggacatcgaccagctcgccgacgatgcgctgatccagctgcacaaggatatggaacgcgccgaggagtgcatccgcgaggggatttccttccacgatgcggggcttctacgcgcgcactacggttgaaagagacctggccggtcgattctgaccggccaaaaccgcacgatccattactttttattcccgaattanttaccttaaaggtaattaattggtgttgctggaagatttcctgcgccggcgtcgcggcatgccgaccgtggctgcacgcgggcaacaaaaaagcgcctctcggcgctttctgggttgcccggcaggtgatgccggcgctgtctgcgatggtgggccgtgatggattcgaaccatcgaccaaaagattaaaagtcttctgctctaccgactgagctaacggcccatgcaacatccctgcctgtcggcggggtgggcattctaccctactttgtgcggtagagagaaatcgtcgcagtatcggcctgcagttaaaccgttccatgccgcggacgcatctcatgcanantccttcgtccttcggagccacggatgcgcctgcccttctttctgttcgcctgcctgctgctgccctgcaccgtcaccgccgctgcggccccatcggtacagatagatgacatcgcccgattctggagtacctacgatgccgtgcatgccgagcccgatgccgcgcagcgggtggccctggtccgccagcactacgtcgagccgggcagtgccggnctgcangcgctgatgaaggngcgcaactacaccgccgccgaatacgcacaagcaatgctcgcctggccgcncttctgggcctcggtgcggccgctgancgccaacgcccggcangccagcgcnacgctngagcnggatctggctgngttccncaggctttaccccgccctgcgcccggccagcatcacctatgcggtgggcgtgctgcgcacaggcggcaccacgctgggggaccaggtgctgatcggcgcggaaatggcactcggcgatgcaagcgtggatgtcagcgaactgccggagccgttgcgcagtcgcctgcgggtcttctacgacagcgcgcccggcgcgaacaacgcgcagaacaacctgcatgagtacgtgcacacccaacagcgcgagactacgggatcgctcgcacagtacgcggtgcgcgaaggcgtggccgagtacatcgccgagcggatcagcggtcgccgcccggcnct

SEQ ID NO: 247 - DNA, 4000 bp, Escherichia coli
  misc_feature (1967)..(1967): n is a, c, g, or t
  misc_feature (1976)..(1976): n is a, c, g, or t
  misc_feature (1989)..(1990): n is a, c, g, or t
ataaataaattttcatctaattttggattatcattaatgtcttattaattattacattattattttcattaactcagttatttatatttatattaatattcttattaccttttcgactttaacatcaagaattttttcaacattatattcttcttctccaacttcttcttctacttcaacatccttacccgagtcgattaattcattttcaacaacttcttccttttttttacttctagtttgtctcttgctagacactaattaaataaaggagaaataataataataataatgaaaaagtaaatagtaattattaatattaaaaaaaaagtttgtaaagaaaaaagaaaataaaatttgaacgaatttttacgaaaaaattaaaattattattcaattattgaatgtatattatttagatcaaatattttaatttaaaagtaattttacacaattttattataagtacattaaaaaaaagaaataaaaaacaaaatatatattcatttattatattacttacttttgtatatgattaattactgattaaaataaataatttacaataaattactttatatatgaaaaaaaaaatatattaaataaatatttctattagatttattaaattaatagatttcattgtacaatactttaaaaaatttttagatatctagaaaaaatatagatcacgtgatatatcgttaattagttgtataaaaattaattgaaatttataaaatatatattttcttaattttagaaaaaatagttcagaaaaaaataggctattttcttataaagttatacataatagaatataatcttaataatgtataatacttacagattgaaatatatcacgcttaatataatattaatttaatcctatataaatgttaattataggatataaatattatagtactttcattaatggttgtattataatataaataactaaggtaaaaataatttcggattaatattcattcttttttaaatcatattcaattaagttattatgaattatgatttgaataagtgtatgatttattgtctatttttgggtctcgcaaaatttcattagggttagggttatagtaagaatatatatatatatatatatatatatatactaccatgaaaaaaaacaaaatttttcctactttgaaattgtggtattatatataaagtagggaataatgtgacgtgacgtttagagcagttcaacattcttttaccatgataaatttcaatatatcacgtgatctggattgattggcttagtggattagatttgttaaatatcgtacaatgacttttaacaatgtacataggtactagtgaactaatgttaataagacagtaaggccaatctaacattttcagtatagttgcttcgctactgtggtctttagcttagggatatacactacggcatttaacggaaaaaggctattttattaatgttcattttgattttataattataatacaaataataaataaaaaataataaaaaaacattttctataattatggcattttaaaaattaaaaatatttcaaacattgtctccctgaccatatattttaaaatttatcatgtactacaaaaaaaggctttatttttaattatactagtgttacaaaaaaaaagtgttgttgtatatatgtaataaatattattatttttaaaatttatagattttattgtgttacaactatacacaatttttatggtaaaatactcagatgtttttaacatatttaatgatagattaatataaatatattatcattaattataattaatagtaatttatcaatataaaaacatgatgaacatcttattttattatttattaatttaaatatacatacattaataatagttgatatctattaaaatgattcttaattctactaataatataggataaaaaaaaaaaaaaaaaaaaaaantaaataacntaaaaatagattnntattaaaaaaatattttaatatttattaataattttttataaaattatacatatttaaataaatatattctattattaatagcgattaattttatttagtaagatttaaaaactaaattaaaaaagaataacatattaaaattaaagactatataaaaattaattattgctcttcagaatcccatgggaagttatctaaatttgaatttttaattttatccaactgtgttctaattcttcctggattatccaaagagtattgatcactttccctacagaaactttgcattaaagttttattatgttcccatttcattttttcatcctatatatttaaaatataaaataatatattaatgagtttatatattttatttataaaaaaacataatattattttgttaaaagatggttataatttacaactggttggtctaaactctctaaatatttttttcttttttcgtccatttctggtgtaacctttaagtccttttcgttccacgactgtggttcatttaatttactaattataatatatatatgcatttattaaaaagttttttttgatagaaaatgtatatatgtattaagatattataccttcttctccaatcatgattacgctccctctgtgaattttccatttctttttgttttttatcattctatttttttaaaaataaataataataaataagagttaatcatttataaaaaacattttaatgattaataattaactatacatttttataattacctttgcagccgcaacataattatcaatatattcacttatatcttcaatttttgaaacattttcaagttgagattgattatttacatcagttgtagattttaatttattatttaaactatttgatctgtgtaatgaggatgattcatttagtattgatgttgattttttcgttgaaggcgtgccttttattattaaaattataatatataatataattttatattgtaagtaaccaaattttagataataataatatcattgttaattataattaaaaaaaaaaaaaaaaaatacttggtttattagaggatttagattcttctttgatttctttaattgttttagaaacatgattttcatcttttgaaatttcactaacttttttcgatttacgttttacttctagtttttcatcattttcttcatctgttatttgttctggttcttcagttttcattggaatatcaactacttcttttataccctatattcaagattatattattatatgaattaattattacggtagtcaccagtgataatatttcagaagaaaaagatatatattttaatatattttaaaagttaaatttggaatctttaaagtagcatttagatacaataccttacgattgtcattctctgaataaattaaccaattaataattaatatatataataacaataagttagtaattatttatagatttgaatatatatataactgcatattttaaatataataataaaataacaataacaacaacaacaacaacaacaataataataataataataataataataataataataataataataataataataacaacaacaacaacaacaacaacaataataataataataataataataataataataataataataataataacaataataataataataataattattataataataataataataatataataactaaacaaaaatatgtataataaaataaaataattaataaataaacaactttacaatgaaataaaacatgtaaatatatataatatataatgattgaatattattgtatattatataataattattataataataacaatagtgacaataacaattatcattgtttgatttaaaatactgaatatcataataaataaagaaaaaaataccacaaattaaaattaaagaaagaaataataactgatacaaatatatcattatttagattataatataatattttatta

SEQ ID NO: 248 - DNA, 4000 bp, Escherichia coli
  misc_feature (1984)..(1985): n is a, c, g, or t
  misc_feature (1987)..(2013): n is a, c, g, or t
  misc_feature (2050)..(2079): n is a, c, g, or t
  misc_feature (2116)..(2145): n is a, c, g, or t
  misc_feature (2182)..(2211): n is a, c, g, or t
  misc_feature (2248)..(2277): n is a, c, g, or t
  misc_feature (2315)..(2343): n is a, c, g, or t
  misc_feature (2380)..(2408): n is a, c, g, or t
  misc_feature (2446)..(2475): n is a, c, g, or t
  misc_feature (2477)..(2477): n is a, c, g, or t
  misc_feature (2481)..(2490): n is a, c, g, or t
  misc_feature (2492)..(2493): n is a, c, g, or t
  misc_feature (2496)..(2498): n is a, c, g, or t
  misc_feature (2500)..(2501): n is a, c, g, or t
  misc_feature (2503)..(2503): n is a, c, g, or t
  misc_feature (2505)..(2505): n is a, c, g, or t
  misc_feature (2507)..(2507): n is a, c, g, or t
  misc_feature (2511)..(2511): n is a, c, g, or t
  misc_feature (2513)..(2530): n is a, c, g, or t
  misc_feature (2532)..(2543): n is a, c, g, or t
  misc_feature (2547)..(2556): n is a, c, g, or t
  misc_feature (2558)..(2559): n is a, c, g, or t
  misc_feature (2562)..(2564): n is a, c, g, or t
  misc_feature (2566)..(2567): n is a, c, g, or t
  misc_feature (2569)..(2569): n is a, c, g, or t
  misc_feature (2571)..(2571): n is a, c, g, or t
  misc_feature (2573)..(2573): n is a, c, g, or t
  misc_feature (2577)..(2577): n is a, c, g, or t
  misc_feature (2579)..(2606): n is a, c, g, or t
  misc_feature (2608)..(2609): n is a, c, g, or t
  misc_feature (2613)..(2622): n is a, c, g, or t
  misc_feature (2624)..(2625): n is a, c, g, or t
  misc_feature (2628)..(2630): n is a, c, g, or t
  misc_feature (2632)..(2633): n is a, c, g, or t
  misc_feature (2635)..(2635): n is a, c, g, or t
  misc_feature (2637)..(2637): n is a, c, g, or t
  misc_feature (2639)..(2639): n is a, c, g, or t
  misc_feature (2643)..(2643): n is a, c, g, or t
  misc_feature (2645)..(2675): n is a, c, g, or t
  misc_feature (2679)..(2688): n is a, c, g, or t
  misc_feature (2690)..(2691): n is a, c, g, or t
  misc_feature (2694)..(2696): n is a, c, g, or t
  misc_feature (2698)..(2699): n is a, c, g, or t
  misc_feature (2701)..(2701): n is a, c, g, or t
  misc_feature (2703)..(2703): n is a, c, g, or t
  misc_feature (2705)..(2705): n is a, c, g, or t
  misc_feature (2709)..(2709): n is a, c, g, or t
  misc_feature (2711)..(2741): n is a, c, g, or t
  misc_feature (2745)..(2754): n is a, c, g, or t
  misc_feature (2756)..(2757): n is a, c, g, or t
  misc_feature (2760)..(2762): n is a, c, g, or t
  misc_feature (2764)..(2765): n is a, c, g, or t
  misc_feature (2767)..(2767): n is a, c, g, or t
  misc_feature (2769)..(2769): n is a, c, g, or t
  misc_feature (2771)..(2771): n is a, c, g, or t
  misc_feature (2775)..(2807): n is a, c, g, or t
  misc_feature (2811)..(2820): n is a, c, g, or t
  misc_feature (2822)..(2823): n is a, c, g, or t
  misc_feature (2826)..(2828): n is a, c, g, or t
  misc_feature (2830)..(2831): n is a, c, g, or t
  misc_feature (2833)..(2833): n is a, c, g, or t
  misc_feature (2835)..(2835): n is a, c, g, or t
  misc_feature (2837)..(2837): n is a, c, g, or t
  misc_feature (2841)..(2841): n is a, c, g, or t
  misc_feature (2843)..(2858): n is a, c, g, or t
  misc_feature (2860)..(2873): n is a, c, g, or t
  misc_feature (2877)..(2886): n is a, c, g, or t
  misc_feature (2888)..(2889): n is a, c, g, or t
  misc_feature (2892)..(2894): n is a, c, g, or t
  misc_feature (2896)..(2897): n is a, c, g, or t
  misc_feature (2899)..(2899): n is a, c, g, or t
  misc_feature (2901)..(2901): n is a, c, g, or t
  misc_feature (2903)..(2903): n is a, c, g, or t
  misc_feature (2907)..(2939): n is a, c, g, or t
  misc_feature (2943)..(2952): n is a, c, g, or t
  misc_feature (2954)..(2955): n is a, c, g, or t
  misc_feature (2958)..(2960): n is a, c, g, or t
  misc_feature (2962)..(2963): n is a, c, g, or t
  misc_feature (2965)..(2965): n is a, c, g, or t
  misc_feature (2967)..(2967): n is a, c, g, or t
  misc_feature (2969)..(2969): n is a, c, g, or t
  misc_feature (2973)..(2973): n is a, c, g, or t
  misc_feature (2975)..(3005): n is a, c, g, or t
  misc_feature (3009)..(3018): n is a, c, g, or t
  misc_feature (3020)..(3021): n is a, c, g, or t
  misc_feature (3024)..(3026): n is a, c, g, or t
  misc_feature (3028)..(3029): n is a, c, g, or t
  misc_feature (3031)..(3031): n is a, c, g, or t
  misc_feature (3033)..(3033): n is a, c, g, or t
  misc_feature (3035)..(3035): n is a, c, g, or t
  misc_feature (3039)..(3063): n is a, c, g, or t
  misc_feature (3065)..(3068): n is a, c, g, or t
  misc_feature (3070)..(3071): n is a, c, g, or t
  misc_feature (3075)..(3084): n is a, c, g, or t
  misc_feature (3086)..(3087): n is a, c, g, or t
  misc_feature (3090)..(3092): n is a, c, g, or t
  misc_feature (3094)..(3095): n is a, c, g, or t
  misc_feature (3097)..(3097): n is a, c, g, or t
  misc_feature (3101)..(3101): n is a, c, g, or t
  misc_feature (3105)..(3105): n is a, c, g, or t
  misc_feature (3107)..(3137): n is a, c, g, or t
  misc_feature (3141)..(3148): n is a, c, g, or t
  misc_feature (3150)..(3150): n is a, c, g, or t
  misc_feature (3152)..(3153): n is a, c, g, or t
  misc_feature (3156)..(3157): n is a, c, g, or t
  misc_feature (3161)..(3161): n is a, c, g, or t
  misc_feature (3163)..(3163): n is a, c, g, or t
  misc_feature (3165)..(3165): n is a, c, g, or t
  misc_feature (3167)..(3167): n is a, c, g, or t
  misc_feature (3171)..(3171): n is a, c, g, or t
  misc_feature (3173)..(3194): n is a, c, g, or t
  misc_feature (3196)..(3203): n is a, c, g, or t
  misc_feature (3207)..(3212): n is a, c, g, or t
  misc_feature (3214)..(3216): n is a, c, g, or t
  misc_feature (3218)..(3219): n is a, c, g, or t
  misc_feature (3223)..(3223): n is a, c, g, or t
  misc_feature (3226)..(3227): n is a, c, g, or t
  misc_feature (3229)..(3229): n is a, c, g, or t
  misc_feature (3231)..(3231): n is a, c, g, or t
  misc_feature (3233)..(3233): n is a, c, g, or t
  misc_feature (3238)..(3269): n is a, c, g, or t
  misc_feature (3273)..(3273): n is a, c, g, or t
  misc_feature (3277)..(3280): n is a, c, g, or t
  misc_feature (3282)..(3282): n is a, c, g, or t
  misc_feature (3284)..(3285): n is a, c, g, or t
  misc_feature (3289)..(3289): n is a, c, g, or t
  misc_feature (3292)..(3293): n is a, c, g, or t
  misc_feature (3297)..(3299): n is a, c, g, or t
  misc_feature (3302)..(3325): n is a, c, g, or t
  misc_feature (3327)..(3335): n is a, c, g, or t
  misc_feature (3338)..(3339): n is a, c, g, or t
  misc_feature (3343)..(3344): n is a, c, g, or t
  misc_feature (3347)..(3348): n is a, c, g, or t
  misc_feature (3351)..(3351): n is a, c, g, or t
  misc_feature (3354)..(3355): n is a, c, g, or t
  misc_feature (3358)..(3359): n is a, c, g, or t
  misc_feature (3361)..(3361): n is a, c, g, or t
  misc_feature (3363)..(3365): n is a, c, g, or t
  misc_feature (3367)..(3401): n is a, c, g, or t
  misc_feature (3405)..(3421): n is a, c, g, or t
  misc_feature (3424)..(3425): n is a, c, g, or t
  misc_feature (3427)..(3431): n is a, c, g, or t
  misc_feature (3434)..(3434): n is a, c, g, or t
  misc_feature (3436)..(3453): n is a, c, g, or t
  misc_feature (3455)..(3460): n is a, c, g, or t
  misc_feature (3462)..(3473): n is a, c, g, or t
  misc_feature (3475)..(3483): n is a, c, g, or t
  misc_feature (3485)..(3498): n is a, c, g, or t
  misc_feature (3500)..(3502): n is a, c, g, or t
  misc_feature (3504)..(3509): n is a, c, g, or t
  misc_feature (3511)..(3514): n is a, c, g, or t
  misc_feature (3516)..(3554): n is a, c, g, or t
  misc_feature (3556)..(3563): n is a, c, g, or t
  misc_feature (3566)..(3571): n is a, c, g, or t
  misc_feature (3573)..(3590): n is a, c, g, or t
  misc_feature (3593)..(3599): n is a, c, g, or t
  misc_feature (3601)..(3601): n is a, c, g, or t
  misc_feature (3603)..(3607): n is a, c, g, or t
  misc_feature (3609)..(3623): n is a, c, g, or t
  misc_feature (3625)..(3630): n is a, c, g, or t
  misc_feature (3632)..(3682): n is a, c, g, or t
  misc_feature (3684)..(3703): n is a, c, g, or t
  misc_feature (3705)..(3804): n is a, c, g, or t
  misc_feature (3806)..(3830): n is a, c, g, or t
  misc_feature (3832)..(3848): n is a, c, g, or t
  misc_feature (3850)..(3909): n is a, c, g, or t
  misc_feature (3911)..(3919): n is a, c, g, or t
  misc_feature (3921)..(3937): n is a, c, g, or t
  misc_feature (3939)..(3986): n is a, c, g, or t
  misc_feature (3988)..(4000): n is a, c, g, or t
tacaccgtattatgcgcgtcatgattctagtctacaaatagctagacaaatttcttggaaagaagatgtaaaatgtgaagtatggactgctattattgcacaaaagatattgaatcaatcatactatttgggagaatgttctttctttgagaaatctcaatcaattatggagttatatcatggtttagaacagtttgatcctagtaatcgtgagggtcactctgccagaatttattttaatacacttttcggtaatgactttactagggaaagtgataatgatatcaatgcagcgctagattatggttatactttattattgagtatgtttgcacgtgaggttgtcgtctgtggttgtatgacacaaattggtttaaagcatgctaatcagtttaatcaatttaaccttgctagtgatattatggaaccatttagaccaattatagatagaattgtttatcaaaatcgacataagaattttgtcaaaatcaagaaagaactcttttcgattttttcagaaacctatctctacaatggaaaagagatgtatttatcaaacattgttagtgattatacaaaaaaagttataaaagtgttaaatcagttaggtgagggaattcctgaatttagaatatgagttacagatatatgcgaatgatattaatgttcgatatgccaacagatactgctgaagagaggaaagcgtatcgtaagtttaggaagtttctattaagtgaaggttttattatgcaccagtattcggtttatagtaaacttttgttaaacaataccgcaaatacagcaatgattggacgacttaaggctaataatcctaaaaaaggaaatataacaatattaacagttactgaaaagcaatttgctcgtatgatttatttgtacggagataagaacaccagtgttgccaattcagacgaaaggttagtgttcttaggagaagattattgtgatgaagattaatttttcgcttttggatgagcctatggagattagccaggggacagttctcgtaattgaggatgtgagtgtgtttgctcaaatagttaaggaattctatcagtatgatgaacaatcgaatttaacaatatttgatagtaaaataaggagtataaagtcctctgaattgcttttaataacagatattttaggttacgatattaatacttctcaggtattaaagttgcttcacacagatattgtaagccagttgaatgataaaccagaagttagatcagaaatagattctttgatatcattaattactgatattatcatggcagagtgtttagaaaatgaactagatatagagtatgatgagattacacttttagaactaattaaatcgttaggtatcagaatcgaaactacgtcttgtacggtttttgaaaaaatatttgagattttacagattttcaaatatttagttaaaaagagaattttggtgttcgtcaatagtttgtcgtatttttctaatgatgaaatttatcaaatcttggaatatacaaagttattacaagctgatgtattatttttggaacctagaaagattaaaggtattcaacaatttattttggataaggattacattttgatgccttacaataactagtaatttggtaataagtatagatagtcttgagttatttcaagactatcttttagtatttagtagtttctacatgaagttgagtggaagaatcattttgttagagagtaggttataagctatctgataggtgagaaggtaagttgattggaaaaagatttctaaaattttttcgatatagcgacagctctatttgttaaaacgttgttatataaggctttttaaggtataataaacataaaaatggaatcattttgaagctgaagtcaggctgagatgaatagcgcgattacgaaatctggtagagaaaaatgacctacgaggttttagagctgtgttgtttcgaatggttccaaaacnntnnnnnnnnnnnnnnnnnnnnnnnnnnngttttagagctgtgttgtttcgaatggttccaaaacnnnnnnnnnnnnnnnnnnnnnnnnnnnnnngttttagagctgtgttgtttcgaatggttccaaaacnnnnnnnnnnnnnnnnnnnnnnnnnnnnnngttttagagctgtgttgtttcgaatggttccaaaacnnnnnnnnnnnnnnnnnnnnnnnnnnnnnngttttagagctgtgttgtttcgaatggttccaaaacnnnnnnnnnnnnnnnnnnnnnnnnnnnnnngttttagagctgtgttgtttcgaatggttccaaaaccnnnnnnnnnnnnnnnnnnnnnnnnnnnnngttttagagctgtgttgtttcgaatggttccaaaacnnnnnnnnnnnnnnnnnnnnnnnnnnnnnagttttagagctgtgttgtttcgaatggttccaaaacnnnnnnnnnnnnnnnnnnnnnnnnnnnnnngntttnnnnnnnnnntnnttnnnanngntncnaaancnnnnnnnnnnnnnnnnnnannnnnnnnnnnntttnnnnnnnnnntnnttnnnanngntncnaaancnnnnnnnnnnnnnnnnnnnnnnnnnnnnanntttnnnnnnnnnntnnttnnnanngntncnaaancnnnnnnnnnnnnnnnnnnnnnnnnnnnnnnntttnnnnnnnnnntnnttnnnanngntncnaaancnnnnnnnnnnnnnnnnnnnnnnnnnnnnnnntttnnnnnnnnnntnnttnnnanngntncnaaannnnnnnnnnnnnnnnnnnnnnnnnnnnnnnnntttnnnnnnnnnntnnttnnnanngntncnaaancnnnnnnnnnnnnnnnntnnnnnnnnnnnnnntttnnnnnnnnnntnnttnnnanngntncnaaannnnnnnnnnnnnnnnnnnnnnnnnnnnnnnnntttnnnnnnnnnntnnttnnnanngntncnaaancnnnnnnnnnnnnnnnnnnnnnnnnnnnnnnntttnnnnnnnnnntnnttnnnanngntncnaaannnnnnnnnnnnnnnnnnnnnnnnnannnnanntttnnnnnnnnnntnnttnnnanngnttcnaaancnnnnnnnnnnnnnnnnnnnnnnnnnnnnnnntttnnnnnnnntntnnttnngaangntncnaaancnnnnnnnnnnnnnnnnnnnnnnannnnnnnntttnnnnnntnnntnntttnganngntncnaaaannnnnnnnnnnnnnnnnnnnnnnnnnnnnnnntttnagannnntntnntttngannggtnnnaannnnnnnnnnnnnnnnnnnnnnnnannnnnnnnnttnnaganntgnnttnttnnganngntnnnannnnnnnnnnnnnnnnnnnnnnnnnnnnnnnnnnntttnnnnnnnnnnnnnnnnnganngnnnnnaanannnnnnnnnnnnnnnnnntnnnnnnannnnnnnnnnnnannnnnnnnntnnnnnnnnnnnnnnannnannnnnntnnnnannnnnnnnnnnnnnnnnnnnnnnnnnnnnnnnnnnnnnnannnnnnnnaannnnnntnnnnnnnnnnnnnnnnnnaannnnnnntntnnnnntnnnnnnnnnnnnnnngnnnnnnannnnnnnnnnnnnnnnnnnnnnnnnnnnnnnnnnnnnnnnnnnnnnnnnnntnnnnnnnnnnnnnnnnnnnntnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntnnnnnnnnnnnnnnnnnnnnnnnnnannnnnnnnnnnnnnnnnannnnnnnnnnnnnnnnnnnnnnnnnnnnnnnnnnnnnnnnnnnnnnnnnnnnnnnnnnnnannnnnnnnnannnnnnnnnnnnnnnnncnnnnnnnnnnnnnnnnnnnnnnnnnnnnnnnnnnnnnnnnnnnnnnnnannnnnnnnnnnnn

SEQ ID NO: 249 - DNA, 4000 bp, Escherichia coli
  misc_feature (90)..(90): n is a, c, g, or t
  misc_feature (106)..(106): n is a, c, g, or t
  misc_feature (260)..(260): n is a, c, g, or t
  misc_feature (462)..(462): n is a, c, g, or t
  misc_feature (562)..(562): n is a, c, g, or t
  misc_feature (801)..(801): n is a, c, g, or t
  misc_feature (860)..(861): n is a, c, g, or t
  misc_feature (924)..(924): n is a, c, g, or t
  misc_feature (1980)..(1980): n is a, c, g, or t
  misc_feature (1985)..(1986): n is a, c, g, or t
  misc_feature (1994)..(1995): n is a, c, g, or t
  misc_feature (1997)..(1998): n is a, c, g, or t
  misc_feature (2003)..(2003): n is a, c, g, or t
  misc_feature (2009)..(2010): n is a, c, g, or t
  misc_feature (2018)..(2018): n is a, c, g, or t
  misc_feature (2024)..(2025): n is a, c, g, or t
  misc_feature (2030)..(2031): n is a, c, g, or t
  misc_feature (2804)..(2806): n is a, c, g, or t
  misc_feature (2852)..(2852): n is a, c, g, or t
  misc_feature (2859)..(2859): n is a, c, g, or t
  misc_feature (2868)..(2869): n is a, c, g, or t
  misc_feature (3065)..(3065): n is a, c, g, or t
  misc_feature (3071)..(3071): n is a, c, g, or t
attagttgttttctatggttatatttattcttcaatacaaacttttcaaaatgtccttcgatataaacatattcccaccattcaggaagnaacatcgctgcaattntacggcggatattgtacgttgcaaagtgtttcatcaggccataataagagttcatcgtactcacaaacttctcaacatacgcttctgcaaatccattttcagctattctattaaatttcctgacagcgttatatgtgttaccaaccaccctgtnagatacataaattctaccaggcaaaatgaacgcccctacaaacaagactccttttttataatgctgaagatacagtttgcgtggatgcaaccgtaaaaggagttgttctttcaggaaaccatcaagaagatggactttggacaatatttcttccggtgatttcactacgatacaaaagtcatcaacaaagcgtacataatanatgaatcccagtatttccatcacgaaataatcatatacagacgccagaaagttggctatgagttgcgacggcaggttcccgatagccactcccctgtcanggtcattatgaaacagacttttattactgggaagtttgtcccacatggagacgggagagcgtctgatacacttattttgtggacaatgaaagatagtaacggctagaaggtaaagcagacattcaatatcatcgcctttataattgtcccttacgaatatgttcagcatttcccataccaacgatttcgagatagacatgaagaaactgaacaggtcatctttgaaaatgtacgcatcngcagtataattctcactgacctcgactatcatgttattcagatagtgcacggcagacanncatccctcacctttccggcagttcttcgagacgttcccttgttcccgaaaacgttcctctaanatcggctcgatacgaagagcgatccagtgatggacaacacgatcaatgaaagcggcggcaaaaacctcccgatataccgggtaagtccgtatgaatacttttgaaaagtccggtacatattcaccgtaaataatagaataccatagccgcaccaatgcagactgataatcattataaaactcaacacaatccgtactcgttcttttctgcctggcacaatcttcggatgcttcgaaaatactgctaagaagtatgtcatagattatattacctgttgcggcgaggggacgaacccggttcgcgttctggcggttgttcgtgttgacgttgccgttgttgaagttcacgttccaactgctggaagccgttgcatccgctatcttagtctttcccggctcatcaccggggggatgcccaataaataattctaattgctcactcataatccccttggcgattatgactccggctttgcgacttgttgcgatccgttagctttttgccgttggagatctgcaaccgtttttttgtaccagccggtactttgcttaccgatactctctgcaagcagacagatttcggctgtttgagtcaggctggtcaaatgtcgttcttcacacactcttagcagtaatttcaatgcatcaaactcacacaaaaacttcatcagataatctgcacggtgctcaaggttcatatctgtatttgcataacggatatattcgcaacaatgaacggcaagcatcatcaactccgtaccaaattcataccggaacgccttggggaattgttgccgggcatcaatgataaggttcagaagcttatacatcgaatttgatataggaaggtcttgtgtaagtgccatgttaattttttaatattttaatgtatgtattagagggcgcaaagttaataactgtaaagcaattaacacaattttagctcaaaaaagtgaaaccaaaaagcccctaccggggcttttatttagttaaccctctaagggataaagaattaaagggataaagtgtttattgcggcgaggggacgaacccggtncgcgnnctggcggnngnncgtgntgacgnngccgtagntgaagnncacgnnccaactgctggaagcgtcatattcggtactagaccaataccagtcgtttgtaaatatattttgattaccaaacatagaagttatgagctcattgatttcggttttatacttggccataagcataagttcacccaatgcgggcaggttccacacggttgtatcttcaattccgtcagattcaagcgtacaggctttataggctctggcaacttcggcggcaggggcaccgacagttccctgggtgtccttgacgcctgcaagggtttctattataacatcggtattttctttgccgtcgaaggtatcatagagtccttggttaccactgccgtagtttttcaggccgcgcaggtcggtaccgtagccaccccatttgaacgttttgttgccgcctgcgtcaatgcagtcgcttttggcgataatgaactggtggcattcggcgcgaagtcggatgccgatacggatatacttggagcggttattcgcgctcatggagttccattcggaagccgtgaaaaagacttgttcaccgtcttcaattcggagcgtagccaaagaaaggtcaagaagcgtacctgaccattgcatatatttggcgatgtcgcttgcgggggtgttttcattcacggttgtaaaacctattgattttaaggcttctatctggtcttgtttattcaagcgcagaagcatggcgttggcgatatttttatccattttattgtataatattaagttaatactattcggaagcaacagctctcacatgaagaagnnntgaatttttgttttgattcgtaatacgcccggtattcagttcgaangcccagncggagttannatcccaaattgttgatgaccagtagtatttatcagtcatcagcatactgtcactactccaaaaggtacgcatcatctcattgattttatcgcggtagcggtacatcagaagcatttggccagatgaaggaaggaaccagttggattcatcctcgataccgtcactttccaaagtgtaggcacggtatgcacgggcngcttcngcagctggcgcaccgatcacaccactattattttggtctttcagagttgcgataatgaggtcagtatcttcctcacccgtgaagcagccatacatggcgcccagtcctttttgattcaggccatctatggctttgccctgaccgccccagtagaaggtggtagtcatgtcggcattatagcactcctgggcggaaattacgaaggagtgtccatgtgcccggatacgaagaccgcgtttgataaacaactgtttgttggtaaccgtgagggaatcccattcctcacgggtgaaataccatttggagttatccgagatgcggttacaggcaagattcaaatcaagcaggccggcagcccacttgatacgttgtccaaattcagatgcgcgggaattctcggtgacatccgagaagcccacggcgttcagtgctgccacttgtgcctgtttattcaagcgaagcagcgttgcgctttgttcattcgtcatagttacttgttgattaaatcattaatatccatattgtcttcagcgaagcgttcgagatattcttcgtaggtttcgccgttataatattcaaggacttcattgatgttgtccagcgttacgttatcgtagtacggttctccgccataagactcattattgaaccagttgatcaggtcgatgtaggcatctatgacggtaaggatgacaaggccgtcgataccggattcaagggattcgatttcatccgtttcacggataactgtcagttcatacgtgccgttgactaccggtttatcctgtctgttgccgtcctcatccattccggcaactccatattcgagaatggcaagaagctcggagccgtcagccttcagtgtcatgttcgagatacggagcatggaaagtttacgggatgccgtttgtgaagcgaggacgtcacgg

SEQ ID NO: 250 - DNA, 4000 bp, Escherichia coli
  misc_feature (1)..(847): n is a, c, g, or t
  misc_feature (918)..(918): n is a, c, g, or t
  misc_feature (1488)..(1488): n is a, c, g, or t
  misc_feature (1791)..(1791): n is a, c, g, or t
  misc_feature (1990)..(1991): n is a, c, g, or t
  misc_feature (1998)..(1998): n is a, c, g, or t
  misc_feature (2296)..(2296): n is a, c, g, or t
  misc_feature (2308)..(2308): n is a, c, g, or t
  misc_feature (2332)..(2332): n is a, c, g, or t
  misc_feature (2702)..(2702): n is a, c, g, or t
  misc_feature (3269)..(3269): n is a, c, g, or t
  misc_feature (3696)..(3696): n is a, c, g, or t
  misc_feature (3714)..(3714): n is a, c, g, or t
  misc_feature (3717)..(3717): n is a, c, g, or t
  misc_feature (3729)..(3729): n is a, c, g, or t
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatttcacgggttacagagcaaccttcgggggttaatacaaactgggtagccagagatacatattctgctgnatataatgctgcaatcatgccacccaaagaagcattattcgagtcgatggcttctttgccggtaaatactacatcgtatttttcccgatcgcaaagagccgcaatttgtttggcaactgtatagctgtcgttagaaaccaaatcaattcgaaatgcttcatcccctccaagtgccaatgccttgcgaataatgggttcactgtcagctccgccaacacaaaccaagtgaaggatggtggcaggatctgattctttcaattcaatggcacgtaccaaggcataccattcgtcgtacgggttaataatccattgcacacccgcttcatcaaaacgagtattgttttcggtaaaggcaatccggctggtggtatccggtgttttactgatgcagaccagtattttcatacagttcgatataagggttacaaattagttgaggtagtaaatggttgtttatgcaactaattgcaaatataggaaggaatttcatagagttttcaaccaaatcgttaatttttttacacagtattttgaaaaaaatcaacccgtaattcggttgtatatttgaanatgaatcggatggaaaaattaaaagaatatctgaaagcgcagcccgacgacccttttctgaatcatgctttggctttggaatatagtaaagaaggggaactagatttagcgcgcgaactattcattcggctcttacagttgcatccagcatatgtaggttcttattatcacctggctgcccttttattgcagcaaaatcaaagagatgcagccattgaatggtatgaaaaagggatggccgcagccaaaaaagcaggggatgcccatgcattcaacgaattaagggcagcttatgatgatgtnatggatgtgtaagaaaaaaggctttctcagctacctctagagccacctgttttgatgggcttctttccaccaccgctggctttactggctcctggcttagcaataaatttagaactttgggcaccgggcttagtagatgaattgccggatttgccattttttttgttgttcacgggtaatgacatacagctcaatttgnnataaagntacgattttttttgcggatttcaagctaaacggctagggaggggttcaactgattcgcagccgcagttcagtatctattttggtaaaaagatggtagggtttatacgatctccattccggcaattccatcagctccatgtaataggggagcttttttttaataaagtcttgctgtgttgccggcggcatattcaaaataataatccatccttcttcctcgctcacctcatcataccattcgcggtaatattcattgtcgctgctgtgaaaattcaatacattttcggcgatgaaaatnaatttactaatncctttcttcatcaattcatccccnatttcccgcttcagcatcatgatatcgttttcaatcgcatcgttccattctccaattaattcaatcacacaaaagtgaagttcatagtctacatagatgatttttagataaagggttttgctgccaaaatcatcccattgcggatggatatagtaattgtaaatggtttgtgagaactcgaattcactgtacttcgtgccataaaagggggatagcctatcatcagctgcgatgtataaatgcctccagttataatagggctcgatagtatgcatagtatttttaatgcccgttttcggcggcttcaatcgctttttttacactaccatgcttcaacaaaaggtctttggcttgctcataatctttcagngccaatccctccattaccatcttcactcctcgatctaccagttttacattgctgagctgcatattcaccattttattgtcttctacccggcccaactgaatcataactgcggtagaaatcatattcaacaccagtttttgagcagttccgcttttcatccgggtacttccagtaacaaattcagttccaaccaccacttctaccggaaaatctgcttctctcgatacgggtgtattgggattacaactgatactgcccgtaataatgccctttcttctgcattgttttaaagcacctatcacataaggggtacttccgctggctgccaaacccactactacatctttgtcactcacaaaatgtttcattaaatcgttccaaccttcatctggatggtcctccgcaaattctacggccgtggtaatggctttgtcgcccccggcaatgatgccgattaccagtccatagggcactccaaacgtgggcggacattcactggcatccacaatacccaatcggccgctggtgccggctccaatataaaataagcggcctcctgccagcatnttgtcggagatagcggctactaatttttcaatttgtggaatagctttttcaaccgcatccggcacagttttatcttcccgattgatattttgtagcaaatcaggaatgctcattttttctaagtgtctgtattgcgagggaagctctgtatatcggataaactctttcatataattattgatgatattgaatcaaaccttgcaggggcgttttcataacccgacccagctttattccataatggttacaaagttcttgtaaaacatctttgaaaccaaaagcaatacttccagtaaaatgaaccggaagctgttcacgctctttgtatttgagtaagtggtgaaaaaagaactcgttacagccatcttccagtatattttctaccatatagtgacccctgttttcggccaaaaaaactgcgaaggangccagataacgattggcnagnggctttttgtanacattttccagtatgtcggctcgggtttgcttaaaacggctttcgaatgccgattgtaaagcctcatccatggtttcatacaaatagtattgtaccagtttttttccaagataagcgccacttccctcatcacctagtatatagccgatacccggactattttttacaatctttttaccgttatagtagcaggaattggaaccggttcctaaaatgcaggcaatccctttgctatggccgcataaggctcgggcagcggccaataaatcgg

SEQ ID NO: 251 - DNA, 4000 bp, Escherichia coli
  misc_feature (1)..(403): n is a, c, g, or t
  misc_feature (488)..(488): n is a, c, g, or t
  misc_feature (492)..(492): n is a, c, g, or t
  misc_feature (494)..(495): n is a, c, g, or t
  misc_feature (497)..(497): n is a, c, g, or t
  misc_feature (500)..(503): n is a, c, g, or t
  misc_feature (505)..(505): n is a, c, g, or t
  misc_feature (507)..(509): n is a, c, g, or t
  misc_feature (511)..(513): n is a, c, g, or t
  misc_feature (517)..(518): n is a, c, g, or t
  misc_feature (520)..(520): n is a, c, g, or t
  misc_feature (522)..(522): n is a, c, g, or t
  misc_feature (525)..(525): n is a, c, g, or t
  misc_feature (527)..(527): n is a, c, g, or t
  misc_feature (530)..(532): n is a, c, g, or t
  misc_feature (535)..(539): n is a, c, g, or t
  misc_feature (541)..(542): n is a, c, g, or t
  misc_feature (544)..(547): n is a, c, g, or t
  misc_feature (549)..(550): n is a, c, g, or t
  misc_feature (552)..(552): n is a, c, g, or t
  misc_feature (554)..(568): n is a, c, g, or t
  misc_feature (570)..(570): n is a, c, g, or t
  misc_feature (572)..(619): n is a, c, g, or t
  misc_feature (621)..(627): n is a, c, g, or t
  misc_feature (629)..(629): n is a, c, g, or t
  misc_feature (632)..(634): n is a, c, g, or t
  misc_feature (636)..(641): n is a, c, g, or t
  misc_feature (643)..(651): n is a, c, g, or t
  misc_feature (653)..(655): n is a, c, g, or t
  misc_feature (657)..(658): n is a, c, g, or t
  misc_feature (660)..(661): n is a, c, g, or t
  misc_feature (663)..(669): n is a, c, g, or t
  misc_feature (671)..(672): n is a, c, g, or t
  misc_feature (674)..(701): n is a, c, g, or t
  misc_feature (703)..(712): n is a, c, g, or t
  misc_feature (714)..(715): n is a, c, g, or t
  misc_feature (717)..(718): n is a, c, g, or t
  misc_feature (720)..(727): n is a, c, g, or t
  misc_feature (729)..(733): n is a, c, g, or t
  misc_feature (735)..(738): n is a, c, g, or t
  misc_feature (740)..(741): n is a, c, g, or t
  misc_feature (743)..(761): n is a, c, g, or t
  misc_feature (764)..(772): n is a, c, g, or t
  misc_feature (774)..(774): n is a, c, g, or t
  misc_feature (776)..(778): n is a, c, g, or t
  misc_feature (780)..(782): n is a, c, g, or t
  misc_feature (784)..(796): n is a, c, g, or t
  misc_feature (799)..(800): n is a, c, g, or t
  misc_feature (803)..(803): n is a, c, g, or t
  misc_feature (805)..(806): n is a, c, g, or t
  misc_feature (811)..(815): n is a, c, g, or t
  misc_feature (817)..(818): n is a, c, g, or t
  misc_feature (820)..(824): n is a, c, g, or t
  misc_feature (826)..(827): n is a, c, g, or t
  misc_feature (829)..(830): n is a, c, g, or t
  misc_feature (832)..(837): n is a, c, g, or t
  misc_feature (840)..(840): n is a, c, g, or t
  misc_feature (845)..(847): n is a, c, g, or t
  misc_feature (850)..(850): n is a, c, g, or t
  misc_feature (852)..(854): n is a, c, g, or t
  misc_feature (858)..(859): n is a, c, g, or t
  misc_feature (862)..(864): n is a, c, g, or t
  misc_feature (866)..(875): n is a, c, g, or t
  misc_feature (877)..(883): n is a, c, g, or t
  misc_feature (885)..(893): n is a, c, g, or t
  misc_feature (895)..(895): n is a, c, g, or t
  misc_feature (897)..(897): n is a, c, g, or t
  misc_feature (901)..(908): n is a, c, g, or t
  misc_feature (910)..(912): n is a, c, g, or t
  misc_feature (915)..(946): n is a, c, g, or t
  misc_feature (949)..(953): n is a, c, g, or t
  misc_feature (955)..(959): n is a, c, g, or t
  misc_feature (962)..(962): n is a, c, g, or t
  misc_feature (964)..(964): n is a, c, g, or t
  misc_feature (967)..(967): n is a, c, g, or t
  misc_feature (969)..(969): n is a, c, g, or t
  misc_feature (971)..(987): n is a, c, g, or t
  misc_feature (989)..(994): n is a, c, g, or t
  misc_feature (996)..(1012): n is a, c, g, or t
  misc_feature (1014)..(1017): n is a, c, g, or t
  misc_feature (1022)..(1032): n is a, c, g, or t
  misc_feature (1034)..(1039): n is a, c, g, or t
  misc_feature (1041)..(1050): n is a, c, g, or t
  misc_feature (1053)..(1056): n is a, c, g, or t
  misc_feature (1058)..(1062): n is a, c, g, or t
  misc_feature (1064)..(1090): n is a, c, g, or t
  misc_feature (1092)..(1101): n is a, c, g, or t
  misc_feature (1103)..(1132): n is a, c, g, or t
  misc_feature (1134)..(1144): n is a, c, g, or t
  misc_feature (1147)..(1148): n is a, c, g, or t
  misc_feature (1150)..(1155): n is a, c, g, or t
  misc_feature (1157)..(1161): n is a, c, g, or t
  misc_feature (1163)..(1164): n is a, c, g, or t
  misc_feature (1166)..(1168): n is a, c, g, or t
  misc_feature (1170)..(1171): n is a, c, g, or t
  misc_feature (1173)..(1178): n is a, c, g, or t
  misc_feature (1180)..(1180): n is a, c, g, or t
  misc_feature (1183)..(1187): n is a, c, g, or t
  misc_feature (1189)..(1196): n is a, c, g, or t
  misc_feature (1200)..(1200): n is a, c, g, or t
  misc_feature (1202)..(1202): n is a, c, g, or t
  misc_feature (1204)..(1204): n is a, c, g, or t
  misc_feature (1207)..(1212): n is a, c, g, or t
  misc_feature (1214)..(1218): n is a, c, g, or t
  misc_feature (1222)..(1227): n is a, c, g, or t
  misc_feature (1230)..(1247): n is a, c, g, or t
  misc_feature (1249)..(1249): n is a, c, g, or t
  misc_feature (1254)..(1255): n is a, c, g, or t
  misc_feature (1257)..(1260): n is a, c, g, or t
  misc_feature (1262)..(1263): n is a, c, g, or t
  misc_feature (1266)..(1277): n is a, c, g, or t
  misc_feature (1279)..(1286): n is a, c, g, or t
  misc_feature (1288)..(1308): n is a, c, g, or t
  misc_feature (1311)..(1311): n is a, c, g, or t
  misc_feature (1316)..(1316): n is a, c, g, or t
  misc_feature (1512)..(1512): n is a, c, g, or t
  misc_feature (1960)..(1960): n is a, c, g, or t
  misc_feature (1965)..(1965): n is a, c, g, or t
  misc_feature (1969)..(1969): n is a, c, g, or t
  misc_feature (1978)..(1978): n is a, c, g, or t
  misc_feature (1982)..(1982): n is a, c, g, or t
  misc_feature (1986)..(1986): n is a, c, g, or t
  misc_feature (1990)..(1991): n is a, c, g, or t
  misc_feature (2006)..(2006): n is a, c, g, or t
  misc_feature (2011)..(2011): n is a, c, g, or t
  misc_feature (2052)..(2052): n is a, c, g, or t
  misc_feature (2133)..(2133): n is a, c, g, or t
  misc_feature (2135)..(2136): n is a, c, g, or t
  misc_feature (2207)..(2207): n is a, c, g, or t
  misc_feature (2251)..(2251): n is a, c, g, or t
  misc_feature (2379)..(2381): n is a, c, g, or t
  misc_feature (2386)..(2391): n is a, c, g, or t
  misc_feature (2393)..(2393): n is a, c, g, or t
  misc_feature (2395)..(2397): n is a, c, g, or t
  misc_feature (2399)..(2401): n is a, c, g, or t
  misc_feature (2403)..(2403): n is a, c, g, or t
  misc_feature (2405)..(2410): n is a, c, g, or t
  misc_feature (2413)..(2415): n is a, c, g, or t
  misc_feature (2418)..(2424): n is a, c, g, or t
  misc_feature (2427)..(2427): n is a, c, g, or t
  misc_feature (2429)..(2429): n is a, c, g, or t
  misc_feature (2431)..(2431): n is a, c, g, or t
  misc_feature (2437)..(2442): n is a, c, g, or t
  misc_feature (2444)..(2448): n is a, c, g, or t
  misc_feature (2450)..(2450): n is a, c, g, or t
  misc_feature (2452)..(2455): n is a, c, g, or t
  misc_feature (2458)..(2459): n is a, c, g, or t
  misc_feature (2461)..(2461): n is a, c, g, or t
  misc_feature (2464)..(2464): n is a, c, g, or t
  misc_feature (2466)..(2466): n is a, c, g, or t
  misc_feature (2468)..(2468): n is a, c, g, or t
  misc_feature (2470)..(2473): n is a, c, g, or t
  misc_feature (2475)..(2475): n is a, c, g, or t
  misc_feature (2477)..(2477): n is a, c, g, or t
  misc_feature (2480)..(2482): n is a, c, g, or t
  misc_feature (2484)..(2485): n is a, c, g, or t
  misc_feature (2487)..(2489): n is a, c, g, or t
  misc_feature (2491)..(2493): n is a, c, g, or t
  misc_feature (2495)..(2497): n is a, c, g, or t
  misc_feature (2499)..(2502): n is a, c, g, or t
  misc_feature (2504)..(2505): n is a, c, g, or t
  misc_feature (2507)..(2507): n is a, c, g, or t
  misc_feature (2509)..(2509): n is a, c, g, or t
  misc_feature (2512)..(2517): n is a, c, g, or t
  misc_feature (2519)..(2522): n is a, c, g, or t
  misc_feature (2525)..(2525): n is a, c, g, or t
  misc_feature (2529)..(2530): n is a, c, g, or t
  misc_feature (2532)..(2533): n is a, c, g, or t
  misc_feature (2535)..(2536): n is a, c, g, or t
  misc_feature (2538)..(2539): n is a, c, g, or t
  misc_feature (2541)..(2550): n is a, c, g, or t
  misc_feature (2552)..(2552): n is a, c, g, or t
  misc_feature (2554)..(2555): n is a, c, g, or t
  misc_feature (2557)..(2563): n is a, c, g, or t
  misc_feature (2565)..(2573): n is a, c, g, or t
  misc_feature (2576)..(2577): n is a, c, g, or t
  misc_feature (2579)..(2581): n is a, c, g, or t
  misc_feature (2583)..(2587): n is a, c, g, or t
  misc_feature (2590)..(2591): n is a, c, g, or t
  misc_feature (2593)..(2594): n is a, c, g, or t
  misc_feature (2596)..(2601): n is a, c, g, or t
  misc_feature (2603)..(2603): n is a, c, g, or t
  misc_feature (2605)..(2606): n is a, c, g, or t
  misc_feature (2608)..(2609): n is a, c, g, or t
  misc_feature (2611)..(2613): n is a, c, g, or t
  misc_feature (2615)..(2615): n is a, c, g, or t
  misc_feature (2617)..(2618): n is a, c, g, or t
  misc_feature (2620)..(2625): n is a, c, g, or t
  misc_feature (2628)..(2632): n is a, c, g, or t
  misc_feature (2634)..(2634): n is a, c, g, or t
  misc_feature (2636)..(2636): n is a, c, g, or t
  misc_feature (2638)..(2638): n is a, c, g, or t
  misc_feature (2640)..(2640): n is a, c, g, or t
  misc_feature (2642)..(2643): n is a, c, g, or t
  misc_feature (2645)..(2645): n is a, c, g, or t
  misc_feature (2647)..(2649): n is a, c, g, or t
  misc_feature (2651)..(2656): n is a, c, g, or t
  misc_feature (2660)..(2662): n is a, c, g, or t
  misc_feature (2664)..(2668): n is a, c, g, or t
  misc_feature (2671)..(2677): n is a, c, g, or t
  misc_feature (2679)..(2685): n is a, c, g, or t
  misc_feature (2688)..(2692): n is a, c, g, or t
  misc_feature (2694)..(2701): n is a, c, g, or t
  misc_feature (2703)..(2704): n is a, c, g, or t
  misc_feature (2706)..(2709): n is a, c, g, or t
  misc_feature (2712)..(2734): n is a, c, g, or t
  misc_feature (2736)..(2736): n is a, c, g, or t
  misc_feature (2738)..(2739): n is a, c, g, or t
  misc_feature (2742)..(2742): n is a, c, g, or t
  misc_feature (2746)..(2747): n is a, c, g, or t
  misc_feature (2749)..(2750): n is a, c, g, or t
  misc_feature (2752)..(2754): n is a, c, g, or t
  misc_feature (2756)..(2765): n is a, c, g, or t
  misc_feature (2768)..(2768): n is a, c, g, or t
  misc_feature (2770)..(2775): n is a, c, g, or t
  misc_feature (2777)..(2779): n is a, c, g, or t
  misc_feature (2782)..(2782): n is a, c, g, or t
  misc_feature (2784)..(2790): n is a, c, g, or t
  misc_feature (2793)..(2800): n is a, c, g, or t
  misc_feature (2802)..(2804): n is a, c, g, or t
  misc_feature (2806)..(2809): n is a, c, g, or t
  misc_feature (2811)..(2825): n is a, c, g, or t
  misc_feature (2827)..(2827): n is a, c, g, or t
  misc_feature (2830)..(2834): n is a, c, g, or t
  misc_feature (2837)..(2839): n is a, c, g, or t
  misc_feature (2841)..(2841): n is a, c, g, or t
  misc_feature (2843)..(2845): n is a, c, g, or t
  misc_feature (2847)..(2849): n is a, c, g, or t
  misc_feature (2853)..(2854): n is a, c, g, or t
  misc_feature (2856)..(2856): n is a, c, g, or t
  misc_feature (2858)..(2858): n is a, c, g, or t
  misc_feature (2860)..(2862): n is a, c, g, or t
  misc_feature (2864)..(2868): n is a, c, g, or t
  misc_feature (2870)..(2870): n is a, c, g, or t
  misc_feature (2873)..(2874): n is a, c, g, or t
  misc_feature (2876)..(2878): n is a, c, g, or t
  misc_feature (2880)..(2880): n is a, c, g, or t
  misc_feature (2883)..(2885): n is a, c, g, or t
  misc_feature (2887)..(2887): n is a, c, g, or t
  misc_feature (2889)..(2890): n is a, c, g, or t
  misc_feature (2892)..(2892): n is a, c, g, or t
  misc_feature (2894)..(2900): n is a, c, g, or t
  misc_feature (2902)..(2905): n is a, c, g, or t
  misc_feature (2907)..(2907): n is a, c, g, or t
  misc_feature (2909)..(2911): n is a, c, g, or t
  misc_feature (2913)..(2913): n is a, c, g, or t
  misc_feature (2915)..(2917): n is a, c, g, or t
  misc_feature (2920)..(2931): n is a, c, g, or t
  misc_feature (2933)..(2939): n is a, c, g, or t
  misc_feature (2941)..(2942): n is a, c, g, or t
  misc_feature (2944)..(2949): n is a, c, g, or t
  misc_feature (2952)..(2954): n is a, c, g, or t
  misc_feature (2957)..(2957): n is a, c, g, or t
  misc_feature (2960)..(2967): n is a, c, g, or t
  misc_feature (2969)..(2970): n is a, c, g, or t
  misc_feature (2973)..(2979): n is a, c, g, or t
  misc_feature (2981)..(2983): n is a, c, g, or t
  misc_feature (2985)..(2989): n is a, c, g, or t
  misc_feature (2991)..(2993): n is a, c, g, or t
  misc_feature (2995)..(2995): n is a, c, g, or t
  misc_feature (2997)..(3001): n is a, c, g, or t
  misc_feature (3004)..(3004): n is a, c, g, or t
  misc_feature (3008)..(3009): n is a, c, g, or t
  misc_feature (3011)..(3017): n is a, c, g, or t
  misc_feature (3019)..(3023): n is a, c, g, or t
  misc_feature (3025)..(3028): n is a, c, g, or t
  misc_feature (3030)..(3030): n is a, c, g, or t
  misc_feature (3032)..(3035): n is a, c, g, or t
  misc_feature (3039)..(3042): n is a, c, g, or t
  misc_feature (3045)..(3045): n is a, c, g, or t
  misc_feature (3048)..(3048): n is a, c, g, or t
  misc_feature (3050)..(3050): n is a, c, g, or t
  misc_feature (3053)..(3054): n is a, c, g, or t
  misc_feature (3058)..(3059): n is a, c, g, or t
  misc_feature (3061)..(3062): n is a, c, g, or t
  misc_feature (3069)..(3071): n is a, c, g, or t
  misc_feature (3074)..(3075): n is a, c, g, or t
  misc_feature (3079)..(3079): n is a, c, g, or t
  misc_feature (3081)..(3081): n is a, c, g, or t
  misc_feature (3089)..(3089): n is a, c, g, or t
  misc_feature (3092)..(3096): n is a, c, g, or t
  misc_feature (3099)..(3099): n is a, c, g, or t
  misc_feature (3109)..(3111): n is a, c, g, or t
  misc_feature (3114)..(3115): n is a, c, g, or t
  misc_feature (3120)..(3120): n is a, c, g, or t
  misc_feature (3122)..(3122): n is a, c, g, or t
  misc_feature (3129)..(3131): n is a, c, g, or t
  misc_feature (3134)..(3134): n is a, c, g, or t
  misc_feature (3136)..(3138): n is a, c, g, or t
  misc_feature (3143)..(3143): n is a, c, g, or t
  misc_feature (3147)..(3147): n is a, c, g, or t
  misc_feature (3155)..(3155): n is a, c, g, or t
  misc_feature (3157)..(3157): n is a, c, g, or t
  misc_feature (3160)..(3160): n is a, c, g, or t
  misc_feature (3163)..(3166): n is a, c, g, or t
  misc_feature (3168)..(3171): n is a, c, g, or t
  misc_feature (3173)..(3179): n is a, c, g, or t
  misc_feature (3181)..(3181): n is a, c, g, or t
  misc_feature (3184)..(3193): n is a, c, g, or t
  misc_feature (3195)..(3198): n is a, c, g, or t
  misc_feature (3200)..(3203): n is a, c, g, or t
  misc_feature (3210)..(3215): n is a, c, g, or t
  misc_feature (3217)..(3218): n is a, c, g, or t
  misc_feature (3223)..(3238): n is a, c, g, or t
  misc_feature (3241)..(3241): n is a, c, g, or t
  misc_feature (3245)..(3245): n is a, c, g, or t
  misc_feature (3251)..(3252): n is a, c, g, or t
  misc_feature (3255)..(3287): n is a, c, g, or t
  misc_feature (3289)..(3298): n is a, c, g, or t
  misc_feature (3300)..(3309): n is a, c, g, or t
  misc_feature (3311)..(3312): n is a, c, g, or t
  misc_feature (3314)..(3324): n is a, c, g, or t
  misc_feature (3326)..(3326): n is a, c, g, or t
  misc_feature (3328)..(3352): n is a, c, g, or t
  misc_feature (3354)..(3354): n is a, c, g, or t
  misc_feature (3356)..(3357): n is a, c, g, or t
  misc_feature (3359)..(3383): n is a, c, g, or t
  misc_feature (3385)..(3385): n is a, c, g, or t
  misc_feature (3387)..(3439): n is a, c, g, or t
  misc_feature (3441)..(3460): n is a, c, g, or t
  misc_feature (3462)..(3495): n is a, c, g, or t
  misc_feature (3497)..(3497): n is a, c, g, or t
  misc_feature (3499)..(3500): n is a, c, g, or t
  misc_feature (3502)..(3504): n is a, c, g, or t
  misc_feature (3506)..(3512): n is a, c, g, or t
  misc_feature (3514)..(3536): n is a, c, g, or t
  misc_feature (3538)..(3556): n is a, c, g, or t
  misc_feature (3558)..(3559): n is a, c, g, or t
  misc_feature (3561)..(3582): n is a, c, g, or t
  misc_feature (3584)..(3588): n is a, c, g, or t
  misc_feature (3590)..(3613): n is a, c, g, or t
  misc_feature (3615)..(3634): n is a, c, g, or t
  misc_feature (3636)..(3639): n is a, c, g, or t
  misc_feature (3641)..(3645): n is a, c, g, or t
  misc_feature (3647)..(3649): n is a, c, g, or t
  misc_feature (3651)..(3655): n is a, c, g, or t
  misc_feature (3658)..(3659): n is a, c, g, or t
  misc_feature (3661)..(3692): n is a, c, g, or t
  misc_feature (3694)..(3701): n is a, c, g, or t
  misc_feature (3703)..(3747): n is a, c, g, or t
  misc_feature (3749)..(3749): n is a, c, g, or t
  misc_feature (3751)..(3755): n is a, c, g, or t
  misc_feature (3757)..(3772): n is a, c, g, or t
  misc_feature (3774)..(3798): n is a, c, g, or t
  misc_feature (3800)..(3804): n is a, c, g, or t
  misc_feature (3806)..(3823): n is a, c, g, or t
  misc_feature (3829)..(3829): n is a, c, g, or t
  misc_feature (3831)..(3838): n is a, c, g, or t
  misc_feature (3840)..(3841): n is a, c, g, or t
  misc_feature (3844)..(3862): n is a, c, g, or t
  misc_feature (3864)..(3878): n is a, c, g, or t
  misc_feature (3880)..(3880): n is a, c, g, or t
  misc_feature (3882)..(3905): n is a, c, g, or t
  misc_feature (3907)..(3932): n is a, c, g, or t
  misc_feature (3934)..(3946): n is a, c, g, or t
  misc_feature (3948)..(3956): n is a, c, g, or t
  misc_feature (3958)..(3963): n is a, c, g, or t
  misc_feature (3968)..(3968): n is a, c, g, or t
  misc_feature (3972)..(3975): n is a, c, g, or t
  misc_feature (3977)..(3978): n is a, c, g, or t
  misc_feature (3980)..(3981): n is a, c, g, or t
  misc_feature (3983)..(3985): n is a, c, g, or t
  misc_feature (3988)..(4000): n is a, c, g, or t
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncgcgtcgtgtcccatgctggccacctgcaggtaccgcagatcccgcctagctcagttggtagagcgcaagactcttaatcttgtngtcntnngntcnnnncncnnngnnngagnngnangcnantgnnncgnnnnngnnannnncnntngnnnnnnnnnnnnnnntngnnnnnnnnnnnnnnnnnnnnnnnnnnnnnnnnnnnnnnnnnnnnnnnntnnnnnnntnttnnnannnnnntnnnnnnnnntnnntnnanntnnnnnnntnntnnnnnnnnnnnnnnnnnnnnnnnnnnnncnnnnnnnnnngnngnncnnnnnnnncnnnnncnnnnanncnnnnnnnnnnnnnnnnnnngcnnnnnnnnnanannnannnannnnnnnnnnnnnatnnaanannaattnnnnntnnannnnnannannannnnnntanaaatnnnttntnnntttnnttnnntnnnnnnnnnntnnnnnnntnnnnnnnnncncntctnnnnnnnntnnnggnnnnnnnnnnnnnnnnnnnnnnnnnnnnnnnnttnnnnntnnnnnttntnttntntnnnnnnnnnnnnnnnnncnnnnnntnnnnnnnnnnnnnnnnntnnnnttttnnnnnnnnnnngnnnnnntnnnnnnnnnnttnnnntnnnnnannnnnnnnnnnnnnnnnnnnnnnnnnncnnnnnnnnnngnnnnnnnnnnnnnnnnnnnnnnnnnnnnnncnnnnnnnnnnntgnncnnnnnncnnnnncnncnnngnntnnnnnncnggnnnnngnnnnnnnncggngngnagnnnnnntnnnnnacannnnnnaannnnnnnnnnnnnnnnnncncaaanncnnnncnnacnnnnnnnnnnnngnnnnnnnngnnnnnnnnnnnnnnnnnnnnncanacgantagtagctacctggttgatcctgccagtagtcatatgcttgtcttaaagattaagccatgcatgtctaagtataagcatttataccgcgagactgcgaacggctcattaaaacagttatggtttatttgatggttcctttgctacttggataaccgtagtaattctagagctaatacatgcacgaaggggcgactnacgaagccctgtatttattagattaaagccaaccacctccgggtgttcgtggtgaatcatagtaacttctcggatcgccggctctacgccagcgacgtgtcattcaaatttctgccctatcagctttagatggtaggatatgggcctaccatggcggtgacgggtaacggagaattagggttcgattccggagagggagcctgagaaacggctaccacttctaaggaaggcagcaggcgcgcaaattacccaatcctgactcagggaggtagtgacaagaaataacaataaaccggcttatgccggtttaattggaatgagtacaatttaaacatcttaacgaggaacaattggagggcaagtctggtgccagcagccgcggtaattccagctccaatagcgtatactaaagttgttgcagttaaaaagctcgtagttggatttctgnggggncggngcggccggncgcnactngcgnntcgagctagcgcttnccctncatcctgccgcgaaccgtgctaccattagtttggtggcgcnggggatcggctcgtttactttgagaaaaatagagtgttcaaagcaggccacacgccttgaataagttagcatggaataatnannaaggacttcggttctattttgttggtgttcgggactgaagtaatgattgatagggacagttggggcggtcngtattccaaagcgagaggtgaaattcttagaccttcggaagacnaacagctgcgaaagcgttccgcaaggatgttccctttgatcaagaacgaaagttgggggatcgaagacgatcagataccgtcgtagtctcaactataaactataccagctagggatcggccaacgttnnnttatnnnnnntngnnngnnncntnnnnnnaannnaannnnnnnggntncngggggnnnnnngnnnnnangnnnnaanntnaangnantnnnngnanggnnncnncnnncnnngnnncnnnngnntnanttnnnnnnannnnggnaaanntnncnngnncnnnnnnnnnnangnntnnnnnnntnnnnnnnnnttnntnnntnnnnnggnngnngnnnnnngncnntnntnnntngnngnnnnnnttnnnnngntnantncnntnannnannnnnncccnnncnnnnnaannnnnnngnnnnnnnttnnnnngnnnnnnnntnntnnnnggnnnnnnnnnnnnnnnnnnnnnnngnannttngggnnannannngnnnnnnnnnnccntnnnnnntnnnggncnnnnnnnggnnnnnnnngnnncnnnnannnnnnnnnnnnnnngnccnnnnnggnnntngnnnannntttnnancngnnncnnnnntnggnntnnncnttnnnantnntngnnnnnnnannnngnannncntnnnaannnnnnnnnnnnannnnnnntnnannnnnnccnnnccnttnnnnnnnncnnccnnnnnnncnnncnnnnnannntncnnnnnaantttnngnnnnnnncnnnnnannnngncnnnncctnnnnaanggnangcnnaaanncnnttaaatnnnaanntttngnggaagganaannnnnaanaaggtttccnnnggnnaaccngnggaaggnnnaanannnttcanaacncaaaaaananaanccnnnnannnntnnnnnnngnggnnnnnnnnnncnnnncnnnnttttttnnnnnncnnccacnnnnnnnnnnnnnnnnaanaaanaaaaannaannnnnnnnnnnnnnnnnnnnnnnnnnnnnnnnncnnnnnnnnnnannnnnnnnnnanncnnnnnnnnnnntntnnnnnnnnnnnnnnnnnnnnnnnnnananntnnnnnnnnnnnnnnnnnnnnnnnnncncnnnnnnnnnnnnnnnnnnnnnnnnnnnnnnnnnnnnnnnnnnnnnnnnnnnnnannnnnnnnnnnnnnnnnnnngnnnnnnnnnnnnnnnnnnnnnnnnnnnnnnnnnncncnncnnncnnnnnnncnnnnnnnnnnnnnnnnnnnnnnncnnnnnnnnnnnnnnnnnnngnngnnnnnnnnnnnnnnnnnnnnnncnnnnnannnnnnnnnnnnnnnnnnnnnnnncnnnnnnnnnnnnnnnnnnnnannnnannnnnannnannnnnaannannnnnnnnnnnnnnnnnnnnnnnnnnnnnnnngnnnnnnnngnnnnnnnnnnnnnnnnnnnnnnnnnnnnnnnnnnnnnnnnnnnnntntnnnnngnnnnnnnnnnnnnnnngnnnnnnnnnnnnnnnnnnnnnnnnngnnnnngnnnnnnnnnnnnnnnnnncccccncnnnnnnnncnnccnnnnnnnnnnnnnnnnnnngnnnnnnnnnnnnnnngngnnnnnnnnnnnnnnnnnnnnnnnntnnnnnnnnnnnnnnnnnnnnnnnnnngnnnnnnnnnnnnnannnnnnnnnannnnnnaaaanaaannnnannannannngannnnnnnnnnnnn

SEQ ID NO: 252 - DNA, 4000 bp, Escherichia coli
  misc_feature (1957)..(1958): n is a, c, g, or t
  misc_feature (1963)..(1963): n is a, c, g, or t
  misc_feature (1970)..(1970): n is a, c, g, or t
  misc_feature (1979)..(1979): n is a, c, g, or t
  misc_feature (1981)..(1982): n is a, c, g, or t
  misc_feature (1984)..(1985): n is a, c, g, or t
  misc_feature (1987)..(1987): n is a, c, g, or t
  misc_feature (1993)..(1994): n is a, c, g, or t
  misc_feature (2020)..(2020): n is a, c, g, or t
  misc_feature (2023)..(2024): n is a, c, g, or t
ggggcgaggggccaggcgctatccccatccttttttaaaagcccctgtcattccgagcccgaagggcgaggaaacccgcagtgaagaagttgcatgcagcgtctctacgccatcgcccgggtcagcgccggcatcataaggcgctaccgataggatggcttgaagcccaatgtcgtcaacttaagggttttcatggcctcggagaggcccaaagttggtagaaaaaccaggcgtaattcaatagggcctcggagaggcccaacgtttgttcggtattcacaccagcgatttaacgtttggcctctccgaggccccataaatacatgcaacatattcttcaaacgttgggcctctccgaggcctttgcgcttaagttgacgacattgggcttgaagccatcctatcggttaacgtcgtttttcaaaattttaattggaggaatgccggtgttttcgacttatgatacaccctccacaatacacgcaccaattatttcgtcctacgagtatattcgtaggacgaattatgtcccaaaaaaaaccgccctcgccttcagtccaggcctaccagcgctgacggtttatccccgggacaaacgcccgggttttttgtcccgaccactaagcgccgggagcggggcaatcgcctgttcagtgcatgccatccagccttccattgagctggggggaacgagcgacgcggaaaccattgttgttgttgcggttctccggcgtgttgttgttgcggttcgccacgcggcggcagttgtcggcgttgttgagccacgagccgccgcagagcacgcggagcgagcctttgcaggttgcccgttttagaaggagatggcaaatttgatgccgggtatttttttcggtataatcaaaaaaaccctatatttgtaaaaaaaagcatcgtacagatggtacaaaccgatcaacccatgagcaagttgcagcttgaactgctcaaattatatgcaactcacatttcagaccaacagttggaaatggttaaaaagttattggcggatttttttgctgaaatgatagacgccgaaatgaaggaagtatgggaaactcaaggttgggatgagcaaacgattgagcaatggaaaacagaacgaatgcgcataccatacaaagttaaatgatgcgcattgttttggacatcaacgtcttgctggtttcgattcctgtggattcaaggtatcgtttaatatttgatgccttaaaaaaaggtcggtaccagctgctgctctcaaacgaaatattagaagagtacgaggaaaaaattgcagaaaaaacaacaagacctgatattgcagccaatgtaatccgactattgctaaacctgtcaaatgttgagcaaatatcaagaatttattataaatggaacttgattacaaacgacccggatgacaataaatatacggactgcgctgtggcaggtaatgcaacaatgatcgttacgaacgacaaggattttaacatcctgaatacaatagaatttcccaaaataaaggtcatgagtggagattcttttttggaattattgaggattgaatcacctgcctcctaaggcccataaacgtataccaagtgagcaaagcccaataactgttcgccgacgccagaaagtcctcgtcgctaagggtgccgttttgccattgccactcccggtgccgcaagcggcgggtgatgcgccgcccgttgtggtaatgcagatccgcatgcgcttttttttaagttttcaccatatatacaccatatatacaaacagtggtgacacataaacactacgtggttatatatgcagcatatatgctgccgcatttggctccgcccgaaaaaaaacagggtgtgccagttgcctgacacaccccgctgaaatgtcctaaaaggtaaaaaggtaaaaagcctaaaaggttaaaaagtcctggcaaggcggaagccaacgnngttgnagcggtngtccggcgngnngnngntgcggnncgctacacggcagtaggtcgggtcgntgnnccacgacccgccgcgaatcacccggtaggagccggaagtggggccggtggggttggtctggctgccggtggggtaatcgccgtaccagtccgcacaccactcccacacattcccgctcatgtcgtacagccccaattgatttggttttttgccgcctacacgccgcgtacccgtatcgttcgtattctccgtgtaccaccccactgcatccagatcattgctgccggcgtacgtaaaattatctttcgcccctttttccccgccgcgggccgcgtactcccactctgcctccgtcggaaggcggtaggtttggccggtttttcggcttagccactggcagtaggctaccgcgtcgttccacgatacgcccgtgaccgggtggtttttgttctccctgctcacgcctctttttttgtagaaatcgttattacccgtctcgatatgataatcatttcccggctccaaccattccgggtagttgcctttggtttcctcgcagaaagccaggtattccccgatggtcacctcgtatttccccatgtaaaaattgctcagggtgacctggtgtacgggtttttcgtcactgctgccgtcttcactgcccatttggaaggtaccgccgggaatggagatcatgttccgctgtatggcggcgatgaccgcctgtacatccaccggcacgggtacctcaaccgggcatccatcggccgtaccgggtgcgggtttattggggcatttatcgttgcagtcgggtatgccgtccccgtcggtgtcggtgtcgggggttccgcatccgcaggcgccgggttgggttttgttggggtcgtcggggcagccgtcggcgtcgtcgggggtaccgtcggcgtcgcggtcgggtttgggcgccgggtctgtggtcgccggtgccgggtcagtcaccgtcaccggtggcgtccattcaaaggcaaacggcagggtgcgttcggcgagcagggtcttccggtcggcgtcggtgtacaggcgcaggcgcagggagtcggcgcgggcgggtttgccaggttcggtgagcaggaggatcagtgcatcctggtactggcccggggtggtattgggcagggtgatctgcgcgaaggagatgttttttccggccccgtcggtggcggtggcggttacgtggggcttcgtgttcaggcgttggccgatctggtaggtagcggtgatgcgcacggcgccgtcggtggtatttggcggctgcacatccaccgcgatcacgcggttttgggttatgcccagcagggtttcgaggttggggcgctgggtgagggattcgaagtaggccatgctttgcagcaggcggtacaggcgttcggcgtcggtgcggttgccggcgtagtagtcgcacaggccgcggccgtgcagggcgtcgagctggagggcggtggggccggtatcggcggggttcctcggctggagtaccagcaccccgtcggcttccaggatcagggcgccggcgtcggtcagtgcggacacaaaagcgcgtcgggcatcgtcgagcgcgtcggcgcgcagccggtcggcgccgtagttataccgcaccctggcgaggttttcctgcgccagggcgtatgggctgcgcagttgcagggcgcgctggaaaagggcggtgtcggcgccatgggccacgccgaggttgttgtatatcagggcgctgtcgggcgtccagcgttcgctgaagagcaggccggcgcgcagggtatcgcggccgggggtgaagtcgtttgtgcgtttcgggaaagccggcgccgggctttgggggcggcaggccatccagccggtagcgccgagcaaggctaagagggcggtcagggcggcggccttccaaaagtcgggggtaaaaaacggctttgcgggcttttccggttcggcgggtactggttcgcggtacttcagccactcgcgtatgttgggtacacgcgcgggcgccgtgccggcagcgg

SEQ ID NO: 253 - DNA, 4000 bp, Escherichia coli
  misc_feature (35)..(35): n is a, c, g, or t
gttcacacccatcacgaagtcgaaatgcatggggncggcgatatagcccttcttgtgcaggcggagcgccatttcgatcatactcttgtcgaagacctccagctcgggtttgatgccccgctcgatcatcttctggccgaagtacttgatcgtgttctccgtgttctcgaagatttcatcgccgccgaaattgagcgtgccgcagtcgagggtcgccatttcggggagcagctccgtaggttgcagccgttcgtcgttggtcatgccgacggcacctcccgtcgaaggctggatgattacgtccgggcaaaccgcacggatagcgtccataacctgtttgaagcggtttttatcctgcgtgggttggccgtcgtcgttgcgcacgtgcaggtggatgatgctcgcgccggcatcgtaggccgacttggcctcccgggcgcactcttccaccgtgtaggggactgcggggttgtgttccttgagtacttccgctccgcagatcgcggccgttatgatcagtttttccatggggtctttggttgaaaagtttgaaaatggttgaattccgttgctttgtccgatgtggcggctaaacctgttcggacctgttcgccgagaatttccggccgcatcggccgttttctctctccggcgctcctgcctgcggtcttcgcatcgcgggacgctttcgtgtccggaacgggccgaaaactccgttagcggctttcagggatgcgctggtcctctttttttacgacgcacgtaccgctggcacggcagaccacgacgggctctttgagtacgtcggccgcagagggcgagatgtcggggcgtgcagcgaccactttgcgggcttcgaagaccatcttgcgcgaggtgttgcccaccttcacgatttcgcccaccgcttcgatataatcgccggcatagaccggggcgagaaattcgacgttgtcgtaggccacgaacagtccttcgtcgccgtcgtgcatgatcaacagttcggtggccacgtcgccgaacagatgcaccatatgggcgccgtccaccagattgcctccgtaatgagcgtctttggcactcatccgaagccgtatcattgatttttccataacctgatatttttaattcgattgagatgcggatttgttctttcggccgttcggttatttggccggagcgaccatgtaatctacgaagatacccggcgtgcggaccgcttcgggggctatcgctccggtttctaccagctcccgcacctcggcgatcaccaggtcggctgcggtggccatcaacgggttgaaattctgtgacgtgcctttatagaccaggttgcccgatcggtcggccaggctcgcgccgagcagggctacgtcggcccgcagcggtttttcgagcaggtaatccttgccatcgacgttgatgatttgtttgccttcggctacgatcgttccgagtccgaccggagtgagcacaccgcccagacctgccccgcccgaacgaacccgttcggccagcgttccctgcgggcagaattcgatctccagttcgccgctgttcatctgctcgctggtgcaggggttggtgccgatgtgcgatacgatcactttgcggacctgcttcccggcgatcagccgtccgcagcctttgtccggataagccgtatcgttcacgatgagggtgaggtcctttacgcccgattcaaccagtgcgtcgatgatcgcgtgggggcttccgttgcccagaaagccgccgatcatgaccgtcattccgtcttttaccattcccgccgcttcggcagcagatataagcttcttcatatggtgattgattttacttaaaattaacaatatcagtctttaatctaacaaaattaaacatttgacgaatgatttgcaatgatttcgacgtttttttgtcgattttgtcgataatcggtcacttcttctccgaaagagtggaatcttcggatccgatcgcgcggaagcgggtgttcggaaggacctgagaaagtacggccggacgcctcgaggcgtccggccgtactttctgcggaacggttctttgcgggatcagagaagccggcagtgcaaacgttcgggcagcggtgcgctgttgttgcggcgccagaccatagcccgatcctgttcctgattgcccgagccgaagtcgaagtcgtccggcgcttcgaaaacgaccggaagcgaccggtcttcgaagccgaacggggcgtaaaagtccttgaggctttcctggcttgggataaggatcgcggcgtcggccccttcttctgcgatccgccgcatcgcctcgcgcatcaatccggaggccaggccccggccccggtagtcggggtcggtcgccacgccgtagatgtaggtcgtgcgccccagctcgctttcgaacgggatcaggtgcagcatggccgccagacggccgtcctcttcggctgcgagcatccgcttgcggctgtaatggccgatcaggaaggagtcgatgaaggtttcttcgtctccgaagcactttatccagagccgtttgcaggctatttcgtcggggtagaggcagagggccgtatatttcttctcgaggaatgccggatggtaggagagcttggcctgccgtagtcccggaatacccaggtcctcttcgcggtcgatgagcgtgtattgctcgggcaggtgcgccacgaactcccggttgatgatggtgaaagccccgtcgtattcggtgtcggccttttcgacatgaacacagaacgtatggtcgttgatcggtgagccgtaagtgaaagcgacgagtttatcaccgacgtagatgcagccaccgataagtcccagccggtcgaaatgggcgaaagcccgctgcatggcccgctgttcggccgacagctcgcccgtatgtccgctgcgggtcttgcgccattcggcttccagacgcatgcactccgcagcatggtcgcgggtcataggctcgtagcggtattcgtattccgcctcgaagcggttgatgtggttgcgtttggattggtatttccggccaggaaggtcgcgcaggtccgaagcgttgtatacatagtcttccagattgcggtcggaggcgaaagcgaactggcagtggcctacactgcggagtttttcgagcccttcaggtgtcatgtcgatgatccgaagccgttgtccggcagcgagtatatcctcctccagatgccgcaggacgggggtgaaatctcctgcgccgacaggctgcatgtagccgatccggtcgctgcccccgatctggaagcggatgaccagaaagccgtccactacgctccaggcggttttgaactggaattgccagcaaaacatgttggcgaacgccaggtcgcagttcgccggggcgtaaggcaatgtgaaggattcgatttcggccttgtcttcgatcgtaatgggtttgaaggtaatcataaattgtcttctacggtgtaatttttggcttccacatgcccgtaatactgttgaatcagggccttgagccgattttcgaccgacgcggtctgttcccggtccgaagtctcgtttcggaacgtcgcgccggtcatccattcctcgtcgaacgagaagagcgcttcgtccgttacgacccggaattccgaatcgtacatcacggcccacggttcgcggtcgggttcgttcagaatgtcgcgtccgaatgcgaaatagggttcccggtttcccaacagtcccagcagggtcggcatgatgtcgatctgctgcacggtctgtgccagaaattgcggtgcgagtgcgccgtcgggggtgtggatgaatccgacgatgtggtagttgccgggataggagcgggtttcctctgccattttctccgaggaaacgtggtccgcgacgaagacgaagattgtcctgcggaaccactcttcgtccttgaaacggcggtagaagttgcggaaggcgagatcttcgtaggctacgggtttgtgtattttggtcgttcccgccgg

SEQ ID NO: 254 - DNA, 4000 bp, Escherichia coli
  misc_feature (1962)..(1963): n is a, c, g, or t
  misc_feature (1968)..(1968): n is a, c, g, or t
  misc_feature (1980)..(1980): n is a, c, g, or t
  misc_feature (1986)..(1987): n is a, c, g, or t
  misc_feature (1998)..(1998): n is a, c, g, or t
  misc_feature (2001)..(2001): n is a, c, g, or t
  misc_feature (2013)..(2013): n is a, c, g, or t
  misc_feature (2017)..(2017): n is a, c, g, or t
  misc_feature (3734)..(3734): n is a, c, g, or t
  misc_feature (3737)..(3737): n is a, c, g, or t
  misc_feature (3747)..(3747): n is a, c, g, or t
  misc_feature (3753)..(3753): n is a, c, g, or t
  misc_feature (3758)..(3759): n is a, c, g, or t
  misc_feature (3770)..(3770): n is a, c, g, or t
  misc_feature (3776)..(3776): n is a, c, g, or t
  misc_feature (3782)..(3783): n is a, c, g, or t
  misc_feature (3792)..(3792): n is a, c, g, or t
  misc_feature (3797)..(3798): n is a, c, g, or t
  misc_feature (3804)..(3804): n is a, c, g, or t
cccgacgggcgatgtcggtgagctgactttcaaccgatgggcctcggacggctcggggcagacggctctcgtgctgccgactcaggctgatgcccagcgcgtggtaaacttcacgctcggcagcgacactttcgtctggaacatcggggaaaaagagttcgacgcaggcagtgaatacagctacaccgttacggtcaatcgcacgccgctgggtatcgcggcctcgattaccgactgggaaacgggcgagggcggctcgggggacgccgaataaccgcgccaatcgaaactggatgtaaaccatgaaaacttccggattatttttaacgttagcagcagcttcggtgctgaccgcctgcctgaaagaggaggacggcatccttgcggagcggcaggagctgcgtctcaggagcggcatcgaagccgtgacgcgcggcgaggtgcaatccacggcgatcgtcgcaggcgaaacggtctatgcgtgggtgacggacgccctgaccggcgaagcgctctacaatgcctgcacgctgaccgcacaggcgggaggcgctctcgcgggcacgacaccgatgtacttccctgcgacgggcaacggtgtgcgggttgcggccctgcacggactgctgaccgaaagccccgcggttgcggcgatgcccggttcgttcgcctttacggtctcccccgaccagagcgaagcgggcggcgcaaactatgtgcactccgatttgctctatgccgcacaaaccgtccagcgcacgaaagaggccgtagaactcgaatgttaccatctgctctcgaaaatggagctgaagatcacccggagcgacggagtgaccgatgcgatcaccgccgtgacgctcgacggcgtggtattgggcggtatgtttacccctgcggccgatgccgaccttgcgcagcggagcgtacgcgccgcgatgatcgttgccgacggacagcggggaacgatgacgctcggcgcgatgcctgcgggcgacaatccggacaatccgatcaccaacgatgcgatcgtcgtgccgcaggatgttggcggcaagaccctgactttcactctttccggcggcagcgagctgtcctatacgatccctgcgggcaggtcattcgagagcggtaaaaaacatgtgtacgaagtgacgctcaagcgcacggggctggaagtgacctccgaaagcggggattggaacgacggcggcagcgaagaggtgcagagtcgggaggtgctcgcctcttatacggccgacgacctcaaacccggcgattatttctactccgacggcacgacttccgatggcggcctgcgcaagctttatgccgacggaacgctggagatggcggtcgggaaacccgtgcccgaaacggacgggggtaaaacggtcgtcggcatcgtctttcagaccgatcccgaccggatcggacaggccgagaaagatgcgttggcggttcggggcgccaccgcgcgcgggctcgtgatggccgtaaagaacgccgcgacgaacatggaatggggaccttacggaacggatgaggggctgacgaaatgcgaaacgaaagcgcagaattacagcgacatcagcggttatggcaactgcgagcggatcagggcttcgcacggtgatctgagtaactatcccgctttcagggcggccgacgattacaacacggtctgcgcggttgccggggtgacgacgggttggtacctgcccgccagcggacagtggtgggatctgctgcaaaatctgggcggctgtgcgatgttggcagatccggcgcagcagacctcgtcggacagcggtgatttttactggtcgggacaaggtgacattcccgccgcactgaacagatggatggagtcgatcgccgctgatagtaaagacccgttcgccgactacaactggttttggtcgtcctcggagtactccggctacaacgcccggtactggnncgtgngctccgatggcnacgtgnnctgctactggnacnataaggacatcngcancgacgtgcgacctgttctagctttttagatgatctatttatctatttaatctatttatctattggatgatacccgcgcagcgggtcgaaaatattaaaccgaaccgaaatgaaacgatcgacccattcgatagcggcccttgcggcccggacggcggtgatggccctgacggccttcggcgccctgtcgctggccggatgctcgcaggaggagcaggctgtgcctgtcgggcaggggcagcggctttccatctcgatctgcgacgacggttatgccccggcggatgacgtccggcccgccttgtcgggcggctgcggaagccttgccgccgaccctgccggaagcctcgcgacccgcgcgacggagaacggttatgcgaccggatttactcccggcgatgcctgcggcctttccatcgtgcgtgacggcgaggtggtcgcagccaatgtgcggctgacggcttcggccggagccggcggcacgaacgaactcgtttggacacccgacccggccgcgggtgagctgtggtacgcctctggcgactgctatttcctctattacccgtggcaggctgcgccgcagggtgccccgaccgtgggggattcgttcgccccgtccgtccccggcgatgccggagcggagtttttcgccgcgctgatcgccgcatggacacccgccgcaaaccagagcgactatcccgcgggctacacggcttccgatctgatgacggccgaagcttcggtggggagtgcctccggcggggtcgtgccactcacgttctcgatgacccatcgcatggcgctcgccgtggtggagtttcctcggacggtttacaagttcgacaacggcgatacgatgattcccgattatgccgttgccgcatcgggcatcgcattttcgggtgcagcccaacctctcgcgacggatggcagcacctatcgctacctcgtcaatcccgccctggcagcggctccgattcttgcgggcggctacggcggcaaccgcgaattcaccatcgctcccacgggccttgaggcaggcagctacaaggtctataaggtggatggcggtagggtggagaaaaaccatacgttgcaggtaggcgattacttcctggcggacggaaacctgctgtcgaaagacgctgcggcggagatggtcgcacaggccgaggtcgcaggcatcgtcttccagaccgctccgtcgcggatcggggagggggaaaagaatgcattgggcggagaggcgcacggccttgtgttggccgcgaagaacgccgcaacgaatgtgcagtggggcccttacggaacggatatccccgatctgccgaacattacgacggtcgcagcctgttacggggacatcgacggttattccaacacccatacggtgtgggcgtttgacggttacacggccaatcccgccgattatcccgctttccgtgccgttgccgatttcaacacgacacatgccgctccgggcaatacgacaggatggttcatgccgtcggcaggtcagctctgggacgtgctggagcatctcggcggcgtgaaggcgttggccgatcaacgcacgaacggcgatcaggagtggtatggcaccgatccgggaaacgatatttgcgccagcctcaaccgatggcttgcccatgtaacggacgcggcgaaattcggcgacagctacaactggttttggtcgtcctcggagtactccggcnacnacgcccgggnctgggncgtgnnctccgatggcngcgtgngctgcnnctggaacgntaagnncgtcancggcgacgtgcgacctgttctagctttttagatgagctatttatctattcaatctatttatctattgcagggaacccgcgtaagcgggtcgattttggaaacgaggcgggagcagaggaggtttgcggccgggctctgcgcgcagaaaaaacgattgatagtttctgaaagatggctttgaccgagcaactgccga

SEQ ID NO: 255 - DNA, 4000 bp, Escherichia coli
  misc_feature (990)..(990): n is a, c, g, or t
  misc_feature (1981)..(1982): n is a, c, g, or t
  misc_feature (1985)..(1985): n is a, c, g, or t
  misc_feature (2221)..(2221): n is a, c, g, or t
cggacatccgggggcggcggcggaggcctcatccgccgggtcgtcgctccgttggccctgctgtggagcctcgggctcgtggcggccctgacgctgacaccgatggctctacctgggatcgccacccggcatctgccggcgctctcgacctcggtggggttgatggtgggcgcggtattgtatttcgttgtgatccggggtcgtcttcgtcgcggtgaagccgggcccccggaccgccgaaccgccgattccaccgagccctgagccatgagcccgagcgacccaagtattgacttccaagcctccccgaatccgctgatccggccggagccgagggtgttgcctcccgaataccctggtgcagcgaggtacgccgaggaggaggtcgacgcggtcgtccgcgtcgtgcgcaaccgttcgcccttccgctactatggaccccggcttggaggcgaggttgcccggttggaggatgagttcgcgtgttttctggccagttcgcccggcggaacatggcccgcgaattcgccttttcgggtcacggcggtcaactcgggcacgggcgcactggaggtcgccctcgacgcccttggggtcggcgccggcgacgaggtacttgttcagggttttctttggatctccagcatctcggccatcgtccgtcagcgggcgattcccgtgctagtcgactccgacgcgactttgaatctcgaccccgacgagatccgtcggcgcatcgggccgaaaacccgggtcatcatgcccgtcccgatgctgggcggatgcgcacggatcggccggcttgccgagaccgtgcgcacggtgaatgccgagagggcccggcagggattgccgccggtacggatcctcgaggattgcgcgcagtcgatgggggcgcacgcctatggaattccggggtcggttgagccgaccgcgcccgagggtatccatcgcgtcggcaccttcggcgacgtcggcatattcagcctncagattaacaagaacatcaccgccggcgagggcgggctgatcgtcacgcgcgatccggacctcgctcggcgcatcgatgccttgcacaacgccgggtacgcgcggggcaaggctccgccggtcaattggtacggggacgagccggtcggatggggtcacggccgacgtctgggggagatgcaaggagcggtggcccgcgtgcagttgcgccggttggacgaaatcctcgcggcgatgcgtcgggggcatgacagcattgaacggcatttgagatcgcttggtctaaagacccgcgcacgtgccgatgcagatgatcccggcgacacaggctactactgccagttccatctaccggatcgcggcgaggacgatgcggggcgcatcttgcgcgggcgccggatcgccgacgcactgcgcgaattcggccttcggccatggttcctgcacgacttcgaggtgcacgtctattacaacatcgagcccttggttggacgctggccactggccggaggtggtccttggccatcgggtgacgcgtcgggcgatccgcgatacgcctatgcgcgcgggacccttccgaaactcgaccgacttctgacatcgacgatcggtatccatgtgcccagcaccctttcgggcaccgaagaggcgtacatacggcaggcgctttcctgggtcatctccactgagaccgatcgctgaagcgccggtctggttgactttggggcttcgacgcggctggcgaacgggctgaacgagctggcgttgaccggcaaaaagtcttggaaagagctgccagtccggtgaccaggccgcgcaatttttctctgcgacttctgcgggcaacagtttgggtgcctggacctgcgcctgggaatgtgatctccccttaggcagtttctgcggtccggtcaaacttgtggggtcttacggaaaaatttgtgcatcagccaaacaaaaagttgcggggataagaaatcaccctagggtnncangcttcaatatgaagtttttccttctgcttcccatcctgatagggctctttggagccgttggagctttcggccaagggctcacaatcacagtcaactcaaccggaaacgacaacaacccagacgaccggctgacgctcgtcgaggcaatcttgatcgccaacgagcgtcttggacgtcccagttcggcagcagagtcgtccttggtcgttaaggggagctcgcgactgctggacgtncgcttcgccattcccggcgacggacctcacttcatcacaccgccacccgggggctttcccccgctgacgactggccttttcgatcaggttttgatcgacggattctcccaacctggagcgcgaccgaactccaacggaatcgagggcaccaacaacgccgcactcaagatcgttctcgactgtcggaagcttgccgccgatccggccacaggcgaaatgccggactggtcgtttaaaatcgccgcatcccgtgtccacttcagaggattttcagtcctggccggccgggacaccgacaactatggcgtatacttcagcgatggcgccgtcggagggcaagtcagcggttgctggtttggagtgtctccggatcagtcgatcctcgccggcggcgaggtcgcaatcgcggcgtacggaaccgagggcggtcaagtgttcgggtcggacggcaatggtgcggacgacctcgccgagatcaacatcatcgttgcgcacgccatcggcgtccaattcgaggagacaaagaatatcctcgttcagaacaacctcatcggggtgctgcctgacgggaagacattgcctcccgaggccatccgggaggccctcgaaggcgatgcggtggaaggcaacgccttggccggcaccatcactcttcggcgaaacctcatcgggggtatgcgcggggacgccatcgaattttatggtcctgcggaaagattgctgctgttggagaacaccatcggcgttgcctgggacggagtgacgccgttgccgaatggaaactttctcaaggtccaagccgtccaagccttcgtgggcttggacaaggggatggtaccgaccgccgcctcgggcaatcgtattgccaaccacaccggatatcttttccgacacaacaaagcggacacccggatcgtccatcgcggaaacgtgttgacgaaaaactcgggttcctatttcgaacaactggcgaattcactcactggtatgcggctcggacgcgcaactgacctttcgcccgtgcttgaggtaaactcgacccggcagatcctgcgggggacccttccgctgagtggccccggtcccgatgcgctaacggctgccacgattgacatctatgcctcggaagaatcgccagacccggatcgccctcctatcgggcgatggctggcatccttcaccgatggaggacctggagatctcgacccatcgacgggggcctttaccttggacctttctgcggtgcctgggttggacagtgtcacccacctagccgtcacgagcaccttggaggatgtcacgggtgcagacacatctccgttttcgaatatccttcggctccctcgcggcgccccccgcctttcactggcacgcaccggcgatggcatgacgctaacgctgaacaccacggagggtacccggtatcaacttcaatccagcctaaccctaggctcggcctggaccgatgtcggaaacgccttcatcggaacgggaagctccaaatccatccctctgcccaaggatcctacggcggcctttttccgagtgaggctttcaaactagggtgttttgaggcaatgcggtccagccccgacgaggccggtcacgaagcgaaagctcacgatgaggccgacttgtccattgcagtcgacataccgagctcagtgctagccggactttggcaaccgggctgcggttttcgctgatttgctccgatcgaccggtgtttttccccggaaaagcgactctttgaactctcggggtcaccgattttctctg

SEQ ID NO: 256 - DNA, 4000 bp, Escherichia coli
  misc_feature (1)..(22): n is a, c, g, or t
  misc_feature (24)..(65): n is a, c, g, or t
  misc_feature (67)..(282): n is a, c, g, or t
  misc_feature (284)..(564): n is a, c, g, or t
  misc_feature (566)..(646): n is a, c, g, or t
  misc_feature (648)..(662): n is a, c, g, or t
  misc_feature (664)..(697): n is a, c, g, or t
  misc_feature (699)..(750): n is a, c, g, or t
  misc_feature (752)..(752): n is a, c, g, or t
  misc_feature (754)..(757): n is a, c, g, or t
  misc_feature (761)..(769): n is a, c, g, or t
  misc_feature (773)..(785): n is a, c, g, or t
  misc_feature (789)..(802): n is a, c, g, or t
  misc_feature (805)..(806): n is a, c, g, or t
  misc_feature (808)..(810): n is a, c, g, or t
  misc_feature (812)..(834): n is a, c, g, or t
  misc_feature (836)..(847): n is a, c, g, or t
  misc_feature (849)..(850): n is a, c, g, or t
  misc_feature (852)..(852): n is a, c, g, or t
  misc_feature (854)..(854): n is a, c, g, or t
  misc_feature (856)..(857): n is a, c, g, or t
  misc_feature (859)..(859): n is a, c, g, or t
  misc_feature (862)..(867): n is a, c, g, or t
  misc_feature (869)..(869): n is a, c, g, or t
  misc_feature (872)..(873): n is a, c, g, or t
  misc_feature (875)..(877): n is a, c, g, or t
  misc_feature (879)..(881): n is a, c, g, or t
  misc_feature (884)..(890): n is a, c, g, or t
  misc_feature (892)..(901): n is a, c, g, or t
  misc_feature (905)..(915): n is a, c, g, or t
  misc_feature (918)..(919): n is a, c, g, or t
  misc_feature (921)..(921): n is a, c, g, or t
  misc_feature (924)..(925): n is a, c, g, or t
  misc_feature (928)..(948): n is a, c, g, or t
  misc_feature (950)..(967): n is a, c, g, or t
  misc_feature (971)..(971): n is a, c, g, or t
  misc_feature (973)..(975): n is a, c, g, or t
  misc_feature (978)..(978): n is a, c, g, or t
  misc_feature (980)..(983): n is a, c, g, or t
  misc_feature (1073)..(1073): n is a, c, g, or t
  misc_feature (1091)..(1091): n is a, c, g, or t
  misc_feature (1093)..(1094): n is a, c, g, or t
  misc_feature (1096)..(1096): n is a, c, g, or t
  misc_feature (1190)..(1190): n is a, c, g, or t
  misc_feature (1217)..(1218): n is a, c, g, or t
  misc_feature (1978)..(1980): n is a, c, g, or t
  misc_feature (1985)..(1988): n is a, c, g, or t
  misc_feature (1990)..(1990): n is a, c, g, or t
  misc_feature (1995)..(1995): n is a, c, g, or t
  misc_feature (1997)..(1999): n is a, c, g, or t
  misc_feature (2003)..(2004): n is a, c, g, or t
  misc_feature (2011)..(2012): n is a, c, g, or t
  misc_feature (2014)..(2016): n is a, c, g, or t
  misc_feature (2530)..(2533): n is a, c, g, or t
  misc_feature (2535)..(2537): n is a, c, g, or t
  misc_feature (2542)..(2542): n is a, c, g, or t
  misc_feature (2545)..(2548): n is a, c, g, or t
  misc_feature (2550)..(2552): n is a, c, g, or t
  misc_feature (2556)..(2556): n is a, c, g, or t
  misc_feature (2559)..(2559): n is a, c, g, or t
  misc_feature (2561)..(2561): n is a, c, g, or t
  misc_feature (2568)..(2568): n is a, c, g, or t
  misc_feature (2570)..(2570): n is a, c, g, or t
  misc_feature (2573)..(2575): n is a, c, g, or t
  misc_feature (2577)..(2577): n is a, c, g, or t
  misc_feature (2579)..(2580): n is a, c, g, or t
  misc_feature (2585)..(2585): n is a, c, g, or t
  misc_feature (2588)..(2588): n is a, c, g, or t
  misc_feature (2598)..(2598): n is a, c, g, or t
  misc_feature (2612)..(2612): n is a, c, g, or t
  misc_feature (2620)..(2624): n is a, c, g, or t
  misc_feature (2626)..(2626): n is a, c, g, or t
  misc_feature (2629)..(2629): n is a, c, g, or t
  misc_feature (2631)..(2636): n is a, c, g, or t
  misc_feature (2638)..(2640): n is a, c, g, or t
  misc_feature (2643)..(2644): n is a, c, g, or t
  misc_feature (2646)..(2646): n is a, c, g, or t
  misc_feature (2649)..(2650): n is a, c, g, or t
  misc_feature (2652)..(2652): n is a, c, g, or t
  misc_feature (2658)..(2658): n is a, c, g, or t
  misc_feature (2663)..(2664): n is a, c, g, or t
  misc_feature (2666)..(2668): n is a, c, g, or t
  misc_feature (2670)..(2671): n is a, c, g, or t
  misc_feature (2673)..(2675): n is a, c, g, or t
  misc_feature (2681)..(2682): n is a, c, g, or t
  misc_feature (2685)..(2685): n is a, c, g, or t
  misc_feature (2687)..(2687): n is a, c, g, or t
  misc_feature (2690)..(2690): n is a, c, g, or t
  misc_feature (2692)..(2693): n is a, c, g, or t
  misc_feature (2695)..(2702): n is a, c, g, or t
  misc_feature (2704)..(2705): n is a, c, g, or t
  misc_feature (2707)..(2717): n is a, c, g, or t
  misc_feature (2720)..(2744): n is a, c, g, or t
  misc_feature (2746)..(2747): n is a, c, g, or t
  misc_feature (2749)..(2755): n is a, c, g, or t
  misc_feature (2757)..(2769): n is a, c, g, or t
  misc_feature (2772)..(2778): n is a, c, g, or t
  misc_feature (2780)..(2798): n is a, c, g, or t
  misc_feature (2800)..(2818): n is a, c, g, or t
  misc_feature (2820)..(2824): n is a, c, g, or t
  misc_feature (2828)..(2836): n is a, c, g, or t
  misc_feature (2838)..(2863): n is a, c, g, or t
  misc_feature (2866)..(2873): n is a, c, g, or t
  misc_feature (2875)..(2877): n is a, c, g, or t
  misc_feature (2879)..(2896): n is a, c, g, or t
  misc_feature (2898)..(2908): n is a, c, g, or t
  misc_feature (2911)..(2920): n is a, c, g, or t
  misc_feature (2922)..(2950): n is a, c, g, or t
  misc_feature (2955)..(2966): n is a, c, g, or t
  misc_feature (2968)..(2979): n is a, c, g, or t
  misc_feature (2981)..(3011): n is a, c, g, or t
  misc_feature (3013)..(3014): n is a, c, g, or t
  misc_feature (3017)..(3036): n is a, c, g, or t
  misc_feature (3038)..(3060): n is a, c, g, or t
  misc_feature (3062)..(3082): n is a, c, g, or t
  misc_feature (3084)..(3084): n is a, c, g, or t
  misc_feature (3086)..(3089): n is a, c, g, or t
  misc_feature (3091)..(3096): n is a, c, g, or t
  misc_feature (3098)..(3128): n is a, c, g, or t
  misc_feature (3130)..(3166): n is a, c, g, or t
  misc_feature (3169)..(3212): n is a, c, g, or t
  misc_feature (3214)..(3218): n is a, c, g, or t
  misc_feature (3220)..(3229): n is a, c, g, or t
  misc_feature (3232)..(3250): n is a, c, g, or t
  misc_feature (3252)..(3252): n is a, c, g, or t
  misc_feature (3254)..(3287): n is a, c, g, or t
  misc_feature (3289)..(3291): n is a, c, g, or t
  misc_feature (3293)..(3299): n is a, c, g, or t
  misc_feature (3302)..(3310): n is a, c, g, or t
  misc_feature (3313)..(3314): n is a, c, g, or t
  misc_feature (3317)..(3322): n is a, c, g, or t
  misc_feature (3326)..(3334): n is a, c, g, or t
  misc_feature (3336)..(3338): n is a, c, g, or t
  misc_feature (3340)..(3385): n is a, c, g, or t
  misc_feature (3387)..(3396): n is a, c, g, or t
  misc_feature (3398)..(3403): n is a, c, g, or t
  misc_feature (3405)..(3429): n is a, c, g, or t
  misc_feature (3431)..(3434): n is a, c, g, or t
  misc_feature (3436)..(3437): n is a, c, g, or t
  misc_feature (3439)..(3453): n is a, c, g, or t
  misc_feature (3455)..(3455): n is a, c, g, or t
  misc_feature (3457)..(3470): n is a, c, g, or t
  misc_feature (3472)..(3491): n is a, c, g, or t
  misc_feature (3493)..(3494): n is a, c, g, or t
  misc_feature (3496)..(3498): n is a, c, g, or t
  misc_feature (3501)..(3502): n is a, c, g, or t
  misc_feature (3505)..(3508): n is a, c, g, or t
  misc_feature (3510)..(3531): n is a, c, g, or t
  misc_feature (3536)..(3538): n is a, c, g, or t
  misc_feature (3541)..(3554): n is a, c, g, or t
  misc_feature (3556)..(3558): n is a, c, g, or t
  misc_feature (3560)..(3562): n is a, c, g, or t
  misc_feature (3564)..(3565): n is a, c, g, or t
  misc_feature (3567)..(3572): n is a, c, g, or t
  misc_feature (3576)..(3581): n is a, c, g, or t
  misc_feature (3583)..(3593): n is a, c, g, or t
  misc_feature (3595)..(3611): n is a, c, g, or t
  misc_feature (3613)..(3642): n is a, c, g, or t
  misc_feature (3644)..(3664): n is a, c, g, or t
  misc_feature (3666)..(3683): n is a, c, g, or t
  misc_feature (3685)..(3702): n is a, c, g, or t
  misc_feature (3704)..(3711): n is a, c, g, or t
  misc_feature (3713)..(3728): n is a, c, g, or t
  misc_feature (3730)..(3747): n is a, c, g, or t
  misc_feature (3749)..(3770): n is a, c, g, or t
  misc_feature (3772)..(3777): n is a, c, g, or t
  misc_feature (3780)..(3791): n is a, c, g, or t
  misc_feature (3795)..(3796): n is a, c, g, or t
  misc_feature (3798)..(3799): n is a, c, g, or t
  misc_feature (3801)..(3827): n is a, c, g, or t
  misc_feature (3830)..(3841): n is a, c, g, or t
  misc_feature (3843)..(3844): n is a, c, g, or t
  misc_feature (3847)..(3863): n is a, c, g, or t
  misc_feature (3865)..(3904): n is a, c, g, or t
  misc_feature (3906)..(3924): n is a, c, g, or t
  misc_feature (3926)..(3946): n is a, c, g, or t
  misc_feature (3949)..(3949): n is a, c, g, or t
  misc_feature (3951)..(3955): n is a, c, g, or t
  misc_feature (3958)..(3961): n is a, c, g, or t
  misc_feature (3963)..(3963): n is a, c, g, or t
  misc_feature (3965)..(3998): n is a, c, g, or t
nnnnnnnnnnnnnnnnnnnnnngnnnnnnnnnnnnnnnnnnnnnnnnnnnnnnnnnnnnnnnnnngnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnannnnnnnnnnnnnnnnnnnnnnnnnnnnnnnnnnnnnnnnnnnnnnnnnnnnnnnnnnnnnnnnnnnnnnnnnnnnnnnnnannnnnnnnnnnnnnnannnnnnnnnnnnnnnnnnnnnnnnnnnnnnnnnnannnnnnnnnnnnnnnnnnnnnnnnnnnnnnnnnnnnnnnnnnnnnnnnnnnnanannnnaaannnnnnnnnaaannnnnnnnnnnnnaaannnnnnnnnnnnnnaannannnannnnnnnnnnnnnnnnnnnnnnngnnnnnnnnnnnntnnanantnnanaannnnnnanaanntnnnannngannnnnnntnnnnnnnnnnaaannnnnnnnnnnaanncnaannaannnnnnnnnnnnnnnnnnnnnannnnnnnnnnnnnnnnnnaaanannnttnannnnttttaagtgataaatatcatttataaagagtttgatcctggctcaggacgaacgctggcggcgcgcctaacacatgcaagtcgaacgagngagagagagcttgctttntnnancgagtggcgaacgggtgagtaacgcgtgaggaacctgcctcaaagagggggacaacagttggaaacgactgctaataccgcataagcccacggntcggcatcgagcagagggaaaaggagnnatccgctttgagatggcctcgcgtccgattagctagttggtgaggtaacggcccaccaaggcgacgatcggtagccggactgagaggttgaacggccacattgggactgagacacggcccagactcctacgggaggcagcagtggggaatattgcacaatgggggaaaccctgatgcagcgacgccgcgtggaggaagaaggtcttcggattgtaaactcctgttgttgaggaagataatgacggtactcaacaaggaagtgacggctaactacgtgccagcagccgcggtaaaacgtaggtcacaagcgttgtccggaattactgggtgtaaagggagcgcaggcgggaagacaagttggaagtgaaatctatgggctcaacccataaactgctttcaaaactgtttttcttgagtagtgcagaggtaggcggaattcccggtgtagcggtggaatgcgtagatatcgggaggaacaccagtggcgaaggcggcctactgggcaccaactgacgctgaggctcgaaagtgtgggtagcaaacaggattagataccctggtagtccacaccgtaaacgatgattactaggtgttggaggattgaccccttcagtgccgcagttaacacaataagtaatccacctggggagtacgaccgcaaggttgaaactcaaaggaattgacgggggcccgcacaagcagtggagtatgtggtttaattcgacgcaacgcgaagaaccttaccaagtcttgacatccnnngacgnnnntngaaanannntttnncttcggnncnnngagacaggtggtgcatggttgtcgtcagctcgtgtcgtgagatgttgggttaagtcccgcaacgagcgcaacccttatggtcagttactacgcaagaggactctggccagactgccgttgacaaaacggaggaaggtggggatgacgtcaaatcatcatgccctttatgacttgggctacacacgtactacaatggcgttaaacaaagagaagcaagaccgcgaggtggagcaaaactcagaaacaacgtcccagttcggactgcaggctgcaactcgcctgcacgaagtcggaattgctagtaatcgtggatcagcatgccacggtgaatacgttcccgggccttgtacacaccgcccgtcacaccatgagagccggggggacccgaagtcggtagtctaaccgcaaggaggacgccgccgaaggtaaaactggtgattggggtgaagtcgtaacaaggtagccgtaggagaacctgcggctggatcacctcctttctaaggagtcaggcaannnnannncatcnaannnngnnngtcnttngnacaggtnanaannnanannttaantanatattgttcnattttgagggcccngaaaaggnnnnncnaanannnnnntnnnaanntnaannanaactgngaaannannntnntnnnaagttnnttntnaananntnnnnnnnntnnannnnnnnnnnnaannnnnnnnnnnnnnnnnnnnnnnnnannannnnnnnannnnnnnnnnnnnaannnnnnntnnnnnnnnnnnnnnnnnnngnnnnnnnnnnnnnnnnnnngnnnnngggnnnnnnnnnannnnnnnnnnnnnnnnnnnnnnnnnnggnnnnnnnnannnannnnnnnnnnnnnnnnnntnnnnnnnnnnnaannnnnnnnnntnnnnnnnnnnnnnnnnnnnnnnnnnnnnnaaaannnnnnnnnnnngnnnnnnnnnnnnannnnnnnnnnnnnnnnnnnnnnnnnnnnnnnannaannnnnnnnnnnnnnnnnnnngnnnnnnnnnnnnnnnnnnnnnnnannnnnnnnnnnnnnnnnnnnngngnnnngnnnnnntnnnnnnnnnnnnnnnnnnnnnnnnnnnnnnngnnnnnnnnnnnnnnnnnnnnnnnnnnnnnnnnnnnnnaannnnnnnnnnnnnnnnnnnnnnnnnnnnnnnnnnnnnnnnnnnnannnnngnnnnnnnnnnggnnnnnnnnnnnnnnnnnnnanannnnnnnnnnnnnnnnnnnnnnnnnnnnnnnnnnannnannnnnnnaannnnnnnnnggnnggnnnnnnaaannnnnnnnnannncnnnnnnnnnnnnnnnnnnnnnnnnnnnnnnnnnnnnnnnnnnnnnntnnnnnnnnnngnnnnnngnnnnnnnnnnnnnnnnnnnnnnnnngnnnnanngnnnnnnnnnnnnnnnanannnnnnnnnnnnnngnnnnnnnnnnnnnnnnnnnngnncnnnaannggnnnncnnnnnnnnnnnnnnnnnnnnnnggaannnaannnnnnnnnnnnnncnnncnnncnncnnnnnnaaannnnnngnnnnnnnnnnngnnnnnnnnnnnnnnnnnannnnnnnnnnnnnnnnnnnnnnnnnnnnnnannnnnnnnnnnnnnnnnnnnnannnnnnnnnnnnnnnnnnannnnnnnnnnnnnnnnnngnnnnnnnngnnnnnnnnnnnnnnnnannnnnnnnnnnnnnnnnntnnnnnnnnnnnnnnnnnnnnnngnnnnnnaannnnnnnnnnnnaaanngnnannnnnnnnnnnnnnnnnnnnnnnnnnnaannnnnnnnnnnngnnaannnnnnnnnnnnnnnnnannnnnnnnnnnnnnnnnnnnnnnnnnnnnnnnnnnnnnnnannnnnnnnnnnnnnnnnnngnnnnnnnnnnnnnnnnnnnnnaantnnnnnggnnnnancnnnnnnnnnnnnnnnnnnnnnnnnnnnnnnnnnntg

SEQ ID NO: 257 - DNA, 4000 bp, Escherichia coli
gccggcatccagatcaatctcaaacgcacctgatactttgccagtattttcgaggcgcaaggcggccaattcatcaaaccgctcccgcgtaatgggctgtgtcttataaaagtggtgggagaaaccgcccttcaccgcctcggcgtctccttgcagataacggcgcagccgtatggccacatccagaaattcctcgccattacccgttgagaagatactgtcatggccattctcccgaatatgaaaagccgcatagactttctggtcttccgctgcctgtgctgactccagttcttcctttgtgatagctgtttcaatctgtacccaccgttctaatggaacagtttcgttgtacagcgttatcaaataatcctgcagatgccgtttaacattactgccttgcgccttcagcgcctcctccagcgccgcccagcgccgctgatccagccacgcctcggtagatacagaatcggccattattcaacccccttcttctcgtcaaaagtatccggcgcggcgcttcgaggggaccgggcaggccgcgggcggggctgttcctccggctccgccatgctttcaatatactccctggtctgagaaggcacatattttttgtagagcttctccatgaacatatccagttccaactctaaagaggtaccgttctttcccgcatagaactggacggctttgagtttttcctgctcaaatgaaaccgtgactgtggcttttttcatcgtgatccctccattacagaaacagttccatggcatgttctgccctggaactgttggcaagtgtttcatcgtattgtgccagaagctgtgaattgacgccgtccagaaccagttccactccataggggccggggcggatggcggcaatcttggcatccagaagagccgagaattcttctttgccctgggcggtcagacggggaaggtccgctgcgggcacccagccaacatcttcggcggcatgaactaaatagacatcatgatccggcagtccaagtgtcaacagatcccgcagatggacggccggggcttccgccagcgcatggagctgctgctcctgcacaggctctggtggaaaatacactctggtttcactgccatccctgcagaaataatcgacctttctccactcgccgccatgggcaacctgcaactccccaagatggctgtatctccagttccgattattttccttgcaccactggactacatggtcgctgacgctgccggacttccagtcgaaggtgaagagagtttcacccttctgccggagcagttccgtccactgtacccggtctgtgaagcccatacttcgggcaacaaacgcctcacacatccggatcgcccagtcggacggctctgcctgatgttcatgtttctttctgaactcctccaactgccaaagcagatccaactgatcctgtttaatattgatgtttctttcctcctctttcgtgtcatccttggactgtttatccagcgatagattgtttccaaaggcttccgtcaagctctcgtagatgctctccgtatcccattcgccagcggcagtcagccggccagcgatctcccgcagggtcgtttcctgggcaagcatctcatcgccggagataagccagggccacatcttcgaggtttcctgctcaaagcgaatgtagtccacgatgtcctggtatgcgtcatcgcagtcaggctcatagcggtgggcgagatcgaagcccatggcctcaatctcctgattagtcagtcccaactcattgtgaagcgtcttgtagagttcctcacttccgtcatgctccgcaaggaaagctatgagcctgttctggattctgttggcgcctgccgttggaaaatggtttgccagggcatccaagctctcccgcaggctgccggcccggtggtcatattccaaccgtattcgcccattgtccagatcaatgaccgcccgctgttccgcagccccgccatgaccaaggtcatggctcagggcctccgcttcatctgcaaatacccgcctgagtggagtgccgcgttcagcggcagcgagagaaagagcctccgcgaagctgctgttctcattttccgcgatggcagcggcccgcgctaacagtggatacagccccacaagcccagctccatcctcgcctacaaaagcggtttgccgtccccgttgctctacttgatacagcactgccgtagtatccctcccatcgttttattaccgtgttctgtctgttttacatagagagatcctgttcctcacccatctccacatcccacatggtccggacctcattcaggtaatacccagccagttctttgtcctcgcaaaagaaggggacgatgccgcggaccccatagtgctcctcaccaaccgctgggttgtaccgcccaagcacatagtgaagggggactttttccattgtgaaaaaagttccccgcacagagcaagtcttgtccttttcatccacgctctctattactccaccgcgtagatcgaaatcgccggggcctccatatggctcggtagcgacaaacagcaccttgtctccagccgtcagctccttagctaacaggcagtcccgcatacgggaaatgatttcatcacgggaggtgaagctctcggcctcctggatttcatcgctctccagttcgagagcggacagagcctgctggtacgcggtatgaagccgttcatccggcacatttgggtcaaggcagtaaccgaaagcccctggagccaggcgggtgattcgttcctcatctgggatctgttgtaattcttcataggcggaaagcagattcaccagcttccctgattttgggagaaggtcagactgcacctcagatgcttcgatctgctcgtccacatattcatcatacagagcgaagccgaggcatccaatttcatcgttgcagatttccaatgtgttatgaaggatatcgtagaggctgctgtcatcgaaatactctgccatatagttcagaatgcctgatatgatctcctccttccgctctgcggaaagagagggggcgggctgctccggcgccaggtttttgcagtagtccagataatagcagacatcaaagcactcgtccgtcagggtgacatccgccgcctccggccgctgctccagcttctcaaggagcatggtatcgaagccgttcccgtcctctatcaccaatcccatttgctcataaagctcactgaaataatagcaccagctaccctcgttggtgttttccgctccctccctgatgatcttttccactgcctgctccagaatggaatcaaccaccgctcttgctccgggcaagtaggcaaagtgtttccccccatcataggcaaaaactccgtctttatgcccctctcccaaaacgaggacgccctggtagatccgtctaccgtgttcatcagcatagaacggctctgcagcccagcggccatcctggtgagggccattcaaaaagtcttggaattcctcgtccggcagcgtaaccagccgaactgcctcacactcaaagatgtggaagcgtccggccttggccggcaattgaagtttcagccgcaaaatatcatcctccagtcttcggtaaataatagcggggattggtacgctccccattgacccgcacttcaaaatgcagatgcggacctgtagacctcccagtggaaccggagagggaaatgatatccccagcctccactgtctggccaacctgggccagtagacgggaattgtggccatacaaggtggatagtccattgccgtggtcgattatcacatagtaaccatagctgctgttatattgggaaactgtgaccgtcccaggcagtgcggcccggataggggtgcctgtgggtactgccagatctatcccggtgtgtccccgtgtctcgccagtgaaggggtcgctgcgatacccgaactccgaggtgaccacggactcccagcctgctccgatgggagagcagaagccat

SEQ ID NO: 258 - DNA, 4000 bp, Escherichia coli
  misc_feature (1)..(13): n is a, c, g, or t
  misc_feature (15)..(20): n is a, c, g, or t
  misc_feature (22)..(29): n is a, c, g, or t
  misc_feature (31)..(32): n is a, c, g, or t
  misc_feature (34)..(35): n is a, c, g, or t
  misc_feature (37)..(38): n is a, c, g, or t
  misc_feature (42)..(43): n is a, c, g, or t
  misc_feature (45)..(45): n is a, c, g, or t
  misc_feature (47)..(47): n is a, c, g, or t
  misc_feature (49)..(53): n is a, c, g, or t
  misc_feature (55)..(56): n is a, c, g, or t
  misc_feature (58)..(58): n is a, c, g, or t
  misc_feature (62)..(64): n is a, c, g, or t
  misc_feature (66)..(67): n is a, c, g, or t
  misc_feature (69)..(73): n is a, c, g, or t
  misc_feature (76)..(76): n is a, c, g, or t
  misc_feature (79)..(84): n is a, c, g, or t
  misc_feature (86)..(89): n is a, c, g, or t
  misc_feature (91)..(91): n is a, c, g, or t
  misc_feature (93)..(93): n is a, c, g, or t
  misc_feature (95)..(96): n is a, c, g, or t
  misc_feature (98)..(98): n is a, c, g, or t
  misc_feature (101)..(103): n is a, c, g, or t
  misc_feature (107)..(108): n is a, c, g, or t
  misc_feature (111)..(115): n is a, c, g, or t
  misc_feature (117)..(119): n is a, c, g, or t
  misc_feature (121)..(121): n is a, c, g, or t
  misc_feature (123)..(127): n is a, c, g, or t
  misc_feature (129)..(130): n is a, c, g, or t
  misc_feature (132)..(132): n is a, c, g, or t
  misc_feature (136)..(136): n is a, c, g, or t
  misc_feature (139)..(139): n is a, c, g, or t
  misc_feature (145)..(146): n is a, c, g, or t
  misc_feature (148)..(150): n is a, c, g, or t
  misc_feature (153)..(153): n is a, c, g, or t
  misc_feature (155)..(155): n is a, c, g, or t
  misc_feature (158)..(159): n is a, c, g, or t
  misc_feature (161)..(162): n is a, c, g, or t
  misc_feature (167)..(167): n is a, c, g, or t
  misc_feature (170)..(172): n is a, c, g, or t
  misc_feature (176)..(176): n is a, c, g, or t
  misc_feature (179)..(182): n is a, c, g, or t
  misc_feature (184)..(184): n is a, c, g, or t
  misc_feature (186)..(186): n is a, c, g, or t
  misc_feature (189)..(189): n is a, c, g, or t
  misc_feature (191)..(191): n is a, c, g, or t
  misc_feature (194)..(194): n is a, c, g, or t
  misc_feature (196)..(196): n is a, c, g, or t
  misc_feature (199)..(199): n is a, c, g, or t
  misc_feature (202)..(205): n is a, c, g, or t
  misc_feature (211)..(211): n is a, c, g, or t
  misc_feature (213)..(213): n is a, c, g, or t
  misc_feature (216)..(216): n is a, c, g, or t
  misc_feature (218)..(218): n is a, c, g, or t
  misc_feature (221)..(222): n is a, c, g, or t
  misc_feature (227)..(228): n is a, c, g, or t
  misc_feature (230)..(230): n is a, c, g, or t
  misc_feature (232)..(235): n is a, c, g, or t
  misc_feature (238)..(238): n is a, c, g, or t
  misc_feature (241)..(242): n is a, c, g, or t
  misc_feature (249)..(249): n is a, c, g, or t
  misc_feature (251)..(252): n is a, c, g, or t
  misc_feature (254)..(257): n is a, c, g, or t
  misc_feature (260)..(260): n is a, c, g, or t
  misc_feature (263)..(264): n is a, c, g, or t
  misc_feature (266)..(267): n is a, c, g, or t
  misc_feature (269)..(271): n is a, c, g, or t
  misc_feature (273)..(273): n is a, c, g, or t
  misc_feature (276)..(276): n is a, c, g, or t
  misc_feature (278)..(278): n is a, c, g, or t
  misc_feature (282)..(282): n is a, c, g, or t
  misc_feature (284)..(284): n is a, c, g, or t
  misc_feature (291)..(295): n is a, c, g, or t
  misc_feature (297)..(302): n is a, c, g, or t
  misc_feature (307)..(307): n is a, c, g, or t
  misc_feature (311)..(311): n is a, c, g, or t
  misc_feature (314)..(314): n is a, c, g, or t
  misc_feature (316)..(316): n is a, c, g, or t
  misc_feature (318)..(326): n is a, c, g, or t
  misc_feature (328)..(328): n is a, c, g, or t
  misc_feature (330)..(330): n is a, c, g, or t
  misc_feature (332)..(334): n is a, c, g, or t
  misc_feature (337)..(337): n is a, c, g, or t
  misc_feature (339)..(344): n is a, c, g, or t
  misc_feature (353)..(353): n is a, c, g, or t
  misc_feature (355)..(355): n is a, c, g, or t
  misc_feature (360)..(360): n is a, c, g, or t
  misc_feature (362)..(367): n is a, c, g, or t
  misc_feature (370)..(370): n is a, c, g, or t
  misc_feature (372)..(375): n is a, c, g, or t
  misc_feature (378)..(379): n is a, c, g, or t
  misc_feature (381)..(381): n is a, c, g, or t
  misc_feature (386)..(386): n is a, c, g, or t
  misc_feature (389)..(390): n is a, c, g, or t
  misc_feature (392)..(396): n is a, c, g, or t
  misc_feature (398)..(398): n is a, c, g, or t
  misc_feature (401)..(401): n is a, c, g, or t
  misc_feature (403)..(403): n is a, c, g, or t
  misc_feature (405)..(406): n is a, c, g, or t
  misc_feature (408)..(409): n is a, c, g, or t
  misc_feature (411)..(413): n is a, c, g, or t
  misc_feature (415)..(416): n is a, c, g, or t
  misc_feature (418)..(418): n is a, c, g, or t
  misc_feature (420)..(421): n is a, c, g, or t
  misc_feature (423)..(424): n is a, c, g, or t
  misc_feature (426)..(430): n is a, c, g, or t
  misc_feature (432)..(434): n is a, c, g, or t
  misc_feature (436)..(439): n is a, c, g, or t
  misc_feature (442)..(444): n is a, c, g, or t
  misc_feature (446)..(447): n is a, c, g, or t
  misc_feature (449)..(452): n is a, c, g, or t
  misc_feature (454)..(455): n is a, c, g, or t
  misc_feature (457)..(459): n is a, c, g, or t
  misc_feature (461)..(461): n is a, c, g, or t
  misc_feature (463)..(465): n is a, c, g, or t
  misc_feature (467)..(467): n is a, c, g, or t
  misc_feature (469)..(472): n is a, c, g, or t
  misc_feature (474)..(474): n is a, c, g, or t
  misc_feature (476)..(481): n is a, c, g, or t
  misc_feature (483)..(484): n is a, c, g, or t
  misc_feature (486)..(487): n is a, c, g, or t
  misc_feature (490)..(490): n is a, c, g, or t
  misc_feature (492)..(498): n is a, c, g, or t
  misc_feature (501)..(502): n is a, c, g, or t
  misc_feature (504)..(506): n is a, c, g, or t
  misc_feature (508)..(512): n is a, c, g, or t
  misc_feature (514)..(520): n is a, c, g, or t
  misc_feature (522)..(531): n is a, c, g, or t
  misc_feature (533)..(543): n is a, c, g, or t
  misc_feature (546)..(554): n is a, c, g, or t
  misc_feature (556)..(557): n is a, c, g, or t
  misc_feature (559)..(559): n is a, c, g, or t
  misc_feature (561)..(562): n is a, c, g, or t
  misc_feature (564)..(565): n is a, c, g, or t
  misc_feature (567)..(570): n is a, c, g, or t
  misc_feature (572)..(576): n is a, c, g, or t
  misc_feature (578)..(579): n is a, c, g, or t
  misc_feature (581)..(584): n is a, c, g, or t
  misc_feature (586)..(587): n is a, c, g, or t
  misc_feature (589)..(592): n is a, c, g, or t
  misc_feature (595)..(596): n is a, c, g, or t
  misc_feature (598)..(598): n is a, c, g, or t
  misc_feature (600)..(605): n is a, c, g, or t
  misc_feature (608)..(609): n is a, c, g, or t
  misc_feature (611)..(613): n is a, c, g, or t
  misc_feature (615)..(619): n is a, c, g, or t
  misc_feature (623)..(625): n is a, c, g, or t
  misc_feature (627)..(627): n is a, c, g, or t
  misc_feature (629)..(629): n is a, c, g, or t
  misc_feature (632)..(636): n is a, c, g, or t
  misc_feature (638)..(638): n is a, c, g, or t
  misc_feature (641)..(645): n is a, c, g, or t
  misc_feature (648)..(648): n is a, c, g, or t
  misc_feature (650)..(655): n is a, c, g, or t
  misc_feature (657)..(658): n is a, c, g, or t
  misc_feature (660)..(661): n is a, c, g, or t
  misc_feature (663)..(666): n is a, c, g, or t
  misc_feature (668)..(673): n is a, c, g, or t
  misc_feature (675)..(677): n is a, c, g, or t
  misc_feature (679)..(690): n is a, c, g, or t
  misc_feature (692)..(700): n is a, c, g, or t
  misc_feature (702)..(703): n is a, c, g, or t
  misc_feature (705)..(706): n is a, c, g, or t
  misc_feature (709)..(712): n is a, c, g, or t
  misc_feature (714)..(721): n is a, c, g, or t
  misc_feature (723)..(723): n is a, c, g, or t
  misc_feature (725)..(726): n is a, c, g, or t
  misc_feature (728)..(728): n is a, c, g, or t
  misc_feature (730)..(733): n is a, c, g, or t
  misc_feature (735)..(745): n is a, c, g, or t
  misc_feature (747)..(747): n is a, c, g, or t
  misc_feature (749)..(749): n is a, c, g, or t
  misc_feature (751)..(755): n is a, c, g, or t
  misc_feature (757)..(767): n is a, c, g, or t
  misc_feature (769)..(778): n is a, c, g, or t
  misc_feature (783)..(787): n is a, c, g, or t
  misc_feature (789)..(791): n is a, c, g, or t
  misc_feature (794)..(795): n is a, c, g, or t
  misc_feature (797)..(799): n is a, c, g, or t
  misc_feature (801)..(810): n is a, c, g, or t
  misc_feature (812)..(813): n is a, c, g, or t
  misc_feature (815)..(824): n is a, c, g, or t
  misc_feature (826)..(846): n is a, c, g, or t
  misc_feature (849)..(853): n is a, c, g, or t
  misc_feature (855)..(856): n is a, c, g, or t
  misc_feature (858)..(859): n is a, c, g, or t
  misc_feature (861)..(862): n is a, c, g, or t
  misc_feature (864)..(868): n is a, c, g, or t
  misc_feature (870)..(870): n is a, c, g, or t
  misc_feature (873)..(877): n is a, c, g, or t
  misc_feature (879)..(883): n is a, c, g, or t
  misc_feature (885)..(888): n is a, c, g, or t
  misc_feature (890)..(892): n is a, c, g, or t
  misc_feature (894)..(897): n is a, c, g, or t
  misc_feature (900)..(902): n is a, c, g, or t
  misc_feature (904)..(910): n is a, c, g, or t
  misc_feature (912)..(915): n is a, c, g, or t
  misc_feature (917)..(919): n is a, c, g, or t
  misc_feature (921)..(926): n is a, c, g, or t
  misc_feature (928)..(930): n is a, c, g, or t
  misc_feature (932)..(933): n is a, c, g, or t
  misc_feature (935)..(935): n is a, c, g, or t
  misc_feature (938)..(939): n is a, c, g, or t
  misc_feature (941)..(947): n is a, c, g, or t
  misc_feature (949)..(953): n is a, c, g, or t
  misc_feature (957)..(958): n is a, c, g, or t
  misc_feature (960)..(964): n is a, c, g, or t
  misc_feature (966)..(973): n is a, c, g, or t
  misc_feature (977)..(980): n is a, c, g, or t
  misc_feature (983)..(985): n is a, c, g, or t
  misc_feature (988)..(989): n is a, c, g, or t
  misc_feature (991)..(994): n is a, c, g, or t
  misc_feature (996)..(998): n is a, c, g, or t
  misc_feature (1002)..(1007): n is a, c, g, or t
  misc_feature (1009)..(1018): n is a, c, g, or t
  misc_feature (1021)..(1025): n is a, c, g, or t
  misc_feature (1029)..(1033): n is a, c, g, or t
  misc_feature (1035)..(1039): n is a, c, g, or t
  misc_feature (1041)..(1043): n is a, c, g, or t
  misc_feature (1046)..(1046): n is a, c, g, or t
  misc_feature (1048)..(1049): n is a, c, g, or t
  misc_feature (1051)..(1051): n is a, c, g, or t
  misc_feature (1053)..(1053): n is a, c, g, or t
  misc_feature (1055)..(1067): n is a, c, g, or t
  misc_feature (1069)..(1071): n is a, c, g, or t
  misc_feature (1073)..(1073): n is a, c, g, or t
  misc_feature (1075)..(1076): n is a, c, g, or t
  misc_feature (1078)..(1084): n is a, c, g, or t
  misc_feature (1086)..(1087): n is a, c, g, or t
  misc_feature (1089)..(1092): n is a, c, g, or t
  misc_feature (1095)..(1101): n is a, c, g, or t
  misc_feature (1103)..(1103): n is a, c, g, or t
  misc_feature (1106)..(1114): n is a, c, g, or t
  misc_feature (1116)..(1133): n is a, c, g, or t
  misc_feature (1135)..(1136): n is a, c, g, or t
  misc_feature (1138)..(1142): n is a, c, g, or t
  misc_feature (1144)..(1147): n is a, c, g, or t
  misc_feature (1150)..(1155): n is a, c, g, or t
  misc_feature (1157)..(1157): n is a, c, g, or t
  misc_feature (1159)..(1159): n is a, c, g, or t
  misc_feature (1161)..(1183): n is a, c, g, or t
  misc_feature (1185)..(1187): n is a, c, g, or t
  misc_feature (1189)..(1191): n is a, c, g, or t
  misc_feature (1194)..(1202): n is a, c, g, or t
  misc_feature (1204)..(1217): n is a, c, g, or t
  misc_feature (1219)..(1231): n is a, c, g, or t
  misc_feature (1233)..(1237): n is a, c, g, or t
  misc_feature (1239)..(1240): n is a, c, g, or t
  misc_feature (1242)..(1245): n is a, c, g, or t
  misc_feature (1247)..(1248): n is a, c, g, or t
  misc_feature (1250)..(1250): n is a, c, g, or t
  misc_feature (1252)..(1253): n is a, c, g, or t
  misc_feature (1256)..(1256): n is a, c, g, or t
  misc_feature (1259)..(1263): n is a, c, g, or t
  misc_feature (1265)..(1266): n is a, c, g, or t
  misc_feature (1268)..(1269): n is a, c, g, or t
  misc_feature (1271)..(1276): n is a, c, g, or t
  misc_feature (1278)..(1280): n is a, c, g, or t
  misc_feature (1283)..(1285): n is a, c, g, or t
  misc_feature (1289)..(1296): n is a, c, g, or t
  misc_feature (1298)..(1311): n is a, c, g, or t
  misc_feature (1314)..(1317): n is a, c, g, or t
  misc_feature (1319)..(1329): n is a, c, g, or t
  misc_feature (1331)..(1331): n is a, c, g, or t
  misc_feature (1333)..(1334): n is a, c, g, or t
  misc_feature (1337)..(1337): n is a, c, g, or t
  misc_feature (1339)..(1347): n is a, c, g, or t
  misc_feature (1349)..(1364): n is a, c, g, or t
  misc_feature (1366)..(1378): n is a, c, g, or t
  misc_feature (1382)..(1390): n is a, c, g, or t
  misc_feature (1392)..(1401): n is a, c, g, or t
  misc_feature (1403)..(1405): n is a, c, g, or t
  misc_feature (1407)..(1407): n is a, c, g, or t
  misc_feature (1409)..(1410): n is a, c, g, or t
  misc_feature (1413)..(1413): n is a, c, g, or t
  misc_feature (1415)..(1416): n is a, c, g, or t
  misc_feature (1418)..(1420): n is a, c, g, or t
  misc_feature (1422)..(1424): n is a, c, g, or t
  misc_feature (1426)..(1429): n is a, c, g, or t
  misc_feature (1431)..(1431): n is a, c, g, or t
  misc_feature (1433)..(1433): n is a, c, g, or t
  misc_feature (1435)..(1443): n is a, c, g, or t
  misc_feature (1446)..(1446): n is a, c, g, or t
  misc_feature (1449)..(1449): n is a, c, g, or t
  misc_feature (1451)..(1454): n is a, c, g, or t
  misc_feature (1457)..(1465): n is a, c, g, or t
  misc_feature (1467)..(1469): n is a, c, g, or t
  misc_feature (1471)..(1471): n is a, c, g, or t
  misc_feature (1473)..(1474): n is a, c, g, or t
  misc_feature (1476)..(1477): n is a, c, g, or t
  misc_feature (1479)..(1486): n is a, c, g, or t
  misc_feature (1488)..(1488): n is a, c, g, or t
  misc_feature (1490)..(1497): n is a, c, g, or t
  misc_feature (1499)..(1509): n is a, c, g, or t
  misc_feature (1511)..(1513): n is a, c, g, or t
  misc_feature (1516)..(1519): n is a, c, g, or t
  misc_feature (1521)..(1522): n is a, c, g, or t
  misc_feature (1524)..(1524): n is a, c, g, or t
  misc_feature (1526)..(1531): n is a, c, g, or t
  misc_feature (1534)..(1536): n is a, c, g, or t
  misc_feature (1538)..(1541): n is a, c, g, or t
  misc_feature (1543)..(1554): n is a, c, g, or t
  misc_feature (1556)..(1557): n is a, c, g, or t
  misc_feature (1559)..(1567): n is a, c, g, or t
  misc_feature (1569)..(1571): n is a, c, g, or t
  misc_feature (3496)..(3496): n is a, c, g, or t
  misc_feature (3578)..(3578): n is a, c, g, or t
  misc_feature (3611)..(3611): n is a, c, g, or t
  misc_feature (3816)..(3816): n is a, c, g, or t
  misc_feature (3902)..(3902): n is a, c, g, or t
nnnnnnnnnnnnntnnnnnngnnnnnnnncnncnncnntccnncnancnnnnncnncntttnnnanntnnnnnaangannnnnngnnnnancngnngnagnnncccnnggnnnnnannngntnnnnngnngntttnttnaaaaanntnnnttnanttnntnnttttnctnnntttnttnnnnancnttntncgnanggntgnnnncaaacnanctncntcnnccggnngntnnnnccnccnncccttcntnntnnnnccngcnncnncnnnanccntncccncnttctttnnnnncnnnnnnaacantccnaananannnnnnnnntncnannnagncnnnnnnttccctttngntttcngnnnnnnttncnnnnganngnttttnttnntnnnnngnttntncnncnncnnntnntncnncnncnnnnncnnntnnnnaannntnngnnnnannannncnannngnannnngncnnnnnncnncnnttncnnnnnnnccnncnnntnnnnntnnnnnnncnnnnnnnnnntnnnnnnnnnnnccnnnnnnnnntnntncnncnncnnnngnnnnntnntnnnntnntnnnnccnntncnnnnnnggnntnnngnnnnncccnnngncnggnnnnncnaannnnnggntnnnnnncnncnncnnnncnnnnnngnnncnnnnnnnnnnnntnnnnnnnnncnncnnccnnnncnnnnnnnncntnntnannnncnnnnnnnnnnncntngnnnnncnnnnnnnnnnncnnnnnnnnnnggggnnnnncnnnggnntnnncnnnnnnnnnncnncnnnnnnnnnngnnnnnnnnnnnnnnnnnnnnnttnnnnncnncnncnngnnnnntnccnnnnncnnnnncnnnntnnncnnnnggnnngnnnnnnncnnnncnnncnnnnnngnnnannanccnnannnnnnngnnnnngggnngnnnnngnnnnnnnngggnnnnggnnnccnnannnncnnngggnnnnnngnnnnnnnnnnggnnnnngggnnnnncnnnnncnnnggncnncngnannnnnnnnnnnnngnnntngnngnnnnnnnanncnnnnccnnnnnnntnccnnnnnnnnncnnnnnnnnnnnnnnnnnncnnannnnncnnnnccnnnnnncngncnnnnnnnnnnnnnnnnnnnnnnncnnngnnnccnnnnnnnnnannnnnnnnnnnnnnannnnnnnnnnnnncnnnnncnncnnnncnngncnnccnggnnnnnanntnngnnnnnncnnnggnnnaaannnnnnnntnnnnnnnnnnnnnnccnnnntnnnnnnnnnnncngnnggntnnnnnnnnntnnnnnnnnnnnnnnnnannnnnnnnnnnnncccnnnnnnnnncnnnnnnnnnncnnncntnnggncnnannngnnngnnnncngncnnnnnnnnnaanggncnnnnccnnnnnnnnngnnntncnncnncnnnnnnnncntnnnnnnnnannnnnnnnnnntnnnggnnnntnngnannnnnnccnnngnnnngnnnnnnnnnnnncnncnnnnnnnnnannngagtgaggctgtaacctagtcaggaacaacttttttgagccgccaaactttttgaggagatcgacgttgttaacacttacagccgcgtcgcacgcataacatgccaatcccgggtctcagcggtatcacagacgacgacatctttgtgacactgaatctctgcctctgcggctgggctatacttgcgttgccccccagttggcgtccagctcactgggaggcctccgttgtcgccttgagtgcgacttttgcgtttgtctacacattaaccttggggcacgccatcttcatagaacgagaggccttaccggaaaacggcggattcagcagcctcgacggcgttgtgaatctcttcaagtccagagcagtcgtgttcagcggctgggtccattacgtttcgttcgaccttctggcgggactgtttatctgcaaagacgcagagaaggcacgacttcctcacctcgttgtcttggcgtgcctccctctggttctcttcgcgggaccgtcggggttgctgctctatctgttgatcaaaaccgtgcttctgtggcctacccaacagaagaccaaaaagggttgagcgggacctgaacatggaatcctcgaaggctcgactcctcgcgctttatctcgccgcgaccaccctctgcgcgatgatgatatcttgggtgatatttgcaccgggttcgtgcacctcctctttcatcgcggcgaatggacccgcgaagggcttgggcggcggatatgaaacacaattggaatcatggactcgatttgtaccacggacgctggtgaccaaatatcgtgacaatacactggtttgcttgctgcacgttctcccctccgtgctttggagtgggctcgtgccgtttcagttgaatccgtggttccgaaaccgtcgaccgagattgcacaggcttttcggtcgggtgctaatggcggtgacggcctcgatgaccgcggggtacgtgatgattcatgtgcgaggtcttcactttcatcaaaatgacttccctacattgaaacagggggaggggctctcagtgttagccccctggttttggccttggctgggtaggtgtattcatgcctgcacttttgggatggcgggatcgaatgatcaagcggcctttgctttcgtcacgttcgagacgtgtgcggctgtgtactgggggatcacactggttttggccggctgctacgcttggaggtacgcgacgggtgcgcagaagctgcacataattcgtcaccgctcctgggcaattagacatgtcgccgcaggattatccgtcgcaacgcagagggttttcataggcgcttctcatgggtggtgtcggctgaactcgttaaggtgtgaggacccaattccgcaaaagggtattttctcggactctctggccttgggagttctcacgtgcgtggtcgcgggcgaagtggcaatccgagacctgcgcgtgttagacacgcgagcgaaggtagattgagatgaactggacgtccgtcgtgtccaaatagtcccacaagttctaaatgtcgacaatctaaacctcctttgcagcggcaagcttgcagcggcctcaggcacctccaactgtaagagtcttacacaaacaccaaaaaatatctaaatatcggctatcccgcgatgagcaacacacggactgggcgcacggcacagcctcggctgtgcgcccaaccaaagagagacgacgcggcgtcgacctcacctctaattgtgtcgacgttaacgactgagaacgactttccccggtaaatatgccgtggtatcgttccatgacccggtcgctgctcggtcttctgcgcatctccccaaccaacgagcagctcatgagtgcactcctccgacttccaccttcggctgcaaaagaagagctgagaagaagggcaactgctgcacttatgtnagaagtggcgcgatccaaggtgcaaaacgaccctcgaacggctgctatgtcagaagtggcgcgatccaaggtgcaaaacgancctcgaacggctgctcacgttcgacccccggtngaggtccgcagatcggaagtatccgccgcgggcgccggactcttccttcgctgcgacgctcctgctgctagaccaggggacttgcttgctctttacgccggtgtttacacccctccggttcccagtgtcactcatgccgcagacggtacctcgattttgattccacagcccgcgctacgagaggacggcgcgtacgtggtgaatntggaaggcggcgggtacctctgcggtgcagaacacgctcttcgagttaaggaaaacgcaacccagggtctttgcgctggctgggcngtcgcagctctggccaatcaccctccccgtggtaccattccgaatgtagaggcgatcgtagttgactggggtgacacgatgagcgacgcagctcggaa

SEQ ID NO: 259 - DNA, 4000 bp, Escherichia coli
  misc_feature (1991)..(1992): n is a, c, g, or t
  misc_feature (3067)..(3067): n is a, c, g, or t
  misc_feature (3693)..(3693): n is a, c, g, or t
  misc_feature (3748)..(3748): n is a, c, g, or t
  misc_feature (3852)..(3852): n is a, c, g, or t
  misc_feature (3950)..(3950): n is a, c, g, or t
tgatacgaatttcattaaactatatagccgagaagccacaagcaacggagaaaaagatccacaaataaaattattttttcatcaagaaataataattgatgctgactctacttatagggatacattgcatgcatctctttatgcatatggtgacgtgtcaattattaatcctggcgatattgcaaataatcctaatcgattaggtattagtaatggattgggtcttcgttctctttttacaatctcttttgattctctaacattaccggaaggctcacttattcgaaaagcaaatttagttttaccctttgatacaactacaagtcctgagagttttgcaattatatttgaaccgatagaagaaataattgattctttgattacggattcaactaatgctatttttgatgccgatccatattctggagttggatatccttatcgtattgctaggacaatggacgaagcatcctatacaatttcaatcaaatcgtttttacaaaatattaccttggggaatgtttcaaatattggatttaaaatttcatcctacgagaagaatgacccatttgaatttttagaattttatttagatgatgaaacgctatctccaaaattggaaattatttatgttaaaaattaagaaaatattatttttaatttttatcgtttctgttgtgtttacccaagggacaatgaactcatttggactagggcatttttatgataatcagggaatcgcttcagccggaaatgggcttagtgtattgtcaccttctttccaaatggatgtttctctaacgaatccatcaacttgggaaaatttagactatacttttttatctttatcttatggtggtaatgagaatagttattccggcaattcattaaaaaatggatattctggactatcaaatgcaagttggattgttccagtaaaatctaagggagcttttggattaacgttggcgccttatttagatcagcgcgtttctatggtcagtaaggatacatcaaatttttatgcattcgatgatacgcttaatttggttaaatcgatagatcgttctggtggcgtcatggtttttaaaatgggctcatcttacttattgaatgaaatgttttcgcttggaatttcgattgatttattgttcgggtcatctcggcaaaacgaatccatcttttttgatggaagctcaatcatccgatcgtctagagcccgctattctggcattttaggaaatttatatttagcaacatcatttaagaataatattaaactatttacgcgacttcagcactctttgaagccaatgagtggaatttatctaaaaaaacatttatttgatgacgcaaatgggaacgggtatcacgaccaaggatctccagatgattttccagtacccgatagtatttctaccttaaatgaatttcaaattaatgaaattcataatccatatagatttggagttggactacaaaaagggttcaataaattgaatacaatttcgattgaatattcatcttttgaagaaaaagctaatctgaataataaacttataattccagctaatgattggattaaaaagtctcaggatttcactttttcagtcgctcggaatccgaataatttatcttcagactggaaggataaattttcggtaaaaacaggtttagtttataaatcccacaaactttcacattccaatattaagataactgaaataggtggggcattaggattaggttttaaatttaaagctgtcggaaatcagtttgacgttaattattaccttggaaaaagagattattctgaaaaatattctaccgaatatgtacaacaattacaatttggagttagtttagcagatcaatggtttgtaaagaggagacaaaagtaaccatgaataaaatgaagattattacccttttatttggggcattatttttaacaatgtgtgtaccccctgaaggtggaaatcagaatcttnnaaaagataaagcaaaattagattcattaagaaaagttcgttgcccaagattgatgagtagtgccgcagaatattatagaaacagagattggaaacaaactgttaggatttatgaagaaattacaacattagattgtgatgagtggaaccccgtttttgcaccgccacaggaaatctaccaatattacgccattgcgtatgagcaaatggggaaatttgatagttccgaattcgtattattagatggtcttcaaaaattaccagaaagtgttgaattaagaaaaaggcttgcatattcttataaacgccaaggtaaaaaagaaaaagagattatcgaatttgaacgaattatagatatggctccattagatatttccattatgaatgatttatcgaaattgtataaagatgaatctcgttttgatgatcaaatatatattcttgaaaaaattcttaaggtagatggaagtaacgaaattgcccaaagtgaattggcaatggctttcgaaagtagtggtaaggatcccttagatgtttatcgtaaacgatacgaagataatccagaaaatttgagttatggtttggattatgcagatcgattgactcaagtggatcggagtgcggatgctactctagttttagatggcgtaattcgtcaagatcctactagcaaattagcctatcgaaaactagcggaagctcataaagaaacaaataatttgaaaaaagccgcaaatgcttatgaagagttattccaaattgatcctagggatggacgaattgcagttgatatttcagatatctatattgacgttggcaattatagtaaggctttacggtgggcagaaaaagcaatgagtttaagtaatggcaacggcagtggattaggacaaaaagctaaagtttatttttatggttgggatactttcagacaaaatccattttcaattaatgatagaatagttgcaaaacttgcttatgattattttgtgaaggcggaagataaagggtttcttgggtttaccaaaagaggatggctagaagaaaattcaaaagacattctctatgggaaggcncaatggttcatggctgatgatagggtaaaaagaacccgcagtatttctccaacttcatcgaattatgattgggtaacagaacatttaaaagccgaacctaactggaaataaatatgtcacatctagctcaacacgattctgagttattccatatccttggaaaagaaatccaccgagaagaatcgactcttgagctaatcgcttcggaaaactttacgagccaatccgttatggaaatggctggcggcgtcatgacgaataaatatgctgaaggatatccaggaaagcgatattatggtggctgtgactttgtagatgaggcggaaaatttagcacgggatcgattgagcgaattgttcggagctgaatataccaatgttcaacctcactccggttctcaagcaaatatggctgctttaatgacctttattaaacccggcgatactgttttaggtttagacctggcccatggtggtcatttaacacatggaagcccggttaacttttctgggcaactttacaattttatttcatatcatgtgtccagagaaacaggtcgtgttgattttaatgaagttgatcgattggcaaaagagcatcaacctaaattaataatttgtggtggnagtgcttatccaagattcatagaatttgaaatgtttaaagaaattgccgataaangcaatgcttttcttatggctgatattgctcatcctagtggactagtggcagctggattgcatccatctccaatgccttattgtgatgtagttaccagtacaacncataaaacgcttcggggacctcggggtggcatcatcatgatggggaaagattttgaaaatccatggggaaaaattgcagcaaaatcgggtcgagttanaatggtctcagaattaattgattccacagtaatgccgggcatccaaggtg

SEQ ID NO: 260 - DNA, 4000 bp, Escherichia coli
  misc_feature (266)..(266): n is a, c, g, or t
  misc_feature (439)..(439): n is a, c, g, or t
  misc_feature (460)..(460): n is a, c, g, or t
  misc_feature (514)..(514): n is a, c, g, or t
  misc_feature (829)..(829): n is a, c, g, or t
  misc_feature (844)..(844): n is a, c, g, or t
  misc_feature (1111)..(1111): n is a, c, g, or t
  misc_feature (1987)..(1987): n is a, c, g, or t
  misc_feature (2000)..(2000): n is a, c, g, or t
  misc_feature (3422)..(3422): n is a, c, g, or t
  misc_feature (3902)..(3902): n is a, c, g, or t
agtgatagcacacaacaaaacttaaataactcaataatatgggaataaaagcgccaataagtatttgtacaggtaaaaggttaaaactaacctgcccaaatgaaaacaacaaggcacttgccagtaggctactcaaaatggctagccgccagcccaatattaaggtggctgcagtaataccaagtatgtgcaggtcaaggccagttaaaataccggctttaatacgccacagtagtgcaaatacaagcgcacaggctaatacaccngtttgcctagcagacgttttataaagcgatttataggtgtttttgtcgaaactaaaaatcgcaatagcaagtacaaggacccacatcagcccttgtatttcagtgtttaacattatagctacttgaacgttgaccaaattggcgcatgatctgatggtttatcaattgcacgnagctcatagtcaattcctgantcaatacaacgctcagcaagtgattgagttgcaagcacaacatcaattcgcagnccgcgattatctaaaaagcctttagagcggtaatcaaaccatgagtattgatcgttaacatcaggatagagttctctgaaggtatctttaaatccccaatctaaaagtgttgatagccattgacgttcctctggttggaaagagcacttacctgtttttagccagcgtttagcgttgacctcaccaatacctatgtctaaatctgtaggtgatatatttatgtcgcccataacaactacatcctgatcgggagtgaggtttgtatctagatgtgtcatcaaatctttataaaattgacgtttataggggaatttngtttcgtgattgatnttatcgccttgcgggaaataaccattcataacggtaatgtcgcgaccgttatcttgttcaatagtgacactgatcatgcgcttttgcgactcttctgtgtcggtagcaaacccttttaagaccgattttggctcttttttgcataacatagctacgccgtaatgtgctttttgaccgtgaaagtagacgtggtaccccattttttgaacatcgtctaatggaaacgcttcatcatgaactttaatctcttgcaagccaattacgtcnggttgatgtttatcaataacagcttgtaattggtgaagacgagcacgcagaccattgatattgaaagaaatcactttcattcgatttacctttaaatttgttctcattttgatagcaaattgtatcagtaatttagcttacataacatgtctgaaatgacaaaatagctgcgcaaatgttgatcaaatggtggtgaaagtttaaacattgttaatgttgtattaatttataaaataaataaaaaattcaattgatctgcaaaaaattggctatataatgcgcgcaaattcattggcaaactcgttcacataggatctctcatgaaagcacaattatttttagcggcaacattattagcatcttcttctgtttcagctcaaagtaacacttacttcagccaagacagctctattgagtctaagctgtgtgtattaagcgcaaacgaaggtttttctgcagcacgtaaattagcagctaagcacaatgtatacttatcacgcttctcacaaagcatcatgtgtaacggccaagatattcgtgatattgcaaagaaagattcaacaaacaacataactgaaaacaaagtagaagtgtttgctaaagatgctcaacaagaaactcaattatgtatgactgcattaaagcaaggtttagcgccagtacgccaaaaaataggtaacttaaactcgcttaaatgtaacggtcagaaagttactgactttgttaagcgttatcaaaacgctgcaatttaattagcacgacaaaattaatgagagcccagcttttacagctgggcttttttttgcaaaatttacaaggttggttgaaaaggtttcaaggctaacgtattgaaaatagaataaataataaacaggntttctgtaaggtnctgaaatttatatttattttattttggcaccagacttgtattagttgttgtgacatttattaacaacgaaggacacgtcttatgaaaaagttaacattagcaacaactattctagcaacattaagtttagcagcctgcgcatctaatcaaggtcttgataaaatagacagcgactttgcaagcctagacaacgacagtgatggttttatttcaaaagttgaagctgacgacgataatatttggggtcacttttcaaatatcgacaccaatatggatgaagaaattagtcgtaaagaatttaatgcttacatgcagttaaacactggcaaggttgcaaccgatagtgatgtaagtgaatcagcctttaaagctgaaattgcaaaatttgacaaaattgaaagtagttttgccagtttagataacgatagtaatggttacatatcagttgttgaaggcaatgacgacgatatttcaaatcactttggttatatggacaaaaacgaagacaagcgaattagtaaaaatgagtttatgggctacataaataaatatggtaaatctgtagctgaagacgaagcgttagagtcaattaaacacagctaattaaaattcagaacataaaaatcaaagccagttattttaactggctttttttatggctaattttagataattgccagatatattttcctagttagtggttgttctgtcataatagatggctgtgtatttttatttattaagagtgtatatggctgggcggcgaattagtgatgagcagttggttgaaatcattgaggctgcgatttttgttgcagacaaacccataagtaaacgccatattaaagacactgttttagtggatattgcaatttctatgtcacgtataaacgaggctatagaaacaatacaaacacactttcaaacccgtggtattcgccttgttgaagttggtagtggttatcgatttcaggcgtgtagtagtttgagcccttggttgagtaacctatggcaagaacgagctcctaaatactcacgtgctttattggaaacattatcacttattgcttatcgtcaacccattacgcgtggtgaaatagagcaagtaagaggtgtaacaacgggttcgaatataattaaaaccttactcgaaagagagtgggtgaaagtggtagggcacaaagaagtaccgggtaagcccgctttatacgccactactaaacaatttttagattatttttcattaacgggtttagaaaacttacctgcgttacctgcgcaacaagaaagtaaaataaaccagttattaagtgatccttctgtgagagaaccatccgaatgaatatacaaggtgaaaagttacaaaaagtcctagccagagctggtgtaggctcgcgtcgtgaaatggaaaaatacattgangctaaccgtgttagtgttaatggcaaagtagctaaactcggtgaccgcgttgaagaaaccgatttaattcgtgttgacggtcataccgtaaaaattgaagaaaaagctgacagaatttgccgtgtaattatgtacaacaaacccgagggagagttgagtacacgtaaagaccctgaaggtcgtcgtactgtatttgacagacttcctcgtattgatggcgatcgttggatagctgtaggccgactggatgtgaatacgtcaggcttaatgttgtttaccaacgatggtgaattagccaatcgtttaatgcacccaagttatgaagtagagcgtgaatattcttcgcgtgtgtttggtgaagtaacaaacgagacacttaaaaacctgatgcgtggtgttgagcttgaagatggtccagcaaaattcacaaatataaaaccgctaggtggtgaagggattaaccgctggtttaatgtgacnttaaacgaagggcgcaaccgcgaagttcgtcgtttatggcaatctcaagacgttgaagtgtcgcgtcttatccgtattcgttacggtaagctagagct

SEQ ID NO: 261 - DNA, 4000 bp, Escherichia coli
  misc_feature (1986)..(1986): n is a, c, g, or t
  misc_feature (2297)..(2297): n is a, c, g, or t
  misc_feature (2371)..(2371): n is a, c, g, or t
  misc_feature (2618)..(2618): n is a, c, g, or t
tccaacagagggagtatcattattttttttcatctcttctattttatttttaatttctgtagaagattttgtgcttttaattatgtctgtaaatcgggaaaaatatgattcaattatatcaagatcaatctctttattcataagcattctctgaaggataagagatgataaataagaatcattattttctacaataaaactttcctcatattttcttaacttatctttcaatgactcaaattgactgttcagatcactcataagaagagtatctctcgcaaaattagcatttctcatttcagattgaaccttgtttaattcaatataaaaatctttagtttttagtttgtatgtactaaagtcatcatttgatttagttcccaacactctggaagttcttaaactgtctttatacactttaacatttatagttccaggttcaataactacaggaaggttttctctttgcttgtcaaaaaccacgtagtgcatttctgggacagatattgaatctgtgaatgaaaacttaccttcaaaaactttagttgaatctacaacaaccggcaaattactttcaccaagttttaccaaaaaaacatttaaatcttcatcatgatttgtttcagcatttatagtaaaggtattatttgaacaaccgtatgagataaatagaattaataataaataaatatattttttcattggagtttgaataaaatttaactttgacaaatataatatttaaatattgatagctatcaatgaaagttataagtgaaattgttaatgaaattaagttaattacgggtgataaacatgtaataactagcaaatggggaaaagaaccgtttagcaagggttggagatatggagagggtgaaacattagctgttgttaaaccaggtacactattagatatttggaaaattttacagaaatgtattgaatatgacgttattgtaataatgcaagctgctaatactggtttaactggaggttcaactccttttggaaagggttacgatagatcaattataattataaatacattaagaataaaatctattcatgttattgaaaatggcaaacaaattattgctcttcctggaagtagtttatatgatttagaaaataaacttaaaccatttaaaaaagaaccacattctgttattggttcaacttcaattggagcttctattgtaggaggggtttgcaataattcaggtggatctttagttcacagaggaccagcctatactgaattagcattatatgcaaaagttaataaggatggtaagctagaattaattaacgagttagatataaatctaggttctagtcctgaggagattttatttaatttagaaaacaaaaattacagtgattcagatattttaaaatctaaaaagttaggttcagatgataaatactctgaaatagttagaggagttgaccaaagcactccagctcgttttaatgcagataaaagattattacattctgcttctggaagtgctggtaaaattgctgtatttgcgttacgtttagatacatatgaagctccgaaaaaaagtaaagtattttatgtcggttctaacaatcaagatgatttttggaaaataagaaaagatattcttgccaattttaatgaacttcccagacttggagattacatgcacagggattgttacgatgctgcaaaaaaatacagtaaggacacatttgtagtaattgaaagacttggaacaaactttttaccatcactttttgaatttaaaagaattgtggacatcatagcagagaaagttaaatttctccctgaaaaattttctgataaactaatgcagtttttaagtaatttttggcctaatcatctgcctaaaaaaatggaactttttagaaatcaatttgaacatcattggataattgaaatgaccgacaaaggtattgatgaagctgaggcttattttaaagattttttcaagnacaaagaaggtgatttttttatatgtaattctaatgaaggaaaaaaagcaatgcttcacagatatgtttcagctagtgcaattggtagatatcaagcattaaataaaaaaaatattggagaaatgatgtctttagatatagcatttccaagaaatgaaaaaaactggttagaaactctaccaaaaaaaattaatgataaacttgaattaaaattttattacggtcatttgttttgtcatgtatttcatcataattatattctaaaaaaaggggtcgatgctaataaattaaaagaagaattgttaaaaatntatgacagaagaggagcacaatatcctgccgaacataatgtaggtcacgaatacaaagcaatgcctgttcttantgagttttataaaaatttagatccaactaattttttcaaccctggaattgggcaaactagtaaacttaaaaattggaaataaccttttattagctagtcttttttatgaaatattttaaacctatttttgtttaaaatttaataatggctggaaattcatttggtaacatattcaaactaacaacatttggagaatctcatgggccagcacttggtggtgttattgatggatgcccacctggaatanaacttgatttagattttattgaaagtgaaatgcaaagaagaaagccagggcaatcttcaattgttactcaaagaaaagaagaagattctgttcaattttacagtggaatatttgaaggaaaaacaaccggaacgccaattggttttttaattcataataaagatcagaaatctaaagattattctcatataaaagacacgtatagaccatcacatgcagattttgtatatgataaaaaatatggtcacagagactacagaggaggaggaagaagttcggcaagagaaacagccagtagagtagtagctggagcaattgctaaacaaatacttgaaggaatcaaaataactgctcacgtatcctctgttggagaaattaaggttgatactcactattcaaaattagatttttctaccattgaaaataatcctgttagatgtgcagatccaaaaactgctgttgaaatggaaagtttcataaaacaaattagaaaggaaggtgatacagttggaggagaggttagttgtgtcattgaaaactgtccaattggtttgggtgaacctgtatttgataaacttcacgctgaacttggtaaagccatgttatcaataaatgcagttaaaggttttgaatacggaagtggttttgatggctcaaaattaaaaggaagtcaacataatgattcatttaattctgacggtaaaacagaaactaataattctggcggaattcaaggcggaattagtaatggaatggatatctacttcaatgtagcatttaagcctgttgcaactattatgaaatctcaaaaaacaatagattccaataataatgaagtagaaatgaaaggtaaaggaaggcacgacccttgtgttgttcctagagctgtgcctattgtggaagctatggcagctttagtattagttgattatttacttattaacaaattgtataaatagttcaaaacgaactattaattaatttatatttatacatatctcattatatattttaggttttataaaattaaaaaaaacctaactaaaatatttgtaccaactaaatataaaaacattcttcttttaaaacacccagaacctaattattatacaccattattcagacccataaagaaaaaaagggtcaaacactatatttaaattgttaatatacagttgtttaagagtgttaaaatatataactactattaagtattttgattgctttaataattgatttagatttaacaaaaacttttataattcatgttaaataaaaaaaaaataatcatttctataataatcgttttattgtttggagtttttttaaattataattctgaacaaaatatagattataattcagttagagaattacataaa

SEQ ID NO: 262 - DNA, 4000 bp, Escherichia coli
  misc_feature (1587)..(1587): n is a, c, g, or t
  misc_feature (1987)..(1988): n is a, c, g, or t
  misc_feature (2509)..(2509): n is a, c, g, or t
tgataatgaaggtaattcactaatttttctttgtgccatttatttctccaatatttgttttaacattcccttgatttgggaaatatcatgttccaatctatttatacgcttttgatttgtttcttgctcaatagctcgatttcttgcgtttaaatattcattataacccttaccatctttattaatgatagcgccggatctattatctttcttatattttaaatccattatgcagtagcaatggctctaaagtctctaatataaggtgttttagtctcatcagtagatgacaatacaattctaatagtaaatgaggtaaactcagacataattttataagtcggctcatattcccattccatccaaccgacattctctacacgttttctagtaaacttagtactcgtcttacgttgcataggaatccaagcaaattctgtggtggttaaacccgaagaagtaatcttaatgaaaggaatctttaaccataagtctaaatgttgtgtaggatcgttggtagaaccacctgatacagcggcaagggcaatatagaattcaccatcgacggaatatttaacaatatcacctgcaatataatccaatgcagtgtcccacaccgtagaatcatctagatcatattcacaaatccaagaacctgtaccatacacggtagtatcatcgacattaccaagatacatacgatcgcgggcaggtcctggaatgatcttgccttgacaatatgctcttgccgcggatgggctaccttgaggtgtattacccgccggtatagcacttacagtagtgtatgtagaatcatatgtgtaaacatacttacctttccagtaaccaataatatcggttaggttataagcattggtagtaatatccactctacaatgacggaaaacattattacctaaagagaaatatacatcaatgtctcttccggttgtatttaactcagacatgaatacactcaattcagaggctggatcatccagttcaatagtcttggtgaggtaattaccatagtaagcacctgtaccttcctctacccattctgtactattatcaacatctgcaagtaatgtacaatccgattctgttgtgataccatcatagatctcaccagtaccaatctgtttacatacatattgtgttaggccagagttaacgatgttttggaaaccaagacggtctttattaacaatagcggaagtattttcagaagaagtcttcatgattgctttccactccaccggttgtcctgcgccaaagttataagcagagtccaattctttattggtcctgttagtaaccgctacataatcggattgactaggaaacttagcgtaccaatcaatttcagtaccttccaataacatctcttcagccgataacataagaatatgtgccgcttcctgtgatgcaggatctgcagagaacgccaccgaagcatcgcctgtattgaatgatgcgcgcattaatctaaatgctacatcccttgtttggtccggcgtccatgttctattattctgtgacatgaacatactacccagagtaggttgttgtgaaatacgagcaccntcaccagaagaagtcttttcaaacccacccaatttagcgacccatacttcatattctgtagtgtcggtcttaataatgaaacaatactctgtattattcataagatatacaggagaatcgaaagtaaatttagtcgcaatgttattataatcatcgtttgatgcaaggaatgcatcattatccgcccacccaccttgagtcaatatctcagccggagtcatattcttttgagagaatggtataattgcaggcccaggaaaaccattaatgacttccctaatttcaaccgctacaggtagatcaacggctaatctgtggaaccataactccaatgcagttacataaacaccaccttccataccttgaataaggaatgtttgtgccagtgggtcatcgccanncggattccacctccgtgttacaatttcagatgatgcagatgatgataaatgtctttcttcattaatctcttgtctactaccagtgatagtagttattgaagcaaccgtctcttcgtgagtggttgctataccgttggctgtatatttagatattgccgctgttgttggttgttcgtctctatcttttaattcaaattctttaacaccaacactataagtaccggccgggatattgaatgtaccagaaatagaacctgatgaatcggtaacattattaccagaccagacaacatttgatgatatatcaacaccatcaaaataaggaatcataagagtgttaggtcttaactgtgtggcttcaaatatgatagccctagccctcatccaaggtactaatgatacatcaataactctatcacctagactttccgtgcgagtattctctgcaaaacttcgttgaataccaacccttgattggtccattgtagtggtggtggatgttctgatccccgcttcgccantattgccattcactcttgaaaattgtgacatagaagttgaaacaccaatattatttgtctgccatgagttccattctgtattccaaccattgaagcttccaggaaatgccgcttcccaagcccctctattacttcccatatcaacgactaaattagcgttgcggctagtatccacccattgatctgtttcaggacttagtgtgatagaaccattccaaaggaatgttaagaatcttacaacattctctgtttcagatgctttactttgatctagtagaattacatcatcatctaaaatttcgtttgtgataccgacacctgttatactattaccagtagaagatgcattatccaatgaatgttcgtgtgtaccaatagtaaatggtaatcttaaagcagatgaagcagggtcaaccgctactagataatctggatgatttacatcacccacaccatgacctctaaagttatctacaacaataccatttttgaatcggtcaagaccatactcatctttaatatccatattaatagcgctttgctctaatatgcttaatgctgtatagtattccacattttcaattcttccttcaagatcttggatgtcattcattgtgtatcgtttgttatccacaaactgagtaccaatatcggaaagattaaatgtatatgccggtattaggaagttatataatggcattgcagtctcaggtacagaaggcacttgaggattaatatctggaatacccttaccaataacgaagttgccggtactttccaaatataatatatcaatacgcggaaggtaatggaagaagtcgaaagtaatatcatcttgaacatgaggaatctcaatgaatgaagtattaacttggttatagtctggacggaagtctaaagaatctcttagattaaatatagaaccgccggtttcagatgtgtaagaaccaatagcttcatattcagtattatccgaaggtgtttcttcgaataacataccggatggaactgtatgatctgtaatatatgagttaaccgcaaatacatcgccactaccatgagcataatatttatatgcaacatcgatagtagaaggtggtgtaccacccgcggtgtgtgttaatataccctgttcgtatgtataatccctttgaccattatcaaatgtataatcagtaacagaagcccatgcaacaccgtcaattgaagtgatctcaatgatatctgtatgagccatagtaaacttagtactcgcgccagtgattgtctctgaagcgattgtagtattagtcttagatcttacatccattgtaatctgtggacgtgcaataacttcaaccgtaacaccgcttaagtcaccagtgattgtaaatacaatcgccgtagaaccagcgcctgaagtatatgtagtgtttacaaccactgatgtatccatgcgcgccgcttgaataatgctttgacttgagaatgtacccgcaagatcagttaatg

SEQ ID NO: 263 - DNA, 4000 bp, Escherichia coli
  misc_feature (1)..(2): n is a, c, g, or t
  misc_feature (8)..(10): n is a, c, g, or t
  misc_feature (12)..(20): n is a, c, g, or t
  misc_feature (26)..(31): n is a, c, g, or t
  misc_feature (35)..(43): n is a, c, g, or t
  misc_feature (46)..(53): n is a, c, g, or t
  misc_feature (56)..(63): n is a, c, g, or t
  misc_feature (68)..(68): n is a, c, g, or t
  misc_feature (72)..(74): n is a, c, g, or t
  misc_feature (78)..(82): n is a, c, g, or t
  misc_feature (85)..(85): n is a, c, g, or t
  misc_feature (88)..(88): n is a, c, g, or t
  misc_feature (95)..(96): n is a, c, g, or t
  misc_feature (99)..(102): n is a, c, g, or t
  misc_feature (105)..(105): n is a, c, g, or t
  misc_feature (108)..(109): n is a, c, g, or t
  misc_feature (112)..(116): n is a, c, g, or t
  misc_feature (121)..(127): n is a, c, g, or t
  misc_feature (139)..(139): n is a, c, g, or t
  misc_feature (143)..(145): n is a, c, g, or t
  misc_feature (148)..(157): n is a, c, g, or t
  misc_feature (164)..(170): n is a, c, g, or t
  misc_feature (173)..(179): n is a, c, g, or t
  misc_feature (182)..(183): n is a, c, g, or t
  misc_feature (186)..(186): n is a, c, g, or t
  misc_feature (189)..(194): n is a, c, g, or t
  misc_feature (197)..(200): n is a, c, g, or t
  misc_feature (203)..(204): n is a, c, g, or t
  misc_feature (207)..(208): n is a, c, g, or t
  misc_feature (211)..(216): n is a, c, g, or t
  misc_feature (221)..(226): n is a, c, g, or t
  misc_feature (229)..(236): n is a, c, g, or t
  misc_feature (240)..(243): n is a, c, g, or t
  misc_feature (246)..(248): n is a, c, g, or t
  misc_feature (251)..(251): n is a, c, g, or t
  misc_feature (254)..(256): n is a, c, g, or t
  misc_feature (259)..(261): n is a, c, g, or t
  misc_feature (264)..(266): n is a, c, g, or t
  misc_feature (269)..(273): n is a, c, g, or t
  misc_feature (276)..(278): n is a, c, g, or t
  misc_feature (281)..(282): n is a, c, g, or t
  misc_feature (288)..(290): n is a, c, g, or t
  misc_feature (293)..(298): n is a, c, g, or t
  misc_feature (301)..(305): n is a, c, g, or t
  misc_feature (308)..(315): n is a, c, g, or t
  misc_feature (323)..(323): n is a, c, g, or t
  misc_feature (330)..(331): n is a, c, g, or t
  misc_feature (335)..(336): n is a, c, g, or t
  misc_feature (341)..(351): n is a, c, g, or t
  misc_feature (359)..(360): n is a, c, g, or t
  misc_feature (363)..(375): n is a, c, g, or t
  misc_feature (378)..(380): n is a, c, g, or t
  misc_feature (383)..(386): n is a, c, g, or t
  misc_feature (394)..(394): n is a, c, g, or t
  misc_feature (399)..(399): n is a, c, g, or t
  misc_feature (403)..(411): n is a, c, g, or t
  misc_feature (424)..(424): n is a, c, g, or t
  misc_feature (427)..(434): n is a, c, g, or t
  misc_feature (437)..(437): n is a, c, g, or t
  misc_feature (442)..(445): n is a, c, g, or t
  misc_feature (451)..(453): n is a, c, g, or t
  misc_feature (456)..(460): n is a, c, g, or t
  misc_feature (463)..(463): n is a, c, g, or t
  misc_feature (467)..(469): n is a, c, g, or t
  misc_feature (472)..(472): n is a, c, g, or t
  misc_feature (475)..(475): n is a, c, g, or t
  misc_feature (478)..(479): n is a, c, g, or t
  misc_feature (482)..(491): n is a, c, g, or t
  misc_feature (494)..(496): n is a, c, g, or t
  misc_feature (499)..(503): n is a, c, g, or t
  misc_feature (508)..(508): n is a, c, g, or t
  misc_feature (510)..(510): n is a, c, g, or t
  misc_feature (512)..(512): n is a, c, g, or t
  misc_feature (519)..(520): n is a, c, g, or t
  misc_feature (525)..(527): n is a, c, g, or t
  misc_feature (530)..(535): n is a, c, g, or t
  misc_feature (538)..(538): n is a, c, g, or t
  misc_feature (545)..(545): n is a, c, g, or t
  misc_feature (553)..(555): n is a, c, g, or t
  misc_feature (558)..(558): n is a, c, g, or t
  misc_feature (561)..(567): n is a, c, g, or t
  misc_feature (572)..(572): n is a, c, g, or t
  misc_feature (575)..(579): n is a, c, g, or t
  misc_feature (582)..(585): n is a, c, g, or t
  misc_feature (589)..(590): n is a, c, g, or t
  misc_feature (595)..(599): n is a, c, g, or t
  misc_feature (605)..(606): n is a, c, g, or t
  misc_feature (612)..(612): n is a, c, g, or t
  misc_feature (615)..(616): n is a, c, g, or t
  misc_feature (623)..(623): n is a, c, g, or t
  misc_feature (626)..(626): n is a, c, g, or t
  misc_feature (631)..(631): n is a, c, g, or t
  misc_feature (635)..(639): n is a, c, g, or t
  misc_feature (644)..(645): n is a, c, g, or t
  misc_feature (647)..(647): n is a, c, g, or t
  misc_feature (649)..(656): n is a, c, g, or t
  misc_feature (660)..(661): n is a, c, g, or t
  misc_feature (666)..(672): n is a, c, g, or t
  misc_feature (679)..(679): n is a, c, g, or t
  misc_feature (686)..(690): n is a, c, g, or t
  misc_feature (694)..(695): n is a, c, g, or t
  misc_feature (699)..(700): n is a, c, g, or t
  misc_feature (711)..(711): n is a, c, g, or t
  misc_feature (714)..(717): n is a, c, g, or t
  misc_feature (722)..(724): n is a, c, g, or t
  misc_feature (732)..(732): n is a, c, g, or t
  misc_feature (749)..(749): n is a, c, g, or t
  misc_feature (881)..(881): n is a, c, g, or t
  misc_feature (1316)..(1316): n is a, c, g, or t
  misc_feature (1418)..(1418): n is a, c, g, or t
  misc_feature (1616)..(1616): n is a, c, g, or t
  misc_feature (1845)..(1845): n is a, c, g, or t
  misc_feature (1979)..(1979): n is a, c, g, or t
  misc_feature (2048)..(2048): n is a, c, g, or t
  misc_feature (2478)..(2478): n is a, c, g, or t
  misc_feature (2547)..(2547): n is a, c, g, or t
  misc_feature (3146)..(3146): n is a, c, g, or t
  misc_feature (3228)..(3228): n is a, c, g, or t
  misc_feature (3232)..(3233): n is a, c, g, or t
  misc_feature (3238)..(3241): n is a, c, g, or t
  misc_feature (3245)..(3250): n is a, c, g, or t
  misc_feature (3252)..(3254): n is a, c, g, or t
  misc_feature (3256)..(3266): n is a, c, g, or t
  misc_feature (3269)..(3269): n is a, c, g, or t
  misc_feature (3273)..(3274): n is a, c, g, or t
  misc_feature (3276)..(3287): n is a, c, g, or t
  misc_feature (3289)..(3293): n is a, c, g, or t
  misc_feature (3296)..(3296): n is a, c, g, or t
  misc_feature (3298)..(3298): n is a, c, g, or t
  misc_feature (3302)..(3302): n is a, c, g, or t
  misc_feature (3306)..(3306): n is a, c, g, or t
  misc_feature (3308)..(3308): n is a, c, g, or t
  misc_feature (3311)..(3311): n is a, c, g, or t
  misc_feature (3313)..(3314): n is a, c, g, or t
  misc_feature (3320)..(3323): n is a, c, g, or t
  misc_feature (3325)..(3326): n is a, c, g, or t
  misc_feature (3328)..(3335): n is a, c, g, or t
  misc_feature (3337)..(3337): n is a, c, g, or t
  misc_feature (3339)..(3339): n is a, c, g, or t
  misc_feature (3343)..(3346): n is a, c, g, or t
  misc_feature (3348)..(3348): n is a, c, g, or t
  misc_feature (3352)..(3354): n is a, c, g, or t
  misc_feature (3356)..(3357): n is a, c, g, or t
  misc_feature (3359)..(3359): n is a, c, g, or t
  misc_feature (3361)..(3366): n is a, c, g, or t
  misc_feature (3368)..(3371): n is a, c, g, or t
  misc_feature (3373)..(3373): n is a, c, g, or t
  misc_feature (3375)..(3376): n is a, c, g, or t
  misc_feature (3380)..(3380): n is a, c, g, or t
  misc_feature (3382)..(3385): n is a, c, g, or t
  misc_feature (3392)..(3395): n is a, c, g, or t
  misc_feature (3397)..(3404): n is a, c, g, or t
  misc_feature (3408)..(3408): n is a, c, g, or t
  misc_feature (3410)..(3411): n is a, c, g, or t
  misc_feature (3413)..(3413): n is a, c, g, or t
  misc_feature (3415)..(3421): n is a, c, g, or t
  misc_feature (3423)..(3427): n is a, c, g, or t
  misc_feature (3430)..(3431): n is a, c, g, or t
  misc_feature (3433)..(3433): n is a, c, g, or t
  misc_feature (3436)..(3436): n is a, c, g, or t
  misc_feature (3438)..(3441): n is a, c, g, or t
  misc_feature (3443)..(3443): n is a, c, g, or t
  misc_feature (3445)..(3446): n is a, c, g, or t
  misc_feature (3448)..(3490): n is a, c, g, or t
  misc_feature (3492)..(3509): n is a, c, g, or t
  misc_feature (3511)..(3532): n is a, c, g, or t
  misc_feature (3534)..(3540): n is a, c, g, or t
  misc_feature (3542)..(3542): n is a, c, g, or t
  misc_feature (3544)..(3548): n is a, c, g, or t
  misc_feature (3550)..(3552): n is a, c, g, or t
  misc_feature (3554)..(3577): n is a, c, g, or t
  misc_feature (3580)..(3583): n is a, c, g, or t
  misc_feature (3585)..(3591): n is a, c, g, or t
  misc_feature (3593)..(3593): n is a, c, g, or t
  misc_feature (3595)..(3597): n is a, c, g, or t
  misc_feature (3599)..(3634): n is a, c, g, or t
  misc_feature (3636)..(3651): n is a, c, g, or t
  misc_feature (3653)..(3656): n is a, c, g, or t
  misc_feature (3658)..(3658): n is a, c, g, or t
  misc_feature (3660)..(3673): n is a, c, g, or t
  misc_feature (3675)..(3682): n is a, c, g, or t
  misc_feature (3684)..(3694): n is a, c, g, or t
  misc_feature (3696)..(3708): n is a, c, g, or t
  misc_feature (3710)..(3710): n is a, c, g, or t
  misc_feature (3712)..(3715): n is a, c, g, or t
  misc_feature (3717)..(3717): n is a, c, g, or t
  misc_feature (3720)..(3722): n is a, c, g, or t
  misc_feature (3724)..(3730): n is a, c, g, or t
  misc_feature (3732)..(3745): n is a, c, g, or t
  misc_feature (3747)..(3773): n is a, c, g, or t
  misc_feature (3775)..(3784): n is a, c, g, or t
  misc_feature (3786)..(3802): n is a, c, g, or t
  misc_feature (3804)..(3820): n is a, c, g, or t
  misc_feature (3822)..(3825): n is a, c, g, or t
  misc_feature (3828)..(3828): n is a, c, g, or t
  misc_feature (3830)..(3836): n is a, c, g, or t
  misc_feature (3839)..(3857): n is a, c, g, or t
  misc_feature (3861)..(3879): n is a, c, g, or t
  misc_feature (3881)..(3888): n is a, c, g, or t
  misc_feature (3891)..(3892): n is a, c, g, or t
  misc_feature (3895)..(3898): n is a, c, g, or t
  misc_feature (3901)..(3902): n is a, c, g, or t
  misc_feature (3904)..(3912): n is a, c, g, or t
  misc_feature (3914)..(3918): n is a, c, g, or t
  misc_feature (3920)..(3928): n is a, c, g, or t
  misc_feature (3930)..(3933): n is a, c, g, or t
  misc_feature (3935)..(3954): n is a, c, g, or t
  misc_feature (3957)..(3958): n is a, c, g, or t
  misc_feature (3963)..(3969): n is a, c, g, or t
  misc_feature (3972)..(3975): n is a, c, g, or t
  misc_feature (3977)..(3990): n is a, c, g, or t
  misc_feature (3992)..(3994): n is a, c, g, or t
  misc_feature (3997)..(4000): n is a, c, g, or t
nngggccnnntnnnnnnnnncccaannnnnngggnnnnnnnnnccnnnnnnnnggnnnnnnnnggccnaaannntttnnnnnttnaanggggaannggnnnnttnggnnggnnnnnttccnnnnnnnaattccaatttnaaannnccnnnnnnnnnnttttccnnnnnnnaannnnnnnccnnccnttnnnnnnggnnnnggnnggnnttnnnnnnaaaannnnnnccnnnnnnnncttnnnnttnnnaanaannnttnnnggnnnaannnnnccnnnccnnaaattnnnaannnnnnccnnnnnaannnnnnnnttccaaanaaggttnnaaannttggnnnnnnnnnnntttttttnnttnnnnnnnnnnnnnaannnaannnntttccttnggttngggnnnnnnnnnttggaaaggaaanaannnnnnnnggnaattnnnncctttnnnttnnnnnttnaaannnttnttnccnnaannnnnnnnnnttnnnggnnnnnggaangntnttttttnnggggnnnccnnnnnnaanaaaaaanaaaagggnnnaanaannnnnnnaaccnccnnnnnccnnnngggnnccggnnnnntttttnnaatttnttnncccaaanttnccaanaaannnnnttccnncncnnnnnnnngggnnttttnnnnnnnggttaanttttttnnnnncctnngggnngaaaaggaaanggnnnnggggnnngggaaacnaaaaaacacggagaacngtcggcgagaccgttctccgtgtcgaatgaagtcagaagcgtgccgagaattgcacgtcgaaagtgttgtagtcgcgatcggctccggctcgatcgtgcgtgtgggtgtagttgagctggaacagatagttnttgcccagacggtagttggaggagaatccccaattggttttcagtccttgccaggtgctggcgtcgtcgcggtagcagtcccagcgaccatagagtttcatgcgttcgcaaccggggacgggcacaccggccagcacgtaccaaccatcgctctcgttggcgccgcccttggtggtgctgccgtggctgtgcacatattcgccgcgggcatcccaacgaccttcatacttgaaaccgagggcgtagcgcttgcgctccaaacggtgggtgggattggcggggtcggtgaaacggccgttccaaccaaagccgccgacggaaaggccatcgatcggacaaacccacaaaccgccgatgagatccttgaaatgatcgatgtcggcgtggttgatgccttggccgttgaagagaccgacctgatagtgcaggaatttncgaccgctcgaaaggggaaggaggtcgcccatgatttgcacacccgcgtcgcgaccgttggaggtgtgttcgccgatgcggtcgttgaggctctgcaatttngaggcgacctgcgagaagctgccgagaccgacggcaagaggcgagaggggtttgtcgaagccgaaggggcggtggaattgaccgatgcgcacttggaattcggggtatttgcgcgattcgacataggcatcgagcagacgaggacctcggtcgacgccgggagcgccactcatctcgagttgaaaccggtagaagacntcgcgccacacatagccgctgccgtagaggcggaggtagcgcatggagaaattgctggcggtggaggcaccctgacgatcggtgacctcaaacttggaagtgaggtagcctccgaaggtgatcgagggtttgaaagcgggaagactttcgggcgtttttgcctgcgctgcgctgacgtgtgcgaggctgtcggccggtgtgagacgggcattcggcgtttcggccggtntggccgcggctgaaccggcacacaacgtgcctaagaaacaaagaaacagagttttcatttggagctaaacggtttgtcatgcaaaattatgaaattctcgagagatatgcagcggaagaaaagagaaaagcgtntgcagacccacctctcagcgctcgagaaactgcataattggcatctcatatacaattgagagaaagaangacgtggactttcaacctgtttttgcaatctatactatcaaaaaagagggaaaaggcttggtgtctcggcgttttctgactacatttgcaagtagaacaataaaataagaataaaacaagcatcctcatggaagaaatactcgaaaagccttatgtgatcgggctcgacatgggcggtacgaactcggtgttcggcatcgtggaccaacgcggcacgattattgcgcaaacggccatcaaaacgaaggcctatcctgatgtcaaagactatgtgaaagcggctgtggaagcgctgcaacctgcactcgacgtggtgggcggcatcgacaacatccgcggtatgggtatcggcgcgccgagcggcaatttctataatggtacgatcgaacgcgcggcgaacctgatttggcagggcattgtcccgatctgngacctcttcgaagaggcgctcggggtaccttgtcgggtgacaaacgatgccaacgcggcggccttgggngaaatgacctacggcattgcacgcggcatgaagaactttatcatgatcaccctcggcacgggtgtgggttcgggcatcgtggtggatggtcgcgtggtgtacggttcggatggtttcgccggagaactgggtcacgtggtgatcgaccacacggaagccggacgcgaatgtggatgcggacgcaaaggctgtctcgaaacgtactgctcggcgacgggtgtggcgcgcacggcacgcgaatttctcgcgaaaagcgatgcgccctctccgctccgcgacttggatcccgaatcgatcacctcgttcgacgtgttccaagctgctgaaaagggcgacaaaatcgctttggacgtcttcgaatacaccggtacgctgctcggacgcacttgcgctgactttgcgaccttcaatacgcccgaggcgtttgtcttcttcggcggattggccaaggcgggcgaatatctcatggaaccgctacgcaaagcgtacgacgaaaacgtgctgaagatcttcaaagtgaaggctatgctcctcatttcgaccctcaagggttcggaagctgccgtactgggcgcctcggcgctgggatgggaataaanctcccctcctcttccccttcttcttcataacggattttacgctcccccgttgaagcttgcgcttcggcgggggatttttgtntttnnccgcnnnngggnnnnnnannncnnnnnnnnnnnacnggtnngnnnnnnnnnnnngnnnnncangnaaangggnangtncnnaaaaannnntnngnnnnnnnntntnctcnnnngngggnnncnnangnnnnnncnnnncncnncaangnnnnaaaaaannnntnnnnnnnncggngnncncnnnnnnntnnnnntanngnggngnnnnananngnnnnnnnnnnnnnnnnnnnnnnnnnnnnnnnnnnnnnnnnnnngnnnnnnnnnnnnnnnnnngnnnnnnnnnnnnnnnnnnnnnngnnnnnnngngnnnnnannntnnnnnnnnnnnnnnnnnnnnnnnnttnnnncnnnnnnncncnnntnnnnnnnnnnnnnnnnnnnnnnnnnnnnnnnnnnnncnnnnnnnnnnnnnnnncnnnncncnnnnnnnnnnnnnncnnnnnnnngnnnnnnnnnnngnnnnnnnnnnnnnanannnngnggnnnannnnnnngnnnnnnnnnnnnnnannnnnnnnnnnnnnnnnnnnnnnnnnntnnnnnnnnnnannnnnnnnnnnnnnnnngnnnnnnnnnnnnnnnnncnnnnggngnnnnnnnggnnnnnnnnnnnnnnnnnnncccnnnnnnnnnnnnnnnnnnncnnnnnnnnggnnaannnntgnngnnnnnnnnngnnnnncnnnnnnnnngnnnntnnnnnnnnnnnnnnnnnnnnggnnggggnnnnnnnttnnnngnnnnnnnnnnnnnncnnnctnnnn

SEQ ID NO: 264 - DNA, 4000 bp, Escherichia coli
  misc_feature (379)..(379): n is a, c, g, or t
  misc_feature (494)..(494): n is a, c, g, or t
  misc_feature (521)..(521): n is a, c, g, or t
  misc_feature (540)..(540): n is a, c, g, or t
  misc_feature (544)..(544): n is a, c, g, or t
  misc_feature (773)..(773): n is a, c, g, or t
  misc_feature (801)..(809): n is a, c, g, or t
  misc_feature (811)..(813): n is a, c, g, or t
  misc_feature (815)..(829): n is a, c, g, or t
  misc_feature (831)..(832): n is a, c, g, or t
  misc_feature (834)..(835): n is a, c, g, or t
  misc_feature (837)..(838): n is a, c, g, or t
  misc_feature (840)..(842): n is a, c, g, or t
  misc_feature (845)..(850): n is a, c, g, or t
  misc_feature (856)..(857): n is a, c, g, or t
  misc_feature (859)..(865): n is a, c, g, or t
  misc_feature (867)..(867): n is a, c, g, or t
  misc_feature (870)..(871): n is a, c, g, or t
  misc_feature (873)..(874): n is a, c, g, or t
  misc_feature (876)..(878): n is a, c, g, or t
  misc_feature (991)..(991): n is a, c, g, or t
  misc_feature (1008)..(1008): n is a, c, g, or t
  misc_feature (1177)..(1177): n is a, c, g, or t
  misc_feature (1269)..(1269): n is a, c, g, or t
  misc_feature (1928)..(1928): n is a, c, g, or t
  misc_feature (1982)..(1982): n is a, c, g, or t
  misc_feature (1985)..(1985): n is a, c, g, or t
  misc_feature (1995)..(1995): n is a, c, g, or t
  misc_feature (2199)..(2199): n is a, c, g, or t
  misc_feature (2496)..(2496): n is a, c, g, or t
  misc_feature (2583)..(2583): n is a, c, g, or t
  misc_feature (2589)..(2589): n is a, c, g, or t
  misc_feature (2625)..(2625): n is a, c, g, or t
  misc_feature (3674)..(3674): n is a, c, g, or t
ggataacgaggctacccagcgcgcatcggattctttcaaattcagggaatccatcaacacatagaggtcgccttccacttcgtcgacgggcagcagatgtcgaaccgccctcgcaagcaactcgcgaaccaggaaggcttcgtcgggtagtccggcttccgaaatgacccgaacgtaagaatgatgcgaccaaaagtcgcgaagggtcgaacgaattgaatcgtggcatggatggcgctcgatggccagtgtcatctgcgaaaggttttcggttcgcgattccgcgggcacattcaggatggtgcggagcaggccatacacacgggtggcccgctctcgtgtagagagagactcaagattggaaagactatctattgcngaggtaatactggctccatctcgcccgaaaaaagaatatgcctacgtataggaacagcaggataattgaaatcgagaagtcggggtcaatttcgataataagtgccgcggtgtancaaggtctctacgccttcgaccacgcngccaatgttacctttatcncaanccccgcgtattcctgctcttctggcctggtcggcaagttgaggggacatatgcaatgtcaccataagaatcggaacttccggagagcgtcgcgtgatttccttggcagcgtccagaccattcatctcgggcatttgaaaatcgaggatgactaagtctggcgatgtttgctgcactttgtcgattgcttctcgaccgtttgacgcctcacaacagacctgccatgaacnttgttgttccaacatttttcgcaggcannnnnnnnnannngnnnnnnnnnnnnnnncnngnntnngnnnggnnnnnntttttnncnnnnnnncnaannanncnnnacctcaacctacgagccaggcttaagcctgtctataccccgcatcgcgtaggttgataagggacttatcaactttcctcgattctcctaacggtttatgggtagtgattaggngatatccgccagaacgncaaaaaggacttcggcaaatgcaggctagtggcccgtgaagaactcggtcatatcaggcgcgactcctgctaaaccgggaaagctgttcactccagaagcggcgaggacgaggcgcagcacgctttgatgctggtaaaccgccttggattgaaagccccgcttggctgnggaactgatgatgagggtagcgacttgcccgccaccatggctaatatcagaccgatcgccttcatcgaatgtgatgatgagcaggccgctgntctgaaactcagaattggagattagagggccgatgttagcttgcagccaagagtccgcctgggcgagtgtgccgtcatgagcgtcgtccatggtgttgggtgtgatgaaggaatattgaggaagagtattattcgccagatcggttgcgaactgcgtaaagggaacaaccttggcggcctgggaggcgctgtcctgcacgtccgataggtaagtgaccgggttgtggcgacgcaagtagacgccagaatcagcacccacataaccgggggaagggagcgattcagcgtaagccttccaggtcttgccggctttcaccaactcgcgaacaacgttgtcatcgttgatggtgccggagaagttgtcgtcgagagtttccatgaggcccgtagtgagcatcaggtaatttggaatcgagggatgcgcgtcggcaaaatattgagtggcgagtccatatttcgaagccagactgttgaaataaggcatggaggaatttccgattacgtcggagtagctgtgattttcctccaccaccagaatgacgtggctgaaagcgggttggttggccgaaacgggggtttgaaccggaagggggccaactcccttaccacctccgccacaaccgaacagaattgaagcgaaaccacaaacagacaaaaangcgataacagtcttgagcctggacaagggtttaggctttcagtaacacggattnctntaaccgcttngatgtggcaaggcggcgaaatgtttacaagaaacgcagctacttgccctggtgtgccggatctgattgcgggctgaggtcgaggccaaattgaggatgcccataggttccggtgatatggatcggtaccacctcgccttttttctttttcttgaagatcgggtcgatagctttcagaaataacgatttcacaccggttgttgtntttgagatcttggtgtccacccgcattcggccgtgcagatcgattttttcgtttatgagattgtaggttccatacatgcgcgctttcgcgccaggaatgccgaatgaaagatcggagaattgggcgattccgccatccagcgagactcgtcctttcagatcagtcagaacagtctcggcatcgtccattttttcgcctctcgcgccagcgctcaattcgttcacgttcttttgggtctccggttttgagaagctaccgtcgtcaataccaaaagtgccttgcaacttgaccttttgnaggaaagattcctctccagggggaatctggaccttggcccggagtgcgatcgctccggacatgggcgacggacggctgttgacaaanaagccnaggatgtcctcgatttgtccctgccgagcatttagntcgaggagcgcagactttcccttgctgcccttggtgcctgcaacactgccttccacgatcagtttagttctaccgaaacggccttcgattcgtttcaagaacgtatcgccatggatggcgtctacaaatgcgttgtaccgggtctcgagtttgaccttgtggccgcccatcttcacctcgaaatcgggaacatcggtaacgcctgcaatgtcgatgtgcttaagtgctccgctgtattctcccttggaggacagtattcccgcgatgcctccgtaaacgccaaggtcggcgtgttcaaaggtatattcgccagaaatcggagtttcacccggcttgcctcttgtccagactccaaatttgccgcgggtagaaatttccccaggaggctcggggttatgaaacttcagttgataatccataggtcgatcccaccttacatcgcgcacgtccgcatcatggacatcgaagcgcagtggttgtttccgcggatcgtcttggaagaactctacggtcgttccgttggccacaatttcgtcgacgacaatgctggagtgctgcgtctgaaaggtcacgttgctgccaaagggcggaatgaatacatgaccgccttcggctctgatgcgcggaacttgtttcgtcagaatgccagaatagctgccctcaatcgtcagcttgtcgatggtaatcagagtccacttatcggggccatggtgaaactcaacgtcttcgagaatgcatcccggagaaggaaaataagtaagatgagaacctcggatcgtcaccgtgctgtcgctggcttccgccagatcttccacgaccgccttctcggtaaagggccaaacgcggctccataagatggcgagacccgtcgcgacacagatcgccacggctgcaatgatgatgatgactcgcttcccgcgggagaattttggcgatgattgatgcaccgccgggtttcgaagttccgggggcgaagcggcattcgttaggacaggtgacgacatcaatcttggactccgaaatacccgtgaaatgttggtaaattagtngatgatttcttaagcaggcccgctacgtttcttgcgggcagcgcttttcgcagttgaccttttgctaggagaagcggccgtcgaactggctactcgtctttcactagccggtttggcaatgcgctgctttgtcgcccgactttggcgagcgatgattgtcgctttcttgactgaccggggccttctggagccaggcttcggcggaggttgggactcttttggtctcaagtcgtttgtgagaatgtgagccatgttcgccagggtgccggcggcttggcccaacttgcgcgccaccgagtttagtagaggttcctgctgcgtcgatt

SEQ ID NO: 265 - DNA, 4000 bp, Escherichia coli
  misc_feature (1)..(6): n is a, c, g, or t
  misc_feature (11)..(11): n is a, c, g, or t
  misc_feature (16)..(18): n is a, c, g, or t
  misc_feature (23)..(23): n is a, c, g, or t
  misc_feature (25)..(27): n is a, c, g, or t
  misc_feature (31)..(31): n is a, c, g, or t
  misc_feature (37)..(37): n is a, c, g, or t
  misc_feature (51)..(51): n is a, c, g, or t
  misc_feature (148)..(149): n is a, c, g, or t
  misc_feature (151)..(151): n is a, c, g, or t
  misc_feature (171)..(172): n is a, c, g, or t
  misc_feature (178)..(178): n is a, c, g, or t
  misc_feature (199)..(199): n is a, c, g, or t
  misc_feature (515)..(515): n is a, c, g, or t
  misc_feature (833)..(840): n is a, c, g, or t
  misc_feature (843)..(844): n is a, c, g, or t
  misc_feature (852)..(856): n is a, c, g, or t
  misc_feature (860)..(860): n is a, c, g, or t
  misc_feature (864)..(864): n is a, c, g, or t
  misc_feature (868)..(868): n is a, c, g, or t
  misc_feature (873)..(875): n is a, c, g, or t
  misc_feature (878)..(878): n is a, c, g, or t
  misc_feature (880)..(881): n is a, c, g, or t
  misc_feature (885)..(887): n is a, c, g, or t
  misc_feature (892)..(892): n is a, c, g, or t
  misc_feature (895)..(897): n is a, c, g, or t
  misc_feature (900)..(900): n is a, c, g, or t
  misc_feature (1989)..(1989): n is a, c, g, or t
nnnnnnaaacnccccnnnaaccnannncccnggaagnagcaccttgacttntacatccgccaatccaccaattcaccaaccgggaattaacccgctggcgcagcttctacggggtttcgccatagattttttaaccgcgcataataanncngttgtagagcgcatcatggnnccaagntaccgcctaaatattggcggngtagtgtttgatgggcgcgacgatgaatatttacccgcaacagctgcccagcttgagcagtttccggggctcaacgtcactgtgcacgacgttgtcattggagagaacgcaatagcaatgtgctttaccgagcacggctcgtcaattcaggatgaagggcacagggcagcctggagcggcatcaccttctttttcacagacggcgagcgctttgttaccggttgggctgaagaagaatatatcgcgagaaaacggcaactaaccttgggccaatgcgaagggattgagccaccccatatcgcgccatgggatacanaggcgcaagccagtaaccccgaaaacgaagcaattgttcgtcaatggatagcccatagccacccgttaaaggacatcccgaacaatcatcgcctatcaccactggaccccgacccagacggtcttgtcgatatccgaggctctagggtaaatgcgctcttttcagcgggggatagggtagtggttcacgccgagtatcacggtatttatgctggcggatttggggacctatctccgctattaattggctgtcaagctgtactccgctttgccgccatagtcactattaggagtggcgagattatagcggctcgaattnnnnnnnnccnnttggggcnnnnncgcncccngagnggaannnccngnnttcnnnttttnttnnnaangggggctttgcgcttgctggccgccaccttctttttctgcacacccgctttaggcggtgcatttttagcagttacagattttttcttagcaaccgccctcttactcttagcgggattcttgtttgatccacgcttggccgcatcggttgccgcaaaagcaccgtcggcaggtgccgaatcaatcatcccagccaaagctccggactgcagacctgccgttacgagatcggcaaacatggcgcctatttgttcggagggcacttttgtctttccgggaacaaaccagcgattagtccagttgagcataccgataatgccaaagcccactatcctcgctgggccaatattgcgaaaacttccatcacgatagccctcttcgatgatcgcagttaccgcctcatcgtagtcgtggttgattttcttcatttgtttagcccaggcggaacgcttgtctgagacgtggttcaagtcctcacgaatgtagatataaagcaatggataggtcgccgtataagacgccattaactccagaatcagggttctcagcttctcgcttggcgatacatcgctttgctgtaccgctttcgccttttcgacgttatcaaccgatgcctctctgataacctcatcgaataattcgtcttttgacgaaatgtagtaatagatggaagcgcgatcaatctggagctcctcagccactgcgctaatcgttgtgccctgaaaccccttctcattaaatacccgcgccgcagcaatcgctatttcttctctgcgtcgctgataggtatccgatgactcgggcttagctttggctgctgcacgccttttaccgatattacttgaattctttgtcactctaccgccttagaagtctgttaacgcactgttgaccataactctagcaggccggactctttatttcgctcttagtttgtactgagacaagtagcagccgtaagagtcagacgcgccgtcatttaagcgactataaatcacgcactggccaaaaaatacgactataagacagccatgtatttttgtcatcagcactgttgacatcttgttctaccgccattattgtcaacggcnatgttgatattattcagatgtgcggtccagtaagtacccatacataatgcgagagtaaataataatgaagaattctatggttagagtgttacatagcgcagtgatctgcgcgtcgggcctagcagccagcagcacctgttatgcccaagaaagcgagacagttctggcgcttgaagaagtcgtcgttgttgcacgaaaacgagcggagaacctacaagaagttccggtatcaatcacggccctcaccggcgagcagctcaaaaatcaaggtgtcttcaatacctctgatcttaacaactccatgcccaacttaaacgtaagctcatcctatggagaaacacaaccgaacttcaccattcgcggcattggtgtgggtactgaatataattccaacgcagcgtcacccaatggcatctatgtcgatgacgtttatcaggcgtttcgcgccagccacggccagcagctttatgatctggctcaaattgaagtcctacgtggcccgcagggaacactttatggccgaaacacaactggcggtgcgattaatttcaccacgatgcaaccacagtttggtgaaacacaaggctacatcacagctggatacggcaactacaaccgcttcgaaactacgggcgccatcgatttcactccctcagagaatctggggattcgaattgccggcacctacaccgagcgtgatgcttacatcgagaatcggctgccagcgggcccagttcaggtcaacccaaacttaccaggcccgtcttatgggtatacaactgagggacgagattctggaggtggcgacactttcgcgttgcgatttaatgcacatttagatttggacagcctcaatgtgcgattcaaagcctatatgagcgaagcgagtggcgaccaagacagcccccagaaccaaggcgaaggtggctttatcgcggtgtcgcgtggtgcgtttggcgggctatacggcatagggttagacgactttttaccgcccgcatatcctggtgatcgcgtgaatgatctagagatcgaggccgatactatcggtggcgctaaggttgagtccgacggtgtcgtgttaaacgtttcttacgatatttcagacacgatcacactgacatcgataactggatttgataacagctactacggacttctgcccaacatcgattgcgatggcaccccctactacgtttgcgcaatcggttatgagtctgatatggaatcctttaaccaagatctccgcgtgaattttacgagcgaccgcctaagtctgatcgtaggcttgtattacggggacgatgagattgttactaacaaccgacccaatttcttcggttttttgagtgacaccaatgccgcattgggtgcaccgacgacatactttaatccgggcggtgcccttggtttgggattaccgacaccgtttcgcgcaacacaagattacactcaaaagcgtgagtctttagcgatctacggggaagcgacctacgatgttaccgacaagctgtcagtgactgtgggcttgcgcagtacgcaggatgattttgcctacgtcgatgcactaaccaccttctttgatgatgccggcgacgcgcgcgcctactttgtttctgattatctgcctggtgtggcgaatgggttctatttattagacgaagcttgttcagctgacggtgcaacttgtgtcccagctagcaccggtacagcaggaccactcaaccagtcagatgactctaagcaaacaactggccgagtgatcgtagactacaagcttatggatgacgttatgttgttcgcgagttatagcaagggatatcggggcggtacgtataacggtttagctttccaaagtgcggcgcaggtttacttcgtggaaccagaagtcgtggatgtgtttgaagcgggctttaagggtcgcttcatgaatgatcgcattcaattaaacgctacagctttctactacgactacgaaggccagcagcaacaggtgatcgaccccagctcc

SEQ ID NO: 266 - DNA, 4000 bp, Escherichia coli
  misc_feature (1586)..(1586): n is a, c, g, or t
  misc_feature (1990)..(1990): n is a, c, g, or t
cgccgccgatgtcgacgggatcgagcaacgccacgggcgtcagcgcgcccgtgcgcccgacctgaatttcgatggcgcgaagcgtcgtcacggcgctcatcgctgtgaatttatgcgctatcgcccatcgaggttgcctcgcatccgcgccgagcgcggtttgaagttcgaccgagttgaccttgtacacgacgccgtctatctcgtacggcatcgtcgggcgagctatttctaaagcatcgtacgcctcgatgagctcgccgatggttttcgccacgcctaaaaatggtacggcgtcaaagccttgcgctggcaagaacgcactcaagaactcgctctgcgtccgccacggagcgtttgtctcctcgtttgacgcgccgacggcgccccaaccgtacgccaaaaaacgcaacggcatttgattatcgtcgacgacgagcgttcgcatcgctcccgccgcggcgttccgagcgtttttgaagacgcgcaaaccagtcgccgcgcgctcggcgttcactcgttgaaaatcttcatcggccacgtgcacttcgccgcgaatctccaacaccgccgggtacggctccgccaacttcatcggcacgccccgagcgccgatgaggtgtcgcgtgacgtcttctcccatctcaccgtcccctctcgacaccgcgtacaccaactcaccgttctcgtatcgcaagctcgcggaggcgccgtcgactttcggctcggcgcaatattcaatcgccgtcgtcgtcgcggcctcgccctccgtctcccctctcaacttctcaacgcgcttcatgaacgcctccacctgccccacgtcgaacgcattccccaacgaccgcatcggaaccgcgtgcgcgatcttttccagcccactcgctccgtccggcgtcgcccccacgcgcgcgcgagcgccgcccgccttcgccgccgtcggatgcgccgccgcgatcgcatcgtacctcgcccgcatcccatcgtactccgaatcgcttatcaccggttccgcgtcgttgtaatactttccatcgtgcatcgcgagctcggcgtccaatcgagccaactcgcgcgccgcctcgctcgcgctcaaccgctcgacgccgttcgccgcgaacccgcgcgtcgtccctcgtccgctcgcgctcgcgcctccgtcccctccccgcgcgcgccgcgcctctccatcgtccacgtcatcgcttcgcgcgtcaccgatcgcgcgcgcgcgcgcgccggcgcggtaacgcgcgcgtctcgttcgaatcgaatcggcgcgcggcgtcccgagttcgcgtcgctcgcaccgcgcgcgcgccgccgggaccgcgctcgccgcgcgcgcgcccgccggcatcgcgcgccacgcctcgatcgcgcgcgcgacgctcgcgccgagcgcgcgtcgtcgcatgcacgacgcgaagtgcgcgcgatgccgcactcgatgccgcgcgacgtcgcgtcgtcggcgtcgtcgcgcgccgcggcgaagaaccgcgccaagcgcaagcgcgcgaggctgccgccgccgcccgccgcgcgcgcggacgcccgggatgacgacgcgcgcgcggacgagngcggcgaggatgacgacgcggtcgtcgcgcgcgcgggcgcgttcggacgatacggcgccgccgacggcgcgatgtcgcgcgcggacgacgagtgggcgacgagcgagcgcacgtgggcgtcgctgttcggcgtgctcgagcggaacgggtacgcgaagaagaaattgtgggcgccgttcgtgtacgacggcgacgcgggacggcggatgcgaagcgcgggattcgaacgcgtggtgcacagacgggcggatttctttgaacgcgtgcgagacggcgtgttcgtgcggtcgctggatgcggtggtggataatccgccgtacacggggaaagggatgaaggaacggatattgaaggcgctgcgagacgcggaggtgccgttttgtttgttgctgccgctgggagtnttgcacgcggcgttcgtgagggacattctggaggagacgcacgtgcaggtgatcgtgccgaggaagtgttacgtgttcaagaagggagggacggaggtgccgtttaagtttttgtgctggttgtgctataagatggagctgaagcgcgacttgtacttcatagactgacgacgtaggggtacagtagggattttgtattttacacacgttgttgtaccgactaactcggagggtgcccggcgcaaagcgaacgatactcgcgacggatcagtccgtgtccgatttcgaggagtaaatcgttaaagcgatagagcacgccgcacgacgtcgaatcactcggcggtaagactgaaatgcgtctgagcgtttcgttcggggcgaacatcgcggtgagggtgaggaacagcaagacgaccgaaacgatgatgaagaacgtgacgagcatttgtacggcttcgttgagtgtctctggacgcgaaggcacgcgccacgaaccacctggcgttcgcgtcggtgccgtcggcgtcgccaaggtgaacttattgaacaagttgtttggcggcgtgcgcgccaccgttctgttcgtttgtcgagagaaccattttaacggagacgccaactgcgtttgcatgagtggcgacccaaacgatctgctcttcttcggtgaaatcaatgaagggctgttattttgatagcgagcgagctgcgtccgagcgtgttcgctcatcttattcgccgccgccagggcttccttggacgctttcaattcagcttccgtcgcggcggagtgtttttccagccaaactttcgccgcgacggcatcggagagttgcgactctaagtcgcgcgtcatgctcttcgcttcgtctcgctcagcgcgtactttgcgtaattcgtcgtagtcgccctcctgcgtcatcgacgcgtcacgtctagcggtggcgagcaactcgttcgcgtgctctaattgatgctgcaagctcgtatagttggctcgaagctcggaaattgattctcgagcttgtgataactcgtgttgtttatcgtccagcgctttgctcaacgcctcgctggcgtgatcgccgctcgcagacatttgtcgaatagtatcaagctctttacgaatcaccaacatctctttatccttcgactgcaccgcatttttcacagcattcttcacttgcgcggcaaacgccaagcgttcaagttctaaacgtttctccatgctcgtgattgactgctggagcaaatctcgctcggcggtgactttcgtcaagtctatggtcaagtctttcactttcgccaacgccgcatcgcacgaagccttggcttccctcaactcgcctgcatccgtctttgaatgctttttcgaagcgactttttccttttccaactctttgttcagcaaaagcagttcggtattcacttcgtacactcgagattccgccgcggcaaattgacgtcgcacttcttcgagttcagtctccaccgtgactcgcacttcgcattcagccttcaaacgccgctcgctttcgtccagtgacttcttactctcctctgcgctcgccttccactctcccagttccttggcgagttcgactattcgactttcagccgcctctaactttctatgcaattcagcgacgacggcggacgacgagtcgcggtcgcgctcaaccttcgcagaggacgcatttttctctcgcaaaatttcaatctccttgttcaaaaagccaacttgcttttccaactttgtgacttgcgaattggcgatcatgttagcctttgccgccatggaagattcaagttcgtgctcatccgccatcgatgaaatttcttgctcagcgacgtgcagcttttttctcagctcttctgtctccgatccggccaaatctgcggcggtttccaagcccgctactttcccttctaacgacaaaacctcttttctcgcactcttaagttctaaaacgtgctctgaacgttcgacctccatgagttttagtttagcgt

SEQ ID NO: 267 - DNA, 4000 bp, Escherichia coli
  misc_feature (211)..(211): n is a, c, g, or t
  misc_feature (262)..(262): n is a, c, g, or t
  misc_feature (974)..(974): n is a, c, g, or t
  misc_feature (1986)..(1986): n is a, c, g, or t
  misc_feature (1989)..(1989): n is a, c, g, or t
  misc_feature (2456)..(2456): n is a, c, g, or t
  misc_feature (3137)..(3137): n is a, c, g, or t
  misc_feature (3175)..(3175): n is a, c, g, or t
  misc_feature (3227)..(3227): n is a, c, g, or t
  misc_feature (3849)..(3849): n is a, c, g, or t
attgccttcccaacaggatgtagctaatatggctgggacgactcgagaaactgtgtcacgtacctatagattaatggaagaggatggctatgtcaagcgggagggtcggaagcttgttatcttgtattttaaacggttcttgagtgatttttcctgaatcaggattcgtaacatccccgacatcatatccctaggttttgatcatattggnattttcaggacaacttctctggtggaataaagtgataccctaacttatatnaaaacctcgtcaaccagcgttttgtttatagacatttaagatagttggagcgtaatattgcgctgcttgaataataactgtcctgggtaagagctatgaaacacgttctaatcagtttggtactttttacaactgttatttttccctctcgaattatttctgggcagaattcaattactgcccataccatctcagacagtgctcatgaggctcgttctatctttgcagccgatgtagatggtgatggggacatggatgtgctctctggtcattataacattgcctggtatgaaaatgatggttctgagagtttcaccccccataccatatcaacatcggcggcttcatctgtttatgcgattgatttggatgatgatggggatatggatgtggtggggtcatccgccggtagtgttgggtggtatgagaatgatggttctgggagtttcgccacccataaaatctgcaatcattattatcatcgcgagttcagatctgtctatgcattggatgtggatggtgacggggatatggatgtggtgacggcttcatattcgcccaatgacaagatcatgtggtatgagaatgacggttcacaatatttcaaccaccatatcatcgcagacagtgtaattggggctcgttctgtctctgcagccgatatagacggtgatggagacatggatgtactctctgggcataataacattgnctggtatgagtatgacggtttagagagtttcaacactcataccgtcgcaacctcaggtgtttcatctgtctatgcggtagatgtggatggtgatggggatatagatgtggtaggatcatctgctggtagtgttggttggtatgagaatgatggttttgagagtttcaccacccgtaccgtctcaacctcaggagcttcatctgtctatgcggttgatttggacggtgatggggatatggatgtggtgggatcatccgctggtagtgttagttggtatgagaatggtggttcagagaatttcacaactcatatcatcacaaccgctgcagatgatgcacaatctgtttatacagcggatgtcgatggtgacggggatttggatgtgctatctgcagcactcggcgacagcaaaatttcctggtatgagattaattattcccctgttgctaatgatacagctataacctcgagcgaggatagagattacactggaatgttatcagcatctgactctgatggcgatgcattaacatatagtatcataattggtccagccaatggaagggcgacagtatctgataatgccacaggtacattctcgtaccgcccggtggaagactatacagggctggacagccttatatttagcgttaccgatagtgtgctttcggatatagcaacggtttcaattacggttactgcagtaaatgatgcgccagtagcggttactgcagcagtgacaaccgaggaagatatggattatggtgggttagtatctgcttttgatattgataatgatccattgacttacagtctactaactgagccatcgcatggtacggtagctattactgatagctcagctggtacatatacctacagtcctaaagtaaattataatggcagtgattcatttacctttactagcagtgatggtacgctttcggatacatctaaagtttctattacagtaactgctgtaaatgattctccagtagcgtttgcggaaagngtnacgaccagtgaagatacaaaatacagcggatcagtatctgcttctgatgtagaaaacgatatattgacatataatattctcaccaatccatcaaatggtactgtatcgattaccaacagttcattggggacatttacctacagccctacgataaattataacggagatgattcgttcacattcactgccaatgattataattattcagatacagcgacggtttcaattacgatcactgcgtggaataattatgcgccagatcaattaccagcagttcatttgggtaatttacctgcagtcctacggcaaattataacggtagtgtgtccaggtatttacctatataagatacaaactggtgaatacatgcggaccaggaaaatggtgctgttgaaatagtttcattaaataggtaaacaacatcaagccccgcccacttgtccagcgtaacgcagtgcagatggagnggggttttttgtttatggacatttagtactggcgggttgtaatattgctcttcaaggagggtgaaatgaacgaaaattatgatttcgtaatcattggtgccggttctgccggttgtgtgctggctaaccgactgagtgccgatggtcaaaatagcgtattgatcctagaagccggccggaacgataaaaaacaggatatacatattcctgctggtttcccaaaacttttcaagactgaatttgactatgattacttgacgacaccacaggcaaccatgaaggaccgggaattgtatctgccccggggaaaaaccctggggggatccagtagcatcaatgccatggtctatatccgtggcaatcgacaggattatgatgaatggagtgccctgggcaatgagggatggtcgtacgatgaggttcttccatacttcaagaaggcagaaaaccaggaagtgatcaaggatgagtaccatggtcagggtggaccactgaatgtaaccaaccgcaattacaccaacccgttgtcagatgtattcgttaaagcagcgcaggaattggattatgatttcaatcctgattttaatggagcgcagcaagagggattcggatattaccaggtaacccaaaaaaacggtgcccgctgtagtacggctgtggcctacctgcaccccgccgctncccgcaaaaacttaactattgaagtcaatgcgcaggtngagcgcatcctgatcgaaaacgaacgggtaactggtttgatctaccaccggnatggagaagcacacgaagtacaggccaataaggaagtgctcctgagcgcaggagcctacaacagcccccagatcctgatgttatctggcattggtgatggagaagaattaaaaaagcatggaatatcggtagcaaagcatctacccggagtgggaaagaacctccaggaccatatggtttatttcactattttcaattcgagctacaaggattctctggattcagcagaaaacttccctgtggtggtgaaaaacttgctcaactaccttcttttcaaaaaaggaccatttaccagtaatattgccgaagcgggtgggttcgtccagtcttctccggatcaacctgctgtggacacacagttccactttggacccaattactacgtagaacatggttttagcaaccctgaaacaggcaacgggtattctattggaggtgaattactgaatcccaccagtaagggaacagttacattgtcatcctcagattttaaggccaaccctgtcattgaccataattacctcagtactgacgatgatgtacaacgatctatctggggatacaaggttacagagaaaatcggtttagccgaggccttcaaaccttatcgttctggttactntatgccggaagagccgctaaccgatgataacgctattgaggatctgattcgggaaaccggagaaactctgtaccatcctacaagtacctgtaaaatgggtacagatgatatggcggtggttgatccagagttacgggtgcatggccttacg

SEQ ID NO: 268 - DNA, 4000 bp, Escherichia coli
  misc_feature (282)..(282): n is a, c, g, or t
  misc_feature (1127)..(1127): n is a, c, g, or t
  misc_feature (1354)..(1354): n is a, c, g, or t
  misc_feature (1385)..(1385): n is a, c, g, or t
  misc_feature (1944)..(1944): n is a, c, g, or t
  misc_feature (1988)..(1988): n is a, c, g, or t
ttagcttgctgtaaagcaggtcatccctcgtaacttttatgtggcatttccctcgattcaagctgcggcaaaacgatgagcgtaaatgcggttgaaggacgttcaagcctgcgctgagacatataaaagcccctaaataagtatctgcataagatcacaatagtgatcgatacctgtcgcgatagagcctcccagcaagcagaatttcataaagtacagtgcctcaaagcaccgttgaggcggcgtgatattcgccggaaggatcaagacttgggtggggtncaaacccagatagtatcttttgggcgtcaaatgacaaaactgccgctgttttgataacgcgcattcaaatggacgtcacaaggatcagacaatgcttatactcgagctgtaaaatgggctcgcagcgtcaattgagtttgacatagcaatcccaaaatgtagggttttgaggggaagaaaaagcttattggtttttgtgatggcacgcccgtttgatttattattgtccgagcttcggactgtttatgaaaaccatcaagagctgacggcttttgcgccgttctgccaagatgtcacgactcagaagatcgaaccaaaaccattgctatgtggacagggattggcacgtgaaaaaaatgaattttttgacacgcaatatcagccactttgcgaggctgtggtggcagcaggagcccaagcgcgttggcgcgaaacctataaacataccaaggtcgggcaagattttttagatcgatttgggtgctttacaatcattggtcccgaaggaggctttcaaagcggccaactttgggcgtgggccgtatatatgccaccccatctatattacccctggcacgagcacccagccgaagaaagctatttggtgattgctggtgaggccgagtttatgcgggctgggcaggcgccgcgttttttaaatcccggagatgttatttttcacgccgcgcagcaaccgcatgctttgcaaacgcatgaagctggggtgttggcgctggtgttttggcgcaacggctttgggatcttgcccgtgctaagcgaagacccgtcataaagcgcatcagaagctgtaaggcctttcttatatcagaagatgaattggattnttaagggtcacgatcctcaagatggtgcatgggataaagccgatgcatcagcctgataacccagatgcaagcctttcaggttggcattgattgtgctacctcctgtcacaaataggctgaatggccccgtggctcaactggatagagcagccccctcctaaggggcaggttgcaggttcgaatcctgccggggtcaccattttttataagataaacgttttatgctnttttaacgtcataggttaaatatgaagaggnttcttagagttatttctttgactctggcgcacttttgttacgcgccgcatattgtttgatgaacgggtttagaagtatcgccaaagtcacacctattagaacacccacaaaatccgcccaaaaatcagagaaatcgccaaaccggtttacatagggttggatgagttcgatagcgccgccaaaaagcagcgcgaggggtgcgatcacgaggccggttttcagccgcaccatcagcataggcattaccagcaaggcaaagcctgcggtgtgaagtagcttatcggcaccctgaggggcaagtttgcccgctccgggtgttagggtcgtggccgcgatcacaacagcgatgcacagcgtagtaaaaagggcaagattttgaagattaccgatgcgttttataaatgatatcatagcgtgacccgacttgagtagatgctttatcggatcctaagctgactgtaaaatgccctatatttatcttttggcgtttaaggccttgatagcagcacaagcggtttaagcctgcaggctcgcggatgcgctgttacaacggtttganatctttaggggttgccaccgtgttgtgaaaactttattcacganttcacctcggggcgcctttttggctgagacgcattttgcgaacccgtcgaacctgaaccggttaagaccggcggaggaaaggtcagcttcatgctacacgctctccgcccgtcgcaaatatggagagaacatgaaatacttcacattcgcagcgggtctgttcactgccagcatgacgttggcacagactccgatacttacaatttatgcaccagattattttgcgtcagaatgggggccagggcccgcgattgaggccgcttttgaggaaagctgcagctgtgacttgcagtttaaaacgggtgatgtcatgtcgcggatcattctggagggtgagcgcaccgaggcagatgccgtgatcggtctgaacacagatattacaaaaaaagcgcgcgaaacgggtttgttcgcggcccatggccaagacaatgcgcagcttacattgccgatagagtggagcgatgaaatattcctgccgttcaactatggccatactgcgtttatctacaatactgaaaaagtggccaacccgcccgcgtcttttgatgcgttggtgaattccggcgcagacttgagcttggtgatccaagatccgcgcagctcaatctcgggcttggccttggtgctctgggtgaaggcggtctatggtgagcaagcagaagcagtttggcaaaagcttgcgccgaaaattctaaccgtcaccaaaggctggtcagaatcatatgggctgttttcagatggcgaagccgatatggtgctctcttacacgacctcaccggcctatcatattgtggcggaaaacgatcttaccaaaaaggcagcgatttttcccgaagggcattatttcatggtcgagttggcggcgaaaatagcatcgacagatgtgcccgatttggcggatgcgtttttggctttcatcatgacagatcaattccaaaacataattccagagggtaattggtctttgcctgcagccctgccaaaatcgcaatggccgcaagcgttccaagacttgcctttgcctgaaaaagtgttgttctattctgaagaagaagccgcaaacctgcgcaaagagacgattgaggaatggcgccgcgcattgtccaaataagcacctcagcgctgatttgtagctttgtacttctaccgcttttggcggtttggggtcaggcggatgggcctaccggcttggggcctgcagattggtcagctttgcgctttaccattttacaggctgcgctttcggcgctcttgtccactttatcagcggtcccgctggcgcgcgcgcttgcgcgcgcgcagttttggggccgcgctgcggtgattaggctgatgggcgcgccttttattttgcccgttattgtcgccattcttggtttgattgcggttttcggtcaaaatggttggctcaatacggggttgcgcagcttgggctttggcagcttttcgatctatgggctgcagggcgtgctgttggcgcatgtgttttttaatttgccccttgccacacggatgattttattgggctgggcaacaatcccacaagagcggttgcggctggggcagagcttggatcttcgcggttttgcgcggtttcgtttgattgagtttccgatgctgatgacggttttgccctcggctgtggtggtcatctttgtgatttgtttatcaagttttactgtggcgctggctttaggaggggggcccaaatcaacgacgctggaattggcgatttatcaagcttttcgatttgactttgatttcgcaaaagccgctctgttggggctggtgcaattgggggtgtctgcattggctgccgttttcgcgctgggctttgcctgggggcatcagctgggcattgggcttgatcgtccaattgcgctgggccgccactctaccttgcaaaaatatctagatggggtggtgattggcgcggccctgctatttttaggcctgcctttgctattggtcttgggcaatgggcttggcagtgtaaccagcttgccggctgc

SEQ ID NO: 269 - DNA, 4000 bp, Escherichia coli
  misc_feature (1981)..(1982): n is a, c, g, or t
  misc_feature (1984)..(1985): n is a, c, g, or t
  misc_feature (1987)..(1988): n is a, c, g, or t
  misc_feature (1991)..(1991): n is a, c, g, or t
  misc_feature (1996)..(1996): n is a, c, g, or t
  misc_feature (2002)..(2003): n is a, c, g, or t
  misc_feature (2006)..(2006): n is a, c, g, or t
  misc_feature (2011)..(2011): n is a, c, g, or t
  misc_feature (2017)..(2018): n is a, c, g, or t
  misc_feature (2026)..(2027): n is a, c, g, or t
  misc_feature (2045)..(2045): n is a, c, g, or t
  misc_feature (2065)..(2065): n is a, c, g, or t
  misc_feature (2388)..(2388): n is a, c, g, or t
  misc_feature (2467)..(2467): n is a, c, g, or t
  misc_feature (2469)..(2469): n is a, c, g, or t
  misc_feature (2478)..(2478): n is a, c, g, or t
  misc_feature (2547)..(2547): n is a, c, g, or t
  misc_feature (2555)..(2555): n is a, c, g, or t
  misc_feature (2559)..(2559): n is a, c, g, or t
  misc_feature (2565)..(2565): n is a, c, g, or t
  misc_feature (2571)..(2571): n is a, c, g, or t
  misc_feature (2573)..(2573): n is a, c, g, or t
  misc_feature (2578)..(2578): n is a, c, g, or t
  misc_feature (2580)..(2580): n is a, c, g, or t
  misc_feature (2582)..(2583): n is a, c, g, or t
  misc_feature (2586)..(2586): n is a, c, g, or t
  misc_feature (2589)..(2589): n is a, c, g, or t
  misc_feature (2595)..(2595): n is a, c, g, or t
  misc_feature (2598)..(2598): n is a, c, g, or t
  misc_feature (2613)..(2614): n is a, c, g, or t
  misc_feature (2617)..(2617): n is a, c, g, or t
  misc_feature (2620)..(2620): n is a, c, g, or t
  misc_feature (2622)..(2627): n is a, c, g, or t
  misc_feature (2629)..(2630): n is a, c, g, or t
  misc_feature (2632)..(2634): n is a, c, g, or t
  misc_feature (2639)..(2641): n is a, c, g, or t
  misc_feature (2643)..(2643): n is a, c, g, or t
  misc_feature (2645)..(2647): n is a, c, g, or t
  misc_feature (2649)..(2650): n is a, c, g, or t
  misc_feature (2652)..(2654): n is a, c, g, or t
  misc_feature (2657)..(2657): n is a, c, g, or t
  misc_feature (2659)..(2659): n is a, c, g, or t
  misc_feature (2662)..(2663): n is a, c, g, or t
  misc_feature (2665)..(2665): n is a, c, g, or t
  misc_feature (2668)..(2668): n is a, c, g, or t
  misc_feature (2670)..(2670): n is a, c, g, or t
  misc_feature (2672)..(2673): n is a, c, g, or t
  misc_feature (2676)..(2676): n is a, c, g, or t
  misc_feature (2679)..(2679): n is a, c, g, or t
  misc_feature (2681)..(2682): n is a, c, g, or t
  misc_feature (2684)..(2684): n is a, c, g, or t
  misc_feature (2686)..(2690): n is a, c, g, or t
  misc_feature (2694)..(2694): n is a, c, g, or t
  misc_feature (2696)..(2696): n is a, c, g, or t
  misc_feature (2698)..(2703): n is a, c, g, or t
  misc_feature (2705)..(2706): n is a, c, g, or t
  misc_feature (2714)..(2715): n is a, c, g, or t
  misc_feature (2718)..(2718): n is a, c, g, or t
  misc_feature (2727)..(2727): n is a, c, g, or t
  misc_feature (2730)..(2730): n is a, c, g, or t
  misc_feature (2732)..(2732): n is a, c, g, or t
  misc_feature (2739)..(2739): n is a, c, g, or t
  misc_feature (2742)..(2743): n is a, c, g, or t
  misc_feature (2748)..(2748): n is a, c, g, or t
  misc_feature (2751)..(2754): n is a, c, g, or t
  misc_feature (2756)..(2756): n is a, c, g, or t
  misc_feature (2758)..(2763): n is a, c, g, or t
  misc_feature (2766)..(2769): n is a, c, g, or t
  misc_feature (2772)..(2777): n is a, c, g, or t
  misc_feature (2779)..(2779): n is a, c, g, or t
  misc_feature (2781)..(2784): n is a, c, g, or t
  misc_feature (2786)..(2786): n is a, c, g, or t
  misc_feature (2789)..(2790): n is a, c, g, or t
  misc_feature (2792)..(2793): n is a, c, g, or t
  misc_feature (2795)..(2795): n is a, c, g, or t
  misc_feature (2797)..(2797): n is a, c, g, or t
  misc_feature (2799)..(2800): n is a, c, g, or t
  misc_feature (2802)..(2802): n is a, c, g, or t
  misc_feature (2808)..(2808): n is a, c, g, or t
  misc_feature (2810)..(2811): n is a, c, g, or t
  misc_feature (2813)..(2817): n is a, c, g, or t
  misc_feature (2819)..(2819): n is a, c, g, or t
  misc_feature (2825)..(2826): n is a, c, g, or t
  misc_feature (2828)..(2829): n is a, c, g, or t
  misc_feature (2831)..(2831): n is a, c, g, or t
  misc_feature (2833)..(2833): n is a, c, g, or t
  misc_feature (2835)..(2835): n is a, c, g, or t
  misc_feature (2842)..(2845): n is a, c, g, or t
  misc_feature (2851)..(2852): n is a, c, g, or t
  misc_feature (2855)..(2855): n is a, c, g, or t
  misc_feature (2857)..(2857): n is a, c, g, or t
  misc_feature (2860)..(2860): n is a, c, g, or t
  misc_feature (2863)..(2863): n is a, c, g, or t
  misc_feature (2865)..(2866): n is a, c, g, or t
  misc_feature (2868)..(2868): n is a, c, g, or t
  misc_feature (2872)..(2875): n is a, c, g, or t
  misc_feature (2877)..(2878): n is a, c, g, or t
  misc_feature (2880)..(2880): n is a, c, g, or t
  misc_feature (2884)..(2890): n is a, c, g, or t
  misc_feature (2894)..(2894): n is a, c, g, or t
  misc_feature (2896)..(2899): n is a, c, g, or t
  misc_feature (2901)..(2902): n is a, c, g, or t
  misc_feature (2905)..(2909): n is a, c, g, or t
  misc_feature (2911)..(2914): n is a, c, g, or t
  misc_feature (2916)..(2921): n is a, c, g, or t
  misc_feature (2923)..(2930): n is a, c, g, or t
  misc_feature (2932)..(2938): n is a, c, g, or t
  misc_feature (2940)..(2946): n is a, c, g, or t
  misc_feature (2948)..(2969): n is a, c, g, or t
  misc_feature (2971)..(2979): n is a, c, g, or t
  misc_feature (2982)..(2984): n is a, c, g, or t
  misc_feature (2986)..(2987): n is a, c, g, or t
  misc_feature (2989)..(2990): n is a, c, g, or t
  misc_feature (2992)..(2992): n is a, c, g, or t
  misc_feature (2998)..(2998): n is a, c, g, or t
  misc_feature (3003)..(3006): n is a, c, g, or t
  misc_feature (3008)..(3008): n is a, c, g, or t
  misc_feature (3011)..(3011): n is a, c, g, or t
  misc_feature (3013)..(3015): n is a, c, g, or t
  misc_feature (3017)..(3017): n is a, c, g, or t
  misc_feature (3019)..(3021): n is a, c, g, or t
  misc_feature (3024)..(3025): n is a, c, g, or t
  misc_feature (3028)..(3030): n is a, c, g, or t
  misc_feature (3032)..(3032): n is a, c, g, or t
  misc_feature (3034)..(3035): n is a, c, g, or t
  misc_feature (3038)..(3038): n is a, c, g, or t
  misc_feature (3042)..(3042): n is a, c, g, or t
  misc_feature (3044)..(3046): n is a, c, g, or t
  misc_feature (3049)..(3051): n is a, c, g, or t
  misc_feature (3054)..(3057): n is a, c, g, or t
  misc_feature (3061)..(3062): n is a, c, g, or t
  misc_feature (3064)..(3064): n is a, c, g, or t
  misc_feature (3068)..(3069): n is a, c, g, or t
  misc_feature (3071)..(3071): n is a, c, g, or t
  misc_feature (3073)..(3073): n is a, c, g, or t
  misc_feature (3075)..(3075): n is a, c, g, or t
  misc_feature (3077)..(3077): n is a, c, g, or t
  misc_feature (3079)..(3079): n is a, c, g, or t
  misc_feature (3083)..(3083): n is a, c, g, or t
  misc_feature (3088)..(3089): n is a, c, g, or t
  misc_feature (3091)..(3095): n is a, c, g, or t
  misc_feature (3097)..(3102): n is a, c, g, or t
  misc_feature (3104)..(3104): n is a, c, g, or t
  misc_feature (3107)..(3107): n is a, c, g, or t
  misc_feature (3111)..(3121): n is a, c, g, or t
  misc_feature (3123)..(3125): n is a, c, g, or t
  misc_feature (3127)..(3129): n is a, c, g, or t
  misc_feature (3132)..(3136): n is a, c, g, or t
  misc_feature (3138)..(3139): n is a, c, g, or t
gatcctgcctgttcggcatttacgggagcaattaacactcccaacaaaaaagatatgcaaataaaaaacaccttcctcatttgtatttaatatactatactttttacgcacatgtccaatcttaatctaaacgaggttcttcgggcttatatctcatgcaggaagaataagagaaacaccgtaaatcaaataaaatttgaactcaatgtggagaataatctttacaacctttatactgagctcaaaaacgaaacataccgtccgggaaggtcaatatgttttgtcgtcacgtatccaaaattgagagagatattcgccgcggatttcaaagacagaattgttcatcatcttctggttgcgcggctggaaccatattacgaaaaaagatttatttacgattcctatgcgtgtagaaaagataaaggagcgcacaaagcggtactaagactccgaaaattttcccgacaaaataaatattatctccagatagacgttaagaactttttcacgagtattgataaaaacactctctattctatttttttaaaaggaaaatttaataaagaaacaagatctcttctgaaaaaaatgatatttcacgaccctacttcaaactactacctaaagggagatggaaatctgtttagcaaaatacccccatgcaaatctcttttttatacgccaaagaacagaggtcttccgataggaaacttaacttctcaattttttgccaatgtgtacctaaacgaagttgaccaatacattaaaagaacattaaaagtaaaacattacatcagatatgttgatgatatgatcttattgtcagacgataaaaaccagcttttaaaatggagggatgaaatcaatggttttttatccgaaaagttaaaactttcgcttcatcccggcaaagatagaataggagcagttgaaaatgggattgattttcttggatatattgtgagaccaaattatatcctttccagacgacgggtcgccggaaatttaaaaaagaaacttaatcttttcaataaaggatattatctgctttcaaacaaccaaaaacagatatcgctacccctatcttcaaacccaacagatgaagaaatagcaagaatgctcactactgttaactcatattacggacattttaaacatgccgatacatataatttaagaaaaaacctatatgaaaatcgcatgggaaaattaaaaaattatcttgaaccggtagataattatgcacacttcagaatcgcaaagtaaatttactttatacataaaacttttccaatttcaaaaatatatttatcttatggtgcacaattttccaaaagaatataaatatggttttggtcagagcataattgacatggcgtgggaaactttggataacacaataaaagcaaatatcacggaaaataactttaaagcggacgcgattgcggagatttctaaatcttttgacaagttaaaaacaaggttaagaatggcttatgaactgcggctcatctcaaacaagagttatacctacatactaaaagaaacaacaggtatgggaagggaaatatcaaggtggatgaattgggctaagagcataaagcccaaacaaagttccgcctgacgcaacgcacagcgttgctattggtcttattgttgttgttggcgttgccattgttgaggttctcgttccaagcgttcgtgctattgcctgagttctcagtagaagaccaaaagttgctcgtttttcccccaactttaaaagataggactaataagaattaagagtcttttccttatcttaataccttacaaggtgtgagggaacggattttatttgggcttttctttactgtcctaagctttgctttccaaacaaagtcgtaacaataaaatctagctcggagataatactaatacaaatttataaattactcaatattccgcctgacgcaacgcacagcgtagctattggtcttanngnngnngtnggcgnagccanngtngaggnactcgnnccaagcgnncgtgctattgcctgagtnctcagtagaagaccaaaagntgctcgtagtggtaaatgaagagctagtctggttatatatgccgtctaagtaagcgccgtctaactccttttgagaagggagataccaatctgtatctgctgactgaccatcctttgaagaaagacttaaaactgcgcatgcatttatggcatttccgcaatcaggatccgttcccgatgtaccataacttgatcttggagtggcactaaagaaatcacactttcctgtagatggggatgaaaatgaatttgtatatgaacctatacttgaactccaataaagaccggttcttgtatcctgatacacatttgctcctgaagcngagcttgttttaatccatgttgattcttctcccgtataatctgatgcgtgggcatcatcatattgaacatattgttcangngagaaatcnatgggttccattgttcctgtttttttagttctgctgtttgaataaaatgtctttcctgatacaacatcngactccgntgcngttccntccggngnccacnangnngantanaaaatnctnttccaatatgtactnnttntgntnnnnnncnnannngacgnnngngnnncnncnnngtntnttnntnttnanannaanaantnntnannnnntttnantnnnnnngnngctccggnntcnggagaaganccngncttctcngcnnctacnggnnnnancnnnnnncgnnnngannnnnntntnnnnanaannannanancnntnattatnannannnnnantattannannanananttttttnnnntcattnnttntnagnatntnngntctnnnntnntntggnnnnnnntccngnnnnannccnnnnngnnnngnnnnnncnnnnnnnngnnnnnnntnnnnnnngnnnnnnnnnnnnnnnnnnnnnnannnnnnnnntannnanncnngntaaaantactnnnntnttntnnngntnnntgnngtnnntncnnaanaatnannnccnnnttnnnngaannanaagnngntnanancngaanaatannannnnnannnnnngntgntgannnnnnnnnnnannntnnntcnnnnntnngaatcatgagcatcccgacatttgttctcttaaaggacgaaaaagaaattgatagaaaagtcggagcaatgccaaaagaaatggtaaaaacctggcttgattcgcatctttaaaaatatggaaaataaaactgcccgaatagctataaatggatttggaagaatcggaaggtcttccttcaggattgcttttgaaaaaaatattgatataacagctataaatgaccttacaaacccccgtgttttggcgcatctcctaaaatacgatactgtttatggaacttatgacaaggaaatttggctggaagaagatgggaaaagaataaatcttgaagacaataaaggtgaaaaagatttttttgataaaaaaggaacagaaaattatctggttgttgaaggcaaaaaaactcttgtcttatccgaaaaagatcccgaaaaacctccgtggaaaaaattaggcatagatgttgttcttgaatgtaccggaaaatttgtaaaagacgatacctcacttgcacatataagagcgggagcaaaaaaagtaattgtctccgctccggtcaaaggcggaacaattcaaacctttatgaagggggttaacgaatctcaatacttaggacaaaacgcaatatcaaacgcctcttgcacaacaaactgcatctcccccgtcctagacgttttggactccaattttaaaataataaaagcaggaatgagcaccatccacgcaattacaaacaatcaaaatgtcgttgacagccccccggctggagaaaaagtagatttaagaagagcccgttcttccggatataacataatcccaacaacaacgggggccgcagatgcaactacggaagttctt

SEQ ID NO: 270 - DNA, 4000 bp, Escherichia coli
  misc_feature (291)..(291): n is a, c, g, or t
  misc_feature (762)..(762): n is a, c, g, or t
  misc_feature (1766)..(1766): n is a, c, g, or t
  misc_feature (1829)..(1829): n is a, c, g, or t
  misc_feature (1988)..(1988): n is a, c, g, or t
  misc_feature (2420)..(2420): n is a, c, g, or t
  misc_feature (2447)..(2447): n is a, c, g, or t
  misc_feature (2453)..(2453): n is a, c, g, or t
  misc_feature (3287)..(3287): n is a, c, g, or t
  misc_feature (3314)..(3314): n is a, c, g, or t
  misc_feature (3365)..(3365): n is a, c, g, or t
  misc_feature (3386)..(3386): n is a, c, g, or t
  misc_feature (3488)..(3488): n is a, c, g, or t
  misc_feature (3681)..(3681): n is a, c, g, or t
  misc_feature (3840)..(3840): n is a, c, g, or t
  misc_feature (3930)..(3930): n is a, c, g, or t
  misc_feature (3933)..(3933): n is a, c, g, or t
agcttggtgagaaagcagttccagcatggatggaggttgtgggatcaaagatgcgtattttggttcacgcaattccaacccgcccaattattgatactcaagtacaagagcaactaatcgttgagctttactccaagtaatcaagtaattaaagcagtaaagatttacagcagtaaaaactaaatatcgtaagccaaccggaagatcaaatagagggtcttccagaacatacggaggaatacagtgctaattgcacaacgccccatcctcactgaggaagtagtaagcgantaccgttcacggttcattattgagccactagaaccaggtttcggttacacccttggtaattcgattcgtcgcaccttgttatcttcaattccaggagcagctgttactggtattcgagtaaacaatgcgttgcatgagttcactgccctagaaggtgtgaaagaagatctaactgagatcgtcttaaacatcaaaaacctagttttatcttcagataatgatgagccatcacttctttacatccgtaaaaatggtgatggaattgttactggtgcagatgttgcagctccagctggtgtgcaggtgcacaacccagagctacacattgctaccttaaactcaaaggcaaagtttgagattgaattaacagttgagcgcggtcgtggttacatcaccgctgttcaaaacaaacaagcaggaggggaaattggtcgaattccagttgactctatttactcacctgtattgcgngttacctacaaagttgaagcaactcgtgttgaacaacgcaccgacttcgatcgcttagttgtagatgttgagactaagagatcaatgaagccagctgatgccatggcatctgccggaaagacattggttgagttgtttggtctagcacgtgaattaaatgctaacgctgaaggtattgagatgggaccttccattcaagatgcagcattagctgctgatatggcacttccaatcgaagatcttgatctaactgttcgttcttataactgcttaaagcgcgaaggtattcacaccgttggtgagttactttcacgttctgaagcagatctaatggatattcgtaacttcggctccaagtcaattgatgaggttaaggcgaaattacaatccatgggaatgcaattaaaggacagcccagctggatttgatccaactaagcatgctaattatggaagcaacgttgatgatgaacttgtcgacgctgaagaggtctaggagagaatatgccaaagccaagtaaaggcccacgtttaggaagtggaccagcacatgagaaattattgctgggcacactagctgcgcaacttttcgaaaaaggaaagttgaccacaactgaagcaaaggcaaagcgtcttcgtccattagcagagcgattaatcactcatgcaaaaaaaggtgatcttgcagcacgtcgtcgcgttatggccagaatctctagcaaatctgtagtgcacacattgtttacagacattgcaaaaagatttgaagcccgtgatggtggctacacccgtataaccaaaatcggtccacgcaaaggtgacaatgcaccaatggcagtaatcgaaatggttgaagctggcgtgccagctaaaaaggttgcaaaaaaagcagcagcgaaagctgagtaataacgcagacctaaaataaagattatgactaaacccactcttgaagttaagagtgggttttctcgtttacgcgttgatttaacttatgacggcacncacttttctggttgggctaaacaacctgagcttcgaactattcaagaagagtttgaaaccgcnctttcaactattaccagaggtgaagtttcaacaatagttgccgggcgaactgatgctggcgtgcatgcaaaacatcaagttttacatgttgacctgccagaaaatactgaagtagaaaacttagcttttaggctaaatcaattgctaaaagcagatgtncgggtattggctgcagattgggcgccacttaattttcatgccagatttggtccgaattctcgcacctatcaatacaagatagttgatggcggaaaagtcaccgcgccttttgatcgccatgacagcgtttcctggtttcgcccacttgatatagatctaatgaatgaagcatcaaaaacattacttggtgagcatgattttttcaccttttgtaaacaccgtgaaggaacaagcaccataaagaaattacttgaatttaactggcaccgggatgaaaaaggtttggtggttggccagattactgctaactcctttggctataacatggttagaaatttagtaggagcagcagtttgtgttggtgaaggaaggtttgaaccagcatggatgaaaaaaacattagagggtcgagtgcgaatttcagatagttangtctttccagcaaaaggtttatctctnattaangttgatttcccgccggcggatcaatacttggctaattacaacgattatcaccatctgcagcaggggcaagagaatgagggcgatttctaagcggggccaggatgcggttttgacctagtcccacacctgaaggtaatctttggcctctggaaatgacccaatcgggacaatccttagcaataagaaaggcagatgctcgtgcgcacatttacacctaaagctggtgagatcacccgtagttggtatctcattgatgctcaagatgtggtgctcggacgtcttgctacccacgctgcaaacttattgcgcggaaaacacaaaacaacttttgctcctcacatggatatgggtgactttgtaattgttatcaatgctgacaaagttgcattgactggttcaaagagctcacaaaaatttgcacaccaacactctggttatccaggtggtatgacttcaactgtttactcagatttgtttgaaaaattcccaacccgcgcggttgaaaaagcaatcaaaggaatgttgccaaagaattctgtaggccgctctgctgcaactaagttaaaagtttatgcaggtagtgagcatccacatgcagctcaaaacccaaaggcatttgagttcaaacaagtttcccagatttcaaagaaataaaataggagaaaaatgtcagaggaaaatttagactcaagcactgaggcactaccaacctcatacagctcaagcacaccagcagctgctacaaaccgcaaagcaattactgctcccggtggtggcgttggtcgtcgtaaagaagctgttgccagagttcgcttagttccaggatctggtcgntgggtagttaatggcaagccacttgangtttatttcccaaacaaggttcaccaacaattagttgctgatccatttaanactgttggcgcagaaggaacntatgatgtttttgctcgcatcaatggcggtggaacatctggtcaagcaggagcacttcgtcttggcgttgctcgtgcgttaaatgaaattgatactgatgcnaaccgaccaaccttgaagaaggctggattcttatctcgtgatgcacgtgtaattgagcgcaagaagtacggccttaagaaggctcgtaagcgttctcaatacagcaagcgctaatttcttagtcgctaaaaaatctaatatggccctcttcggcaccgatggtgtacgaggtgttgcaaatgttgatctcacngctgaacttgctgttgatttagcaatcgctgccgcacatgttctaggtgaaattggtgcatttgctggccatcgcccaaaagcaattgttggacaagattctcgtgcctctggtgattttttagaggcagcagttgttgctggattaactagtgctggngttgatgtttaccgagttggcgtactgccaacacctgcaattgcattcttagttaaagaaagtaatgccgatctaggcgtaatgattagngcntcccataacccaatgccagataatggaattaagttctttgcaaaaggtggggataaattagctgatc

SEQ ID NO: 271 - DNA, 4000 bp, Escherichia coli
  misc_feature (1)..(4): n is a, c, g, or t
  misc_feature (6)..(11): n is a, c, g, or t
  misc_feature (14)..(20): n is a, c, g, or t
  misc_feature (22)..(22): n is a, c, g, or t
  misc_feature (24)..(25): n is a, c, g, or t
  misc_feature (27)..(27): n is a, c, g, or t
  misc_feature (29)..(31): n is a, c, g, or t
  misc_feature (33)..(36): n is a, c, g, or t
  misc_feature (38)..(40): n is a, c, g, or t
  misc_feature (42)..(42): n is a, c, g, or t
  misc_feature (48)..(49): n is a, c, g, or t
  misc_feature (51)..(65): n is a, c, g, or t
  misc_feature (70)..(71): n is a, c, g, or t
  misc_feature (73)..(81): n is a, c, g, or t
  misc_feature (84)..(84): n is a, c, g, or t
  misc_feature (86)..(86): n is a, c, g, or t
  misc_feature (88)..(88): n is a, c, g, or t
  misc_feature (93)..(93): n is a, c, g, or t
  misc_feature (95)..(96): n is a, c, g, or t
  misc_feature (98)..(98): n is a, c, g, or t
  misc_feature (100)..(101): n is a, c, g, or t
  misc_feature (103)..(103): n is a, c, g, or t
  misc_feature (105)..(105): n is a, c, g, or t
  misc_feature (113)..(115): n is a, c, g, or t
  misc_feature (117)..(117): n is a, c, g, or t
  misc_feature (120)..(124): n is a, c, g, or t
  misc_feature (127)..(128): n is a, c, g, or t
  misc_feature (130)..(133): n is a, c, g, or t
  misc_feature (136)..(144): n is a, c, g, or t
  misc_feature (146)..(147): n is a, c, g, or t
  misc_feature (153)..(156): n is a, c, g, or t
  misc_feature (158)..(160): n is a, c, g, or t
  misc_feature (162)..(164): n is a, c, g, or t
  misc_feature (166)..(167): n is a, c, g, or t
  misc_feature (169)..(171): n is a, c, g, or t
  misc_feature (174)..(174): n is a, c, g, or t
  misc_feature (177)..(191): n is a, c, g, or t
  misc_feature (196)..(197): n is a, c, g, or t
  misc_feature (199)..(200): n is a, c, g, or t
  misc_feature (202)..(202): n is a, c, g, or t
  misc_feature (204)..(207): n is a, c, g, or t
  misc_feature (210)..(210): n is a, c, g, or t
  misc_feature (212)..(221): n is a, c, g, or t
  misc_feature (224)..(226): n is a, c, g, or t
  misc_feature (228)..(230): n is a, c, g, or t
  misc_feature (232)..(234): n is a, c, g, or t
  misc_feature (236)..(237): n is a, c, g, or t
  misc_feature (240)..(242): n is a, c, g, or t
  misc_feature (245)..(249): n is a, c, g, or t
  misc_feature (251)..(252): n is a, c, g, or t
  misc_feature (254)..(265): n is a, c, g, or t
  misc_feature (267)..(267): n is a, c, g, or t
  misc_feature (270)..(270): n is a, c, g, or t
  misc_feature (272)..(273): n is a, c, g, or t
  misc_feature (275)..(277): n is a, c, g, or t
  misc_feature (279)..(285): n is a, c, g, or t
  misc_feature (289)..(292): n is a, c, g, or t
  misc_feature (295)..(296): n is a, c, g, or t
  misc_feature (298)..(303): n is a, c, g, or t
  misc_feature (306)..(315): n is a, c, g, or t
  misc_feature (317)..(324): n is a, c, g, or t
  misc_feature (326)..(327): n is a, c, g, or t
  misc_feature (330)..(330): n is a, c, g, or t
  misc_feature (333)..(344): n is a, c, g, or t
  misc_feature (346)..(347): n is a, c, g, or t
  misc_feature (349)..(356): n is a, c, g, or t
  misc_feature (358)..(365): n is a, c, g, or t
  misc_feature (367)..(368): n is a, c, g, or t
  misc_feature (370)..(374): n is a, c, g, or t
  misc_feature (376)..(376): n is a, c, g, or t
  misc_feature (378)..(383): n is a, c, g, or t
  misc_feature (385)..(385): n is a, c, g, or t
  misc_feature (387)..(390): n is a, c, g, or t
  misc_feature (392)..(400): n is a, c, g, or t
  misc_feature (402)..(407): n is a, c, g, or t
  misc_feature (410)..(412): n is a, c, g, or t
  misc_feature (414)..(415): n is a, c, g, or t
  misc_feature (418)..(426): n is a, c, g, or t
  misc_feature (428)..(432): n is a, c, g, or t
  misc_feature (435)..(436): n is a, c, g, or t
  misc_feature (438)..(440): n is a, c, g, or t
  misc_feature (442)..(442): n is a, c, g, or t
  misc_feature (446)..(448): n is a, c, g, or t
  misc_feature (451)..(451): n is a, c, g, or t
  misc_feature (453)..(459): n is a, c, g, or t
  misc_feature (461)..(463): n is a, c, g, or t
  misc_feature (465)..(472): n is a, c, g, or t
  misc_feature (474)..(474): n is a, c, g, or t
  misc_feature (476)..(478): n is a, c, g, or t
  misc_feature (480)..(480): n is a, c, g, or t
  misc_feature (483)..(483): n is a, c, g, or t
  misc_feature (485)..(489): n is a, c, g, or t
  misc_feature (492)..(494): n is a, c, g, or t
  misc_feature (496)..(496): n is a, c, g, or t
  misc_feature (498)..(499): n is a, c, g, or t
  misc_feature (502)..(507): n is a, c, g, or t
  misc_feature (509)..(509): n is a, c, g, or t
  misc_feature (513)..(513): n is a, c, g, or t
  misc_feature (518)..(518): n is a, c, g, or t
  misc_feature (524)..(526): n is a, c, g, or t
  misc_feature (528)..(530): n is a, c, g, or t
  misc_feature (532)..(532): n is a, c, g, or t
  misc_feature (534)..(535): n is a, c, g, or t
  misc_feature (537)..(537): n is a, c, g, or t
  misc_feature (539)..(539): n is a, c, g, or t
  misc_feature (541)..(544): n is a, c, g, or t
  misc_feature (547)..(547): n is a, c, g, or t
  misc_feature (549)..(552): n is a, c, g, or t
  misc_feature (554)..(555): n is a, c, g, or t
  misc_feature (557)..(559): n is a, c, g, or t
  misc_feature (562)..(563): n is a, c, g, or t
  misc_feature (565)..(566): n is a, c, g, or t
  misc_feature (570)..(580): n is a, c, g, or t
  misc_feature (583)..(584): n is a, c, g, or t
  misc_feature (587)..(588): n is a, c, g, or t
  misc_feature (592)..(593): n is a, c, g, or t
  misc_feature (595)..(598): n is a, c, g, or t
  misc_feature (600)..(606): n is a, c, g, or t
  misc_feature (609)..(622): n is a, c, g, or t
  misc_feature (624)..(628): n is a, c, g, or t
  misc_feature (630)..(630): n is a, c, g, or t
  misc_feature (633)..(649): n is a, c, g, or t
  misc_feature (651)..(651): n is a, c, g, or t
  misc_feature (655)..(662): n is a, c, g, or t
  misc_feature (664)..(665): n is a, c, g, or t
  misc_feature (667)..(667): n is a, c, g, or t
  misc_feature (669)..(671): n is a, c, g, or t
  misc_feature (673)..(673): n is a, c, g, or t
  misc_feature (677)..(678): n is a, c, g, or t
  misc_feature (680)..(691): n is a, c, g, or t
  misc_feature (694)..(698): n is a, c, g, or t
  misc_feature (702)..(703): n is a, c, g, or t
  misc_feature (705)..(706): n is a, c, g, or t
  misc_feature (708)..(711): n is a, c, g, or t
  misc_feature (713)..(713): n is a, c, g, or t
  misc_feature (715)..(716): n is a, c, g, or t
  misc_feature (719)..(719): n is a, c, g, or t
  misc_feature (722)..(723): n is a, c, g, or t
  misc_feature (726)..(729): n is a, c, g, or t
  misc_feature (731)..(733): n is a, c, g, or t
  misc_feature (735)..(735): n is a, c, g, or t
  misc_feature (737)..(743): n is a, c, g, or t
  misc_feature (746)..(749): n is a, c, g, or t
  misc_feature (752)..(754): n is a, c, g, or t
  misc_feature (758)..(758): n is a, c, g, or t
  misc_feature (760)..(762): n is a, c, g, or t
  misc_feature (764)..(774): n is a, c, g, or t
  misc_feature (777)..(783): n is a, c, g, or t
  misc_feature (785)..(789): n is a, c, g, or t
  misc_feature (791)..(794): n is a, c, g, or t
  misc_feature (796)..(797): n is a, c, g, or t
  misc_feature (800)..(807): n is a, c, g, or t
  misc_feature (809)..(812): n is a, c, g, or t
  misc_feature (815)..(816): n is a, c, g, or t
  misc_feature (820)..(820): n is a, c, g, or t
  misc_feature (822)..(825): n is a, c, g, or t
  misc_feature (827)..(838): n is a, c, g, or t
  misc_feature (840)..(840): n is a, c, g, or t
  misc_feature (844)..(847): n is a, c, g, or t
  misc_feature (849)..(850): n is a, c, g, or t
  misc_feature (853)..(857): n is a, c, g, or t
  misc_feature (859)..(861): n is a, c, g, or t
  misc_feature (864)..(864): n is a, c, g, or t
  misc_feature (886)..(886): n is a, c, g, or t
  misc_feature (1135)..(1135): n is a, c, g, or t
  misc_feature (1156)..(1156): n is a, c, g, or t
  misc_feature (1267)..(1267): n is a, c, g, or t
  misc_feature (1320)..(1320): n is a, c, g, or t
  misc_feature (1581)..(1581): n is a, c, g, or t
  misc_feature (1954)..(1955): n is a, c, g, or t
  misc_feature (1960)..(1960): n is a, c, g, or t
  misc_feature (1967)..(1967): n is a, c, g, or t
  misc_feature (1979)..(1979): n is a, c, g, or t
  misc_feature (1982)..(1982): n is a, c, g, or t
  misc_feature (1984)..(1985): n is a, c, g, or t
  misc_feature (1987)..(1987): n is a, c, g, or t
  misc_feature (2002)..(2003): n is a, c, g, or t
  misc_feature (2006)..(2006): n is a, c, g, or t
  misc_feature (2383)..(2383): n is a, c, g, or t
  misc_feature (2884)..(2884): n is a, c, g, or t
  misc_feature (2906)..(2906): n is a, c, g, or t
  misc_feature (2911)..(2911): n is a, c, g, or t
  misc_feature (2917)..(2917): n is a, c, g, or t
  misc_feature (2920)..(2920): n is a, c, g, or t
  misc_feature (2932)..(2932): n is a, c, g, or t
  misc_feature (2934)..(2934): n is a, c, g, or t
  misc_feature (2986)..(2986): n is a, c, g, or t
  misc_feature (3115)..(3115): n is a, c, g, or t
  misc_feature (3133)..(3133): n is a, c, g, or t
  misc_feature (3265)..(3265): n is a, c, g, or t
  misc_feature (3340)..(3340): n is a, c, g, or t
  misc_feature (3430)..(3430): n is a, c, g, or t
  misc_feature (3457)..(3457): n is a, c, g, or t
  misc_feature (3502)..(3502): n is a, c, g, or t
  misc_feature (3636)..(3636): n is a, c, g, or t
  misc_feature (3641)..(3641): n is a, c, g, or t
  misc_feature (3681)..(3681): n is a, c, g, or t
  misc_feature (3752)..(3752): n is a, c, g, or t
  misc_feature (3755)..(3755): n is a, c, g, or t
  misc_feature (3759)..(3759): n is a, c, g, or t
  misc_feature (3763)..(3763): n is a, c, g, or t
  misc_feature (3765)..(3766): n is a, c, g, or t
  misc_feature (3768)..(3768): n is a, c, g, or t
  misc_feature (3772)..(3772): n is a, c, g, or t
  misc_feature (3774)..(3774): n is a, c, g, or t
  misc_feature (3777)..(3777): n is a, c, g, or t
  misc_feature (3779)..(3779): n is a, c, g, or t
  misc_feature (3782)..(3782): n is a, c, g, or t
  misc_feature (3785)..(3785): n is a, c, g, or t
  misc_feature (3789)..(3789): n is a, c, g, or t
  misc_feature (3793)..(3793): n is a, c, g, or t
  misc_feature (3797)..(3799): n is a, c, g, or t
  misc_feature (3801)..(3803): n is a, c, g, or t
  misc_feature (3805)..(3806): n is a, c, g, or t
  misc_feature (3808)..(3808): n is a, c, g, or t
  misc_feature (3810)..(3813): n is a, c, g, or t
  misc_feature (3815)..(3815): n is a, c, g, or t
  misc_feature (3817)..(3818): n is a, c, g, or t
  misc_feature (3820)..(3820): n is a, c, g, or t
  misc_feature (3824)..(3825): n is a, c, g, or t
  misc_feature (3827)..(3830): n is a, c, g, or t
  misc_feature (3832)..(3832): n is a, c, g, or t
  misc_feature (3834)..(3834): n is a, c, g, or t
  misc_feature (3836)..(3837): n is a, c, g, or t
  misc_feature (3841)..(3841): n is a, c, g, or t
  misc_feature (3843)..(3843): n is a, c, g, or t
  misc_feature (3845)..(3845): n is a, c, g, or t
  misc_feature (3847)..(3847): n is a, c, g, or t
  misc_feature (3849)..(3849): n is a, c, g, or t
  misc_feature (3851)..(3852): n is a, c, g, or t
  misc_feature (3854)..(3854): n is a, c, g, or t
  misc_feature (3856)..(3857): n is a, c, g, or t
  misc_feature (3861)..(3861): n is a, c, g, or t
  misc_feature (3863)..(3863): n is a, c, g, or t
  misc_feature (3865)..(3865): n is a, c, g, or t
  misc_feature (3868)..(3868): n is a, c, g, or t
  misc_feature (3870)..(3871): n is a, c, g, or t
  misc_feature (3874)..(3875): n is a, c, g, or t
  misc_feature (3877)..(3877): n is a, c, g, or t
  misc_feature (3893)..(3893): n is a, c, g, or t
  misc_feature (3896)..(3896): n is a, c, g, or t
  misc_feature (3903)..(3904): n is a, c, g, or t
  misc_feature (3910)..(3910): n is a, c, g, or t
  misc_feature (3914)..(3914): n is a, c, g, or t
  misc_feature (3919)..(3920): n is a, c, g, or t
  misc_feature (3923)..(3923): n is a, c, g, or t
  misc_feature (3926)..(3927): n is a, c, g, or t
  misc_feature (3929)..(3932): n is a, c, g, or t
  misc_feature (3935)..(3935): n is a, c, g, or t
  misc_feature (3940)..(3940): n is a, c, g, or t
  misc_feature (3943)..(3943): n is a, c, g, or t
  misc_feature (3946)..(3947): n is a, c, g, or t
  misc_feature (3949)..(3949): n is a, c, g, or t
  misc_feature (3952)..(3952): n is a, c, g, or t
  misc_feature (3955)..(3957): n is a, c, g, or t
  misc_feature (3960)..(3961): n is a, c, g, or t
  misc_feature (3963)..(3963): n is a, c, g, or t
  misc_feature (3965)..(3969): n is a, c, g, or t
  misc_feature (3975)..(3976): n is a, c, g, or t
  misc_feature (3981)..(3982): n is a, c, g, or t
  misc_feature (3990)..(3991): n is a, c, g, or t
  misc_feature (3994)..(3994): n is a, c, g, or t
  misc_feature (3997)..(3997): n is a, c, g, or t
  misc_feature (4000)..(4000): n is a, c, g, or t
nnnnannnnnnggnnnnnnncngnntntnnnannnntnnnancgcggnngnnnnnnnnnnnnnnncacgnntnnnnnnnnnggnangnggaantnngntnngngngcgggcgnnnanggnnnnnggnngnnnncgnnnnnnnnncnnatcccnnnncnnncnnntnnannntanttnnnnnnnnnnnnnnncgggnnanngnannnncgntnnnnnnnnnngcnnntnnngnnnanngannncgnnnnnanngnnnnnnnnnnnncnccntnncnnncnnnnnnngttnnnnatnncnnnnnncgnnnnnnnnnntnnnnnnnnannagnaannnnnnnnnnnngnngnnnnnnnncnnnnnnnntnnannnnngnannnnnnancnnnncnnnnnnnnncnnnnnngcnnnanncgnnnnnnnnntnnnnnacnnannngnaaannngcncnnnnnnngnnngnnnnnnnntnannngnagnannnnnagnnntncnngcnnnnnnantgcncttcntgcggnnngnnngngnnanangnnnnacngnnnngnnannncgnnanngaannnnnnnnnnngcnntgnnccgnngnnnncnnnnnnntgnnnnnnnnnnnnnngnnnnncntgnnnnnnnnnnnnnnnnnangccnnnnnnnngnngnannncntganngnnnnnnnnnnnncgnnnnncgcnnanngnnnncngnngcngannatnnnnannnanannnnnnnggnnnnacnnnacangnnntnnnnnnnnnnnggnnnnnnncnnnnnannnncnnaannnnnnnntnnnncgnngcgnannnngnnnnnnnnnnnnanaaannnntnnaannnnngnnnaangacaatgacaattaacgagttngcggcagaggttcacaagaacgccgttgaccacggatggtgggaaggcgaaagaacgtttccggagatcgtggcgcttattcattcggaggtatccgaagcgctggaggaataccgcgacgggaaaccgcttctttatttcccctgcaacgctggcggcgtttgttgcgaagaggacggaagcgcgcattgcggaagccgcccttacgatccggaaaatccgaacgcccgttgttccgcgcagagcaanaagcccgaagggatcgcggcngagcttgccgacgtgattattcgcgttcttgattattgcgcgtatgccggaattgacattgaaaacgtgctggaggtaaagcacgaatacaacaaaagccgcccgtatcgncacggcggcaagaagtgttaatcatggcggagcgggtgaaccacccgccgcantataacgcgggcgggattgagtgtatcgacgcgctggaagccgcgacaagcgggcttcaaggtatcgaagccttttgcacagcgaacgcgatcaagtatttgtggcgctggaagctgaaaaacggtgaagaggacttgcaaaaggcggtttggtatatcaacagacttattcaacgagcgggcgcagacagcgccgcaggaaaggagctattcaatatgaaagagaacaaacacggcttcgagccgaaacaggaattcacnatgggcgggatcgcttggacggtcattcagacgggcgcggattgggtgaagtgcattgcttccgattgcgtcgaggaacgcgccttcgatgaagggaacaagaacgactttgccgcttcttcccttcgtgcctatctgaacggcgaattcttgcgccgtctgattaaggcgggcgcgccggaagaaatgttcgagtatttcaacatcgacttgaccgcagacgacggcttgaagaattacggcggcgatcgcgtccggatcgggcttatcacttgcgaggaataccgccttttgcgcggcaacattccggcacttccggatcgttggtggtggacggctacaccggacagcccgataaattctttcgtccgcnncgtcnattcggncggctctttgancancnncnacgcgtactacggcnnctntggcgttcgcccgctttgcaatctcaaatctgaaatcttggtatcgtacttaaacggcgagaacgcagaggaacagaagaagcgcgccgaagccgtcgatatgatgaagcatattgccgccgcgtgggacatcgacgcggaagaggttttcgggagggctgacgaatgacaatgtatcaattcatggtgaacgccttttatatgctttgcggcgttgcttgcgtcgccgcttccgttgtgatcgtctacatcgttttgaacgtgcttttcagagcgcttcggaggggcggcgggaacaatggcagatattaagatcgacgaagaattgcttttgcgcgcagggctggggatcggctacgcgttcgcgccattctttnggggcattttagaaggcgttgaagattacacgatcgaacaggcggcgcgggaaatgcaggaagaacacgacgcgcaggaagccgaagagggcttgaaacgtccggttgaaaaaacgctgatcggcgattgccggaagtgctggtgcgatcaatgcgcgaagctggaacaatgcgttcacttgcgcgaaggcgcgcttccggacggggtacgcccgttcccttgcgtcgggtgcgcggacggaatgcgcttcaagccttgtgaagaagaacggtgcgccgatttcgagcagggcgcaggatttaataacggctgacaaaacaaaaaaagagaacgtccggttgcgacgttccggacgttctcttttcctcttacatagctgtaaaaggagctattcaatattgaaattatagcattttacggcgcttttgtcaaggaagggcggcgggattatgcagagggttaaaagacgtattttttcgggcgttgtatgtgaacaggangtttacaccgtatccgatcgancaaanatcaanaangctgaaccgcgncngcgcttcaaggacgacgaagagcgcgcgcaacaccggatcggcatatcaaancggaaacaccagcggctggttaatgaaaacttttcgccgctttccttatatagtacgctgacgttcgacgacgacagcgaagttcatacattcagcgaagcgcgcagaatacgcgacaattacttccgncggcttcaaagggcttgncccgacgcgaagatcattatttacatggggcgcggcaagtctacgaaccgaattcattttcacatgatttcggacggcataccggaagaaacgatcagcggcaagtggaacgacggatcagtaatccatatncggcacttgcgcgaacacaattattataacggcgttgactacgggcaggattacacggggcttgcggattacctnttcaaccattggacaccggaacagggcggacaccgttggaaggcgacgcgcaatcttcgccagccggagaaggaagcgccgacgcttgcncttcggacgtatacggaaaagaaagcnccgatcgcgccgaagggttacaagctggtggaagcccgcgcgacnaagtggggctacatatattataaatatgtacgcgaaccggagaaaccgaaacgccggaagaaacgcgaatagcgggaacgcccgaaggggcgcaataaaaagccttgtaaatgtgtaaagttttacgaccagcnctttnccttccggaagattgattttatttattccccgtcgcccgnttttcagagatcacgaacgcgcgcattgtcaagggtgcgaagcacggcgaagccgcttgcccttgataatnaangcgngggngnnanaaangnggnanggnggngggnatanaaannnannngnnangnnnngntnnanaacnngnnnngngnanncccncngnancncnnananntttntncnttnannccnntnccccccagcggggggnggnggggggnnaaaaanaaanaaggnnaanaanntnnnnttnaattnaanaanntntanaannnggnntntnnnnngggaannaaagnntttccggnnggnttnttn

SEQ ID NO: 272 - DNA, 4000 bp, Escherichia coli
  misc_feature (33)..(33): n is a, c, g, or t
  misc_feature (1627)..(1627): n is a, c, g, or t
  misc_feature (1928)..(1928): n is a, c, g, or t
  misc_feature (1995)..(1996): n is a, c, g, or t
  misc_feature (2026)..(2026): n is a, c, g, or t
tcggcgcgatcacgcagttcctcgcataccgcntggggtaggccgccgacgccgatttggatacaggcccgatcgggcaccagggccgctacatgccttccgatcacccgatcgatatccgtgatgggccgctgcggcagttccggtagttcggagtcgtcttcgacaagcgcgtcgacctcggacacatgcagcgccgatgcgccatacaccctcggcatgttggggttgacctcgacgatgaggtgcttggcctggcgcgccaccgaactcgtgtagtcgttgttggtgccgaaggtgaagtatccgtgctcatccatcggtgagacggtcacgatgaaggtatcgaccggaatggattcggcgaacagccgcaccgagccgctgaacgaggtcggcacgaagaagacgaccttgcgtccgtcctgctcgccccgcttgatcagctcacgctcgggtcgttgcaaaaacattgagtacggctgcaggcgccccatcaggtcgtagcgaaggacggtgtcggccatcggggtttcggcgtggaagtagtagagcttgacgcggtcgatctcgccccggccagcccgggccgccaaggcgcccagcagcgcgcgcggttgactggcggcctggccgatcgcgaccgaggaccccgacgtcaccgcctgaatcgcggtgtcggggtcggtgagcttggcgtggtagatgctcgcagtgtcgggcgatgtggcggtgctcatcagtagttggcctcctcggcgggtgaacccgcgcgcttgtagatcagcatggtgcgttcgaacgtcatcaccacgacaccgtcctggttggtgccggtggttcgcaccgtgacgatgccttgggtaggtcggcttttcgactcccgcttggacagcacggtcgacgttgcgtaaagcgtgtcgccggcgaacaccggatgggtggcgcgcacctggtcccaacccaggttggccacaactttggcgctgatggtcttaacgctcatcccggtcagcatcgcgatggtcagggtggaatcgacgaggagacgcttccattcggtggccgcggcgtaattggcgtcgaagtgcaccggctgggtgttcatcgtgagcagcgtcatccagatgttgtcggtgtcggtgatggtgcggcccggccggtgctcgaaggtatcgccgacgacgaaatcctcgtagtacagaccggacgtctcgcggtacacctgtggtgcgacctcgttgtaggccgagaacggcgtttgcatggtttctccttacctttctttcagtggttgacgttctgcagaatgcggcgagcgtgccgggcaacggcttcgtcaaccatcacgccggcgaccgttccgacgccggcccggttcgcctcgattacttttctggcccagtcgatttcgcgctcgtcgggcgcaaatgcggcgttgatgaccggtatctgtctgggatggatggcggcctttccggcgaatccttcggcaacggcgcgtcgggtcgcgtgctcaagcccggcatcgtcgctgatatcgaagaacggggaatcgatcacggggatcgcggcggcggccgcgtgggtcaatagaacgttgcgggcatatgcggtgacctcggcntgcccgtctgcaccgaggtcggccgacaggtcatcgccgccgagcatgaccgcgtccaccacccgtggatccagcagcgcaccgatctgggtgacggcacgtgcgctttcgtagatcaccacaacacgcgctgccttgcgcgcctgcgctagcagcgatttcaccaggccggccacggcggccgactcagccttcgggatcaccacgaaatcggggtcacaggatgactgcaacagcgcggtcaggtcttgccagccggccaaggtggccggcgcgttgatccgcagcgccgtctgcaccnccgaaggccgatcggagccaaggtaattcaatgcggcgcgacgggcctggtctttcgccgccgtggnnaccgaatcctccaggtcgagaatcaccgcngccgcgcccacctctgcggccctgttgaagtgactgggcttggttgcgggcgtaaacaacatgctgcgcggtatgtgtgtcatgttcgagctcctctcattgacaagtcgatgtcgtctccgcgggccctcaagctccgggcggcgggcactgcgtggcgacggctgcaacgcgatgaagcgttaacccgcgtgccggatcttgttgactcacaacgctctcctatgtgatttggggtaacagcaagcggtgattggtatgtcgcgcgttgcctgtagccagtatttgtctgcggtttcggcgccggctgtaccagatgccgaaccgggggcaggctgagcgcaggaacaggtgctcatcgccgttgcggttgtcggtttctaggaggttgtggtcgatgtactgcgcggccagcccgatgttcacccgctcgacgcccatggcgtccagttcgagcatcaccagcgtgcttagcacatcctggagcagtgcttgatcaatgcgcagcgcgatctcattgccgggcttggggtttcccgtgaccagccgggagttgatcaacgtttgggtgaggttgaacgccatggtggtgcacccttctgggtggggcggggcagcggaccccgggtggtgccaaacagtggtctggcaccaccggtttggatgagcggttagatgttgtcttcggccagaaactcggcgtacttctgctcgaaatcccagacctgctggaaaccgatcatgtgcacgaagtctttgaacggaatgagcggatcgcgcactggcttgccttgcgcgagcgatgcgtagacgctagccagtgcgtgactggcggcgaagagcccagcggtggggtagatcgccacagcgaatcccaattcctgaagccgggtttgcggcaggatcggggtgagtccgccgtgaagctggttggacaggaccggcacatcgaacgccgccccgatctttctcatctgctcttcggactcaggggcctcgatgaacaagatgtcggcgcccgccttggcgtaggcctcgccacgccgcagcgcgtcatcgaaacccaacgatgccagcgcgtcagtgcgggccaggatcagaaagtcctctgacgagcgcgcgtcgcaggcgaccttgatcttgttgaccatctcctcagccgggaccacgggacgatggggggtatggccgcacttcttcgggaagtgctgatcttccagctggatcactgcgacgccggctttctcataacctcgcacggtgtgcgcgacgttgagcaggccaccatagccggtgtcgccgtcggcgatcagcggcttgtggatggcgtgggcgatggcctcggcgcggtcgaccatgtcggtgtaggtggccaggcccgcgtcgggctgccccagataggacgccacgaccccgtagccggtcatatagatcgcctgcgcctcggtgcgatcggccagcttagccgagaccagatcgaaaacgcccggggcagtgatgaactgcccgctcttcagcatcgcgcggatggtgttcttggtggtggtttcggtgttcattttatcttcctttttggttatgagacgaggacacactgtccgccccgacggattaggttttctcagaaccggcgtgagcttcgttgcgccgtgcgttaactgagggccgagttcaccggcgggttgagcatgcctgtcaggatcgcgatgtcgtcgatcatttcgaggccgagcacggtgcgctggatggcgtcttggcggcggcgcccgatcactctatgggtcagatggcgatacttgtcgacgatttgggcgttggtgagttggtggtccccggtgccgcgcggatgggtgactacctgctcacgtgttgtgccgtcatggagggtaatcaacacgcgcgtggtgaggcgctgacttgccggcagtgcgtcgtaggcctttacgtggtgggtgtgtgttcgggtgatgagct

SEQ ID NO: 273 - DNA, 4000 bp, Escherichia coli
  misc_feature (821)..(821): n is a, c, g, or t
  misc_feature (967)..(967): n is a, c, g, or t
  misc_feature (1252)..(1252): n is a, c, g, or t
  misc_feature (1986)..(1986): n is a, c, g, or t
  misc_feature (2963)..(2963): n is a, c, g, or t
ctcgttgagctgcctatgctgggatttccgaagcagacagaaagcatcctttacaggatacttagcaacggattcataccggttatagcgcatgtggagcgatacgccgatatccggaaggacattgaaatacttaagggatttatcgagatgggctgtatttcccaggtaaatgcaacatcgataaacggcacggcaagcaggaaaatccaggagacggcaaaaaccgtaataatcagcagcatggcccatcttgtcgcatcggactgccattcggaccgcaggaggagtcccaggctgaaagcagcatttgaaactgtaaggacctgggcaggagacgaaaaagcggagatgctgttctccaggaatccccggtccatattggaaaatgaagcagtacatgtcgacgagcccgttataatacgaaagaaaaaatttttcagtatcaaattaccgcataaactgccatgggaggtttaaaaagtgcaatatgaacagcaagagcaggagcttgatttgagagaaataatacatatattgactgtacgttggtggataattgcaatattcacggcattgtcgataataatcacagggttcgtgacatttacgatgatcgatcctgtatacaaggctgaaacatctctgtttgttggaaaagaaagtgacaagatcgcgtcactggatctcggtgagttcaacctcaataaaagccttgtatcggactaccgtcagctcatattgagccgcctggtgtcccaggaggtaatcgatgagctgggacttgacatgaccgtaagtacattccagaaaaaagttgnagttactacgatcgaagattccagactgttcaagatatcattcgaaagtacggacccgaaaatggccatggatgtggcaaacgccctggcgcaggtactggtggagaaagcgcaggatatcatacaagtaaaaaatattaaaatantcgatgaggcagaactgcctgagaacccgataaaaccgaataaaattcagaatttgctggtagctgcggtacttggtgcctttatcggcgcaggcgcagttatccttgttgaatatctcgattacacgataaaaaatgccaatgatgtggaaagacttctcaaacttaatacgatcggtgaaataccacagtttgcgggtgaaaaaagaggcaagagcaaagggcttttttcaaagagaaaacacagttccggcaaaaaacgggacaaaaatgctgtcagccatntgctgataactataacggatcccaaggctccggcttcagaagcatacaggtcactgcgtacaaatataggctattcaggcattgacaaacaggtcaggctgatagtgttaacaagttcccgcatggcagaaggaaaatcgacgacggccgcaaacatggccgtcagtatggcacaatcagggaaaaatgtgctgctgatagacgcagacctgagaaagccgagagtccacaggtatttcaacctgtcaaacgatataggcttaactgatattgttgtaaagaacgtctcaacggaggaggcaattaagaagttcagctatgttgaaaacctcagcattatatgcagcggatcggtgcctccgaatcctaccgagatacttgaatccaaaaagctcgcagaattgctgcaggagctcaaggaaaaatttgatattgtaataatagatacgcctcctgtgggtcagcttactgacggtgctatactggccagtatagcagacggcgttatactcgttgcggcatcaggtgagtcgaacatagatatggtaaggcgcgccagggcagcacttatgcaggttaacgccaacataataggcgtagtcctgacaaagataaacaaaaccaggagcggaagttactatacgtattacaattatgacaaatattatggcagcgaagattaataagtaagaaacaaatgcagataaaatgcagttgttaagtaattatgcaantaatgtaaaaataagtattgactaaaccactttattactataatatgggttttgtgaatatacggtatgtgccaacaaagcaaaaacttttatatgaatctgaaaatgaattatagtacagatcgcggcaaaatataacggcatataccggactgcacacaaaagacaggtagtgaagacacttaaagaagaaagatacgaaaaaatccgaggtccgtaaatggtgtttcggcccgtttccgggacaaggaggtcaaatgcaggtttgtgggggacgtttatggtttttgccatatgcgaatggcgaagctgcgcctttctgcgcaaattcttgcaaatgatccatatcagcagattagcaaaaattagaaataataaacagatattgtattttatctattatgtcttatacccaggaggagaagagatgcaaaaagctatcagaatagtctcacttgtaattatcgatgcaatactgctgaatctctctctctgccttgcacttctcgtcagattcgatacagatataccgcaacagtatttatcgtatatgagggacagtgcactcgcagttacagtgctgcagttagtaatattcttcgttttcggtctgtacaggagcctttgggaatacgcaagcatagaagaattggtccagatcgcaatggcaaccacagccgcgacagttctcagatatgtcgcagaactggtaacaggaaatgcctttccgatatcgatctatattgcatcatgggcattcatctgcatgctggccggcggcgtgaggatcagttaccggtgcgttcgccggctcaggacacgtattgagagaaaccggtgcaactccagcagggtcatgatcattggcgcaggaagcgcgggttcgatgcttatcaaagaattgaaaaaccatgctgacatgaatatggtaccggtagtaatggtagatgacgataaaacaaagcacggcactaccnttaacggtgtcccggtcgtagccggaagggagaaaataaaggaagtagcaaaacgatataaaatagatgagatcatagtcgcaataccatctgcatccagaagggaaatagccgaactgctacgcataagcaaggaaacgaagtgcaggctcaagacattgcccaatgtacttgaactcatggatggagaggtaaacgtaaaacagatccgcgatgtcaacattgaagacttgcttggccgcgacgaggtcagcctgaacattgatgaaatatcggggtatcttaaagatgaagtagtcatggtaaccggcggaggcggctcaataggatcggaactctgccgccagatcgccaggttcgggccaaagaaactaatcatattcgatatatatgagaataatgcatacgatctgcagaacgaactggtattcaaatacaaggataaactggatcttgaagtagtcatcggttcctgccgggacagggaaaggctgaaagacgtgtttgagcgttacaggccgggagtcgtgttccatgcggcagcccacaagcatgtaccgctgatggagagcaacccgtccgaagcggtgaagaacaatgtattcgggactctgaatacgtgcaggcgtgccattgactacggtacaaagaaatttatactgatttccactgacaaggcagtaaaccccaccaacataatgggagcgtcaaaacgtcttgccgagatcatagtccagtccatgaacaggatgggaaacacgaagttcgcagcggtacgctttggtaatgtgctgggaagtaacggcagcgttataccgctatttaagaaacagataattcgcggcggcccagttactgttactcaccctgatatcacgagatatttcatgacaattccggaagcagcacagctggttatacaggcaggggcactggcaaaaggcggagaagtattcgtgctggatatgggcgagcctgtgaagatagatgaccttgccagggatctgatacgtctttcaggccttgaaccggatgtg

SEQ ID NO: 274 - DNA, 4000 bp, Escherichia coli
  misc_feature (1200)..(1200): n is a, c, g, or t
  misc_feature (1203)..(1203): n is a, c, g, or t
  misc_feature (1652)..(1652): n is a, c, g, or t
  misc_feature (1983)..(1985): n is a, c, g, or t
  misc_feature (1989)..(1989): n is a, c, g, or t
  misc_feature (1995)..(1995): n is a, c, g, or t
  misc_feature (2009)..(2009): n is a, c, g, or t
  misc_feature (3037)..(3037): n is a, c, g, or t
  misc_feature (3797)..(3797): n is a, c, g, or t
  misc_feature (3812)..(3812): n is a, c, g, or t
  misc_feature (3878)..(3878): n is a, c, g, or t
gaaggtgctggattcgaattcgaaaacgctattgtcggtggggtagttcctcgtgaatacatccctgcagttgaagctggattgaaagacgctatggaaaacggggtattagctggttatccattagttgacatcaaagctaaactttacgatggatcataccatgatgtcgattcatctgaaacagccttcaaagttgccgcttctatggcattgaaagctgctgctaagaaagctcaacctgctatcttagaacctatgatggctgttgaaattacagttcctgaagaatacttcggagatgtaatgggacacgttaacgctcgtcgtggacgtgttgaaggttctgaagttcgtggtaacgcacaaatcgttaaaggtatgattcctttatcagaaatgttcggttacgcaactacattacgttctgcaacacaaggtcgtggtactttcagtatgacatttgaccactatgaagatgttcctaagagcattgcagaagaaatcattaagaaaaacggcggtaacggagaataatctctagcactgcatcctatcaaatgaactgaatcggctggttatgtcagtcataaccagttgatttttaagagagttctttggtataattacaatcggtagatactgttatagaatctaacaaaactcaattattaggaggaatcatttaaatggcaaaagaaaaatttgaccgttcaaaaccacacgttaacattggtacaatcggccacgttgaccacggtaaaacaacattaactgctgctattacaactgtattagctaagaaaggtttcgcgcaagctcaagattacggttcaatcgataaagctccagaagaacgcgaacgtggtatcacaatcaacacagctcacgttgagtacgaaactgacactcgtcactacgctcacgttgactgcccaggacacgcggactacgttaaaaacatgatcactggtgctgctcaaatggacggtgctatcttagtagtatctgcagctgacggcccaatgccacaaacacgtgaacacatcttattatcacgtcaagtaggtgttccttacatcgttgtattcttaaacaaagttgacatggttgacgatgaagaattattagaattagtagaaatggaagttcgtgacttattatcagaatacgatttcccaggcgatgacactccagttnttncaggttctgctttacgcgctttagaaggcgacgcttcatacgaagaaaaaatcttagaattaatggctgcagttgacgaatacatcccaactccagaacgtgacgttgacaaaccattcatgatgccagtcgaagacgtgttctcaatcacaggtcgtggtactgttgctacaggtcgtgttgaacgtggacaagttcgtgttggtgacgaagttgaaatcgttggtatttcagaagaaacttctaaaacaactgttacaggtgttgaaatgttccgtaaattgttagactatgctgaagcaggggataacattggtacattattacgtggtgttacacgtgacaacatcgaacgtggacaagttcttgctaaaccaggaacaatcactccacatactaaattcaaagctgaagtttacgtattaactaaagaagaaggtggacgtcanactccattcttcactaactaccgtcctcaattctacttccgtacaacagacatcactggtgtttgcttgttaccagaaggcgttgaaatggtaatgcctggtgacaacgtaactatggaagttgaattaattcacccagttgctatcgaaaacggtactaaattctctatccgtgaaggtggacgtacagtaggtgctggttcagtagcttctatcgaaaaataatttttcttaaaattgattttcaagactatccaattttggatagtctttttttattaaaattttttaaattaaaatgtcagacaattgaaagcgaaaaacaaaaatnnnagtnaaatgncaaaaacgttgatntaacaacgtttgtaaagggtttaaaacaaaatggaacacacgggcgcgtgtgcataaataaatgttgttaaatcaacggttttcgcttgcaatcaaaaaaagaatcttgtatactattaaaagtgccgcagaggaatgtaaattctaaagcagcataccccctcttaaaataagaaggggagctatgaaacgagaggttgcgacacgcccggacgctttgccacgaaagggtcaagtcggaaattcgcgtggagctagtcttatgacaacattagacgaaggaggaaagacaatggcaaaacaaaaaatccgtatccgtttgaaagcttacgaacaccgtgcgcttgatcaatcagcggaaaaaatcgtagaaacagcaaaaagaactggtgctagcgtagctggtccaattccattgccaacagaaagatcgctttacacagttattcgtgcgactcacaaatataaagattctcgcgaacaatttgaaatgcgtacacacaagcgtttgatcgacatcgttaatccaacgccaaaaactgttgatgccttaatgaagcttgatttaccaagcggcgttgacatcgaaatcaaattataataaatagaaaaatggaggtgtaaccatgaccaaaggaatcttaggcaaaaaagtagggatgactcaatactttacagaagcaggtgaacttattcctgtaacagtagttgaagtaactccaaacgttgttcttcaattaaaaacaatcgaaaacgacggttacgaagctgttcaattaggtttcgacgacttacgtgaagttttatcaaatcgccctgctaaaggtcatgtagcaaaagcaaatgctactcctaagcgcttcattcgtgaattcaacaatgtcgagcttagcgagtacgaagtaggacaagaaattacagttgatgtattcaaagcaggagacatcgttgacgtaacaggtacatctaaagggaaaggtttccaaggtgctatcaaacgtcatggacaatctcgcggaccaatggcncacggttctcgttaccaccgtcgtcctggttcaatgggtggagcatcattcccatcacgcgttttcaaaggtaaagcattacctggacaaatgggtggcgaccgtatcactattcaaaacttagaagtagtgaaagttgatgcagaacgcaatgtaatcttaatcaaaggtaacgtacctggatctaagaaatcattagtagaaattaaaacagcaattaaatctaaataataaatagggaaggaggaacgagagaatgacaaaagttacattatttaaacaagatggaacaacaaacggagaaatcgaattaaactcagaaatcttcggaattgaaccaaacgaaaatgtagtattcgacgcagtaatcatgcaacgcgcttcattacgtcaaggaacacacgctgttaaaaaccgtagtgcagtaagcggaggcggccgtaaaccatggcgccaaaaaggaactggtcgtgctcgtcaaggatcaatccgttcaccacaatggcgtggcggaggtattgtattcggaccaacacctcgttcatatagttacaaattacctaaaaaagtacgtcgcttagcgattaaatcagtattatcacaaaaagtattggataacaagcttgttgtagtggaagcattacaatttgacgcaccaaaaacaaaagagtttgcacaagtattgtctaacttaaacgttgatacaaaagtgttagtagttgtagaatcttcaaacgatttcgcattattagcagctcgnaacattccaaacgtnacaatcgttgacgaaacagatgttacagtattagacgttgtaaacaacgacaaattattattcacnaaagcagctctttctaaagtagaggagggacttcaataatggatgcacgtgacgtaatcaaacgccctatcattactgaagcttcaatgcttgctactgacgaaaagaaatacacttttgaa

SEQ ID NO: 275 - DNA, 4000 bp, Escherichia coli
  misc_feature (257)..(257): n is a, c, g, or t
  misc_feature (259)..(259): n is a, c, g, or t
  misc_feature (309)..(309): n is a, c, g, or t
  misc_feature (562)..(562): n is a, c, g, or t
  misc_feature (791)..(791): n is a, c, g, or t
  misc_feature (1951)..(1951): n is a, c, g, or t
  misc_feature (2141)..(2142): n is a, c, g, or t
  misc_feature (2145)..(2145): n is a, c, g, or t
  misc_feature (2147)..(2150): n is a, c, g, or t
  misc_feature (2154)..(2156): n is a, c, g, or t
  misc_feature (2158)..(2161): n is a, c, g, or t
  misc_feature (2163)..(2165): n is a, c, g, or t
  misc_feature (2171)..(2171): n is a, c, g, or t
  misc_feature (2174)..(2174): n is a, c, g, or t
  misc_feature (2176)..(2179): n is a, c, g, or t
  misc_feature (2181)..(2186): n is a, c, g, or t
  misc_feature (2188)..(2190): n is a, c, g, or t
  misc_feature (2193)..(2194): n is a, c, g, or t
  misc_feature (2196)..(2213): n is a, c, g, or t
  misc_feature (2218)..(2221): n is a, c, g, or t
  misc_feature (2223)..(2232): n is a, c, g, or t
  misc_feature (2237)..(2240): n is a, c, g, or t
  misc_feature (2242)..(2248): n is a, c, g, or t
  misc_feature (2250)..(2254): n is a, c, g, or t
  misc_feature (2256)..(2261): n is a, c, g, or t
  misc_feature (2263)..(2293): n is a, c, g, or t
  misc_feature (2295)..(2297): n is a, c, g, or t
  misc_feature (2299)..(2302): n is a, c, g, or t
  misc_feature (2305)..(2305): n is a, c, g, or t
  misc_feature (2307)..(2312): n is a, c, g, or t
  misc_feature (2314)..(2315): n is a, c, g, or t
  misc_feature (2317)..(2345): n is a, c, g, or t
  misc_feature (2347)..(2350): n is a, c, g, or t
  misc_feature (2352)..(2357): n is a, c, g, or t
  misc_feature (2359)..(2375): n is a, c, g, or t
  misc_feature (2377)..(2385): n is a, c, g, or t
  misc_feature (2387)..(2395): n is a, c, g, or t
  misc_feature (2398)..(2401): n is a, c, g, or t
  misc_feature (2403)..(2421): n is a, c, g, or t
  misc_feature (2423)..(2434): n is a, c, g, or t
  misc_feature (2436)..(2437): n is a, c, g, or t
  misc_feature (2439)..(2447): n is a, c, g, or t
  misc_feature (2449)..(2454): n is a, c, g, or t
  misc_feature (2456)..(2464): n is a, c, g, or t
  misc_feature (2466)..(2466): n is a, c, g, or t
  misc_feature (2468)..(2470): n is a, c, g, or t
  misc_feature (2472)..(2485): n is a, c, g, or t
  misc_feature (2487)..(2491): n is a, c, g, or t
  misc_feature (2493)..(2505): n is a, c, g, or t
  misc_feature (2508)..(2512): n is a, c, g, or t
  misc_feature (2514)..(2518): n is a, c, g, or t
  misc_feature (2520)..(2520): n is a, c, g, or t
  misc_feature (2522)..(2558): n is a, c, g, or t
  misc_feature (2560)..(2566): n is a, c, g, or t
  misc_feature (2568)..(2580): n is a, c, g, or t
  misc_feature (2583)..(2620): n is a, c, g, or t
  misc_feature (2622)..(2629): n is a, c, g, or t
  misc_feature (2634)..(2648): n is a, c, g, or t
  misc_feature (2650)..(2651): n is a, c, g, or t
  misc_feature (2653)..(2681): n is a, c, g, or t
  misc_feature (2683)..(2699): n is a, c, g, or t
  misc_feature (2702)..(2703): n is a, c, g, or t
  misc_feature (2706)..(2736): n is a, c, g, or t
  misc_feature (2738)..(2749): n is a, c, g, or t
  misc_feature (2751)..(2779): n is a, c, g, or t
  misc_feature (2781)..(2787): n is a, c, g, or t
  misc_feature (2789)..(2808): n is a, c, g, or t
  misc_feature (2810)..(2817): n is a, c, g, or t
  misc_feature (2820)..(2828): n is a, c, g, or t
  misc_feature (2830)..(2839): n is a, c, g, or t
  misc_feature (2841)..(2860): n is a, c, g, or t
  misc_feature (2862)..(2887): n is a, c, g, or t
  misc_feature (2889)..(2890): n is a, c, g, or t
  misc_feature (2892)..(2903): n is a, c, g, or t
  misc_feature (2905)..(2914): n is a, c, g, or t
  misc_feature (2916)..(2916): n is a, c, g, or t
  misc_feature (2918)..(2929): n is a, c, g, or t
  misc_feature (2931)..(2944): n is a, c, g, or t
  misc_feature (2946)..(3023): n is a, c, g, or t
  misc_feature (3025)..(3025): n is a, c, g, or t
  misc_feature (3027)..(3037): n is a, c, g, or t
  misc_feature (3039)..(3042): n is a, c, g, or t
  misc_feature (3044)..(3057): n is a, c, g, or t
  misc_feature (3060)..(3062): n is a, c, g, or t
  misc_feature (3064)..(3069): n is a, c, g, or t
  misc_feature (3071)..(3075): n is a, c, g, or t
  misc_feature (3077)..(3096): n is a, c, g, or t
  misc_feature (3098)..(3100): n is a, c, g, or t
  misc_feature (3102)..(3103): n is a, c, g, or t
  misc_feature (3105)..(3111): n is a, c, g, or t
  misc_feature (3113)..(3124): n is a, c, g, or t
  misc_feature (3126)..(3140): n is a, c, g, or t
  misc_feature (3142)..(3164): n is a, c, g, or t
  misc_feature (3166)..(3169): n is a, c, g, or t
  misc_feature (3171)..(3172): n is a, c, g, or t
  misc_feature (3174)..(3195): n is a, c, g, or t
  misc_feature (3197)..(3203): n is a, c, g, or t
  misc_feature (3205)..(3210): n is a, c, g, or t
  misc_feature (3212)..(3245): n is a, c, g, or t
  misc_feature (3250)..(3260): n is a, c, g, or t
  misc_feature (3262)..(3280): n is a, c, g, or t
  misc_feature (3282)..(3304): n is a, c, g, or t
  misc_feature (3306)..(3307): n is a, c, g, or t
  misc_feature (3309)..(3315): n is a, c, g, or t
  misc_feature (3317)..(3330): n is a, c, g, or t
  misc_feature (3332)..(3335): n is a, c, g, or t
  misc_feature (3338)..(3362): n is a, c, g, or t
  misc_feature (3365)..(3398): n is a, c, g, or t
  misc_feature (3400)..(3403): n is a, c, g, or t
  misc_feature (3405)..(3415): n is a, c, g, or t
  misc_feature (3417)..(3430): n is a, c, g, or t
  misc_feature (3432)..(3433): n is a, c, g, or t
  misc_feature (3435)..(3442): n is a, c, g, or t
  misc_feature (3448)..(3449): n is a, c, g, or t
  misc_feature (3452)..(3453): n is a, c, g, or t
  misc_feature (3455)..(3457): n is a, c, g, or t
  misc_feature (3459)..(3461): n is a, c, g, or t
  misc_feature (3463)..(3486): n is a, c, g, or t
  misc_feature (3489)..(3493): n is a, c, g, or t
  misc_feature (3495)..(3500): n is a, c, g, or t
  misc_feature (3502)..(3511): n is a, c, g, or t
  misc_feature (3513)..(3523): n is a, c, g, or t
  misc_feature (3525)..(3526): n is a, c, g, or t
  misc_feature (3528)..(3529): n is a, c, g, or t
  misc_feature (3531)..(3531): n is a, c, g, or t
  misc_feature (3533)..(3535): n is a, c, g, or t
  misc_feature (3537)..(3538): n is a, c, g, or t
  misc_feature (3540)..(3545): n is a, c, g, or t
  misc_feature (3547)..(3548): n is a, c, g, or t
  misc_feature (3550)..(3551): n is a, c, g, or t
  misc_feature (3553)..(3570): n is a, c, g, or t
  misc_feature (3572)..(3611): n is a, c, g, or t
  misc_feature (3613)..(3618): n is a, c, g, or t
  misc_feature (3620)..(3646): n is a, c, g, or t
  misc_feature (3648)..(3656): n is a, c, g, or t
  misc_feature (3658)..(3658): n is a, c, g, or t
  misc_feature (3660)..(3674): n is a, c, g, or t
  misc_feature (3676)..(3689): n is a, c, g, or t
  misc_feature (3691)..(3697): n is a, c, g, or t
  misc_feature (3699)..(3699): n is a, c, g, or t
  misc_feature (3702)..(3723): n is a, c, g, or t
  misc_feature (3725)..(3780): n is a, c, g, or t
  misc_feature (3782)..(3818): n is a, c, g, or t
  misc_feature (3820)..(3865): n is a, c, g, or t
  misc_feature (3867)..(3877): n is a, c, g, or t
  misc_feature (3879)..(3908): n is a, c, g, or t
  misc_feature (3910)..(3964): n is a, c, g, or t
  misc_feature (3966)..(4000): n is a, c, g, or t
ctccgaataccataatttatagctcaggagtgagactatgggagttaacttccattgtcaaaagggaaacaacccagaccaccagctaaggtccctaattataactaagtgggaaaggaggtggagattcacaaacaactaggaggttggcttagaagcagccatacctttaaagagtgcgtaatagctcactagtcgagagtctctgcgccgacaatgtaacggggctaagttataaaccgaagctgtggaatccntntggattggtaggagagcgttctgtaggccgttgaagaagaagggtaaccnactttggaggtatcagaagtgagaatgcaggaataagtagcgagaaagggggcgagaatccccctcgccggaagaccaaggttttcagggtaaagcttgtcttccctgagtaagccgggacctaagcccaggctataatgcgtaggcgaatggaaaacagattaatatttctgtgccagtcatttattgtgatggagggacgcagaagggtatgcgcgcggacgatcggttgtgtccgtagaagtatgtaggntgacttagtaggtaaatccattaagttatatctgaggtatgatatacagtcgtaagatgaatgcgcaaatcccacgctgccaagaaaagcttctaacgttaatatatgactgcccgtactgtaaaccgacacaggtggtcaggatgagaaatctaaggcggacaggctaactctcgttaaggaactctgcaaaataacctcgtaacttcgggagaagaggagcccttgngtgttagtatccatgcgatacaaagcgctcgagggtcgcagtgaagaggctcaagcaactgtttaacaaaaacacaggtctatgctaagctggaaggcgatgtatatgggctgacacctgcccagtgctggaaggttaagaggaggagtgagagctccgaattgaagccccagtgaacggcggccgtaactataacggtcctaaggtagcgaaattccttgtcgggtaagttccgacctgcacgaatggtgtaatgatttgagcgctgtcttgacgggaggcctggtgaaattgtattaccggtgaagataccggttacctacagtaggacggaaagaccccatggagctttactgtagcttggtattgggttttggcattgcatgtataggatagttgggagactatgatgatatggcgctagctgtatcggagtcatcggtggaataccaaccattcaatgctgaaattctaatctgtggtttgtagccacggagacagtgctaggtgggcagtttgactggggcggtcgcctccgaaagagtaacggaggcgttcaaaggttctctcaggttggatggaaatcaaccatagagtgcaatggcataagagagcttgactgcaagactgacgggtcgagcagatgcgaaagcaggacatagtgatccggcgattccgaatggaagggtcgtcgctcaacggataaaagctaccctggggataacaggctgatcctacccgagagtccatatcgacggtagggtttggcacctcgatgtcggctcatcgcatcctggggctggagaaggtcccaagggttgggctgttcgcccattaaagcggtacgtgagctgggttcagaacgtcgtgagacagttcggtccctatccactgtaggcgttagaatattgagaagacctgtccttagtacgagaggaccgggatggacaaacctctgatgtaccagttgtcacgccagtggcacagctgggtagtcacgtttggaatagataaccgctgaaagcatctaagcgggaaactaacttcaagataagtattctttaagataccttcgagcctaggaggttgataggttgggggtgtaagtacagcaatgtatttagctgaccaatactaattatcgaagttttaatctaaantctactatatagtttcaagtgttcagacttgcgcataataactttatgtgataaaatatatttgcttggtgagtatagctatgggggtacacctagttacattccgaacctagaagttaagcccatatacgctgatggtacttggctggaagcggcctgggagagtatggatttgccaagctattttttnnggnannnnagtnnntnnnncnnntttttnttnannnnannnnnnannnttnnannnnnnnnnnnnnnnnnnttttnnnntnnnnnnnnnnttttnnnntnnnnnnntnnnnnannnnnntnnnnnnnnnnnnnnnnnnnnnnnnnnnnnnnannnannnnaanannnnnnannannnnnnnnnnnnnnnnnnnnnnnnnnnnnannnnannnnnnannnnnnnnnnnnnnnnnannnnnnnnnannnnnnnnnaannnntnnnnnnnnnnnnnnnnnnnannnnnnnnnnnnanntnnnnnnnnnannnnnnannnnnnnnnanannnannnnnnnnnnnnnnannnnntnnnnnnnnnnnnnaannnnnannnnnanannnnnnnnnnnnnnnnnnnnnnnnnnnnnnnnnnnnntnnnnnnnannnnnnnnnnnnnaannnnnnnnnnnnnnnnnnnnnnnnnnnnnnnnnnnnnnannnnnnnnaaaannnnnnnnnnnnnnnannannnnnnnnnnnnnnnnnnnnnnnnnnnnntnnnnnnnnnnnnnnnnnaannaannnnnnnnnnnnnnnnnnnnnnnnnnnnnnnannnnnnnnnnnnannnnnnnnnnnnnnnnnnnnnnnnnnnnnannnnnnnannnnnnnnnnnnnnnnnnnnannnnnnnnttnnnnnnnnntnnnnnnnnnntnnnnnnnnnnnnnnnnnnnnannnnnnnnnnnnnnnnnnnnnnnnnnannannnnnnnnnnnnannnnnnnnnnanannnnnnnnnnnnannnnnnnnnnnnnnannnnnnnnnnnnnnnnnnnnnnnnnnnnnnnnnnnnnnnnnnnnnnnnnnnnnnnnnnnnnnnnnnnnnnnnnnnnnnanannnnnnnnnnnannnnannnnnnnnnnnnnnttnnntnnnnnntnnnnntnnnnnnnnnnnnnnnnnnnnannnannannnnnnntnnnnnnnnnnnnannnnnnnnnnnnnnntnnnnnnnnnnnnnnnnnnnnnnntnnnnannannnnnnnnnnnnnnnnnnnnnntnnnnnnnannnnnnannnnnnnnnnnnnnnnnnnnnnnnnnnnnnnnnnaaaannnnnnnnnnnannnnnnnnnnnnnnnnnnnannnnnnnnnnnnnnnnnnnnnnnannannnnnnntnnnnnnnnnnnnnntnnnnttnnnnnnnnnnnnnnnnnnnnnnnnnaannnnnnnnnnnnnnnnnnnnnnnnnnnnnnnnnnannnnannnnnnnnnnnannnnnnnnnnnnnnannannnnnnnnaaaaannaannannnannnannnnnnnnnnnnnnnnnnnnnnnnaannnnnannnnnnannnnnnnnnnannnnnnnnnnnannannanannnannannnnnnannannannnnnnnnnnnnnnnnnnannnnnnnnnnnnnnnnnnnnnnnnnnnnnnnnnnnnnnnnannnnnntnnnnnnnnnnnnnnnnnnnnnnnnnnntnnnnnnnnnanannnnnnnnnnnnnnnannnnnnnnnnnnnnannnnnnnanaannnnnnnnnnnnnnnnnnnnnntnnnnnnnnnnnnnnnnnnnnnnnnnnnnnnnnnnnnnnnnnnnnnnnnnnnnnnnnannnnnnnnnnnnnnnnnnnnnnnnnnnnnnnnnnnnntnnnnnnnnnnnnnnnnnnnnnnnnnnnnnnnnnnnnnnnnnnnnnnannnnnnnnnnnannnnnnnnnnnnnnnnnnnnnnnnnnnnnnannnnnnnnnnnnnnnnnnnnnnnnnnnnnnnnnnnnnnnnnnnnnnnnnnnnnnnannnnnnnnnnnnnnnnnnnnnnnnnnnnnnnnnnn

SEQ ID NO: 276 - DNA, 4000 bp, Escherichia coli
  misc_feature (13)..(13): n is a, c, g, or t
  misc_feature (16)..(16): n is a, c, g, or t
  misc_feature (1560)..(1560): n is a, c, g, or t
  misc_feature (1576)..(1576): n is a, c, g, or t
  misc_feature (1579)..(1579): n is a, c, g, or t
  misc_feature (1584)..(1584): n is a, c, g, or t
  misc_feature (1606)..(1606): n is a, c, g, or t
  misc_feature (1611)..(1611): n is a, c, g, or t
  misc_feature (1641)..(1641): n is a, c, g, or t
  misc_feature (1670)..(1671): n is a, c, g, or t
  misc_feature (1675)..(1675): n is a, c, g, or t
  misc_feature (1677)..(1680): n is a, c, g, or t
  misc_feature (1684)..(1686): n is a, c, g, or t
  misc_feature (1695)..(1699): n is a, c, g, or t
  misc_feature (1702)..(1703): n is a, c, g, or t
  misc_feature (1722)..(1722): n is a, c, g, or t
  misc_feature (1731)..(1731): n is a, c, g, or t
  misc_feature (1737)..(1737): n is a, c, g, or t
  misc_feature (1739)..(1740): n is a, c, g, or t
  misc_feature (1749)..(1750): n is a, c, g, or t
  misc_feature (1755)..(1755): n is a, c, g, or t
  misc_feature (1767)..(1768): n is a, c, g, or t
  misc_feature (1827)..(1829): n is a, c, g, or t
  misc_feature (1835)..(1835): n is a, c, g, or t
  misc_feature (2032)..(2032): n is a, c, g, or t
ggttgaatttcanacnagcaaaggagcgattcgctatcaattatatctaggaaatggaaaaattaaacgcattaaggaaacaaaaaattagggcagtaatcttactagaagcagtagtagctttggctgtgtttgccagcattgcgacccttcttttggggaaaattcagaaaaatagacaagaagaggcagaaatcttgcaaaaggaagaagtcttgcgtgtggcgaagatggctctgcaaacagggcaaaatcaggtaaacataaatggagtggagattcaggtatttgctagtgaaaaaggattggaggtctaccatggttcagagaaattgctcgatcttaaagagcagtaaggtaagagctttcactcttttagaatctctgattgcccttatcgtcattagcggaggtttgctactttttcaagctatgagtcagctcctcatttcagaagttcgttaccagcagcaaagcgagcaaaaagagtggctcttgtttgtggatcaactggaggcagagttagagcgttcgcagtttgaaaaggtagaaggcaatcgcctctacatgaaacaggatggtaaggatatctctatagggaaatctaaatcggatgattttcggaagaccgatgccagcggacggggctaccaacctatggtttatggacttaaatcagctcaaattacagagggaaatcaactggttcgcttccgtttccagtttcaaaaaggcttagaaagggagttcatctatcgtgtggaaaaagcaaaaagttaaggcaggcgttctcttatatgcagtcaccatggcagccatttttagccttttgttgcagttttatttgaatcggcaagtcgcccatcacaaagactttgccctaaacaaagaaaagttggcagcttttgctatggccaagcgaagtaaagataaggttgaacaagaaagtggagaacgagtctttaacttaggaaaagtcaggtatcacaatacgaaaacaggttttgcaacaagtgttcgtatgaataagggcaactatgaatttctctttcctcagatgaaaacccaagaaaagagaacagctaaaaaggaagaggtagcgactgattcaagcaatcaagcagggaagaaaaaatcagaagaaaagtctgaaaagaaagacaaatcctagtcaattcaacttctttgtgctaaactaaaagcatgaaacatgattttaatcacaaagcagaaacttttgattcgcccaaaaatatctttcttgcaaatttggtttgtcaagcagttgaaaaacagatcgctcttctatcagacaaagaaattctggatttcggtggtgggacaggtctattagctttgcccctagccaagcaggccaagtcggttacccttgtagatatctcggagaaaatgctggagcaagcccgtttgaaagcagagcaacaagacatcaagaatatccagtttttggagcaggatttactggcaaatcccttggaacagcaatttgacctgattgttgtcagtcgggttcttcatcatatgcctgatctagatgcnactcttgccatgtttnacnatcancttagggagaatggacaagttntcatngctgattttgtcaagacagataccaaccancatggttttgatttagctgaactggaaannaagntnnnncagnnnggtttttcnnnnnttnntagtcagattctctatagngctgaaggncttttncnnggaaattanncaganctctttttaacnntagcccaaaaatcactcgctgactaaagcagtgattttttctcttcagatggaaaaaannngggaantttgataagataggaatatggattttgaaaaaattgaacaagcttatacgtatttactagagaatgtccaagtcatccaaagtgatttggcgaccaacttttatgatgccttagtagagcaaaacagcatttatctagatggcgagactgagcaaaagcaggtcaaggagaacaatcaagcccttaagcgcttagcncttcgcaaggaagagtggctcaagacctaccagtttctcttgatgaaggcgggacaaacggagcctttacaggccaatcaccagtttacgccggatgccattgccctcctcttggtacttattgtggaagagttgctggatcaagaggaaattagcatcctcgaaataggttctggtatggggattttgggggctactttcttgacttctcttgctaaaaaagtagattacttgggaatcgaagtggatgacttgctgattgatttggcagccagtatggcagatgtgattggtttgcaggctggttttgtccaaggagatgccgttcgtccgcaaatgcttaaagaaagcgacgtggtcatcagcgacttgcctgtaggctattacccagacgatgccatcgcttctcgctatcaagtggcttctagtcaagagcatacctatgcccaccatttgctgatggaacaaggcttcaagtaccttaagtcaaatggctatgctatttttctagctccgagtgatttattgaccagccctcaaagtgactcattaaaagggtggctcaaagacgaagtgagtctggctgctatcatcgctctgccagaggatattttctcaactgcaagccaagctaaaagtatttttgtcttacagaagaaaagagacaaggaaatagaaccctttgtctaccctcttactagcttgcaagatccgtcagttttgttgacctttaaagaaaattttcaaaattggagcaaaggtactgaaatataaaagagattttgttataatagatgaaaacgcttaaaaagaggtatcatcttatgacaaaaacaattgcaatcaatgcaggaagctcaagcttgaaatggcaactataccaaatgccagaagaaactgtattggcgaaaggcttgattgaacgtattggcttgaaggattcgatctcaacagtaaaatttgacggtcgttcggagcaacaaattcttgatattgaagaccatacacaagccgttaaaattttattagatgacttgattcgttttgacattatcaaagggtacgacgaaattacaggtgtcggccaccgcgtcgttgcaggtggtgaatatttcaaggaatcaacagttgttgagggagatgtgttagaaaaagttgaggaattgggactgttggctcctcttcacaatccagctaacgcagctggaattcgcgcatttaaggaattgctgccagatattaccagtgttgtcgtatttgatacctcattccacacaaccatgccagagaaggcttatcgctaccctctaccaactaaatactacacagacaacaaggttcgtaaatatggtgcccacgggacaagccaccagtttgtcgcagaagaagcagcgaaacttttgggccgtcctctagaagatttgaaattgattacctgccatattggtaacggggcttctatcacagctgttaagggtgggaagtctgtggatacttctatgggattcacaccacttggaggtgtgatgatgggaactcgtacaggagatattgaccctgctatcatcccttatctcatgcaatatacagaggatttcaatacccctgaagatattagtcgcgttctcaatcgtgaatcagggctcatgggagtttctggccagtcaagcgatatgcgtgatgtgattgctgccatggaagcaggagaccatgatgcaactttggcttatgaaatgtatgttgatcgtatccaaaaacatatcggccaatatcttgcagtcctaaatggagcagatgcgattatcttcacagcaggtatcggtgaaaatgctgcaaacgtacgtgaagatgtcatctcaggtatctcttggtttggttgtgatgtggatccagaaaagaacgtctttggtgtaacgggagatatctcaactgatgcggcgaaaatccgtgtcttggttattccaacag

SEQ ID NO: 277 - DNA, 4000 bp, Escherichia coli
  misc_feature (11)..(11): n is a, c, g, or t
  misc_feature (86)..(86): n is a, c, g, or t
  misc_feature (107)..(107): n is a, c, g, or t
  misc_feature (233)..(233): n is a, c, g, or t
  misc_feature (260)..(260): n is a, c, g, or t
  misc_feature (380)..(380): n is a, c, g, or t
  misc_feature (404)..(404): n is a, c, g, or t
  misc_feature (521)..(521): n is a, c, g, or t
  misc_feature (1075)..(1075): n is a, c, g, or t
  misc_feature (1237)..(1237): n is a, c, g, or t
  misc_feature (1240)..(1240): n is a, c, g, or t
  misc_feature (1252)..(1252): n is a, c, g, or t
  misc_feature (1300)..(1300): n is a, c, g, or t
  misc_feature (1396)..(1396): n is a, c, g, or t
  misc_feature (1488)..(1488): n is a, c, g, or t
  misc_feature (1730)..(1730): n is a, c, g, or t
gtgcgtccggnggcagcctgcccggcgggctgcgcagcgccggcagcggatttacccttccgcaaaccccgccggcgggggagganttcaccatcccttcctcggcngccgacgggttcgaggatttcgtttcggggagcagtttcgaggtggagtccggcgccgggttcgggacgagtgccctggagttcatcccttccggggctacggccgggcagcagcggctggcggtngaggggcgtccggaatttaccgatccnctgccgttgggcggcgggtacctcgccgcgctgctgggcgggaggttcgtcgtggtggacgtgcggcgtgcccgcgagcgcattctttatgaggattacctgaagatgctcggaaacggntcttccgtgagccagcaactgctntttcccgagcggctggtgttgtcgggcgacgaatatgcgctgctcgaggagaacgccgtggaattcgcgtcgctgggattcgacatcgactttgcgggggaggggacgatcgaggtnaagggcactccggccgatatgccggccgatgccgtcgaccagatggtctacgacctgctgcaagccttttcgacgcccgtgtcgctcgcggatcagcgccgcgagaagatcgccgccgtcatggcgcgcggcggggcgaaaggcattccccgcaatatgtcgcgcgacgaagccgccgtactgctcgcccagctcgccgctacgggcaatttcagtttctcgccctcgggcaaagccataactgcagaaataacccccgaagatatccgtaccaaactgggataatccggtggaaaaacgtacttttgtaaaaattttacgcaatgaacagctattttcagacacccccggtggtgaaaaacctgataatcatcaatgccctggtctacatggctacggccctgatccaaccggcacataacgccatcatggagtattgcgccctgtggctgggagcgccgttgttccacacctaccagttcgtcacctatatgttcgtgcatgccaatttcgagcatatcttcttcaatatgttcgccttgtggatgttcggncgtacgttggaatacgaattggggtcgaagcgtttcctgacctattacatggtttgcggcatcggtgcggcgctgatccagtatttcacggcgctggcgttcggcgagctgcccatgtcgctggttggtgcttcgggcgcggtgatggggctgctgctcgcnttnggcgtcatgcancccaatgcggtcatcatgctgctgatcccgccgatcccgatgaaggcnaaatggttcgtcatcatctacggcgtcatcgaacttttcctcggctggcgcggcgtaggcaatgtggcgcatttcgcccacgtgggcggtatgctntggggtttcctgctgctccactggtggaagcagcgcggcataatccgcttctgagccgatgtccggcgaattctataagaacgattacggcngccggcgcggggagaaaccgcaccgcagcctgctcatgtggctgctcgacctggtgatgacgctcctgaccgtcgttgtcggggccacgatggccgtcacctatttcgtcccttatgtgaaccccgccggggtctggttctttcccctgctggggcttgccgccccggcgatctacgtcgctacggtcatcctggcgctctactgggtcatccgctggcggttgctccgcgccggaacgatnctggcgctggtcgtcatcggcctcttcaaggtttcgctcttctataagcccgaattccgccgcagctacggcgaggagagctacgaccgccgggctttcaaggtcatgacctataacgtgcgcagtttcttcggcgaaagcggagccagcaatgtcgatgacatcgtgcgcctgatcggcgaatacgatcccgatatcgtctgcatgcaggagttcaatgcccgcctggccgagaaatccgacgatttcgccctgttggacgagaaatacgaaagcgcggccttcggccgcacgcaggctcccgattcgctgtatggggcatcgcttttcatcctgagcaaataccgtatcctgcgctcgggcatcgtcctgacccccaatacgtcggtctgggccgacctgctgatcggtgacgatacggtgcgcgtgttcaacaaccacctgcgttcgacggcgatcaaggcggccgacaacgaatatatcaccaaccgcgatttcatctccgacacggcacgcgaagtcaagatccgcagcatcgtgagccgcctgcgcgagaacagcatcctgcgtgccgcacaggtcgatagcattgccgatgtcatcgccgacgcgcgtgcgcggtgcatcgtctgcggcgatttcaacgatacgccgatgtcctatgtttaccgcacgatggccggggggctgaacgacgctttcagcaagagcggttcgggctattcgcatactttccgcggcttcttcaatacgctgcgtatcgactatgtcctctgctccgacagtttcgacccggtttcctacgaggtgccgcaggtcgaatattcggatcacctgcccgtcgtggtgcgtctccaaaagaatctactgaataactaatccgataaactatgattttcgactctttgaagaacagcgcgctctattatccggtgagcccgcgtctggaaaaagccttcggcttcatcgcttcgaccgactgggaaacgatggagccggggatccatgaactcgacggcaaggacatctatgtcaacgtaatggaacctgagctgaaaaaaccggcggatgccaaactcgaaatacacgacgcctatatcgacatccaggtgctgatccgcggtgagcaggagaccttcgggtggagcgagcgtgccgacctgcgcaagccgctgggcgaattcgatgccgggaaggatatccgtttcttcgacgatgagccgcagaccttctatacgctgcgcccggggcagttcacgatcttcttccccgaggacggccatgcgccgatgatcggcgagggcaatgtacgcaagatcattgtgaaggttcgcaagtaacggcgggccggattacggatgcgcgagaggcggttccctgcggaaccgcctctcgttttgccgttatgctgcgtcgggttttcggggtgcgagccgcatcgcggggtaggtgtagcaggcggtgcaggcgacaaggacaatccccgaagcagaagctccggggattgtgtcgttatgtgccgtaagagtattattttccgatgccgtagtagcgcagcccggcgttgagcacctcttccttgtcgaagatgttgcggccgtcgaccaggatgttgtcgcgcatgagcgtgagcaattgcggccagtcgggcatccggaactgtttccactccgtgacgagtgcgatggcatcggcgccctttgcagcttcgtacatcgaacctgcgtaatgcaccccttcgtcgccgatcctgcggcgggcttcctccatcgccacggggtcgtagacccgaaccgtggcgcccgccttacgcaacaggtcgatcaccaccagtgccggcgcttcgcgcatgtcgtccgtttcgggcttgaacgcgaggccccatatcgcgatggtttttccgtgcaggtcgcccagtgcccgttgcagtttgccgaacaggatggatttctgcccttcgttgacccgttccaccgcctcgatgacctgcatcgtataaccgtgttcctgggccgtacgggccagggctttcacgtccttggggaagcacgagccgccgtagccgcagccggggtagaggaacttgctgccgatgcgggcatcggatccgatgcccttgcgcaccatttcgacgttcgcccctaccaggtcgcagagattggcgatctcgttcatgaacgaaatgcgggtcgccagcatggcgttggccgcgtatttggtcatttccgccgaggggatgtccatgaacagcacccggaaattgttgatca

SEQ ID NO: 278 - DNA, 4000 bp, Escherichia coli
  misc_feature (2)..(4): n is a, c, g, or t
  misc_feature (6)..(6): n is a, c, g, or t
  misc_feature (8)..(9): n is a, c, g, or t
  misc_feature (13)..(14): n is a, c, g, or t
  misc_feature (17)..(18): n is a, c, g, or t
  misc_feature (20)..(20): n is a, c, g, or t
  misc_feature (22)..(24): n is a, c, g, or t
  misc_feature (27)..(27): n is a, c, g, or t
  misc_feature (29)..(33): n is a, c, g, or t
  misc_feature (35)..(35): n is a, c, g, or t
  misc_feature (37)..(38): n is a, c, g, or t
  misc_feature (40)..(45): n is a, c, g, or t
  misc_feature (49)..(53): n is a, c, g, or t
  misc_feature (56)..(56): n is a, c, g, or t
  misc_feature (59)..(61): n is a, c, g, or t
  misc_feature (64)..(76): n is a, c, g, or t
  misc_feature (80)..(82): n is a, c, g, or t
  misc_feature (86)..(90): n is a, c, g, or t
  misc_feature (92)..(92): n is a, c, g, or t
  misc_feature (94)..(99): n is a, c, g, or t
  misc_feature (101)..(101): n is a, c, g, or t
  misc_feature (103)..(105): n is a, c, g, or t
  misc_feature (110)..(110): n is a, c, g, or t
  misc_feature (112)..(112): n is a, c, g, or t
  misc_feature (114)..(116): n is a, c, g, or t
  misc_feature (118)..(119): n is a, c, g, or t
  misc_feature (122)..(122): n is a, c, g, or t
  misc_feature (126)..(126): n is a, c, g, or t
  misc_feature (128)..(128): n is a, c, g, or t
  misc_feature (130)..(130): n is a, c, g, or t
  misc_feature (132)..(133): n is a, c, g, or t
  misc_feature (135)..(137): n is a, c, g, or t
  misc_feature (139)..(141): n is a, c, g, or t
  misc_feature (143)..(147): n is a, c, g, or t
  misc_feature (151)..(151): n is a, c, g, or t
  misc_feature (154)..(158): n is a, c, g, or t
  misc_feature (160)..(164): n is a, c, g, or t
  misc_feature (167)..(169): n is a, c, g, or t
  misc_feature (176)..(176): n is a, c, g, or t
  misc_feature (179)..(181): n is a, c, g, or t
  misc_feature (183)..(184): n is a, c, g, or t
  misc_feature (186)..(187): n is a, c, g, or t
  misc_feature (190)..(192): n is a, c, g, or t
  misc_feature (194)..(194): n is a, c, g, or t
  misc_feature (196)..(197): n is a, c, g, or t
  misc_feature (199)..(201): n is a, c, g, or t
  misc_feature (204)..(204): n is a, c, g, or t
  misc_feature (206)..(209): n is a, c, g, or t
  misc_feature (211)..(212): n is a, c, g, or t
  misc_feature (214)..(214): n is a, c, g, or t
  misc_feature (217)..(218): n is a, c, g, or t
  misc_feature (222)..(230): n is a, c, g, or t
  misc_feature (232)..(233): n is a, c, g, or t
  misc_feature (236)..(236): n is a, c, g, or t
  misc_feature (238)..(239): n is a, c, g, or t
  misc_feature (241)..(241): n is a, c, g, or t
  misc_feature (243)..(244): n is a, c, g, or t
  misc_feature (246)..(250): n is a, c, g, or t
  misc_feature (252)..(256): n is a, c, g, or t
  misc_feature (259)..(260): n is a, c, g, or t
  misc_feature (262)..(263): n is a, c, g, or t
  misc_feature (267)..(271): n is a, c, g, or t
  misc_feature (274)..(278): n is a, c, g, or t
  misc_feature (282)..(282): n is a, c, g, or t
  misc_feature (284)..(284): n is a, c, g, or t
  misc_feature (287)..(287): n is a, c, g, or t
  misc_feature (289)..(290): n is a, c, g, or t
  misc_feature (292)..(294): n is a, c, g, or t
  misc_feature (296)..(297): n is a, c, g, or t
  misc_feature (301)..(302): n is a, c, g, or t
  misc_feature (304)..(314): n is a, c, g, or t
  misc_feature (316)..(316): n is a, c, g, or t
  misc_feature (319)..(321): n is a, c, g, or t
  misc_feature (325)..(325): n is a, c, g, or t
  misc_feature (328)..(328): n is a, c, g, or t
  misc_feature (332)..(332): n is a, c, g, or t
  misc_feature (334)..(336): n is a, c, g, or t
  misc_feature (340)..(341): n is a, c, g, or t
  misc_feature (343)..(343): n is a, c, g, or t
  misc_feature (345)..(348): n is a, c, g, or t
  misc_feature (350)..(350): n is a, c, g, or t
  misc_feature (352)..(355): n is a, c, g, or t
  misc_feature (361)..(364): n is a, c, g, or t
  misc_feature (366)..(378): n is a, c, g, or t
  misc_feature (382)..(382): n is a, c, g, or t
  misc_feature (384)..(387): n is a, c, g, or t
  misc_feature (389)..(389): n is a, c, g, or t
  misc_feature (392)..(392): n is a, c, g, or t
  misc_feature (394)..(395): n is a, c, g, or t
  misc_feature (397)..(397): n is a, c, g, or t
  misc_feature (400)..(402): n is a, c, g, or t
  misc_feature (407)..(410): n is a, c, g, or t
  misc_feature (412)..(415): n is a, c, g, or t
  misc_feature (417)..(418): n is a, c, g, or t
  misc_feature (420)..(424): n is a, c, g, or t
  misc_feature (427)..(430): n is a, c, g, or t
  misc_feature (432)..(432): n is a, c, g, or t
  misc_feature (434)..(434): n is a, c, g, or t
  misc_feature (436)..(440): n is a, c, g, or t
  misc_feature (442)..(443): n is a, c, g, or t
  misc_feature (447)..(449): n is a, c, g, or t
  misc_feature (451)..(451): n is a, c, g, or t
  misc_feature (453)..(453): n is a, c, g, or t
  misc_feature (456)..(456): n is a, c, g, or t
  misc_feature (458)..(464): n is a, c, g, or t
  misc_feature (466)..(469): n is a, c, g, or t
  misc_feature (471)..(471): n is a, c, g, or t
  misc_feature (474)..(474): n is a, c, g, or t
  misc_feature (476)..(477): n is a, c, g, or t
  misc_feature (480)..(483): n is a, c, g, or t
  misc_feature (485)..(488): n is a, c, g, or t
  misc_feature (490)..(490): n is a, c, g, or t
  misc_feature (493)..(495): n is a, c, g, or t
  misc_feature (497)..(498): n is a, c, g, or t
  misc_feature (500)..(503): n is a, c, g, or t
  misc_feature (506)..(508): n is a, c, g, or t
  misc_feature (511)..(511): n is a, c, g, or t
  misc_feature (514)..(514): n is a, c, g, or t
  misc_feature (516)..(518): n is a, c, g, or t
  misc_feature (520)..(525): n is a, c, g, or t
  misc_feature (527)..(534): n is a, c, g, or t
  misc_feature (536)..(537): n is a, c, g, or t
  misc_feature (539)..(539): n is a, c, g, or t
  misc_feature (541)..(542): n is a, c, g, or t
  misc_feature (544)..(545): n is a, c, g, or t
  misc_feature (547)..(548): n is a, c, g, or t
  misc_feature (551)..(556): n is a, c, g, or t
  misc_feature (558)..(558): n is a, c, g, or t
  misc_feature (564)..(567): n is a, c, g, or t
  misc_feature (572)..(573): n is a, c, g, or t
  misc_feature (575)..(578): n is a, c, g, or t
  misc_feature (580)..(582): n is a, c, g, or t
  misc_feature (585)..(585): n is a, c, g, or t
  misc_feature (587)..(589): n is a, c, g, or t
  misc_feature (591)..(593): n is a, c, g, or t
  misc_feature (596)..(597): n is a, c, g, or t
  misc_feature (599)..(599): n is a, c, g, or t
  misc_feature (601)..(601): n is a, c, g, or t
  misc_feature (607)..(611): n is a, c, g, or t
  misc_feature (617)..(618): n is a, c, g, or t
  misc_feature (623)..(627): n is a, c, g, or t
  misc_feature (630)..(633): n is a, c, g, or t
  misc_feature (636)..(637): n is a, c, g, or t
  misc_feature (639)..(639): n is a, c, g, or t
  misc_feature (641)..(641): n is a, c, g, or t
  misc_feature (643)..(648): n is a, c, g, or t
  misc_feature (650)..(651): n is a, c, g, or t
  misc_feature (653)..(653): n is a, c, g, or t
  misc_feature (655)..(658): n is a, c, g, or t
  misc_feature (661)..(661): n is a, c, g, or t
  misc_feature (664)..(667): n is a, c, g, or t
  misc_feature (669)..(669): n is a, c, g, or t
  misc_feature (671)..(674): n is a, c, g, or t
  misc_feature (676)..(677): n is a, c, g, or t
  misc_feature (679)..(685): n is a, c, g, or t
  misc_feature (687)..(687): n is a, c, g, or t
  misc_feature (689)..(690): n is a, c, g, or t
  misc_feature (694)..(696): n is a, c, g, or t
  misc_feature (698)..(699): n is a, c, g, or t
  misc_feature (717)..(717): n is a, c, g, or t
  misc_feature (770)..(771): n is a, c, g, or t
  misc_feature (805)..(805): n is a, c, g, or t
  misc_feature (1095)..(1095): n is a, c, g, or t
  misc_feature (1137)..(1137): n is a, c, g, or t
  misc_feature (1140)..(1140): n is a, c, g, or t
  misc_feature (1960)..(1960): n is a, c, g, or t
  misc_feature (1966)..(1967): n is a, c, g, or t
  misc_feature (1972)..(1972): n is a, c, g, or t
  misc_feature (1974)..(1974): n is a, c, g, or t
  misc_feature (1978)..(1978): n is a, c, g, or t
  misc_feature (1993)..(1993): n is a, c, g, or t
  misc_feature (1997)..(1997): n is a, c, g, or t
  misc_feature (2514)..(2514): n is a, c, g, or t
  misc_feature (2877)..(2877): n is a, c, g, or t
  misc_feature (2889)..(2889): n is a, c, g, or t
  misc_feature (3143)..(3143): n is a, c, g, or t
  misc_feature (3293)..(3293): n is a, c, g, or t
  misc_feature (3677)..(3677): n is a, c, g, or t
  misc_feature (3680)..(3680): n is a, c, g, or t
  misc_feature (3803)..(3803): n is a, c, g, or t
  misc_feature (3809)..(3810): n is a, c, g, or t
  misc_feature (3812)..(3812): n is a, c, g, or t
  misc_feature (3998)..(3998): n is a, c, g, or t
cnnncngnntgcnnccnncntnnnccngnnnnncntnnannnnnngggnnnnnccncannngcnnnnnnnnnnnnnggcnnncggnnnnncncnnnnnngntnnngggtncngnnngnngcngggntncngnngnnntnnncnnnnngccnggnnnnngnnnnnccnnngggccgnccnnngnnannccnnngncnngnnnccncnnnntnntnccnnttcnnnnnnnnncnnggngnntnanngnnnnnannnnnccnntnngggnnnnnggnnnnngggnanccngnngnnncnnaacnntnnnnnnnnnnntnccnnngttnggngggngnnnggcnncngnnnncntnnnnggggcnnnngnnnnnnnnnnnnnggtngnnnncnggngnntnggnnnggggnnnngnnnnanngnnnnnggnnnngncngnnnnntnnttcnnntntnaantnnnnnnncnnnncnccncnnggnnnntnnnncnggnnngnncnnnnggnnnggngtnannncnnnnnncnnnnnnnngnngngnntnngnnccnnnnnngnacgggnnnncgggnngnnnncnnnccngnnngnnnccnngncngggggnnnnnccttannccttnnnnnctnnnngcnncncntnnnnnncnncntnnnngcnggnnnngntnnnntnncnnnnnnnantnngggnnntnnttttccttccatagattncggcgggttcgccgaaacggatggtctatgtgttgggttcttggggccccgcnncgcctcaccgatagagcgggtccgggacggcggncggagggcgaaataaccccgtccgcgcatcggccacacgggcggatgagcgaacggggtcattcacggttctaccagttctcgctgccctggtagagggggtacttggcgcagagtgcatccacgcgagcgcgcagggccgcgatgtccgggttcggcagcagcacggaggcgatgatgtcagccacctcggtgaagccctcggcgtcgaagccgcgggttgccagcgcggaggtgccgatgcgcagaccggaggtcaccatcggcgggcgcgggtcgttcggaacggcnttacggttgacggtgatgccggcgtcgtgcagcaggtcctcngcntccttgccgttgagcgcgtggtggcgcaggtcgacgagcaccaggtgaacgtcggtgccgccggaggcaatcgaaacgccggcgtccttcacgtcctgctccagcaggcgcttcgccaggatctgcgcgccctcaatggtgcgcttctgacgctccttgaagccctcggatgcggcaatcttgaacgcggtagccttcgcggcgatcacgtgcatgagcgggccgccctgctggccggggaacacggccgagtcaatcttcttcttcagctcctcggtgcagaggatgaagcccgagcgggggccgcccagggtcttgtgtacggtggaggacaccacgtgtgcgtgcgggacggggttcgggtgcagacccgcagccaccaggcccgcgaagtgtgccatgtccacccacaggtacgcgccgatttcgtcggcaatcgcgcggaatgcggcgaagtccagctggcgggggtacgcggaccagccggcgataatcagcttggggcgctcggccagggccagctcgcgcacctgctccatgtcaacgtagccgttctcgtccacgctgtaggcgacaacgttgtacagcttgccggagacgttcagcttcataccgtgggtcaggtggccaccgtgcgccagggacagacccatgatggtgtcgccggggttcagcagcgcgtgcatgacggcgttgttcgcctgcgcgccggagtggggctgtacgttcgcgtgctccgcgccgaagagctccttcacacgggcaatggcgaggtcctcaacgatatcgacgtactcgcagccgccgtagtagcggcggncggggnntcccncngcgnacttgttggtcagcnccgngccctggctctgcatcacagcgcgggggacaaagttctcggatgcaatcatctcgagggtgttctgctggcgcttgcgctccagctcaatggcttctgctacctcggggtcgaggtcggcgaggggcatctcgaggatcttctgctcggtcattacgctcctgggagtgtttttacggtatcttcggtggctcgtcatcggggttgcggcagcgtctgcggctgaaaaccctgaatgaaaaaatatgagctacacctcataataccgtaaagcccgttctccttcgagaaggaaaacgggctttgggatgcatcatgatgaagttttacggcgccggtatggtaccggtgcgggacgcttgacacgccccggcgggcctatcggcaaggcggcgcaggtcggtgagtcctaagcctggcgcaggatggcggaggcgtactccaggtaggcctcgcgggcgctatccttcttaccgccggccaccagctgggtctgcaccacgtaaccggtcagcacngagagcacggccgcgccgatgacggtcagccattcctcgagctcctcatcggtgaagtccagttcagcggcgccccaggcgcggtagcgctccagggcctgatcgcgcaggtaggttagctgctcggaaaccacggcacccagctgcggcatggagaccgcctcgccccaggtcaccagcaggtgacggcgcaccttgggggtgtccagcaccttcaggcacccgaacacgtagtcccagggctgctcggcgcggatgcggtcgaagggagccaggtccatgcgcgcggcggcgaggataatctcatccttggaggagaagtgattgtagatggctccagcagacaggccggtggcggcgatnatctcgctcatngaggccttctggtagccgtgcttgatgaaacactcgcgggcggtctctacaatctgagaacgcctgttctttttgtattcttcgctgactttaggcacaacctaatcctagcgaattttttggcgctccgcgcgccttccgggcgcaccttccgagctgtggagccccaaaacgcaaaaaatagaataaaaattccataaaaaggcggggtgccccgaaaatccggggcaccccgcctcactcacgcgctcacncccgcccggccgtaaccggccgcggcggtacgcgtagccgcaaaatcttagtggaagaagtggcgggtaccggtcaggtacatggtcacgccggcagccttagcggcctcgataacttcctcatcacggatcgaaccgcccgggtgcacnacggcacgcacgccggcgtccagcagaacctgcaggccgtcagcgaaggggaagaacgcatcggatgcggcaaccgcaccgcgggcacgctcgttaccctcgccgccgagggtgttcgcacgctcaacggacagcttgcaggagtccacgcggttcacctggcccatgccgatgcccactgcggcgccgttatcggccagcagaatggcgttcgacttgggcgagcgcagtgcacgccacgcgaattcgaggtcgcgcagggtggcctcgtcggcgggctcgccggcaaccagggtccagttcttcgggtcgtcgccctcagcctgcaggcggtcggcctcctggaagagcgcgccgccggagatggggcggtactcgatggcntcncggctaaagccctcgggcagaaccagcaggcgcaggttcttcttctcgcgcagaatctccagggcctcgggctcgtagccgggggccacgacaacctcggtgaagatgcccttgacggtacgngccatnncngcggtcaccgggcggttagcggcaatcacgccaccgtatgcggacagcgggtcgcaggcgtgagccttcgcgtgagcgtccgcaatcggatcggcggcaccgggggttgccacggcgataccacaggggttgttgtgcttgatgacggcaacggccggctcgtcgaagtcgtaggcggcgcgcagngc

SEQ ID NO: 279 - DNA, 4000 bp, Escherichia coli
tgctgtcgcggccggtgccggatgcagcgatttcctcgacaccagtctcgaccagaacgaaacgggggagtcgatcgagacgacactcggtacgttgtggaaattcggcaatgctttctacaccccgattgcttccggttatactacgctcgactccaatcttttcgcagcggcgaccgacgaggcacagcaaaccaaagtgcagtgcaatgccagctatttcaacaagggggtcatcaacgctaacctcaacccgatttcgaatctttataccgactgctacgaagggatccgtgccgccaattttttccttgactacacagccaacggcaaaggcgagtacatggtgggcatgaaccgcgatacgatcaacgaccgccccaactatgaacgggacttggcctcgctgcactggtaccaggccgaagcgcacatcgcacgggcttattactatgccgaactgatcaagcagtacggcggcgttcccatcgtcgagagccagtatgccgcgaacaagttcatcccgcgttcctcctacgaccagatagtcgagtacattgtcaaggagatcgatgaccataagggaaaactggctgtcgactgggcgagtttctccgagcgcaacggccgctttacgctgggcgccgcgctggccatcaaggcgcgtgtgctgctctatgccgcctcgccgctccacaatcccgacaacgatgtcgagaagtggaaaaaagccgccgcggctgcctacgatattatcagcaacccggatttgaactactccctcgacagcgattacggggcttatttccaaggtaaccgcagcctttccagcccggaaaccatctatgtcgtacgccgcgaacagtccaatgcgatggagagcaacaactatccgatcgctacgccgggcggtgcgtcgggcgtgacgccgacgcagaacttggtcgaggcctatgagtgggtcggcgatcccgttgccggggatccctatgccaaccgcgacccgcgtctggcggcaagcgtcgtgaccaacggcagcacctggaacggtcatgtgatcgaccagtcaccgggcggtaggcacgacatgtccgccccgaatgcaagcaagacgggatattaccttaaaaagttcctgaccgacaacctcgacctgacgcagggcgccaaggtgcagcataactgggtgtcctaccgctatgccgaggtgctgctcaactatgccgaagcgatgaatgaggcctatggccccgaccaggctcccggcgactatgcgctcacggcgctcgatgccctgcaactggtgcgcgaccgtgccagtctgcagcttccgattgtcacggcggcgacccgcgacgaattccgcgaggccgtcaagcacgaacgccgcatcgaactggccttcgaggatcatcgttactgggatctgctgcggtggaaggatgcgatggaggtactcaacaaacccgtccgcggtgtgaaggtaacgaaaacaggagaaggcaagtggtcgtatacgcagaccgaagtggctacgcgcactttcctcgaacgcaactattatatgcctttcacccgttccgaggttgaaaattcgaatcatacgctcgaacagaaccccggttattagttccgggatgcaaaagaacaatgaattatgaaaaacaagttgatcctgctcatcgcatttctttgcacatgtgcctttgcagcctgcgagggcgacggcgacgccgattacggattcggtaaagtatatatgccccaggccgtttcgaccggcggcctgaacaactcctatgccgtaccttcgggcggtggtgactatacctacaatttccgtgttgaaaacggtacggttcgaataatcctgggtgtcatacgctcgggaaagctctccgataagaaagggtataccgtcgatgtctacacttctgcggaggacacggcggccgccgtgtccgcattcggcggcgaagccatgcccgagggactttattcgctgccttcgacggtcgtggtgccagacgggaaaaccggtgggacattctacctcgatattcccgtgctggcgatttcgaggagcgaatacgccggcaagaaactggtgctttccgtcggaatccggaatccgtcggcatacgaactttccgatgcggcgaccaaaaccgccgttatcgtgaatgtcgatgccctgaaggccttgctctaaacatcttaacctgtgagaacgatatgcctcttgtcggagaggcatatcgtttctcaaaatcatgacgacctatgaaaaaagccattctgatcctctttgtactcctctccgcggccgggatacgggcgcagatccgttccgtggaatgcactgcgcccaggcccggcctttacgagcgtaccgatttcacgatccgcttgacggcccgttacgacaatgcctatctgcaggagcaggttgctctcgacatgctgattaccacgccttcgggcgccgaacgtatgctgccttgttactgggtcgagggggcgtcgggtgccgagtcgcgctgggaagcccgtttcacgcctcaggaagagggacgctatgcctgccgcttccgcctgagcgaacagggccgtgaaacctcccgctcgaaaaccgtacacctcgatgtcggccctgccgcggattcccggggtattctgcatgtgcgcgattactggacgttgatttacgacgacggaacgccgttccggggtgttgctgaaaacatctgctgggaatcgcgtgccaacgacgattcgcgctttttcaaggccctgcacgaacagcacgacaaatataactacgactacatgctgccgctcttcgcccgcaacggtggtaattttattcgcgtttggatgtgcggattcaatttcccgatcgaccagcaagaccatttcaacaacatacgctacgaggcatccgatgcatactataatcccagcgccatcgcccgtctcgaccatttcgtcgggctttgcgaacggctggggatacacgcgatgctctgcatgggacagggtgccgtgcatgccgaccgggcgtttttcaccggggagccgcaggcccgccgctacatgaaccgcctgcgctatatcgtcgcacgctggggttacagtccggcgatcggtatgtgggagttcttcaacgagatcgacaacatccagttccgcgatgcgaagaacccgatcccggccgaagagatagtcgcctggcatgcccgcatggccaggtacctgaaaagtatcgacccttacggacaccccgtcaccacgtcgatttcccaccgggatctcgaagggctcaattcggtgcctgggatcgacgtcaaccagaagcatatctattgcaatacgggcattattccggccgagatactccgctatgaaaaccgtttcggcaaaccctacgttatcggcgagttcggctatgagtgggactggtcgaagaacttcgatgattttggcgcggatatggatcgcgatttccgccggggactttggtacggcattttctcgcccacgcctctgacgccgatgagctggtggtgggagtatttcgagaaccgcggtatgatggcctatttcaggggagtgcggcaaatatccgaccggatgctcgccgacggcaagggctctttcgaacagatgaccgtagcgtgcaacccggcagaagcaatgggcatccggtgtggcgacgtggtctatgtttacctttataacaattctgccgagcacatcagggaggcgggactcaccgtcaatctgggttgtaatggcagctatgcggtcgaagcgttcgatcccgcgacgtgcattagcacggcgcagggcaaccttccgaccccagggcgttttgtactcgaaaaaatcacgctcgcgccatatgccgagcggatctacatctttactcccgaatccgttaaatgaccggtttatgcgtcttaaaacaattgccatgatgctgacgctgggcatcgct

SEQ ID NO: 280 - DNA, 4000 bp, Escherichia coli
  misc_feature (140)..(140): n is a, c, g, or t
  misc_feature (156)..(156): n is a, c, g, or t
  misc_feature (224)..(224): n is a, c, g, or t
  misc_feature (264)..(264): n is a, c, g, or t
  misc_feature (294)..(294): n is a, c, g, or t
  misc_feature (300)..(300): n is a, c, g, or t
  misc_feature (404)..(404): n is a, c, g, or t
  misc_feature (447)..(447): n is a, c, g, or t
  misc_feature (474)..(474): n is a, c, g, or t
  misc_feature (546)..(546): n is a, c, g, or t
  misc_feature (558)..(558): n is a, c, g, or t
  misc_feature (570)..(570): n is a, c, g, or t
  misc_feature (595)..(595): n is a, c, g, or t
  misc_feature (597)..(597): n is a, c, g, or t
  misc_feature (724)..(724): n is a, c, g, or t
  misc_feature (766)..(766): n is a, c, g, or t
  misc_feature (781)..(781): n is a, c, g, or t
  misc_feature (907)..(907): n is a, c, g, or t
  misc_feature (940)..(940): n is a, c, g, or t
  misc_feature (964)..(964): n is a, c, g, or t
  misc_feature (1003)..(1003): n is a, c, g, or t
  misc_feature (1015)..(1015): n is a, c, g, or t
  misc_feature (1027)..(1027): n is a, c, g, or t
  misc_feature (1066)..(1066): n is a, c, g, or t
  misc_feature (1108)..(1108): n is a, c, g, or t
  misc_feature (1138)..(1138): n is a, c, g, or t
  misc_feature (1144)..(1144): n is a, c, g, or t
  misc_feature (1223)..(1223): n is a, c, g, or t
  misc_feature (1336)..(1336): n is a, c, g, or t
  misc_feature (1373)..(1373): n is a, c, g, or t
  misc_feature (1404)..(1404): n is a, c, g, or t
  misc_feature (1426)..(1426): n is a, c, g, or t
  misc_feature (1441)..(1441): n is a, c, g, or t
  misc_feature (1548)..(1548): n is a, c, g, or t
  misc_feature (1551)..(1551): n is a, c, g, or t
  misc_feature (2062)..(2062): n is a, c, g, or t
  misc_feature (2388)..(2388): n is a, c, g, or t
  misc_feature (2741)..(2741): n is a, c, g, or t
  misc_feature (3248)..(3248): n is a, c, g, or t
cgattaagcgatagccaggcgtgccagtcactgctgggctcggtacgacgcagttctgaggcgaggcgctgcactgaagcctctgagatcaggtcgaagacggttgaatggctgatctgactgtctgtatctggcgccangcgaagtcgatcgagngctactttcgccgcctcaatgggctgttgagactcttggaatcgtctctgacgctctgagagcagcangtcatgctcttgaatgctgttaaatgagatcgcgtctaanaaccgattggactgcctgaggtcgccgcgnagccanaagagctgcgaacgaataaactgttctgtctttggagaaatgtctgcctcggttagggcgtcgagctccgtctgcgcaaacagccagccccgcgcgctcgacanatcttgactccatgcaatgatgcgcgtgtccaaagtgtcgtcntgggtgatgccgggcgacgtctcctgncgactgggaatgggataagcggtttgctgattactggcgcttttgggctcggtgggagaggtcgtggtacangacgacgtggcnaggacaacagcngtcaggaccgccaatcgatgcagtngngcagataaagtgccattatgtcctgctcccgcagggtcttttaacgtcattgtagagaaaccactcattttccatccgattgtacgtagaggagcgtgaattgaaagccgcattgtatgttgtgccnacaccaatcggtaactttgaggacatgacgcttcgcgcaatnagcgtgctgcagggngtggatcttattgcggctgaggatacgagacattcgcggatgctcttgagtcattacgatatcgacacgcctatgacaagttttcacgagcacagcggcgaggcggtcgttactgatgtcgccagncgcatcgagcagggacaagccgttgcattaatnagcgatgccggaacaccgctcgtntctgatcccgggtacgtcctggtaaggtccgtgcaagancggggcctgtcnattgtccccctncctggcgcgtgtgccgctgtgactgcactcagtgctgcnggcttgccaacccatagtttccggttcgagggtttcctctcngccaaacgcggtccgcgacgctcccgcctngacgcncttaagtcaattgattcaacactgatcttctatgaggccccacaccggattttggatttgttgagtgacatgctcgagntcctcgagcccgatcgcgaaatttgcattgctcgagaaattacaaaaacatttgaaactattcgtcgtgggtcgattgcggaaatttatgcctgggtgggcagtgattcaaancagcagcgaggcgagcttgtcgtgatggtggcgtcanggcaggagcaagcaagcacggtaagtgacgnggcgttaaagctgctttaccgnctctcggacgagttnccacctcggaaagctgcacagcttgtggccgatcattacaaactgaaatcgcgcgcgctttatcagttactgctagatcgagagtaatcgtttgttgagtctgttcnttncgggtgctagcgtacgcgtgagtcagttagacggccgctgtaactccggttacagaggaaagtccgggctccaacgggtcagagcgccaggtaacgcctggggggcgtgagctcacggaaagtgcagcagaaaggaaaccgcccatgtgttttgtgggtaagggtgaaaaggtgcggtaagagcgcaccgcgcggctggtaacaggcgtggcgatggtaaaccccgctcggagcaagaccaaatagggatccttatgccgtgaccctcggcggatccgggtaggtcgctacaggcgtctggtgacaggcgtcgcagatgaatggccgttctcgacagaacccggcttatcgactgactcttctgtgcacccccgtaaaagggggtgttctttatacttttttagaatataaaactaattttcaattacctttcctgcttctggcatagaaagtatctccaacacccacctaatagactgacttttttcttaattaccgtcctcataagccncgaaaaaaaccgccgatttgttgccgagaggcgcatataaggtgctgaaatacttagagatttttatttcaagacattgaccctccgtcgtcacgttgttaaggtggtgattagtgggagaaagtgggtaattggggaattaacctgcttttttttgaaataagtggaggtttgtggtgtttaggggagtacagcacatcaatcttgatgcgaaagggcgattgtctgtccctgcgcgtcaacgcgagttgcttctcgatatcagtgcgggctccgtggtcgtgaccatcgatacacagtcttcatgtttggtgttgtatcccttncgcgagtgggagcgcattgagcgcgatgttcaagacctgcccacactcaaccctgcggttcgacgtttccagcggcttgtgctgggttatgccagtgatcttgaccttgatggaaatggtcgggtgttgttgcctggcgcgctgcgtgagtacgcgcagctcgacaagcgcgtggtgttggtcggacaggggaataagctcgagctttggtctgagcccctttgggaggctgagtgcaaagctgcattggcggccgacggcgacgagttgcctgccgagctcctagggctgaagctttgaacgatacgggacatgtttccgtattgctcgaggagtcggtcgcggccttggcnattaaccccgacggcacgtatctcgatgggacgtttggccgaggcggtcacagcaaagcaatcttaggtgccttgtcctctaagggcagactcatcgcggtcgataaggaccccgctgctgaggcgtcggccaagtcgtttgctgacgactcgagatttgaatttatggcgggtagttttgcagatctaccggcatcggtttccgacggcgcgctcgacggtattttgctcgacctgggcgtctcgtcaccgcagcttgataacgcggatcgtggctttggatttcgcgacgacggtccactggacatgcgaatggatacgcgttcgggtgtcactgctgcggactggatcgccgtggcgtcagaagcccagatcgctgaggtgattaaaacgtacggtgaagagcggttcgcacgtcgcatggcatccgccattgtgaaggtgagggctgagaccccgatatcccgaactaagcagttggccagcattgtcgccgaggcaaatccncggtgggagcctaacaaacatcctgcgactcgggcgttccaggccattcgtatctatatcaaccgagagcttgaggacctagagctcgcactcgatcctatggtcgccaagttggcgccgcgaggccgtttagttgttatcagctttcactcccttgaagatcgaattgtgaaacggtttatgcgcaatcaggctagaggtgagcaactccctcggcgcgtgccagtgattgatagcgatacgggtaaaacgctaaatttggtgggtaaggccgtgaagccctcaagcagcgaggtcgagcgtaatccaaggtcgcgatcggccattatgcgaattgcggagcgacggtaatgcgggggcgattcagcgcttcacccttgcggatcgccctctgtgctggacttgttttgttcagcgcgttgttggttgtcggtgagacgcatcaaacgcgtttgctctttaccaagcttcaggctcaggagagtgagcggtggcacttacaagagcgctacagtcgtcttttattggaatactcaacactctcggcgcctcaccgcatcagtgcgctttcacagacatcgctcgctatgaagtcgcccaatacggggtcgattagggtggtggcgcaatgagccgcggtcgcccccccgttcttgtttatcgctggcgaatcgcccttacggcggcagtgcttgcagggctctttggcatgttggttgttcgactggtgcaactgcaggtgggtgcaagtc

SEQ ID NO: 281 - DNA, 4000 bp, Escherichia coli
  misc_feature (1968)..(1968): n is a, c, g, or t
  misc_feature (1971)..(1971): n is a, c, g, or t
  misc_feature (1974)..(1974): n is a, c, g, or t
  misc_feature (1985)..(1985): n is a, c, g, or t
  misc_feature (1992)..(1992): n is a, c, g, or t
  misc_feature (1995)..(1996): n is a, c, g, or t
  misc_feature (1999)..(1999): n is a, c, g, or t
  misc_feature (2014)..(2014): n is a, c, g, or t
  misc_feature (2019)..(2019): n is a, c, g, or t
  misc_feature (2032)..(2032): n is a, c, g, or t
  misc_feature (2035)..(2035): n is a, c, g, or t
  misc_feature (2041)..(2041): n is a, c, g, or t
  misc_feature (2053)..(2053): n is a, c, g, or t
  misc_feature (2780)..(2780): n is a, c, g, or t
  misc_feature (2984)..(2986): n is a, c, g, or t
  misc_feature (2988)..(2994): n is a, c, g, or t
  misc_feature (2996)..(2996): n is a, c, g, or t
  misc_feature (2998)..(2998): n is a, c, g, or t
  misc_feature (3000)..(3001): n is a, c, g, or t
  misc_feature (3005)..(3010): n is a, c, g, or t
  misc_feature (3015)..(3017): n is a, c, g, or t
  misc_feature (3020)..(3021): n is a, c, g, or t
  misc_feature (3023)..(3024): n is a, c, g, or t
  misc_feature (3026)..(3028): n is a, c, g, or t
  misc_feature (3033)..(3035): n is a, c, g, or t
  misc_feature (3037)..(3039): n is a, c, g, or t
  misc_feature (3041)..(3042): n is a, c, g, or t
  misc_feature (3044)..(3044): n is a, c, g, or t
  misc_feature (3046)..(3046): n is a, c, g, or t
  misc_feature (3048)..(3050): n is a, c, g, or t
  misc_feature (3052)..(3057): n is a, c, g, or t
  misc_feature (3059)..(3064): n is a, c, g, or t
  misc_feature (3066)..(3069): n is a, c, g, or t
  misc_feature (3071)..(3071): n is a, c, g, or t
  misc_feature (3073)..(3076): n is a, c, g, or t
  misc_feature (3078)..(3078): n is a, c, g, or t
  misc_feature (3080)..(3082): n is a, c, g, or t
  misc_feature (3084)..(3084): n is a, c, g, or t
  misc_feature (3088)..(3088): n is a, c, g, or t
  misc_feature (3090)..(3091): n is a, c, g, or t
  misc_feature (3093)..(3094): n is a, c, g, or t
  misc_feature (3096)..(3096): n is a, c, g, or t
  misc_feature (3098)..(3098): n is a, c, g, or t
  misc_feature (3100)..(3100): n is a, c, g, or t
  misc_feature (3104)..(3104): n is a, c, g, or t
  misc_feature (3106)..(3127): n is a, c, g, or t
  misc_feature (3129)..(3133): n is a, c, g, or t
  misc_feature (3136)..(3140): n is a, c, g, or t
  misc_feature (3143)..(3144): n is a, c, g, or t
  misc_feature (3146)..(3163): n is a, c, g, or t
  misc_feature (3165)..(3165): n is a, c, g, or t
  misc_feature (3168)..(3172): n is a, c, g, or t
  misc_feature (3174)..(3174): n is a, c, g, or t
  misc_feature (3176)..(3177): n is a, c, g, or t
  misc_feature (3179)..(3181): n is a, c, g, or t
  misc_feature (3184)..(3188): n is a, c, g, or t
  misc_feature (3193)..(3208): n is a, c, g, or t
  misc_feature (3210)..(3210): n is a, c, g, or t
  misc_feature (3212)..(3213): n is a, c, g, or t
  misc_feature (3216)..(3217): n is a, c, g, or t
  misc_feature (3219)..(3219): n is a, c, g, or t
  misc_feature (3223)..(3227): n is a, c, g, or t
  misc_feature (3231)..(3234): n is a, c, g, or t
  misc_feature (3236)..(3240): n is a, c, g, or t
  misc_feature (3244)..(3245): n is a, c, g, or t
  misc_feature (3247)..(3256): n is a, c, g, or t
  misc_feature (3259)..(3260): n is a, c, g, or t
  misc_feature (3263)..(3270): n is a, c, g, or t
  misc_feature (3273)..(3273): n is a, c, g, or t
  misc_feature (3276)..(3276): n is a, c, g, or t
  misc_feature (3278)..(3289): n is a, c, g, or t
  misc_feature (3291)..(3298): n is a, c, g, or t
  misc_feature (3301)..(3303): n is a, c, g, or t
  misc_feature (3305)..(3311): n is a, c, g, or t
  misc_feature (3314)..(3316): n is a, c, g, or t
  misc_feature (3318)..(3321): n is a, c, g, or t
  misc_feature (3323)..(3326): n is a, c, g, or t
  misc_feature (3328)..(3331): n is a, c, g, or t
  misc_feature (3333)..(3333): n is a, c, g, or t
  misc_feature (3335)..(3338): n is a, c, g, or t
  misc_feature (3342)..(3348): n is a, c, g, or t
  misc_feature (3353)..(3357): n is a, c, g, or t
  misc_feature (3359)..(3368): n is a, c, g, or t
  misc_feature (3371)..(3372): n is a, c, g, or t
  misc_feature (3374)..(3380): n is a, c, g, or t
  misc_feature (3382)..(3384): n is a, c, g, or t
  misc_feature (3386)..(3389): n is a, c, g, or t
  misc_feature (3392)..(3393): n is a, c, g, or t
  misc_feature (3395)..(3396): n is a, c, g, or t
  misc_feature (3398)..(3399): n is a, c, g, or t
  misc_feature (3402)..(3402): n is a, c, g, or t
  misc_feature (3404)..(3404): n is a, c, g, or t
  misc_feature (3406)..(3407): n is a, c, g, or t
  misc_feature (3409)..(3410): n is a, c, g, or t
  misc_feature (3415)..(3416): n is a, c, g, or t
  misc_feature (3418)..(3424): n is a, c, g, or t
  misc_feature (3427)..(3428): n is a, c, g, or t
  misc_feature (3430)..(3434): n is a, c, g, or t
  misc_feature (3436)..(3437): n is a, c, g, or t
  misc_feature (3441)..(3443): n is a, c, g, or t
  misc_feature (3445)..(3450): n is a, c, g, or t
  misc_feature (3452)..(3453): n is a, c, g, or t
  misc_feature (3458)..(3458): n is a, c, g, or t
  misc_feature (3460)..(3460): n is a, c, g, or t
  misc_feature (3462)..(3462): n is a, c, g, or t
  misc_feature (3464)..(3467): n is a, c, g, or t
  misc_feature (3469)..(3469): n is a, c, g, or t
  misc_feature (3471)..(3483): n is a, c, g, or t
  misc_feature (3486)..(3486): n is a, c, g, or t
  misc_feature (3488)..(3492): n is a, c, g, or t
  misc_feature (3495)..(3495): n is a, c, g, or t
  misc_feature (3497)..(3504): n is a, c, g, or t
  misc_feature (3506)..(3517): n is a, c, g, or t
  misc_feature (3519)..(3522): n is a, c, g, or t
  misc_feature (3525)..(3525): n is a, c, g, or t
  misc_feature (3527)..(3528): n is a, c, g, or t
  misc_feature (3530)..(3530): n is a, c, g, or t
  misc_feature (3532)..(3535): n is a, c, g, or t
  misc_feature (3537)..(3537): n is a, c, g, or t
  misc_feature (3539)..(3539): n is a, c, g, or t
  misc_feature (3542)..(3543): n is a, c, g, or t
  misc_feature (3545)..(3547): n is a, c, g, or t
  misc_feature (3549)..(3557): n is a, c, g, or t
  misc_feature (3559)..(3561): n is a, c, g, or t
  misc_feature (3563)..(3563): n is a, c, g, or t
  misc_feature (3566)..(3568): n is a, c, g, or t
  misc_feature (3571)..(3571): n is a, c, g, or t
  misc_feature (3573)..(3577): n is a, c, g, or t
  misc_feature (3580)..(3580): n is a, c, g, or t
  misc_feature (3582)..(3582): n is a, c, g, or t
  misc_feature (3584)..(3586): n is a, c, g, or t
  misc_feature (3588)..(3591): n is a, c, g, or t
  misc_feature (3594)..(3597): n is a, c, g, or t
  misc_feature (3600)..(3600): n is a, c, g, or t
  misc_feature (3602)..(3607): n is a, c, g, or t
  misc_feature (3610)..(3619): n is a, c, g, or t
  misc_feature (3622)..(3624): n is a, c, g, or t
  misc_feature (3626)..(3627): n is a, c, g, or t
  misc_feature (3630)..(3635): n is a, c, g, or t
  misc_feature (3637)..(3637): n is a, c, g, or t
  misc_feature (3639)..(3639): n is a, c, g, or t
  misc_feature (3641)..(3648): n is a, c, g, or t
  misc_feature (3652)..(3655): n is a, c, g, or t
  misc_feature (3657)..(3657): n is a, c, g, or t
  misc_feature (3659)..(3661): n is a, c, g, or t
  misc_feature (3663)..(3663): n is a, c, g, or t
  misc_feature (3665)..(3677): n is a, c, g, or t
  misc_feature (3679)..(3681): n is a, c, g, or t
  misc_feature (3683)..(3690): n is a, c, g, or t
  misc_feature (3692)..(3697): n is a, c, g, or t
  misc_feature (3700)..(3702): n is a, c, g, or t
  misc_feature (3704)..(3710): n is a, c, g, or t
  misc_feature (3712)..(3713): n is a, c, g, or t
  misc_feature (3715)..(3716): n is a, c, g, or t
  misc_feature (3718)..(3721): n is a, c, g, or t
  misc_feature (3723)..(3723): n is a, c, g, or t
  misc_feature (3725)..(3727): n is a, c, g, or t
  misc_feature (3729)..(3729): n is a, c, g, or t
  misc_feature (3731)..(3732): n is a, c, g, or t
  misc_feature (3737)..(3739): n is a, c, g, or t
  misc_feature (3741)..(3746): n is a, c, g, or t
  misc_feature (3752)..(3752): n is a, c, g, or t
  misc_feature (3754)..(3755): n is a, c, g, or t
  misc_feature (3758)..(3762): n is a, c, g, or t
  misc_feature (3764)..(3779): n is a, c, g, or t
  misc_feature (3781)..(3781): n is a, c, g, or t
  misc_feature (3783)..(3783): n is a, c, g, or t
  misc_feature (3785)..(3789): n is a, c, g, or t
  misc_feature (3791)..(3793): n is a, c, g, or t
  misc_feature (3795)..(3795): n is a, c, g, or t
  misc_feature (3797)..(3797): n is a, c, g, or t
  misc_feature (3799)..(3802): n is a, c, g, or t
  misc_feature (3811)..(3812): n is a, c, g, or t
  misc_feature (3816)..(3816): n is a, c, g, or t
  misc_feature (3818)..(3819): n is a, c, g, or t
  misc_feature (3821)..(3822): n is a, c, g, or t
  misc_feature (3824)..(3824): n is a, c, g, or t
  misc_feature (3826)..(3826): n is a, c, g, or t
  misc_feature (3829)..(3830): n is a, c, g, or t
  misc_feature (3832)..(3833): n is a, c, g, or t
  misc_feature (3835)..(3835): n is a, c, g, or t
  misc_feature (3838)..(3838): n is a, c, g, or t
  misc_feature (3840)..(3843): n is a, c, g, or t
  misc_feature (3846)..(3846): n is a, c, g, or t
  misc_feature (3849)..(3851): n is a, c, g, or t
  misc_feature (3854)..(3858): n is a, c, g, or t
  misc_feature (3860)..(3862): n is a, c, g, or t
  misc_feature (3864)..(3864): n is a, c, g, or t
  misc_feature (3866)..(3866): n is a, c, g, or t
  misc_feature (3868)..(3868): n is a, c, g, or t
  misc_feature (3871)..(3871): n is a, c, g, or t
  misc_feature (3875)..(3875): n is a, c, g, or t
  misc_feature (3877)..(3880): n is a, c, g, or t
  misc_feature (3882)..(3882): n is a, c, g, or t
  misc_feature (3884)..(3888): n is a, c, g, or t
  misc_feature (3890)..(3891): n is a, c, g, or t
  misc_feature (3893)..(3897): n is a, c, g, or t
  misc_feature (3899)..(3899): n is a, c, g, or t
  misc_feature (3901)..(3901): n is a, c, g, or t
  misc_feature (3908)..(3910): n is a, c, g, or t
  misc_feature (3912)..(3913): n is a, c, g, or t
  misc_feature (3915)..(3915): n is a, c, g, or t
  misc_feature (3920)..(3920): n is a, c, g, or t
  misc_feature (3925)..(3926): n is a, c, g, or t
  misc_feature (3930)..(3930): n is a, c, g, or t
  misc_feature (3934)..(3934): n is a, c, g, or t
  misc_feature (3937)..(3937): n is a, c, g, or t
  misc_feature (3946)..(3950): n is a, c, g, or t
  misc_feature (3952)..(3953): n is a, c, g, or t
  misc_feature (3956)..(3957): n is a, c, g, or t
  misc_feature (3965)..(3965): n is a, c, g, or t
  misc_feature (3968)..(3970): n is a, c, g, or t
  misc_feature (3980)..(3984): n is a, c, g, or t
  misc_feature (3986)..(3986): n is a, c, g, or t
  misc_feature (3989)..(3989): n is a, c, g, or t
aatattttttaaacaccttttcaaatttacctggctaatccttatcagattgggaaatattctgtaacctaagaaaggaataccttgactaactttatttaactgggttactttatcttttattttcaggtgcagggcattagacaaaaaacatctaattaaaacaaggtctctttgaagattttcttttttatttgaaaaaagaataatatcatccatatatcttacataacccttataaccaaggttatgtttaacatattgatcaagtttattcaaataaatattggcaaaaaattgggatgttaaattacccaccggtaacccaatttctatattattattcatactcgtgttctgattttttagaatgatggaacataaattaataataaaagggtctttaattttgcggttaattaaatccaataaaatgttatgatctatattaggaaagaatttctcaatatccagtttcataaaccaggaatatttcctggaataattttgaactgctgatacagctaaatgtagtccttttcctttacgcgtagcataagaatctggaataaaaatattttcaaaatatggttcaattacattaactaatgcatggtggactactctatctctaaaatcagcaatactaataagccgttctttaggttccttaatattaaagtatctataaggatggggtttataggttccattttgcaattcactttgtaattcaaatatattcttttcacaataatatatccattctgctgtttcttcttttctttttttatgtttacatgctttttgataagcaagataaaggttctgccaagaaattaatttttcccaaagatatcctatccttttaggcactttttaaccaaccccctaccattttcccgctttccagtaattccctactgatatattgatattggttttcagctaataatttcattttataagccatttgaattaatgttcttaatacatccaacttcaaatttattttatttaaatattcccttttagatgaactatagatagtttgaacaatcaattctaatatatctaaacatatattatccattttctgagctaatgaatatctcagattttttggaaatctttctgtccttccaaatatccagatagatacatctatccattttacatacaaagggtaatcatttttcattttttaataccgtttcttgtaatatcttgataatctgctcaccatatttttctgctttccccttcatccctttaatagaataaaaatcacttattgtttggggttgttttttcacaatctcataaagctgagaattatacattataatataggcaggtaatccttcattggcagcaaattcatttcgccaatctcttaatctctcatattgttcttgttccgatttacttaaactatttaaatcaggcctaagatgtgtccctttacgcggtaaatattctacaaaaaaagaataatagatattcccttcattattaataaattctttttctatcctaataacattgttatcttgacaaaaacggttaaattcttgatcttcaaattcacccctatctctgtcaaatctaactaacatcaatttaaacataccttttccattctattatttttattgctaagtaaaaccatatttcttgtttaaactaaaataaggtaacatcatttcctaaaaaagatgtataaaatttagcttaacaaatctcttaattatgatgttcatatctatcatacttaattaaatactctaaatacaattatgtgttttaccttatccaaaatattttggcagggggacaggtccccctgcacccccactcatcgtttacctcattcatttcttgcttttgttcttcatttgcaaaaggcaaaaaaggaaaaaagcaaaaattaattaagggaaatcctacaaacgcggaagccaatgncgntgntgctgtaggtngcactgntgnngtnacgattggaaacagngcaantgctggcaatgtngtnccagcnaccgccacgtanaacacgataggtaccactttctgctccatggggattattttgatctcctgtgggataagctccataaatatcccaacaccactcccaaacattaccactcatatcaaacaattgtaattcattggcactttttgtagctaccggatgagtagtaccatctgaattagtagtataccaggcaactccatctatatcattacttccactataggtataacccaggctgctattaccaccccgggcagcaaacatccattccatttcagtaggtaaacgatagccgttagcagtccagttacaactgaaattagtatgattagaagcagttccgctccacccggagggccaagcattagggttagttccatactcaatttctccaactttataactgtaacaaggtgtaagattttcctgcatacttctccggttgcaatactcaatagcattgaaccaggttgtttgctccacaggcctgctgagatcaccggtaaaataagagggattagttcccattacagctaaatattcaccctgcgtaatttcagttctatcaagataaaaagtgctgattgtaacattggaggtgccgttattaaaagttccaccttccactttgataaatcctaccggctgaagggtgggagaaggattatcgcgagcaatcaatttaagcttgtaattagaaccagtaaccattccatcttgagcgggataccaggttatntgttttcctgttccagttgtaactgcattacctatatcacctgttgtatgggtagggaaaaaagtataacttgctcccccgttattagaaacgagcattataacttgacagtttccatcagctgaaagatcataagatattgtaatctgtccggtaccaggtgttaccgtaacattgcttactgttgggacagtagcagcaaannngnnnnnnnanananntaannnnnnaatannnatnngnntnnntttcnnntnnntnntncntnnntnnnnnntnnnnnntnnnngntnnnntntnnntngttngnngnnanangnaaanannnnnnnnnnnnnnnnnnnnnntnnnnnttnnnnnttnncnnnnnnnnnnnnnnnnnntngcnnnnngntnncnnnttnnnnntttcnnnnnnnnnnnnnnnntnannttnnanattnnnnntttnnnntnnnnnattnntnnnnnnnnnnaannaannnnnnnnccnggntnnnnnnnnnnnngnnnnnnnntannnannnnnnntannngnnnnannnngnnnntncnnnnttcnnnnnnngtaannnnnannnnnnnnnntcnntnnnnnnnannntnnnnatnnanntnnatnantnncnnccagnnannnnnnntanntnnnnnanntatnnntnnnnnnanntacanananannnncntnnnnnnnnnnnnngtngnnnnnatnannnnnnnnannnnnnnnnnnngnnnnagntnntncnnnntngnttnntnnntnnnnnnnnnannnanatnnnttncnnnnngantnannnannnnaannnnacncnnnnnnttnnnnnnnnnntgnnngnnaannnnnntngntnnnnnnnnaggnnnngntnnntnannnnnnnnnnnnntnnntnnnnnnnncnnnnnngannnannnnnnntnngnntnnnngnannngnannaacannngnnnnnncctttncnnaannnnncnnnnnnnnnnnnnnnntnantnnnnnannntntnannnnccctttccnntaanannanntncnctnntnntnatnannnnaantannnatnnnnntnnntntntnttnatantnnnncncnnnnntnngnnnnntnanctttttnnntnntntttanatctnnttanattntanatataaatnnnnnannccnnattctctnttnnntaaaatattnnnnntnttncctatataata

SEQ ID NO: 282 - DNA, 4000 bp, Escherichia coli
  misc_feature (1996)..(1996): n is a, c, g, or t
cgttcttcgtccattcgtgtcgtttccagacggtttcgcgaagacgcgccgaagaggttccaacgcactaacaccccacgcgttccacgcgtactactttcaacaaccaccaccacatccatgcgcagatgttcactttccccacggcgtcgtcggtttgagacgctcgggaggcgcaaacgtcattggacagatttttgcgctggcgaaattcgcttggatccatcgtctattcatgtccaaagaatccgctctattggtgatcgtgcgctgatgaatgaacacctcgcgcatctccattccctcctcggcgaataaagccaccaaatcttctattgtgaagtagtacgcgcgcgtgccgtcgtgtcgcacataaaagttttccgacaacttttgattcgccgccaccttcccttcgaacctttcctgcgctaaatcccccgcggcgtagtcacgaacgcatattgcgcctcgttgaccgtctcgcatgacggtcgatagatttcgtacgcagtacttcatcttctctcgcgacatcgcgctcagcgcgaacaccatcgtggcgacgtcgacgcatccggcgggtacgttctccaacaagctctcacacgtcgcgtcgcacacgaacgccttgacgcgatcgcgatcgcgtggcggcagcgtcgccgcgcgttcgagcaccatatctatcgcgcgcttactaaaatcgcagcagtacaccgtcgcttcggcgtcgagctcgagcagcggaaacaccgtgttcccgaccccgcacccgagctctagaaacgcgcgcggcgcgtcttcacgaggcgcgtacgacggcgcgggacctcgcgcgcggtccacgcgcgcgcccatgtcctcgtcgacgtcctcgagcgcggtttcctcgggaggtttggcgaacacgtccggccattcgcgcgccaaccagtgccgatccttgaagaaattcgtcgcgtgcgtcttgtaaaagacgtcccagttttttcgcgcgtctgtttcgtatttttggcgccaaaaatcgctcacggtgtcggacatgacgcgcgagccgtcgccacggcgcgtcccgcagtgcggcggttacgacgccgcggcgacgcctcggtcggtgcacgcgatcgtgcgggtttcggtgacgatgatatcgactaacttatcgtgcgcgtccacgggaacggcacctggggggtagacttgacacccgtacgcgagggcgacgacgagtggcggcgtcgcgccgacgcgcgccgcctcgtcggcgtaccgcgtcaaaaacgcgtcgtaatacccgcctccgcgaccgagtctgcgcccatcctcgccgaacgccacgccaggaacgacgacgacgtccaacgcgccaaccttcgcgatgtccctcaccgcgtctaagcgccgcgacccgtccgcgtacgtctcgcgcggctcggccaaatcgtacgcgccgcgagtcgcgtccgcctcgacgtctcgcacgtgaagcatgcgcatcgacgacgacccggcgtcgtcaacgatcggcacgaaaaccatgacgtcgtccgtcgcccctcgcaccgcggcgtcgtcgatgtacgtcgccatcgagcactctcgcaggcgttcgctcgccaagtacgcgccgacgcgccgcgcgttcgccgacgccttcatctccctcaaccgtcccgcgatcgccgcgtccgcggcgcgcatcgcctccgtcgtcatcagtctcagcgcgtcccgcgccgcgcggcgcatcgaccgcttcgcgtcgccatcgccgtcgccgtcgcgcgcgctcgacgccatccgtcccgcgcgcgcgcgtccgcgcgtccacgcgcgcgcgtccgcgagcgcgagcgcgcgcgcgagtccgcgcatgcgcgctcgaacgcccgcgcgcgattcgcgcgattcgcgcgctcgagcgcgcgcgcgtcgccgcgcgtcgccgcgcgtcggcgtctgcgaccgccccgcaacacccacggcgccagancggcgcgcatggtgctcgcgtcggtcgtcgaggcgacgctcggacgcgtcgccgcgctcggacgcacggcctcgagcgcgtcgacgtccgcgagcggcgtcgcggacgccggcgcggcgacgctgcggcgactcggcgcggcgaagacgcgcgggacgtcgtcgctcgatgacttgaacgaacacgcgaaaatcatcaccgacggcgtcgatttccggccggtgacggacacgtcgtgcttcgtcgacgcgtatcgctcgagcgacgcggcgacggcggtgatgttcgtcttcatcagcgggtgcgtgctcggggcggtgccgcagtacctgaaggtggtggtgttggggacttcggaggggctgtcgctgagctcgttggcgctgatgaacgtgtcgaacgtgtgcgcgacgatgaatgtgttcattctgcattacgagcagatccgacggtgcgtcgcgggagcggcggggtacgagtacgagcggtgtcaggcgtcgctgttgacgctgtattacacgttgatttacacgttgctgtggataccgctctacccgctcgcggcgcacttcacgagcgatcgcaagacggaatactttgggtacgtcatgtctaagcgtaaggcggcgtggtacgggttagcgttgtgggcggtgccgtgcgcgttgctcgcggcgcccgtcgcgaggatgttgttcggatcgacgtgttttgagtttgaacgttatgcgattttcttagggttgacgaacgcagttttagaaaccacgcgatacgtgccgcagttgtgggagtccgtacactccaaaggttcgggggcgatgagttacatgcgattagcgctgtccgtcgcgggcgggctcggggcgacgattcaaaaggcggtgatgcacgagtcttggtccacgtgggggcctccgctcatcgggcacggattggagatggctatcttctgcgtgaacctattcaacgacatgacgcgccgtcgcgagcgcacggacatgaggaaagaggctttaggattaatgcgcgattcggacgacgactacgaagacagccgcgacgacatggagacggacgcccacgcgaagcgcaaggctgcgatgttagagtcagccgaatccgccgcgcgcacgggatcgcccacgaaatccgaatcagacgtggaggattgggtgcaaaatatccccaccgagggcggtttcaaggcgaagacgtccttcgtgtggcatcgcgcgtgcacggacaagcacttcttcacgtcgttggtgcgatacctctagatttccctcgttcggcgcgcgcgcgtcgagtgctcaaccatttagtcatcgtcaatatcagtagattctctagcgactcaagccgtccgcgagcgcgtcgccgcgtcgccgcgtagcgcgtcccgtcccgactcgccgcgccactccgtgacatgcgcgcgagcgcgctcgccaaaacgctcgtcgagaacggtgcgagacgcgtcgttggtcacgcgtcgactccgcgcgtcgtcgcgcccggcgcgcgcgcaccgccgccgcgcgcgagacgaatgcgcgtccaggcttcgccagtcaccgtcgcgcccgcaccgccctcgacgccgcgcttcacctctgacatcaccgccgatggcgtcgatgcgttggtaacgacgatcgtctccgagtacgagcgcgcgctgcgcgacgccgcgcgcgggacgacgtgggaatcgacgttttcaacgacgctgcgcgcgcttggacgcgcgagcgaggcgagcgccgcggcgacgcttccggcgatgacgcatcgcgaacgcgacgtgcgagaggcgagcacgaaggcgaaggataagttgaaagcgatgtttgacgggacattcgcgcgaagggaggtgtacgaggcgatgaaagcggtcggcgcggacgcggcgccgacgagcgaggcgagacgcgcgagcgagtatttgatgcgagagtttgagaggaacggtgcggcgttgagcgccgagaa

SEQ ID NO: 283 - DNA, 4000 bp, Escherichia coli
  misc_feature (1)..(2): n is a, c, g, or t
  misc_feature (5)..(6): n is a, c, g, or t
  misc_feature (8)..(12): n is a, c, g, or t
  misc_feature (14)..(18): n is a, c, g, or t
  misc_feature (20)..(32): n is a, c, g, or t
  misc_feature (34)..(38): n is a, c, g, or t
  misc_feature (40)..(53): n is a, c, g, or t
  misc_feature (55)..(57): n is a, c, g, or t
  misc_feature (59)..(59): n is a, c, g, or t
  misc_feature (61)..(63): n is a, c, g, or t
  misc_feature (65)..(65): n is a, c, g, or t
  misc_feature (67)..(72): n is a, c, g, or t
  misc_feature (74)..(74): n is a, c, g, or t
  misc_feature (76)..(80): n is a, c, g, or t
  misc_feature (83)..(85): n is a, c, g, or t
  misc_feature (87)..(89): n is a, c, g, or t
  misc_feature (91)..(96): n is a, c, g, or t
  misc_feature (98)..(103): n is a, c, g, or t
  misc_feature (105)..(114): n is a, c, g, or t
  misc_feature (116)..(116): n is a, c, g, or t
  misc_feature (119)..(120): n is a, c, g, or t
  misc_feature (122)..(122): n is a, c, g, or t
  misc_feature (127)..(127): n is a, c, g, or t
  misc_feature (130)..(133): n is a, c, g, or t
  misc_feature (135)..(140): n is a, c, g, or t
  misc_feature (143)..(144): n is a, c, g, or t
  misc_feature (146)..(153): n is a, c, g, or t
  misc_feature (156)..(156): n is a, c, g, or t
  misc_feature (158)..(164): n is a, c, g, or t
  misc_feature (166)..(166): n is a, c, g, or t
  misc_feature (168)..(171): n is a, c, g, or t
  misc_feature (175)..(176): n is a, c, g, or t
  misc_feature (178)..(180): n is a, c, g, or t
  misc_feature (182)..(182): n is a, c, g, or t
  misc_feature (185)..(196): n is a, c, g, or t
  misc_feature (198)..(203): n is a, c, g, or t
  misc_feature (205)..(207): n is a, c, g, or t
  misc_feature (209)..(211): n is a, c, g, or t
  misc_feature (213)..(216): n is a, c, g, or t
  misc_feature (218)..(222): n is a, c, g, or t
  misc_feature (224)..(226): n is a, c, g, or t
  misc_feature (228)..(228): n is a, c, g, or t
  misc_feature (230)..(233): n is a, c, g, or t
  misc_feature (235)..(235): n is a, c, g, or t
  misc_feature (237)..(242): n is a, c, g, or t
  misc_feature (244)..(244): n is a, c, g, or t
  misc_feature (246)..(252): n is a, c, g, or t
  misc_feature (254)..(255): n is a, c, g, or t
  misc_feature (258)..(266): n is a, c, g, or t
  misc_feature (268)..(270): n is a, c, g, or t
  misc_feature (275)..(278): n is a, c, g, or t
  misc_feature (281)..(283): n is a, c, g, or t
  misc_feature (285)..(286): n is a, c, g, or t
  misc_feature (288)..(289): n is a, c, g, or t
  misc_feature (291)..(293): n is a, c, g, or t
  misc_feature (295)..(303): n is a, c, g, or t
  misc_feature (305)..(307): n is a, c, g, or t
  misc_feature (309)..(311): n is a, c, g, or t
  misc_feature (313)..(314): n is a, c, g, or t
  misc_feature (316)..(316): n is a, c, g, or t
  misc_feature (322)..(325): n is a, c, g, or t
  misc_feature (327)..(330): n is a, c, g, or t
  misc_feature (333)..(335): n is a, c, g, or t
  misc_feature (337)..(340): n is a, c, g, or t
  misc_feature (343)..(344): n is a, c, g, or t
  misc_feature (346)..(348): n is a, c, g, or t
  misc_feature (350)..(350): n is a, c, g, or t
  misc_feature (352)..(355): n is a, c, g, or t
  misc_feature (357)..(357): n is a, c, g, or t
  misc_feature (359)..(359): n is a, c, g, or t
  misc_feature (362)..(363): n is a, c, g, or t
  misc_feature (365)..(366): n is a, c, g, or t
  misc_feature (368)..(370): n is a, c, g, or t
  misc_feature (372)..(383): n is a, c, g, or t
  misc_feature (386)..(391): n is a, c, g, or t
  misc_feature (393)..(396): n is a, c, g, or t
  misc_feature (398)..(398): n is a, c, g, or t
  misc_feature (400)..(402): n is a, c, g, or t
  misc_feature (405)..(410): n is a, c, g, or t
  misc_feature (413)..(414): n is a, c, g, or t
  misc_feature (416)..(418): n is a, c, g, or t
  misc_feature (420)..(422): n is a, c, g, or t
  misc_feature (424)..(424): n is a, c, g, or t
  misc_feature (426)..(426): n is a, c, g, or t
  misc_feature (429)..(438): n is a, c, g, or t
  misc_feature (441)..(443): n is a, c, g, or t
  misc_feature (445)..(450): n is a, c, g, or t
  misc_feature (453)..(454): n is a, c, g, or t
  misc_feature (457)..(457): n is a, c, g, or t
  misc_feature (459)..(463): n is a, c, g, or t
  misc_feature (465)..(466): n is a, c, g, or t
  misc_feature (469)..(479): n is a, c, g, or t
  misc_feature (485)..(485): n is a, c, g, or t
  misc_feature (487)..(489): n is a, c, g, or t
  misc_feature (491)..(497): n is a, c, g, or t
  misc_feature (499)..(499): n is a, c, g, or t
  misc_feature (501)..(502): n is a, c, g, or t
  misc_feature (504)..(508): n is a, c, g, or t
  misc_feature (510)..(511): n is a, c, g, or t
  misc_feature (513)..(514): n is a, c, g, or t
  misc_feature (519)..(519): n is a, c, g, or t
  misc_feature (521)..(524): n is a, c, g, or t
  misc_feature (527)..(531): n is a, c, g, or t
  misc_feature (533)..(535): n is a, c, g, or t
  misc_feature (537)..(538): n is a, c, g, or t
  misc_feature (540)..(540): n is a, c, g, or t
  misc_feature (544)..(545): n is a, c, g, or t
  misc_feature (547)..(547): n is a, c, g, or t
  misc_feature (550)..(550): n is a, c, g, or t
  misc_feature (552)..(553): n is a, c, g, or t
  misc_feature (556)..(559): n is a, c, g, or t
  misc_feature (561)..(561): n is a, c, g, or t
  misc_feature (563)..(566): n is a, c, g, or t
  misc_feature (568)..(570): n is a, c, g, or t
  misc_feature (572)..(577): n is a, c, g, or t
  misc_feature (579)..(585): n is a, c, g, or t
  misc_feature (588)..(592): n is a, c, g, or t
  misc_feature (597)..(598): n is a, c, g, or t
  misc_feature (600)..(603): n is a, c, g, or t
  misc_feature (605)..(605): n is a, c, g, or t
  misc_feature (607)..(609): n is a, c, g, or t
  misc_feature (613)..(613): n is a, c, g, or t
  misc_feature (615)..(616): n is a, c, g, or t
  misc_feature (618)..(618): n is a, c, g, or t
  misc_feature (622)..(622): n is a, c, g, or t
  misc_feature (624)..(627): n is a, c, g, or t
  misc_feature (630)..(633): n is a, c, g, or t
  misc_feature (635)..(638): n is a, c, g, or t
  misc_feature (642)..(644): n is a, c, g, or t
  misc_feature (646)..(649): n is a, c, g, or t
  misc_feature (651)..(654): n is a, c, g, or t
  misc_feature (656)..(658): n is a, c, g, or t
  misc_feature (660)..(673): n is a, c, g, or t
  misc_feature (675)..(683): n is a, c, g, or t
  misc_feature (685)..(695): n is a, c, g, or t
  misc_feature (697)..(706): n is a, c, g, or t
  misc_feature (708)..(711): n is a, c, g, or t
  misc_feature (713)..(715): n is a, c, g, or t
  misc_feature (717)..(719): n is a, c, g, or t
  misc_feature (721)..(723): n is a, c, g, or t
  misc_feature (725)..(727): n is a, c, g, or t
  misc_feature (731)..(731): n is a, c, g, or t
  misc_feature (733)..(733): n is a, c, g, or t
  misc_feature (736)..(740): n is a, c, g, or t
  misc_feature (742)..(743): n is a, c, g, or t
  misc_feature (746)..(749): n is a, c, g, or t
  misc_feature (752)..(759): n is a, c, g, or t
  misc_feature (761)..(764): n is a, c, g, or t
  misc_feature (767)..(767): n is a, c, g, or t
  misc_feature (769)..(778): n is a, c, g, or t
  misc_feature (785)..(789): n is a, c, g, or t
  misc_feature (792)..(793): n is a, c, g, or t
  misc_feature (795)..(796): n is a, c, g, or t
  misc_feature (798)..(799): n is a, c, g, or t
  misc_feature (801)..(808): n is a, c, g, or t
  misc_feature (810)..(811): n is a, c, g, or t
  misc_feature (813)..(813): n is a, c, g, or t
  misc_feature (815)..(815): n is a, c, g, or t
  misc_feature (817)..(821): n is a, c, g, or t
  misc_feature (824)..(825): n is a, c, g, or t
  misc_feature (827)..(828): n is a, c, g, or t
  misc_feature (830)..(832): n is a, c, g, or t
  misc_feature (834)..(835): n is a, c, g, or t
  misc_feature (837)..(844): n is a, c, g, or t
  misc_feature (846)..(850): n is a, c, g, or t
  misc_feature (852)..(853): n is a, c, g, or t
  misc_feature (855)..(857): n is a, c, g, or t
  misc_feature (859)..(861): n is a, c, g, or t
  misc_feature (863)..(863): n is a, c, g, or t
  misc_feature (865)..(869): n is a, c, g, or t
  misc_feature (871)..(871): n is a, c, g, or t
  misc_feature (873)..(877): n is a, c, g, or t
  misc_feature (879)..(879): n is a, c, g, or t
  misc_feature (882)..(882): n is a, c, g, or t
  misc_feature (884)..(886): n is a, c, g, or t
  misc_feature (889)..(894): n is a, c, g, or t
  misc_feature (897)..(899): n is a, c, g, or t
  misc_feature (902)..(904): n is a, c, g, or t
  misc_feature (906)..(906): n is a, c, g, or t
  misc_feature (913)..(913): n is a, c, g, or t
  misc_feature (916)..(917): n is a, c, g, or t
  misc_feature (919)..(920): n is a, c, g, or t
  misc_feature (923)..(923): n is a, c, g, or t
  misc_feature (925)..(927): n is a, c, g, or t
  misc_feature (929)..(931): n is a, c, g, or t
  misc_feature (933)..(939): n is a, c, g, or t
  misc_feature (941)..(949): n is a, c, g, or t
  misc_feature (951)..(955): n is a, c, g, or t
  misc_feature (957)..(958): n is a, c, g, or t
  misc_feature (960)..(964): n is a, c, g, or t
  misc_feature (967)..(967): n is a, c, g, or t
  misc_feature (969)..(973): n is a, c, g, or t
  misc_feature (975)..(975): n is a, c, g, or t
  misc_feature (977)..(979): n is a, c, g, or t
  misc_feature (981)..(984): n is a, c, g, or t
  misc_feature (986)..(987): n is a, c, g, or t
  misc_feature (989)..(989): n is a, c, g, or t
  misc_feature (991)..(995): n is a, c, g, or t
  misc_feature (997)..(1005): n is a, c, g, or t
  misc_feature (1008)..(1009): n is a, c, g, or t
  misc_feature (1011)..(1025): n is a, c, g, or t
  misc_feature (1027)..(1027): n is a, c, g, or t
  misc_feature (1029)..(1031): n is a, c, g, or t
  misc_feature (1033)..(1033): n is a, c, g, or t
  misc_feature (1035)..(1037): n is a, c, g, or t
  misc_feature (1041)..(1049): n is a, c, g, or t
  misc_feature (1051)..(1051): n is a, c, g, or t
  misc_feature (1053)..(1056): n is a, c, g, or t
  misc_feature (1058)..(1061): n is a, c, g, or t
  misc_feature (1063)..(1064): n is a, c, g, or t
  misc_feature (1066)..(1066): n is a, c, g, or t
  misc_feature (1068)..(1069): n is a, c, g, or t
  misc_feature (1071)..(1075): n is a, c, g, or t
  misc_feature (1078)..(1080): n is a, c, g, or t
  misc_feature (1082)..(1085): n is a, c, g, or t
  misc_feature (1091)..(1091): n is a, c, g, or t
  misc_feature (1218)..(1218): n is a, c, g, or t
  misc_feature (1235)..(1235): n is a, c, g, or t
  misc_feature (1238)..(1241): n is a, c, g, or t
  misc_feature (1243)..(1243): n is a, c, g, or t
  misc_feature (1250)..(1250): n is a, c, g, or t
  misc_feature (1277)..(1277): n is a, c, g, or t
  misc_feature (1284)..(1284): n is a, c, g, or t
  misc_feature (1331)..(1331): n is a, c, g, or t
  misc_feature (1380)..(1380): n is a, c, g, or t
  misc_feature (1382)..(1382): n is a, c, g, or t
  misc_feature (1409)..(1409): n is a, c, g, or t
  misc_feature (1415)..(1415): n is a, c, g, or t
  misc_feature (1418)..(1418): n is a, c, g, or t
  misc_feature (1442)..(1442): n is a, c, g, or t
  misc_feature (1458)..(1458): n is a, c, g, or t
  misc_feature (1463)..(1463): n is a, c, g, or t
  misc_feature (1923)..(1924): n is a, c, g, or t
  misc_feature (1929)..(1929): n is a, c, g, or t
  misc_feature (1932)..(1932): n is a, c, g, or t
  misc_feature (1938)..(1938): n is a, c, g, or t
  misc_feature (1941)..(1942): n is a, c, g, or t
  misc_feature (1957)..(1957): n is a, c, g, or t
  misc_feature (1962)..(1963): n is a, c, g, or t
  misc_feature (1968)..(1969): n is a, c, g, or t
  misc_feature (1971)..(1971): n is a, c, g, or t
  misc_feature (1983)..(1984): n is a, c, g, or t
  misc_feature (1989)..(1989): n is a, c, g, or t
  misc_feature (1995)..(1996): n is a, c, g, or t
  misc_feature (1998)..(1998): n is a, c, g, or t
  misc_feature (2179)..(2179): n is a, c, g, or t
  misc_feature (2197)..(2197): n is a, c, g, or t
  misc_feature (2230)..(2230): n is a, c, g, or t
  misc_feature (2252)..(2255): n is a, c, g, or t
  misc_feature (2293)..(2293): n is a, c, g, or t
  misc_feature (2295)..(2295): n is a, c, g, or t
  misc_feature (2305)..(2305): n is a, c, g, or t
  misc_feature (2309)..(2309): n is a, c, g, or t
  misc_feature (2365)..(2365): n is a, c, g, or t
  misc_feature (2404)..(2404): n is a, c, g, or t
  misc_feature (2431)..(2431): n is a, c, g, or t
  misc_feature (2434)..(2435): n is a, c, g, or t
  misc_feature (2437)..(2440): n is a, c, g, or t
  misc_feature (2446)..(2446): n is a, c, g, or t
  misc_feature (2448)..(2451): n is a, c, g, or t
  misc_feature (2453)..(2480): n is a, c, g, or t
  misc_feature (2482)..(2487): n is a, c, g, or t
  misc_feature (2489)..(2491): n is a, c, g, or t
  misc_feature (2493)..(2495): n is a, c, g, or t
  misc_feature (2497)..(2503): n is a, c, g, or t
  misc_feature (2505)..(2506): n is a, c, g, or t
  misc_feature (2508)..(2519): n is a, c, g, or t
  misc_feature (2521)..(2524): n is a, c, g, or t
  misc_feature (2526)..(2526): n is a, c, g, or t
  misc_feature (2528)..(2528): n is a, c, g, or t
  misc_feature (2530)..(2537): n is a, c, g, or t
  misc_feature (2539)..(2539): n is a, c, g, or t
  misc_feature (2541)..(2549): n is a, c, g, or t
  misc_feature (2551)..(2556): n is a, c, g, or t
  misc_feature (2558)..(2562): n is a, c, g, or t
  misc_feature (2564)..(2564): n is a, c, g, or t
  misc_feature (2566)..(2572): n is a, c, g, or t
  misc_feature (2575)..(2576): n is a, c, g, or t
  misc_feature (2578)..(2580): n is a, c, g, or t
  misc_feature (2582)..(2582): n is a, c, g, or t
  misc_feature (2584)..(2584): n is a, c, g, or t
  misc_feature (2586)..(2586): n is a, c, g, or t
  misc_feature (2589)..(2595): n is a, c, g, or t
  misc_feature (2597)..(2598): n is a, c, g, or t
  misc_feature (2600)..(2601): n is a, c, g, or t
  misc_feature (2603)..(2603): n is a, c, g, or t
  misc_feature (2605)..(2607): n is a, c, g, or t
  misc_feature (2611)..(2612): n is a, c, g, or t
  misc_feature (2614)..(2620): n is a, c, g, or t
  misc_feature (2623)..(2623): n is a, c, g, or t
  misc_feature (2625)..(2635): n is a, c, g, or t
  misc_feature (2637)..(2638): n is a, c, g, or t
  misc_feature (2640)..(2642): n is a, c, g, or t
  misc_feature (2646)..(2647): n is a, c, g, or t
  misc_feature (2649)..(2650): n is a, c, g, or t
  misc_feature (2652)..(2658): n is a, c, g, or t
  misc_feature (2660)..(2662): n is a, c, g, or t
  misc_feature (2665)..(2667): n is a, c, g, or t
  misc_feature (2669)..(2671): n is a, c, g, or t
  misc_feature (2673)..(2675): n is a, c, g, or t
  misc_feature (2678)..(2679): n is a, c, g, or t
  misc_feature (2681)..(2689): n is a, c, g, or t
  misc_feature (2691)..(2694): n is a, c, g, or t
  misc_feature (2697)..(2708): n is a, c, g, or t
  misc_feature (2711)..(2720): n is a, c, g, or t
  misc_feature (2722)..(2725): n is a, c, g, or t
  misc_feature (2727)..(2731): n is a, c, g, or t
  misc_feature (2733)..(2735): n is a, c, g, or t
  misc_feature (2737)..(2745): n is a, c, g, or t
  misc_feature (2747)..(2747): n is a, c, g, or t
  misc_feature (2749)..(2749): n is a, c, g, or t
  misc_feature (2751)..(2756): n is a, c, g, or t
  misc_feature (2758)..(2759): n is a, c, g, or t
  misc_feature (2761)..(2763): n is a, c, g, or t
  misc_feature (2765)..(2770): n is a, c, g, or t
  misc_feature (2772)..(2776): n is a, c, g, or t
  misc_feature (2778)..(2778): n is a, c, g, or t
  misc_feature (2780)..(2783): n is a, c, g, or t
  misc_feature (2785)..(2785): n is a, c, g, or t
  misc_feature (2787)..(2796): n is a, c, g, or t
  misc_feature (2799)..(2801): n is a, c, g, or t
  misc_feature (2803)..(2810): n is a, c, g, or t
  misc_feature (2814)..(2821): n is a, c, g, or t
  misc_feature (2823)..(2823): n is a, c, g, or t
  misc_feature (2825)..(2834): n is a, c, g, or t
  misc_feature (2836)..(2842): n is a, c, g, or t
  misc_feature (2844)..(2844): n is a, c, g, or t
  misc_feature (2846)..(2849): n is a, c, g, or t
  misc_feature (2851)..(2851): n is a, c, g, or t
  misc_feature (2854)..(2854): n is a, c, g, or t
  misc_feature (2856)..(2865): n is a, c, g, or t
  misc_feature (2867)..(2868): n is a, c, g, or t
  misc_feature (2870)..(2871): n is a, c, g, or t
  misc_feature (2873)..(2873): n is a, c, g, or t
  misc_feature (2875)..(2875): n is a, c, g, or t
  misc_feature (2878)..(2880): n is a, c, g, or t
  misc_feature (2882)..(2891): n is a, c, g, or t
  misc_feature (2893)..(2896): n is a, c, g, or t
  misc_feature (2898)..(2899): n is a, c, g, or t
  misc_feature (2901)..(2905): n is a, c, g, or t
  misc_feature (2907)..(2907): n is a, c, g, or t
  misc_feature (2910)..(2918): n is a, c, g, or t
  misc_feature (2921)..(2921): n is a, c, g, or t
  misc_feature (2924)..(2931): n is a, c, g, or t
  misc_feature (2934)..(2936): n is a, c, g, or t
  misc_feature (2938)..(2938): n is a, c, g, or t
  misc_feature (2940)..(2953): n is a, c, g, or t
  misc_feature (2957)..(2960): n is a, c, g, or t
  misc_feature (2962)..(2965): n is a, c, g, or t
  misc_feature (2967)..(2970): n is a, c, g, or t
  misc_feature (2973)..(2974): n is a, c, g, or t
  misc_feature (2976)..(2979): n is a, c, g, or t
  misc_feature (2982)..(2990): n is a, c, g, or t
  misc_feature (2992)..(2993): n is a, c, g, or t
  misc_feature (2995)..(3000): n is a, c, g, or t
  misc_feature (3002)..(3006): n is a, c, g, or t
  misc_feature (3009)..(3015): n is a, c, g, or t
  misc_feature (3017)..(3017): n is a, c, g, or t
  misc_feature (3020)..(3020): n is a, c, g, or t
  misc_feature (3022)..(3022): n is a, c, g, or t
  misc_feature (3024)..(3024): n is a, c, g, or t
  misc_feature (3026)..(3029): n is a, c, g, or t
  misc_feature (3031)..(3033): n is a, c, g, or t
  misc_feature (3035)..(3036): n is a, c, g, or t
  misc_feature (3038)..(3042): n is a, c, g, or t
  misc_feature (3044)..(3044): n is a, c, g, or t
  misc_feature (3046)..(3046): n is a, c, g, or t
  misc_feature (3048)..(3050): n is a, c, g, or t
  misc_feature (3053)..(3055): n is a, c, g, or t
  misc_feature (3057)..(3058): n is a, c, g, or t
  misc_feature (3061)..(3068): n is a, c, g, or t
  misc_feature (3070)..(3074): n is a, c, g, or t
  misc_feature (3076)..(3077): n is a, c, g, or t
  misc_feature (3079)..(3082): n is a, c, g, or t
  misc_feature (3084)..(3084): n is a, c, g, or t
  misc_feature (3086)..(3087): n is a, c, g, or t
  misc_feature (3089)..(3090): n is a, c, g, or t
  misc_feature (3092)..(3101): n is a, c, g, or t
  misc_feature (3104)..(3111): n is a, c, g, or t
  misc_feature (3113)..(3120): n is a, c, g, or t
  misc_feature (3122)..(3125): n is a, c, g, or t
  misc_feature (3127)..(3130): n is a, c, g, or t
  misc_feature (3132)..(3137): n is a, c, g, or t
  misc_feature (3139)..(3141): n is a, c, g, or t
  misc_feature (3143)..(3144): n is a, c, g, or t
  misc_feature (3146)..(3146): n is a, c, g, or t
  misc_feature (3149)..(3157): n is a, c, g, or t
  misc_feature (3159)..(3161): n is a, c, g, or t
  misc_feature (3163)..(3164): n is a, c, g, or t
  misc_feature (3166)..(3167): n is a, c, g, or t
  misc_feature (3169)..(3169): n is a, c, g, or t
  misc_feature (3171)..(3173): n is a, c, g, or t
  misc_feature (3175)..(3176): n is a, c, g, or t
  misc_feature (3178)..(3185): n is a, c, g, or t
  misc_feature (3188)..(3191): n is a, c, g, or t
  misc_feature (3193)..(3193): n is a, c, g, or t
  misc_feature (3195)..(3195): n is a, c, g, or t
  misc_feature (3197)..(3202): n is a, c, g, or t
  misc_feature (3206)..(3206): n is a, c, g, or t
  misc_feature (3208)..(3209): n is a, c, g, or t
  misc_feature (3211)..(3212): n is a, c, g, or t
  misc_feature (3214)..(3214): n is a, c, g, or t
  misc_feature (3216)..(3220): n is a, c, g, or t
  misc_feature (3222)..(3225): n is a, c, g, or t
  misc_feature (3227)..(3228): n is a, c, g, or t
  misc_feature (3230)..(3234): n is a, c, g, or t
  misc_feature (3237)..(3237): n is a, c, g, or t
  misc_feature (3239)..(3241): n is a, c, g, or t
  misc_feature (3244)..(3244): n is a, c, g, or t
  misc_feature (3246)..(3247): n is a, c, g, or t
  misc_feature (3249)..(3255): n is a, c, g, or t
  misc_feature (3257)..(3258): n is a, c, g, or t
  misc_feature (3260)..(3264): n is a, c, g, or t
  misc_feature (3266)..(3270): n is a, c, g, or t
  misc_feature (3272)..(3277): n is a, c, g, or t
  misc_feature (3279)..(3287): n is a, c, g, or t
  misc_feature (3290)..(3290): n is a, c, g, or t
  misc_feature (3292)..(3292): n is a, c, g, or t
  misc_feature (3294)..(3294): n is a, c, g, or t
  misc_feature (3296)..(3298): n is a, c, g, or t
  misc_feature (3301)..(3306): n is a, c, g, or t
  misc_feature (3308)..(3309): n is a, c, g, or t
  misc_feature (3311)..(3312): n is a, c, g, or t
  misc_feature (3314)..(3314): n is a, c, g, or t
  misc_feature (3316)..(3323): n is a, c, g, or t
  misc_feature (3325)..(3325): n is a, c, g, or t
  misc_feature (3327)..(3327): n is a, c, g, or t
  misc_feature (3329)..(3336): n is a, c, g, or t
  misc_feature (3338)..(3349): n is a, c, g, or t
  misc_feature (3351)..(3361): n is a, c, g, or t
  misc_feature (3363)..(3363): n is a, c, g, or t
  misc_feature (3365)..(3366): n is a, c, g, or t
  misc_feature (3368)..(3370): n is a, c, g, or t
  misc_feature (3372)..(3375): n is a, c, g, or t
  misc_feature (3377)..(3377): n is a, c, g, or t
  misc_feature (3380)..(3392): n is a, c, g, or t
  misc_feature (3394)..(3395): n is a, c, g, or t
  misc_feature (3397)..(3398): n is a, c, g, or t
  misc_feature (3401)..(3401): n is a, c, g, or t
  misc_feature (3403)..(3403): n is a, c, g, or t
  misc_feature (3405)..(3408): n is a, c, g, or t
  misc_feature (3410)..(3411): n is a, c, g, or t
  misc_feature (3413)..(3414): n is a, c, g, or t
  misc_feature (3416)..(3417): n is a, c, g, or t
  misc_feature (3419)..(3420): n is a, c, g, or t
  misc_feature (3422)..(3424): n is a, c, g, or t
  misc_feature (3426)..(3434): n is a, c, g, or t
  misc_feature (3437)..(3443): n is a, c, g, or t
  misc_feature (3445)..(3446): n is a, c, g, or t
  misc_feature (3448)..(3450): n is a, c, g, or t
  misc_feature (3452)..(3452): n is a, c, g, or t
  misc_feature (3454)..(3457): n is a, c, g, or t
  misc_feature (3459)..(3460): n is a, c, g, or t
  misc_feature (3462)..(3467): n is a, c, g, or t
  misc_feature (3469)..(3480): n is a, c, g, or t
  misc_feature (3484)..(3484): n is a, c, g, or t
  misc_feature (3486)..(3488): n is a, c, g, or t
  misc_feature (3491)..(3491): n is a, c, g, or t
  misc_feature (3493)..(3494): n is a, c, g, or t
  misc_feature (3497)..(3497): n is a, c, g, or t
  misc_feature (3499)..(3500): n is a, c, g, or t
  misc_feature (3502)..(3505): n is a, c, g, or t
  misc_feature (3507)..(3510): n is a, c, g, or t
  misc_feature (3512)..(3513): n is a, c, g, or t
  misc_feature (3515)..(3518): n is a, c, g, or t
  misc_feature (3521)..(3527): n is a, c, g, or t
  misc_feature (3529)..(3533): n is a, c, g, or t
  misc_feature (3537)..(3537): n is a, c, g, or t
  misc_feature (3539)..(3541): n is a, c, g, or t
  misc_feature (3543)..(3545): n is a, c, g, or t
  misc_feature (3547)..(3554): n is a, c, g, or t
  misc_feature (3558)..(3558): n is a, c, g, or t
  misc_feature (3560)..(3560): n is a, c, g, or t
  misc_feature (3563)..(3569): n is a, c, g, or t
  misc_feature (3571)..(3572): n is a, c, g, or t
  misc_feature (3574)..(3577): n is a, c, g, or t
  misc_feature (3579)..(3581): n is a, c, g, or t
  misc_feature (3583)..(3584): n is a, c, g, or t
  misc_feature (3587)..(3589): n is a, c, g, or t
  misc_feature (3591)..(3592): n is a, c, g, or t
  misc_feature (3594)..(3594): n is a, c, g, or t
  misc_feature (3596)..(3597): n is a, c, g, or t
  misc_feature (3600)..(3602): n is a, c, g, or t
  misc_feature (3604)..(3604): n is a, c, g, or t
  misc_feature (3606)..(3613): n is a, c, g, or t
  misc_feature (3615)..(3615): n is a, c, g, or t
  misc_feature (3617)..(3618): n is a, c, g, or t
  misc_feature (3620)..(3625): n is a, c, g, or t
  misc_feature (3629)..(3638): n is a, c, g, or t
  misc_feature (3640)..(3643): n is a, c, g, or t
  misc_feature (3646)..(3647): n is a, c, g, or t
  misc_feature (3649)..(3649): n is a, c, g, or t
  misc_feature (3651)..(3651): n is a, c, g, or t
  misc_feature (3654)..(3655): n is a, c, g, or t
  misc_feature (3657)..(3659): n is a, c, g, or t
  misc_feature (3661)..(3670): n is a, c, g, or t
  misc_feature (3672)..(3675): n is a, c, g, or t
  misc_feature (3677)..(3679): n is a, c, g, or t
  misc_feature (3683)..(3683): n is a, c, g, or t
  misc_feature (3685)..(3689): n is a, c, g, or t
  misc_feature (3691)..(3691): n is a, c, g, or t
  misc_feature (3693)..(3694): n is a, c, g, or t
  misc_feature (3696)..(3696): n is a, c, g, or t
  misc_feature (3698)..(3698): n is a, c, g, or t
  misc_feature (3700)..(3709): n is a, c, g, or t
  misc_feature (3711)..(3718): n is a, c, g, or t
  misc_feature (3722)..(3731): n is a, c, g, or t
  misc_feature (3733)..(3733): n is a, c, g, or t
  misc_feature (3735)..(3737): n is a, c, g, or t
  misc_feature (3739)..(3739): n is a, c, g, or t
  misc_feature (3741)..(3744): n is a, c, g, or t
  misc_feature (3746)..(3753): n is a, c, g, or t
  misc_feature (3755)..(3757): n is a, c, g, or t
  misc_feature (3759)..(3759): n is a, c, g, or t
  misc_feature (3761)..(3764): n is a, c, g, or t
  misc_feature (3766)..(3766): n is a, c, g, or t
  misc_feature (3768)..(3769): n is a, c, g, or t
  misc_feature (3771)..(3772): n is a, c, g, or t
  misc_feature (3774)..(3775): n is a, c, g, or t
  misc_feature (3777)..(3777): n is a, c, g, or t
  misc_feature (3779)..(3782): n is a, c, g, or t
  misc_feature (3784)..(3790): n is a, c, g, or t
  misc_feature (3792)..(3794): n is a, c, g, or t
  misc_feature (3797)..(3801): n is a, c, g, or t
  misc_feature (3803)..(3803): n is a, c, g, or t
  misc_feature (3806)..(3821): n is a, c, g, or t
  misc_feature (3824)..(3824): n is a, c, g, or t
  misc_feature (3826)..(3828): n is a, c, g, or t
  misc_feature (3832)..(3839): n is a, c, g, or t
  misc_feature (3841)..(3841): n is a, c, g, or t
  misc_feature (3844)..(3845): n is a, c, g, or t
  misc_feature (3847)..(3848): n is a, c, g, or t
  misc_feature (3850)..(3851): n is a, c, g, or t
  misc_feature (3854)..(3862): n is a, c, g, or t
  misc_feature (3864)..(3870): n is a, c, g, or t
  misc_feature (3872)..(3872): n is a, c, g, or t
  misc_feature (3874)..(3882): n is a, c, g, or t
  misc_feature (3884)..(3887): n is a, c, g, or t
  misc_feature (3889)..(3893): n is a, c, g, or t
  misc_feature (3896)..(3899): n is a, c, g, or t
  misc_feature (3901)..(3902): n is a, c, g, or t
  misc_feature (3905)..(3910): n is a, c, g, or t
  misc_feature (3912)..(3913): n is a, c, g, or t
  misc_feature (3916)..(3921): n is a, c, g, or t
  misc_feature (3923)..(3923): n is a, c, g, or t
  misc_feature (3926)..(3926): n is a, c, g, or t
  misc_feature (3928)..(3933): n is a, c, g, or t
  misc_feature (3935)..(3939): n is a, c, g, or t
  misc_feature (3941)..(3944): n is a, c, g, or t
  misc_feature (3947)..(3950): n is a, c, g, or t
  misc_feature (3952)..(3952): n is a, c, g, or t
  misc_feature (3954)..(3964): n is a, c, g, or t
  misc_feature (3966)..(3973): n is a, c, g, or t
  misc_feature (3975)..(3982): n is a, c, g, or t
  misc_feature (3984)..(3986): n is a, c, g, or t
  misc_feature (3988)..(3989): n is a, c, g, or t
  misc_feature (3991)..(3991): n is a, c, g, or t
  misc_feature (3993)..(3997): n is a, c, g, or t
  misc_feature (3999)..(4000): n is a, c, g, or t
nnccnncnnnnnannnnncnnnnnnnnnnnnnannnnnannnnnnnnnnnnnncnnncngnnngntnnnnnncncnnnnntcnnncnnncnnnnnncnnnnnntnnnnnnnnnntnaannanaacancannnnannnnnngannannnnnnnncancnnnnnnntnannnncggnngnnncntcnnnnnnnnnnnnannnnnnannncnnngnnnntnnnnncnnncngnnnnangnnnnnntntnnnnnnncnncannnnnnnnnannncagcnnnnccnnngnngnngnnntnnnnnnnnnannntnnnannangacgannnntnnnncgnnncnnnngtnntnnncnannnntngncgnngnngnnnannnnnnnnnnnncgnnnnnngnnnntntnnncannnnnnacnncnnntnnngngntgnnnnnnnnnncgnnnannnnnnatnntcncnnnnntnntcnnnnnnnnnnngcggcngnnncnnnnnnngncnncnnnnngnnannagaanannnngcnnnnnannncnncntcgnngntgntnntcnnnncnannnnannnannnnnntnnnnnnnttnnnnnacaannannnntnannncagnannanaagnannnntcnnnnannnnatcnnngnnnntnnnnannncnnnnnnnnnnnnnncnnnnnnnnngnnnnnnnnnnnannnnnnnnnncnnnntnnncnnngnnntnnnggangncgnnnnnannaannnngcnnnnnnnncnnnnctncnnnnnnnnnnggaggannnnngcnncnncnncnnnnnnnncnncncngnnnnntcnncnncnnncnncnnnnnnnncnnnnncnncnnncnnnanannnnncngnnnnncnacngnnngannnnnngcnnnctnnncnacgacgncgnngnngtngnnnannncnnnnnnncnnnnnnnnngnnnnngnngnnnnncgncnnnnngngnnngnnnntnntngnnnnncnnnnnnnnnacnncnnnnnnnnnnnnnnngncnnnangnnncggnnnnnnnnnancnnnnannnncnncncnncnnnnntcnnntnnnngggaanagatacgtttcggcgtatcaggctaccatacagcgcagcacgacgaccctctgctcggtcgtgaatatggatgccgactaccgaggcggcaacaacaatacggcgtatgacggaacctatcgcacgntcctcggacgcccggcnacnnnnanctcccgnaccaatttccgcaattacgcccgcaancgcaagnccggttcgacggaatggaactgcatgacctacgacatccaaaaaganctgtattggctcttcgtcatcgaatatgccacgctcaactcgcaggcgncnttcaatgcggaaaaggacagcaacggntatgcncanggcggcctcggagcaggtgtaacnaacatgtccgattggngcggnttcaacggctattatccgttcgtgccgtgcggccataccgacgaactcggaaacggcacgggcgaggtagcataccccgtcatcaatgaggacggatcgacccgatgcacggtcatggttccgcgctatcggggtgtcgagaatcctttcggtcatgtttggcaatggacggacggcatcaacatccggatcagcccgaccgaggagaatggcggcgacgggttgagcaaggtattcgtctgcaccgatccggccaaattctcggatagcggttacgacggctacgcccatgtaggcaacgaggcccgcgcagagggatatgtcaaagaggtgattttcggcgagggaggagagatcatgccctccgtcgtaggaggcggttcttcgacctatttctgcgactaccactataccaacatcccgacggccgaagcattgcgcggtgtcctgttcggcggtnntgcgnatnacggcncgnntgccggttttgcgtntgcgnnttcgnntnacgcgccctcgnntacgnatgcgnntntcgggtctcgcctttgctttatccccgcataacggataacgccacagaaaacacgctcggccaataattaaacgatacgacaatggagaataaccataatccgatggaagatgacggttcgctggatttcctgaaaatccccgccgacgaaaccaacaagcattttaactgccccgaaacnacgcagcagaagttgatnaacctcaccttttgggtctgcgactacatcganggagtgaaaacgaagttcggannnnatcggacgctcgtcaagatcaagatgaatcgggacgancncgaccgcgangcangcaagttcttcaccaattcgcgggaaatcaaatatgtcctcgccaagattcggganatggacaaattcccgcgacgggtaacgatgcgggcatcnggaacgcggtactatttggagtaatgnatnnannnnggttgntnnnncnnnnnnnnnnnnnnnnnnnnnnnnnnnnannnnnngnnngnnngnnnnnnntnngnnnnnnnnnnnnannnncncncnnnnnnnnangnnnnnnnnngnnnnnncnnnnnantnnnnnnnagnnannnanananatnnnnnnngnnannancnnncctnncnnnnnnnaanannnnnnnnnnnannannnagtnngnngnnnnnnncnnnccnnncnnncnnncgnncnnnnnnnnnannnnaannnnnnnnnnnnaannnnnnnnnnannnnannnnnannnannnnnnnnntngntnnnnnncnncnnncnnnnnnannnnnangnnnngngnnnnnnnnnncgnnngnnnnnnnncttnnnnnnnnanannnnnnnnnnannnnnnntncnnnncntgnannnnnnnnnnannanncntncannnannnnnnnnnnannnngnncnnnnncnatnnnnnnnnnganagnnnnnnnnatnnntngnnnnnnnnnnnnnnccgnnnncnnnntnnnncanncnnnnatnnnnnnnnncnnannnnnntnnnnntcnnnnnnnanganananannnntnnntnnannnnngngngnnncannnanngannnnnnnngnnnnncnngnnnncnannanngnnnnnnnnnncgnnnnnnnntnnnnnnnnannnncnnnngnnnnnncnnncnntngannnnnnnnnannnanngnnancnnncnncnnnnnnnnaannnnangnannnnnncgcncnncnngntnnnnncnnnnanngnnnnnacngnnngcntnncnnnnnnnanntnnnnnannnnntnnnnnncnnnnnnnnngcntncntnnntcnnnnnntnnannangnnnnnnnngngngnnnnnnnntnnnnnnnnnnnncnnnnnnnnnnntntnncnnncnnnnangannnnnnnnnnnnncnncnngcngncnnnnannannanntnncnnncnnnnnnnnnacnnnnnnngnnannnancnnnnanntnnnnnngnnnnnnnnnnnncggncnnncangnncgngnncnnnntnnnntnngnnnngtnnnnnnncnnnnncaancnnncnnncnnnnnnnnatcnancannnnnnntnncnnnngnnngnncgnnngnntnannaannnantnnnnnnnngngnnannnnnnacannnnnnnnnnannnngtnngnanggnngnnngnnnnnnnnnnannnnannnattnannnnnancnntnantnnnnnnnnnntnnnnnnnncgtnnnnnnnnnnangnnngncnnnntnnnnnnnngnnngnannnnangnnanntnnancnnnngnnnnnnnannnagnnnnngnccnnnnnnnnnnnnnnnntgncnnngggnnnnnnnnanccnncnncnnaannnnnnnnnannnnnnntncnnnnnnnnngnnnntnnnnnggnnnncnntannnnnnannaannnnnngnagncnnnnnncnnnnnannnnggnnnncnannnnnnnnnnnannnnnnnnannnnnnnnannncnncnannnnngnn

SEQ ID NO: 284 - DNA, 4000 bp, Escherichia coli
  misc_feature (1349)..(1349): n is a, c, g, or t
  misc_feature (1377)..(1377): n is a, c, g, or t
  misc_feature (1986)..(1986): n is a, c, g, or t
  misc_feature (2000)..(2000): n is a, c, g, or t
  misc_feature (3812)..(3812): n is a, c, g, or t
  misc_feature (3983)..(3983): n is a, c, g, or t
aggatcggtctctgacgaaatgattgcacacaaaattgagggtacggcactctaccagagattgccaggagaaatgcacgcgtcctcccgggtagtagaaccattgaacgtcgagccggagaatcgaattgcccagttcccaacgtttgaaacgtggcaagcgcgccgcaagaacaaatagaagtgggcacgtctgtaaatcgaatcatgcagtttaagcagttcagtgttcgagatgaccgctgcgctatgaaagttggaacagacgcgctgctgcttgcatcatggtgctcagtagattcaatgttcgacattgttgatttgggatgtggatcaggcattattgccatcatgttggctcaacgagccaccgaagcgcaggtccttggagttgaacttgaagagaacgctgccatacaggcgtcgagcaatatggcaggatcacctttttcaaatcggatggaggccatcctcgagagcgcacaagaatttgcgagccatcccgacaacaaatggaagtttgatttggtggtttgcaacccgccctatttccatggcaaacctaagtcaccagatcaagcgcgtaatctcgctcggcatgatgaatcacttccgctgaaagagttgctgctggctgctcacgaagtcatgaggccgaacggcacattggcccttgcttggccaatggacagaaaggagaagctgatgaaagaatccttggaaatgggattagcactgactcgttattgtgaaatagctggaacaacgaatcatgagccgaagcgttttttatcggagtggaagaagatttccagcaacttcgaagctggacagcctgttgaaacggagcgactcaacattgaatcaagaccacggatttcaggcaaacctcaacattctgctcggtacaaacagctgcttgagtccttcttgatagaatgggggtaggcagcttatgccccaatcacttgcttcaatcgatcaatttgtgcggaccacaattctttcgcatcatcgatttcgtcttcttcggcaaagtctgttactacgatggcggtgtctcctgttaaatcgtcaatcttgattcgaaattcaaaaaaggttgacaatccttcctcttcgtcttccgtccagcgaaatttcacgaactcgtcgcgcttctttgtcaccaatcgagcactttcttcgcttccatcccataaaaagatgtgtacatcctttttgatattgacatcgtcacaaaaccattcggctaggccgctgggtgtgctgaacatattaaaaagcacgcctttggagctattgattgggtgctcaacttggaatctctctttctccatgggtcacangtgtgtcaaatggcaagatacagcgaanttcgcaagggtaggcggggtttttgaaaaattgatttttaaaggcttttctcgcgttcgtcattatatttgcgcccgaaatggcgggatagctcagccggttagagcgcaggattcataatcctgaggtcgagagttcgagtctctctcccgctactacccgagacccgaagacattttgtcttcgggttttgttttgctattctcgtgaatacacggaaacattggggctgtggagtaatgcatgattccaaacgtgtgttcggaattttccaaacgattagttcaagccatttgatatccccttgcggagatttaattcactcaatcagctttggttcatccattcgattgagcttcgaccttttcaccagaatgtctatttgaaacctccgatgcattgcgtctgggctttttttcttctgtgtttcttgctgccatgcaatcatttgctctttcaagtagtaagagcaaagaaagacaggggttgtggcagtttgttcgcccaatctctgcatgccaaaaatttttattcagtcttgaatgcgcattattttaaatgttattcgatgtttttgtaagtaaaaacaaattgagaccacgcttttangggtataaaagatnaatattaatcgacgaaagtaaatatacacccgaattaatgtgttatattagtgggagaatcgtcccattatgaagccaaattatttgttttttccttcggtgttcattgcattcttgctcggtagtgcccagctggccagcggtcaagttgaaatcaacctgactgaacacacagcttcaaccaacggaaccacctaccgtctctacgctgaattcgacgagacggcaaacattacttcagtatttgcgccggaagccatttatcaagatcaatggtggccaggtctcgacccttcggattcgagtgatgatctccctccgaactccattccctccatttcttttgcgacagacgcttccaacggtttctttcaatttgcacttggccaacattacaacacgccttcaggaatcattccttctttgtttcagttctaccctgacatggagttcgactcatggttcaccattggcggggcagagggggtctcggcgggtgttcaacttattccaggacagacggatgcgttgaataatttcaacaatggcggatcctttgatacggatgggtttgccgatggtggggggtggtacactgcgacgagcacgcccatttacacggatgaaaatggtcaaattttattagcgcagcttaccgttgaagagggcgcaagcatcgatgtcgttttgtccttgatctggcgggatgataatgcggtgagtcatgtggaaatcggacttacggcatcaataggcgacaatggagcgggctgcatggattcgatggcctgcaattacaattcaagtgctacggaagcgggagattgtgttttcgcatctgatccatgtgaatcttgttcaggggagtctgatggcaccggaacgatcgtgttaaatgatgcagacggcgatgatgtttgcgatagcgatgaagtgatcggttgccagaatgccagtgcctgtaattacaattcaagtgccaccgactctggtgtttgctcatttgcatcgggttgcgacgaatgcgctggtaaccctacgaacggatcgggattcgtacaggacaatgatgctgacaatgatggtgtatgcgacgttgatgaagttctgggttgcaccaattcttcagcctgcaactatttggaagatgcaacagaggacagtggagcatgcgttttgcctgctaattgtgaaacatgtacaggagaaacagatggctcaggtacaattgtagataatgaccaagacggcgatggggtatgtgatgttgatgaagttgcgggatgtttggatgcctccgcgtgcaattacaatgcccaggccacagacgatggtggagggtgcatatatgctaccggctgcgactactgttcgggcgctacagatggaagcgggtctattttaaatggcgataccgatggagattccgtttgcaattcggatgaaattgaagggtgtttggacagcatggcgtgcaattacaatcaatttgcaacggattctagcgcttgtgaatatgcgtttggatgtgccgaatgctctggtgccgatgacggaacagggatggttgttgccaatgacgacgatgaagatggggtttgcaatgtggatgagatcagcggttgtcaggattcaaatgcgtgcaactataacaatgatgctacagacgatagcggcgattgtcagtaccccgcgggttgtgacagttgctcaggcgcatccgatggatcaggtgttataattgacaacgatgcagacaatgatggggtttgtgatgcagatgagattgtgggttgccaagtcccgtcggcntgtaacttcaatgaaaatgctaccgaatcgggtgattgcacttaccctgatactgggtacaactgcgcgggcgtttgtttaaatgactttgatggcgacggcgtgtgcgatgttttcgaggtcagcggctgcgtttacgctagcgcgtgcaactatgatgcgtcagcgacngatgacgacggatcatg

SEQ ID NO: 285 - DNA, 4000 bp, Escherichia coli
  misc_feature (13)..(13): n is a, c, g, or t
  misc_feature (72)..(72): n is a, c, g, or t
  misc_feature (335)..(336): n is a, c, g, or t
  misc_feature (338)..(338): n is a, c, g, or t
  misc_feature (340)..(342): n is a, c, g, or t
  misc_feature (344)..(344): n is a, c, g, or t
  misc_feature (346)..(360): n is a, c, g, or t
  misc_feature (362)..(367): n is a, c, g, or t
  misc_feature (369)..(369): n is a, c, g, or t
  misc_feature (371)..(371): n is a, c, g, or t
  misc_feature (373)..(374): n is a, c, g, or t
  misc_feature (376)..(377): n is a, c, g, or t
  misc_feature (379)..(381): n is a, c, g, or t
  misc_feature (383)..(387): n is a, c, g, or t
  misc_feature (389)..(390): n is a, c, g, or t
  misc_feature (392)..(419): n is a, c, g, or t
  misc_feature (421)..(422): n is a, c, g, or t
  misc_feature (424)..(424): n is a, c, g, or t
  misc_feature (426)..(427): n is a, c, g, or t
  misc_feature (429)..(429): n is a, c, g, or t
  misc_feature (431)..(432): n is a, c, g, or t
  misc_feature (434)..(434): n is a, c, g, or t
  misc_feature (437)..(437): n is a, c, g, or t
  misc_feature (439)..(445): n is a, c, g, or t
  misc_feature (447)..(448): n is a, c, g, or t
  misc_feature (450)..(453): n is a, c, g, or t
  misc_feature (455)..(455): n is a, c, g, or t
  misc_feature (1545)..(1545): n is a, c, g, or t
  misc_feature (1989)..(1989): n is a, c, g, or t
  misc_feature (1997)..(1997): n is a, c, g, or t
  misc_feature (2004)..(2004): n is a, c, g, or t
  misc_feature (2018)..(2018): n is a, c, g, or t
  misc_feature (2026)..(2026): n is a, c, g, or t
  misc_feature (2040)..(2040): n is a, c, g, or t
  misc_feature (2055)..(2055): n is a, c, g, or t
  misc_feature (2757)..(2757): n is a, c, g, or t
  misc_feature (2820)..(2820): n is a, c, g, or t
  misc_feature (2869)..(2869): n is a, c, g, or t
  misc_feature (3935)..(3935): n is a, c, g, or t
ggttgcttgttanctgtttacgctttgatggttgactgacaacctggcgtgagaatggccaggttaaacggngccgtttataccggaacgtcttgtttaacagcgaaaattaccggtgtgaaccgatgacaatgcttagttaggctgctcatattgagcaaccagcattgttataaggtcttataacgctatagattagctgaatctagcgttctctctcattggttgtttcttggtcacgtggttactgaattcaaatgtatgccgtgtacgggtgatacagacaattcgatgattgtaatttatcatgtggattatgttcgctcgtttggttnncnannntngnnnnnnnnnnnnnnncnnnnnncntnanngnntnnnannnnnannannnnnnnnnnnnnnnnnnnnnnnnnnnnannantnntnannanatntnnnnnnngnntnnnntngatgaacaaccttgaattcagacgagacggccagacctccttcgttactgcaatgcccgaagctggcaattggatttcgacccgttaacggatttacttcataatcaaattgttattatttttgtattggtttgaggtagcactgtagaaagaggattttaaaagctagacatgtgagaagattttacgctatgaaaacatttttcttagtcagtgattatatcttaatgttttcgctatattaagaacaagcgatcttgtgattgacaaacaaattcttaagcattatagatctatatttggtgtagtcaaaaagcaaaataaattttaagcttaaattgcttatttgcttagttttgtggttcaagtatgaagggtgatcacattactatcaccccaccttttcataacaaaacttagcttaggtgaaaaaaaaatagaaatttatgagttggtaaggctggtggaataggccatttccgagttactccagcctctgtttcaaaacgagtcctcgtgcaaaactttcgaatgaaaatgagtttgatttgcgtgaaaatggacctttaggggaaacacagtttcacatgaatagtttcgcacgaagactcgttttgagaaagaggcaaaagccaactcggaaatgacctattgtgataaagaaactaaccttgcagtggttgcgggaagtaagcctgtaactcgtagaggcaggcaagttccttgcagatcatctcggtttattagtgatatcaatacttgctttcaagttcagccctgcttttaagtttgttgcgaacaaatgaacaataatgaattatttttaggtgttgctctaaaccatgacacgaggttattgcgctgtcaggagaaatcatttggctcgctcgcttgtcagattaaaattagaggcgttataacatttgacattccattcaaatgtggcagaggctttgcatatttcgataagtaaacattccgaaataccattaattacaaaaagaagcgaaagtaaactacgatgtttcgaagtcatcttaactccataaacaggtagagaaaatgaaataacggtcaagatgttaatttntagggtgaaagttggaagaatatgtgtaagtgtaacacgatctaattaaggtttttaggtaaaccaacaatgcattgtttataatttcaaatgtgatctatacaattcagaacatgtcggctatactactagcccacctttgccagcacatcgaagaccaaagagcctattccactgcaagaccatggtgtcaagtcccttgacccgtctaacatgtttgccgtgctgaaagaaagtgcccaggaaagcattactgttgaatttacgaagtgcttttcagtttcatttgtgaaagaaaacccaaactcaatagacagacggacttaactcgtgcacaaatattcatctaagtttattccacgtttttataattgttgacacgtaagaactcttaataagaccgtgttacactctcttcttacaccgttcacacactacggattnacatctcnaccgttnttttatcttctctncatgtttntggagttggggtgncttggagacgtcgtngtttactctcgcttctttttgtaattacttatgtatttaatccaacatgatcaaaggctgccgtttcattctggaatgtctttggtaaatgatgggtcacgtgatgggtcacgtgatgggtcacgtgatggtgggtagtacgaattctcgaacttattagtgcgcctgcgtaaagtcatcgcatctcacgcgacgtgtcacgtcagtcacgttttggagtccgagagtcttagagactgggactgcttccaaagtagaaatacgtgttcgtccttatattctgtctcttactatttacttataaggcaaactggtatctttttggctttcgtgcggtttcaacaaaacctaaaacgagacacgcacgaaacactttcttacaaaccgttttaaaaactgctctttttgtaggccctttgtctagaattaattatcattttactttcttttcactttcttgctgtttataataaaaattttcccacaaatatcgacattatacaggttcaacggtctcctcgttattattttctatccttcggattttcttggtttgcgttgcgtgtttacaggtgttaaaactcggtctgtataatcgccaattataagtactgaaatagtggattcaaattcatgaaattagtcgtggatgtgaacataatctgtacctagttaagctaaaatcaaaggaaatatttgaantaaaaatttcatagcaatgtaagtttatgccgtgcttacccactttctataatcgtggcaaantctattgttttattttttcggtttcgtagccatgcgtgtagtttatcgntctgattacgagccaatttggatattttaattatttttcttggcattttctcacttttatcttcgctctgtctcacagcacccaatcagcgattttcaaattggattgacaacgattattcctcgaatgttgcgacaagctggcaaaaaaatacggcataattgaaaactttttatgtgtaaacgaaataattaaaatagaattgatgaggaaacgaactaatataatgcgttctgttgtagctcttttggaggactgaatgctttgtcttcccgtttgtttcactatgccttggatcacaatttttagcgtattttgtttgttcctttagtcctttaattcaacttccaatttttgaacacaggataaattacacaaaaagacgaccaattaaaacagtattcattcgaaggggaaaacctcgtgaatacaactatgttttattctcctccgtatatttgaaaagctgttttacactctcttgtcacgttctgaccaagaaactcagtgaaatatgaaacaacttgcgtaaaaaggtcatctgattgtaaaatcaaatggttttaaaaaatgttctctatatggatcagccaattttctgcgaatgttttgaaaaccttactttttctctgtgtttgaacaaaccatgaaaacacaaaaggctatttggaaacgtttttaacgtcttggatcacaattccatttgaaggagttgagtgttttcctttctgacaacggatatgaaaatggtaattatcagaggccttcaaacaaacaaaagattttaaatgcagatgttttattttctctcgatattttcaactcctaaggtaaatttgctttgtaaaatgtttacagacgaaagcaaaacagaactgggtattgtcctttcttgcagttaattcgagaatagattcactgactttctttctatgtttatttatcagtatggatgctcgaataattatacaattttctttcgtgtcttcgtttacgtgtgtataacgatgcacaacacagaaggaaaacgatgttttgaaggtaaaccatgcatcaaagaacattnaaatttgcattaattcacaaaaggcgtattgcaaaaggtcctacattgcagccgcttattaaaat

SEQ ID NO: 286 - DNA, 4000 bp, Escherichia coli
  misc_feature (2)..(3): n is a, c, g, or t
  misc_feature (5)..(6): n is a, c, g, or t
  misc_feature (12)..(12): n is a, c, g, or t
  misc_feature (15)..(15): n is a, c, g, or t
  misc_feature (19)..(20): n is a, c, g, or t
  misc_feature (46)..(46): n is a, c, g, or t
  misc_feature (98)..(98): n is a, c, g, or t
  misc_feature (118)..(118): n is a, c, g, or t
  misc_feature (122)..(122): n is a, c, g, or t
  misc_feature (139)..(139): n is a, c, g, or t
  misc_feature (141)..(141): n is a, c, g, or t
  misc_feature (161)..(161): n is a, c, g, or t
  misc_feature (432)..(432): n is a, c, g, or t
  misc_feature (434)..(438): n is a, c, g, or t
  misc_feature (448)..(449): n is a, c, g, or t
  misc_feature (451)..(451): n is a, c, g, or t
  misc_feature (453)..(454): n is a, c, g, or t
  misc_feature (484)..(484): n is a, c, g, or t
  misc_feature (488)..(488): n is a, c, g, or t
  misc_feature (504)..(504): n is a, c, g, or t
  misc_feature (506)..(508): n is a, c, g, or t
  misc_feature (817)..(817): n is a, c, g, or t
  misc_feature (1051)..(1052): n is a, c, g, or t
  misc_feature (1076)..(1076): n is a, c, g, or t
  misc_feature (1079)..(1079): n is a, c, g, or t
  misc_feature (1114)..(1115): n is a, c, g, or t
  misc_feature (1119)..(1120): n is a, c, g, or t
  misc_feature (1127)..(1127): n is a, c, g, or t
  misc_feature (1141)..(1141): n is a, c, g, or t
  misc_feature (1151)..(1151): n is a, c, g, or t
  misc_feature (1158)..(1159): n is a, c, g, or t
  misc_feature (1163)..(1163): n is a, c, g, or t
  misc_feature (1172)..(1172): n is a, c, g, or t
  misc_feature (1188)..(1188): n is a, c, g, or t
  misc_feature (1231)..(1231): n is a, c, g, or t
  misc_feature (1445)..(1445): n is a, c, g, or t
  misc_feature (1449)..(1449): n is a, c, g, or t
  misc_feature (1482)..(1482): n is a, c, g, or t
  misc_feature (1497)..(1497): n is a, c, g, or t
  misc_feature (1986)..(1986): n is a, c, g, or t
  misc_feature (1991)..(1991): n is a, c, g, or t
  misc_feature (2639)..(2639): n is a, c, g, or t
  misc_feature (2780)..(2780): n is a, c, g, or t
  misc_feature (2784)..(2787): n is a, c, g, or t
  misc_feature (2790)..(2790): n is a, c, g, or t
  misc_feature (2792)..(2792): n is a, c, g, or t
  misc_feature (2796)..(2797): n is a, c, g, or t
  misc_feature (2800)..(2805): n is a, c, g, or t
  misc_feature (2819)..(2821): n is a, c, g, or t
  misc_feature (2825)..(2825): n is a, c, g, or t
  misc_feature (2827)..(2832): n is a, c, g, or t
  misc_feature (2834)..(2845): n is a, c, g, or t
  misc_feature (2847)..(2852): n is a, c, g, or t
  misc_feature (2854)..(2855): n is a, c, g, or t
  misc_feature (2857)..(2858): n is a, c, g, or t
  misc_feature (2860)..(2860): n is a, c, g, or t
  misc_feature (2862)..(2872): n is a, c, g, or t
  misc_feature (2874)..(2874): n is a, c, g, or t
  misc_feature (2876)..(2877): n is a, c, g, or t
  misc_feature (2879)..(2895): n is a, c, g, or t
  misc_feature (2897)..(2904): n is a, c, g, or t
  misc_feature (2906)..(2915): n is a, c, g, or t
  misc_feature (2917)..(2918): n is a, c, g, or t
  misc_feature (2921)..(2930): n is a, c, g, or t
  misc_feature (2932)..(2936): n is a, c, g, or t
  misc_feature (2938)..(2939): n is a, c, g, or t
  misc_feature (2941)..(2951): n is a, c, g, or t
  misc_feature (2953)..(2960): n is a, c, g, or t
  misc_feature (2962)..(2981): n is a, c, g, or t
  misc_feature (2983)..(2993): n is a, c, g, or t
  misc_feature (2995)..(2997): n is a, c, g, or t
  misc_feature (2999)..(3041): n is a, c, g, or t
  misc_feature (3043)..(3045): n is a, c, g, or t
  misc_feature (3047)..(3047): n is a, c, g, or t
  misc_feature (3049)..(3052): n is a, c, g, or t
  misc_feature (3054)..(3055): n is a, c, g, or t
  misc_feature (3057)..(3078): n is a, c, g, or t
  misc_feature (3080)..(3080): n is a, c, g, or t
  misc_feature (3082)..(3082): n is a, c, g, or t
  misc_feature (3084)..(3085): n is a, c, g, or t
  misc_feature (3087)..(3087): n is a, c, g, or t
  misc_feature (3089)..(3092): n is a, c, g, or t
  misc_feature (3094)..(3094): n is a, c, g, or t
  misc_feature (3096)..(3097): n is a, c, g, or t
  misc_feature (3109)..(3109): n is a, c, g, or t
  misc_feature (3111)..(3111): n is a, c, g, or t
  misc_feature (3113)..(3114): n is a, c, g, or t
  misc_feature (3117)..(3118): n is a, c, g, or t
  misc_feature (3121)..(3121): n is a, c, g, or t
  misc_feature (3126)..(3126): n is a, c, g, or t
  misc_feature (3132)..(3132): n is a, c, g, or t
  misc_feature (3134)..(3134): n is a, c, g, or t
  misc_feature (3136)..(3137): n is a, c, g, or t
  misc_feature (3139)..(3141): n is a, c, g, or t
  misc_feature (3145)..(3146): n is a, c, g, or t
  misc_feature (3148)..(3148): n is a, c, g, or t
  misc_feature (3151)..(3152): n is a, c, g, or t
  misc_feature (3155)..(3155): n is a, c, g, or t
  misc_feature (3157)..(3157): n is a, c, g, or t
  misc_feature (3160)..(3160): n is a, c, g, or t
  misc_feature (3165)..(3165): n is a, c, g, or t
  misc_feature (3179)..(3181): n is a, c, g, or t
  misc_feature (3184)..(3184): n is a, c, g, or t
  misc_feature (3198)..(3200): n is a, c, g, or t
  misc_feature (3202)..(3205): n is a, c, g, or t
  misc_feature (3207)..(3209): n is a, c, g, or t
  misc_feature (3211)..(3215): n is a, c, g, or t
  misc_feature (3219)..(3225): n is a, c, g, or t
  misc_feature (3227)..(3227): n is a, c, g, or t
  misc_feature (3229)..(3238): n is a, c, g, or t
  misc_feature (3240)..(3240): n is a, c, g, or t
  misc_feature (3242)..(3252): n is a, c, g, or t
  misc_feature (3254)..(3254): n is a, c, g, or t
  misc_feature (3256)..(3263): n is a, c, g, or t
  misc_feature (3265)..(3265): n is a, c, g, or t
  misc_feature (3267)..(3273): n is a, c, g, or t
  misc_feature (3275)..(3276): n is a, c, g, or t
  misc_feature (3278)..(3278): n is a, c, g, or t
  misc_feature (3280)..(3282): n is a, c, g, or t
  misc_feature (3284)..(3285): n is a, c, g, or t
  misc_feature (3287)..(3296): n is a, c, g, or t
  misc_feature (3298)..(3307): n is a, c, g, or t
  misc_feature (3309)..(3309): n is a, c, g, or t
  misc_feature (3311)..(3313): n is a, c, g, or t
  misc_feature (3493)..(4000): n is a, c, g, or t
tnncnntccggnggntgcnnctccaggatcgtgccgtcgacggagnggtccgacccgtcttgaaacacggaccaaggagtctgacatgggtgcgagtngtagggtggcaaaccctagngcgnagagaaatcgagatagncngagcctgttacagggcgcanggctggcagagcgttgttcttttgttcagtgcctagcaagagcacttatgtcgggacccgaaagatggtgaactatgcttgtgcagggtgaagtcaggagaaatcctgatggaagctcgaagcgatactgacgtgcaaatcgttcgtctgacatgagtataggggcgaaagactaatcgaaccatctagtagctggttccctccgaagtttcccccaggatagcaggaattcactgtgagttttatcaggtaaagcgaatgattaggggantnnnnnctgaaacagnntngnnccattctcaaactttaaatgggtaagaagngggngttgcttaattgaacntnnncgtcgaatcagggttcttagtgggccatttttggtaagcagaactggcgatgtgggatgctccagacgcgttggttaaggggccaaagtactcgctcattccgataccacaaagggtgttggttgatgaagacagcaggacggtggtcatggaagtcgaaatccgctaaggagtgtgtaacaactcacctgccgaatcaactagccccgaaaatggatggcgctcaagcgagtccccgaaaccgggccattggagcagatgcgacgctccaatgagtaggagggcgcgggggttgcggcgaaggcgctngcgcgagccacgcttagagcagcctctggtgcagatcttggtgttagtagcaaatattcaaatgaaaactttgaagaccgaagtggagaaaggtttcacgtgaacatcatttggacgtgagtgactcggtcctaaggtattccgtatgggattcagaaggcgcggcttgtcgcgccatcggccaaaagggcaatcggttaaaattccgatagtgcggacacggtgctgagcggnnacgcgttcgaaccaggtgacggtngcncgggccccgggaagagttctcttttctttttgacnnagcnncaggccntgaaataggattanccttagatanggcgggnngcgnggcagagcngctgaccctttcagcngtccggtgcgctcgggaagccccttgaaaagcctggggagtgnatgcactcggtcccagccgtactcataaccgcatcaggtctccaaggttaaaagcctctggtcaatagaacaatgtaggtaagggaagtcggcaaattggttccgtaagttcgcgaaatggaatggctcgtcagactggatggtagaggctcggtccatgaagcgtgctagccgacgggactggctagctggccctcgggctggcgggccgggnctgnccggcaggcgcgtggaggggctgagattgcgcngggccttcgggaccngtcgcgttctcgccataacaagcagtcaatgacgaactcgtagtgaccacaggaacccgactgtttaattaaaacaaagcattgtgacggtcgcaagtcgatgttgacacaatgtgatttctgcccagtgctctgaatgtcaaagtgatgtaattcaaccaagcgcgggtaaacggcgggagtaactatgactctcttaaggtagccaaatgcctcgtcatctaattagtgacgcgcatgaatggatcaacgaggttcctactgtccctatctactatctagcgaaaccacagccaagggaacgggcttgggagtaacggcggggaaagaagaccctgttgagcttgactctagtctgacattgtgaaatgacctgattggtgcagcataagtgggagcgcaagcaacagtgagataccactactttcagcgttgttttacttacatggttagcaaccgcggacactctgttgtccatttctagtattnaaggncttcgggccgaggttcgtcgtggacactgtcaggtggggagtttggctggggcggcacatctgttaaatgataacacaggtgacccaagatcagctcagagcgaacggaaatcgctcgtcgagtttaagggcaaaagctgatttgactttcattttcagtatgagtggaagcagtgaaagctcaggcctagcgatcctttaggtcctcggacattgaggctagaggtgtcagaaaagttaccacagggataactggcttgtggcggccaagcgttcatagcgacgtcgctttttgattcttcgatgtcggctcttcctacccctttctcgcacaagggaaaaaaggtaagattgttcacctactaacagggaacgtgagctgggtttagaccgtcgcgagacaggttagttttatcctactgttacacaatcacgccaatagtacgccccttcagtacgagaggaaccatgggcgcgcacgtccggtaaattgggttggtggaaacgccattgcccagaaactgccatgcgtcggataacggctgaacgcctctaagccggaaaccgtactagcacgcgtgatgttttgggtgttctcatcggttgaagttccgatagccttcgggccaggaccatacgcactttcgnggtgcgcacagcaacgctagatttgaactcccgtggatcatttgtagacgacttaaattccaaaccgggtattgtaatgtgtagagatgccttgttgcatcgatcgcatgagattcagcccgcgtttttcgattcggaaanaaannnnttntntttnnttnnnnnnttctttttttcttnnntttntnnnnnntnnnnnnnnnnnngnnnnnngnncnntngnnnnnnnnnnntngnngnnnnnnnnnnnnnnnnngnnnnnnnnannnnnnnnnntnnttnnnnnnnnnngnnnnntnntnnnnnnnnnnncnnnnnnnngnnnnnnnnnnnnnnnnnnnncnnnnnnnnnnnannngnnnnnnnnnnnnnnnnnnnnnnnnnnnnnnnnnnnnnnnnnnngnnnanannnnanntnnnnnnnnnnnnnnnnnnnnnnananannanannnngncnnaaatatacagcncncnngannaanaaaanaaaatnanannannntatnnanttnntantnctnttttnttcatctttttcannnatnagtactttttttgnnnannnnannngnnnnncggnnnnnnnangnnnnnnnnnncncnnnnnnnnnnnantnnnnnnnnangnnnnnnngnncncnnncnntnnnnnnnnnngnnnnnnnnnngnannntcgggtgctgtatgtcttttttgtttttttgaaggtctccttcgcttgaacccagaatataatctccatgtccgtaccttttagagtctcgattttcagcatgttgagcataccttctcggccttttggctaagatcaagtgtagtatctgttcttatcagcttaatctctggtacgtgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 287 - DNA, 4000 bp, Escherichia coli
  misc_feature (1991)..(1992): n is a, c, g, or t
  misc_feature (2511)..(2511): n is a, c, g, or t
  misc_feature (2898)..(2898): n is a, c, g, or t
cagcagtcatggcttgatgctagaggtcgcctaagagagcatgcaaaggatcttacagcctgaaatgctggatggattgccagcggatcaccctgcagcagtggcgtctagaaaggacttgagaatcatcaatcggttgatgaatcacgtatcatttctcaatcggtcgacacgctggatccaggacaaagcaaagaaaagtccggttcggatcgtcgaactgggaagcggagatggtagcctcgcgtgcaggatgttattgagatggggtaaggtagctactggaagccgcattctttttgtggatcaatctccctgcttggaaaaaaatcatgcggagccactcgacagattgggatgggaagtcgacaaccaggtggtagacgtctttaagtggttcgaaaaagatgcttctgaaatcgatttatgttttgccagtctattcgtgcatcattttacatttgaggagatcagtcgcttatttgatcaactaaaagccaggacaaaagcgttcgtctgtcttgaacctcgacgagattggaaaggccttttagcggccaaggccctttggtgcatccgatgcgatcccgtcaccttaaatgatgcatgcatcagcgtacgcgctggattcctcaatcaagaactctcccagatttggatgcagaacaccgaaacatcatgggatatggaagagcgctcagccggtctgttcagtcaccttttttccgctaagaacctgtccgatagatcatcatgagtctcaggcccatcaccattgtcggcggagggatcagcggtttgtctttgggcattgatctccaactaaaaggctttgcagttcagctttttgaagccggcgattatccccgccatcgggtttgcggtgaatttctcagcggacaaggttatcgccaactcaaggaatgggggttggccaagtcattcctggcagccggtgccgtcgaagcaactcactttaaatgttatggcccagcgggcatgtctccagtcttacgtttgccatcgcctgccttgtgcctctctcgttattgcatggatgactgcatggcagaacatttcagagaactaggcggccatctcatcactcggtatcgcgttcatcctgctgattttgagcagaaggagggaacgatttgggcacacggccgactcgctcaaacacgtcaaaaatgcccctggattggttacaagtgtcacattaaggattacccattggcagctgatctggagatgcattttggcagaaatggctacgtgggtctttgccgcgtggaagatggaaaaatcaatgtatgcggactgacgcgcatggcagaacgggcctcagcgatgcccggaaaaggccgttggctgccatgggccttgtcatcccttcacccctcaaaacacaagaaccttcagaaagcacaatgccttgaggacagcctttgctacacggctggtctgcaatacaaagcgcggtggtttgaaaagacacgcacaaaagctgtcattggagaccataggacgctcatacctccgcttacgggcaatggcatgtccatggcggtggaatccgctcatctggccacctccttcatccaaaactattttgaggggggccttcagtgggatgaggtctgtcagcaaatgaaccgagccatgaacaaacgtttccgaaaacgcctcctggttgccggcgtgctacagagactgatcctagcacgccatggtgaggggatccgaaacaacctcattcaaaacatgagtgcgtttcaccgatatctgtatgcttggactcgctaagagcccgatgaaggatcccgagcaatgtattcaaaggaaaactagattaaaggctgaaagactgggaaatgatgcccatttctcaccaccaaccattcaaaatggttgccatccaatgggttattaacagatggtagaatgatacttttttgtatacatctagtttggtttatgtataaatagannggctattccttaatagtgattcatcaaaagtgggcttctgcagagggtgcagaggccctttttgatgtcgtgggagccttttttgatatgatttgaggctgacaggaggtttacccatttttttcgtgttgaagaaacgcagatcacgaaccctcagaaaggcaggagagactaccttcgagagtccccttgaaaccagggaagatctttctggatgaactcctgatcttcaaacgccgaatggccatcgacataggtgatcacactgccgggtttcgagccgctaccagaaccatgacgagcgtgctgtttgttaggaggattgatggtcgacccaatgggatgaggccccccagcattgtagacccgctcgtgatcccagtctggagcaataaaataagtggcacagccaaaaaagaaaatggaggtgggttcaggcacggtgctgaatttgggcatcttgatgcccgcgggacccgccatacgctcgttgataccataggaagcagtgaattcgancgtctttgcatccggcccacggccactcatgcgcatccgcaccttccttaggtcactgtggtcgtaaggtccctcatgttcggcagggtcttcaaaagatttgaggctctcaaaataacctgctgcgatcatggacttgatccagtcggtgtggtcggaagtggtggccttaggaaactgaccattgaagtcatccccatacatcatggttgccagcgcaatttgcttctgattgttcatgcagagaatcttgcgcgcagagaccttggctcctgccagggcgggaagcaataaggacgcaagaatggcaatgatggcaaccaccaccaacaattcaatcagggtaaaagcacgcagagacttcatgatttgcaacgggttatcganaatcgtgaagtttcacgccagaaaaatcaagcaggaagctaggaagcctcggctgcccgtgcgttcagctctggcttttcatccatgccaaccatcaggcgcgcatcctgggcaaaacactcccaaggcctccatcgacacccaggacttgccccgtcacccaggaggactcctccgatagaagccaggccatgctgtgagccacgtctgcgggagaacccagccggcctaaggcgtgcatgccttgggatgccttgcggttggcgtcgctggaaaggagagattctgtcaggggtgtctcgaccaatcccggtgccacacaattcacccggatacctcttgcagcataggtcgctgctgcggaaagggtcagtcccataatggctcccttggcagcggcaatagcctcgtggttggccatcccaatccttgaagctgccgaggccgtcaggacaatagaaccgccggtgcgcatcatcgcatgagcagcagctcccaaaataccaaaagcggtgcttacgtgggtgtgcatgacatcattccactcttcctgtgacgtcagatgagctggtttgagcaacaggctgccgatgcataccgcgactccatcaagaccatccatctcttccttagacctggcgatggttgaacgaaccgcctgccaatcatgcatatccaccacttgagtaccgtcgcatacttcggaagtcaccttctggagccgatcagcgtctctaccaaaaccacaaacgtgatgagcttgttgtttcagtttcataccaagggccgtaccgataccgccggtgattccaaagatcatgtatttacgctgtttcataggattttctaccccgccctcatcgaaatttgagccacttttcatgtgccatcatccaagaagctgtcaaccgtctcctttccattcgatgagctagacttaggttcaagaatgcaggcgatccaagttaatccaaggccaacgaacaacctactggtaaaaagaccgttgcatcatcgccactcggagttaagttgctctattctgtcatggatgaattctgcctcaaaaagatgtcttcgatgctttcagacctcgatcact

SEQ ID NO: 288 - DNA, 4000 bp, Escherichia coli
  misc_feature (1)..(2): n is a, c, g, or t
  misc_feature (5)..(7): n is a, c, g, or t
  misc_feature (10)..(10): n is a, c, g, or t
  misc_feature (12)..(18): n is a, c, g, or t
  misc_feature (20)..(21): n is a, c, g, or t
  misc_feature (23)..(23): n is a, c, g, or t
  misc_feature (25)..(26): n is a, c, g, or t
  misc_feature (29)..(37): n is a, c, g, or t
  misc_feature (39)..(39): n is a, c, g, or t
  misc_feature (41)..(58): n is a, c, g, or t
  misc_feature (61)..(64): n is a, c, g, or t
  misc_feature (66)..(66): n is a, c, g, or t
  misc_feature (68)..(68): n is a, c, g, or t
  misc_feature (70)..(70): n is a, c, g, or t
  misc_feature (72)..(82): n is a, c, g, or t
  misc_feature (85)..(85): n is a, c, g, or t
  misc_feature (87)..(88): n is a, c, g, or t
  misc_feature (92)..(107): n is a, c, g, or t
  misc_feature (111)..(140): n is a, c, g, or t
  misc_feature (144)..(144): n is a, c, g, or t
  misc_feature (146)..(157): n is a, c, g, or t
  misc_feature (159)..(160): n is a, c, g, or t
  misc_feature (162)..(163): n is a, c, g, or t
  misc_feature (165)..(165): n is a, c, g, or t
  misc_feature (167)..(167): n is a, c, g, or t
  misc_feature (170)..(174): n is a, c, g, or t
  misc_feature (177)..(189): n is a, c, g, or t
  misc_feature (191)..(191): n is a, c, g, or t
  misc_feature (193)..(193): n is a, c, g, or t
  misc_feature (195)..(195): n is a, c, g, or t
  misc_feature (197)..(197): n is a, c, g, or t
  misc_feature (199)..(211): n is a, c, g, or t
  misc_feature (213)..(213): n is a, c, g, or t
  misc_feature (221)..(221): n is a, c, g, or t
  misc_feature (223)..(227): n is a, c, g, or t
  misc_feature (229)..(229): n is a, c, g, or t
  misc_feature (231)..(236): n is a, c, g, or t
  misc_feature (238)..(238): n is a, c, g, or t
  misc_feature (240)..(248): n is a, c, g, or t
  misc_feature (250)..(250): n is a, c, g, or t
  misc_feature (252)..(253): n is a, c, g, or t
  misc_feature (255)..(262): n is a, c, g, or t
  misc_feature (268)..(268): n is a, c, g, or t
  misc_feature (270)..(271): n is a, c, g, or t
  misc_feature (273)..(284): n is a, c, g, or t
  misc_feature (290)..(290): n is a, c, g, or t
  misc_feature (292)..(297): n is a, c, g, or t
  misc_feature (300)..(300): n is a, c, g, or t
  misc_feature (302)..(306): n is a, c, g, or t
  misc_feature (308)..(310): n is a, c, g, or t
  misc_feature (312)..(312): n is a, c, g, or t
  misc_feature (314)..(322): n is a, c, g, or t
  misc_feature (324)..(331): n is a, c, g, or t
  misc_feature (333)..(333): n is a, c, g, or t
  misc_feature (335)..(338): n is a, c, g, or t
  misc_feature (340)..(340): n is a, c, g, or t
  misc_feature (342)..(349): n is a, c, g, or t
  misc_feature (351)..(354): n is a, c, g, or t
  misc_feature (356)..(356): n is a, c, g, or t
  misc_feature (359)..(359): n is a, c, g, or t
  misc_feature (362)..(362): n is a, c, g, or t
  misc_feature (364)..(367): n is a, c, g, or t
  misc_feature (372)..(373): n is a, c, g, or t
  misc_feature (376)..(377): n is a, c, g, or t
  misc_feature (379)..(379): n is a, c, g, or t
  misc_feature (381)..(382): n is a, c, g, or t
  misc_feature (384)..(384): n is a, c, g, or t
  misc_feature (386)..(397): n is a, c, g, or t
  misc_feature (399)..(399): n is a, c, g, or t
  misc_feature (401)..(401): n is a, c, g, or t
  misc_feature (403)..(403): n is a, c, g, or t
  misc_feature (405)..(407): n is a, c, g, or t
  misc_feature (411)..(411): n is a, c, g, or t
  misc_feature (413)..(413): n is a, c, g, or t
  misc_feature (415)..(415): n is a, c, g, or t
  misc_feature (417)..(417): n is a, c, g, or t
  misc_feature (419)..(421): n is a, c, g, or t
  misc_feature (423)..(423): n is a, c, g, or t
  misc_feature (425)..(429): n is a, c, g, or t
  misc_feature (432)..(434): n is a, c, g, or t
  misc_feature (439)..(441): n is a, c, g, or t
  misc_feature (444)..(444): n is a, c, g, or t
  misc_feature (446)..(447): n is a, c, g, or t
  misc_feature (449)..(451): n is a, c, g, or t
  misc_feature (453)..(453): n is a, c, g, or t
  misc_feature (455)..(455): n is a, c, g, or t
  misc_feature (457)..(459): n is a, c, g, or t
  misc_feature (461)..(464): n is a, c, g, or t
  misc_feature (466)..(466): n is a, c, g, or t
  misc_feature (468)..(469): n is a, c, g, or t
  misc_feature (471)..(475): n is a, c, g, or t
  misc_feature (477)..(477): n is a, c, g, or t
  misc_feature (479)..(481): n is a, c, g, or t
  misc_feature (492)..(495): n is a, c, g, or t
  misc_feature (497)..(498): n is a, c, g, or t
  misc_feature (503)..(505): n is a, c, g, or t
  misc_feature (507)..(513): n is a, c, g, or t
  misc_feature (515)..(516): n is a, c, g, or t
  misc_feature (520)..(521): n is a, c, g, or t
  misc_feature (525)..(525): n is a, c, g, or t
  misc_feature (527)..(528): n is a, c, g, or t
  misc_feature (530)..(541): n is a, c, g, or t
  misc_feature (543)..(543): n is a, c, g, or t
  misc_feature (546)..(552): n is a, c, g, or t
  misc_feature (554)..(554): n is a, c, g, or t
  misc_feature (556)..(565): n is a, c, g, or t
  misc_feature (567)..(571): n is a, c, g, or t
  misc_feature (573)..(573): n is a, c, g, or t
  misc_feature (575)..(575): n is a, c, g, or t
  misc_feature (577)..(577): n is a, c, g, or t
  misc_feature (579)..(582): n is a, c, g, or t
  misc_feature (586)..(590): n is a, c, g, or t
  misc_feature (592)..(594): n is a, c, g, or t
  misc_feature (596)..(601): n is a, c, g, or t
  misc_feature (605)..(605): n is a, c, g, or t
  misc_feature (607)..(610): n is a, c, g, or t
  misc_feature (612)..(623): n is a, c, g, or t
  misc_feature (625)..(625): n is a, c, g, or t
  misc_feature (627)..(631): n is a, c, g, or t
  misc_feature (633)..(633): n is a, c, g, or t
  misc_feature (635)..(638): n is a, c, g, or t
  misc_feature (640)..(640): n is a, c, g, or t
  misc_feature (642)..(647): n is a, c, g, or t
  misc_feature (650)..(652): n is a, c, g, or t
  misc_feature (654)..(654): n is a, c, g, or t
  misc_feature (656)..(662): n is a, c, g, or t
  misc_feature (664)..(664): n is a, c, g, or t
  misc_feature (666)..(667): n is a, c, g, or t
  misc_feature (669)..(669): n is a, c, g, or t
  misc_feature (671)..(671): n is a, c, g, or t
  misc_feature (673)..(679): n is a, c, g, or t
  misc_feature (682)..(684): n is a, c, g, or t
  misc_feature (686)..(686): n is a, c, g, or t
  misc_feature (688)..(688): n is a, c, g, or t
  misc_feature (690)..(690): n is a, c, g, or t
  misc_feature (692)..(692): n is a, c, g, or t
  misc_feature (694)..(707): n is a, c, g, or t
  misc_feature (709)..(709): n is a, c, g, or t
  misc_feature (712)..(713): n is a, c, g, or t
  misc_feature (715)..(721): n is a, c, g, or t
  misc_feature (723)..(729): n is a, c, g, or t
  misc_feature (734)..(734): n is a, c, g, or t
  misc_feature (736)..(736): n is a, c, g, or t
  misc_feature (739)..(744): n is a, c, g, or t
  misc_feature (746)..(748): n is a, c, g, or t
  misc_feature (750)..(750): n is a, c, g, or t
  misc_feature (753)..(757): n is a, c, g, or t
  misc_feature (759)..(759): n is a, c, g, or t
  misc_feature (761)..(761): n is a, c, g, or t
  misc_feature (763)..(764): n is a, c, g, or t
  misc_feature (766)..(766): n is a, c, g, or t
  misc_feature (768)..(776): n is a, c, g, or t
  misc_feature (779)..(795): n is a, c, g, or t
  misc_feature (799)..(808): n is a, c, g, or t
  misc_feature (810)..(818): n is a, c, g, or t
  misc_feature (820)..(828): n is a, c, g, or t
  misc_feature (833)..(835): n is a, c, g, or t
  misc_feature (841)..(841): n is a, c, g, or t
  misc_feature (844)..(844): n is a, c, g, or t
  misc_feature (846)..(847): n is a, c, g, or t
  misc_feature (849)..(852): n is a, c, g, or t
  misc_feature (854)..(858): n is a, c, g, or t
  misc_feature (862)..(868): n is a, c, g, or t
  misc_feature (870)..(870): n is a, c, g, or t
  misc_feature (873)..(873): n is a, c, g, or t
  misc_feature (875)..(877): n is a, c, g, or t
  misc_feature (879)..(879): n is a, c, g, or t
  misc_feature (881)..(881): n is a, c, g, or t
  misc_feature (883)..(885): n is a, c, g, or t
  misc_feature (887)..(887): n is a, c, g, or t
  misc_feature (889)..(892): n is a, c, g, or t
  misc_feature (897)..(898): n is a, c, g, or t
  misc_feature (909)..(909): n is a, c, g, or t
  misc_feature (911)..(911): n is a, c, g, or t
  misc_feature (913)..(916): n is a, c, g, or t
  misc_feature (920)..(921): n is a, c, g, or t
  misc_feature (923)..(925): n is a, c, g, or t
  misc_feature (927)..(927): n is a, c, g, or t
  misc_feature (929)..(946): n is a, c, g, or t
  misc_feature (948)..(958): n is a, c, g, or t
  misc_feature (960)..(964): n is a, c, g, or t
  misc_feature (966)..(973): n is a, c, g, or t
  misc_feature (975)..(980): n is a, c, g, or t
  misc_feature (982)..(983): n is a, c, g, or t
  misc_feature (985)..(987): n is a, c, g, or t
  misc_feature (989)..(998): n is a, c, g, or t
  misc_feature (1000)..(1000): n is a, c, g, or t
  misc_feature (1002)..(1005): n is a, c, g, or t
  misc_feature (1011)..(1017): n is a, c, g, or t
  misc_feature (1019)..(1019): n is a, c, g, or t
  misc_feature (1021)..(1028): n is a, c, g, or t
  misc_feature (1032)..(1032): n is a, c, g, or t
  misc_feature (1034)..(1039): n is a, c, g, or t
  misc_feature (1043)..(1048): n is a, c, g, or t
  misc_feature (1050)..(1053): n is a, c, g, or t
  misc_feature (1058)..(1060): n is a, c, g, or t
  misc_feature (1062)..(1065): n is a, c, g, or t
  misc_feature (1067)..(1067): n is a, c, g, or t
  misc_feature (1071)..(1073): n is a, c, g, or t
  misc_feature (1075)..(1075): n is a, c, g, or t
  misc_feature (1078)..(1084): n is a, c, g, or t
  misc_feature (1086)..(1086): n is a, c, g, or t
  misc_feature (1088)..(1094): n is a, c, g, or t
  misc_feature (1096)..(1097): n is a, c, g, or t
  misc_feature (1099)..(1099): n is a, c, g, or t
  misc_feature (1104)..(1106): n is a, c, g, or t
  misc_feature (1108)..(1109): n is a, c, g, or t
  misc_feature (1111)..(1116): n is a, c, g, or t
  misc_feature (1118)..(1118): n is a, c, g, or t
  misc_feature (1120)..(1126): n is a, c, g, or t
  misc_feature (1128)..(1137): n is a, c, g, or t
  misc_feature (1139)..(1141): n is a, c, g, or t
  misc_feature (1143)..(1147): n is a, c, g, or t
  misc_feature (1149)..(1149): n is a, c, g, or t
  misc_feature (1151)..(1156): n is a, c, g, or t
  misc_feature (1158)..(1158): n is a, c, g, or t
  misc_feature (1160)..(1162): n is a, c, g, or t
  misc_feature (1165)..(1166): n is a, c, g, or t
  misc_feature (1168)..(1168): n is a, c, g, or t
  misc_feature (1170)..(1170): n is a, c, g, or t
  misc_feature (1172)..(1172): n is a, c, g, or t
  misc_feature (1178)..(1178): n is a, c, g, or t
  misc_feature (1182)..(1188): n is a, c, g, or t
  misc_feature (1190)..(1192): n is a, c, g, or t
  misc_feature (1194)..(1203): n is a, c, g, or t
  misc_feature (1205)..(1210): n is a, c, g, or t
  misc_feature (1212)..(1212): n is a, c, g, or t
  misc_feature (1214)..(1219): n is a, c, g, or t
  misc_feature (1221)..(1221): n is a, c, g, or t
  misc_feature (1223)..(1223): n is a, c, g, or t
  misc_feature (1225)..(1225): n is a, c, g, or t
  misc_feature (1227)..(1227): n is a, c, g, or t
  misc_feature (1229)..(1231): n is a, c, g, or t
  misc_feature (1236)..(1241): n is a, c, g, or t
  misc_feature (1243)..(1243): n is a, c, g, or t
  misc_feature (1245)..(1245): n is a, c, g, or t
  misc_feature (1247)..(1247): n is a, c, g, or t
  misc_feature (1249)..(1249): n is a, c, g, or t
  misc_feature (1251)..(1251): n is a, c, g, or t
  misc_feature (1253)..(1255): n is a, c, g, or t
  misc_feature (1257)..(1265): n is a, c, g, or t
  misc_feature (1267)..(1271): n is a, c, g, or t
  misc_feature (1273)..(1273): n is a, c, g, or t
  misc_feature (1278)..(1278): n is a, c, g, or t
  misc_feature (1280)..(1285): n is a, c, g, or t
  misc_feature (1287)..(1287): n is a, c, g, or t
  misc_feature (1289)..(1290): n is a, c, g, or t
  misc_feature (1294)..(1302): n is a, c, g, or t
  misc_feature (1307)..(1318): n is a, c, g, or t
  misc_feature (1325)..(1327): n is a, c, g, or t
  misc_feature (1329)..(1339): n is a, c, g, or t
  misc_feature (1341)..(1341): n is a, c, g, or t
  misc_feature (1343)..(1352): n is a, c, g, or t
  misc_feature (1354)..(1359): n is a, c, g, or t
  misc_feature (1361)..(1364): n is a, c, g, or t
  misc_feature (1366)..(1367): n is a, c, g, or t
  misc_feature (1370)..(1372): n is a, c, g, or t
  misc_feature (1374)..(1376): n is a, c, g, or t
  misc_feature (1378)..(1384): n is a, c, g, or t
  misc_feature (1386)..(1388): n is a, c, g, or t
  misc_feature (1390)..(1390): n is a, c, g, or t
  misc_feature (1392)..(1394): n is a, c, g, or t
  misc_feature (1396)..(1398): n is a, c, g, or t
  misc_feature (1402)..(1402): n is a, c, g, or t
  misc_feature (1404)..(1407): n is a, c, g, or t
  misc_feature (1409)..(1414): n is a, c, g, or t
  misc_feature (1416)..(1417): n is a, c, g, or t
  misc_feature (1419)..(1426): n is a, c, g, or t
  misc_feature (1428)..(1429): n is a, c, g, or t
  misc_feature (1431)..(1436): n is a, c, g, or t
  misc_feature (1438)..(1441): n is a, c, g, or t
  misc_feature (1443)..(1449): n is a, c, g, or t
  misc_feature (1451)..(1454): n is a, c, g, or t
  misc_feature (1456)..(1462): n is a, c, g, or t
  misc_feature (1464)..(1465): n is a, c, g, or t
  misc_feature (1468)..(1471): n is a, c, g, or t
  misc_feature (1473)..(1475): n is a, c, g, or t
  misc_feature (1477)..(1483): n is a, c, g, or t
  misc_feature (1485)..(1486): n is a, c, g, or t
  misc_feature (1489)..(1501): n is a, c, g, or t
  misc_feature (1503)..(1508): n is a, c, g, or t
  misc_feature (1510)..(1513): n is a, c, g, or t
  misc_feature (1515)..(1520): n is a, c, g, or t
  misc_feature (1522)..(1535): n is a, c, g, or t
  misc_feature (1537)..(1538): n is a, c, g, or t
  misc_feature (1540)..(1548): n is a, c, g, or t
  misc_feature (1550)..(1550): n is a, c, g, or t
  misc_feature (1552)..(1558): n is a, c, g, or t
  misc_feature (1560)..(1560): n is a, c, g, or t
  misc_feature (1562)..(1567): n is a, c, g, or t
  misc_feature (1569)..(1575): n is a, c, g, or t
  misc_feature (1577)..(1579): n is a, c, g, or t
  misc_feature (1581)..(1583): n is a, c, g, or t
  misc_feature (1585)..(1590): n is a, c, g, or t
  misc_feature (1592)..(1594): n is a, c, g, or t
  misc_feature (1596)..(1596): n is a, c, g, or t
  misc_feature (1598)..(1602): n is a, c, g, or t
  misc_feature (1604)..(1611): n is a, c, g, or t
  misc_feature (1613)..(1618): n is a, c, g, or t
  misc_feature (1620)..(1621): n is a, c, g, or t
  misc_feature (1623)..(1655): n is a, c, g, or t
  misc_feature (1657)..(1658): n is a, c, g, or t
  misc_feature (1660)..(1671): n is a, c, g, or t
  misc_feature (1673)..(1677): n is a, c, g, or t
  misc_feature (1679)..(1681): n is a, c, g, or t
  misc_feature (1683)..(1695): n is a, c, g, or t
  misc_feature (1697)..(1698): n is a, c, g, or t
  misc_feature (1700)..(1704): n is a, c, g, or t
  misc_feature (1707)..(1707): n is a, c, g, or t
  misc_feature (1709)..(1711): n is a, c, g, or t
  misc_feature (1713)..(1718): n is a, c, g, or t
  misc_feature (1720)..(1723): n is a, c, g, or t
  misc_feature (1725)..(1728): n is a, c, g, or t
  misc_feature (1730)..(1732): n is a, c, g, or t
  misc_feature (1734)..(1735): n is a, c, g, or t
  misc_feature (1737)..(1737): n is a, c, g, or t
  misc_feature (1739)..(1750): n is a, c, g, or t
  misc_feature (1752)..(1753): n is a, c, g, or t
  misc_feature (1755)..(1755): n is a, c, g, or t
  misc_feature (1757)..(1765): n is a, c, g, or t
  misc_feature (1767)..(1775): n is a, c, g, or t
  misc_feature (1777)..(1779): n is a, c, g, or t
  misc_feature (1782)..(1782): n is a, c, g, or t
  misc_feature (1784)..(1791): n is a, c, g, or t
  misc_feature (1793)..(1798): n is a, c, g, or t
  misc_feature (1800)..(1801): n is a, c, g, or t
  misc_feature (1803)..(1803): n is a, c, g, or t
  misc_feature (1805)..(1813): n is a, c, g, or t
  misc_feature (1815)..(1815): n is a, c, g, or t
  misc_feature (1817)..(1822): n is a, c, g, or t
  misc_feature (1824)..(1833): n is a, c, g, or t
  misc_feature (1835)..(1837): n is a, c, g, or t
  misc_feature (1839)..(1842): n is a, c, g, or t
  misc_feature (1844)..(1850): n is a, c, g, or t
  misc_feature (1852)..(1852): n is a, c, g, or t
  misc_feature (1954)..(1954): n is a, c, g, or t
  misc_feature (1961)..(1961): n is a, c, g, or t
  misc_feature (1965)..(1965): n is a, c, g, or t
  misc_feature (1977)..(1977): n is a, c, g, or t
  misc_feature (3374)..(3375): n is a, c, g, or t
  misc_feature (3386)..(3386): n is a, c, g, or t
  misc_feature (3392)..(3392): n is a, c, g, or t
  misc_feature (3395)..(3400): n is a, c, g, or t
  misc_feature (3405)..(3405): n is a, c, g, or t
  misc_feature (3409)..(3409): n is a, c, g, or t
  misc_feature (3413)..(3413): n is a, c, g, or t
  misc_feature (3415)..(3415): n is a, c, g, or t
  misc_feature (3417)..(3417): n is a, c, g, or t
  misc_feature (3419)..(3420): n is a, c, g, or t
  misc_feature (3422)..(3422): n is a, c, g, or t
  misc_feature (3424)..(3424): n is a, c, g, or t
  misc_feature (3428)..(3429): n is a, c, g, or t
  misc_feature (3433)..(3433): n is a, c, g, or t
  misc_feature (3435)..(3437): n is a, c, g, or t
  misc_feature (3439)..(3439): n is a, c, g, or t
  misc_feature (3445)..(3445): n is a, c, g, or t
  misc_feature (3450)..(3450): n is a, c, g, or t
  misc_feature (3452)..(3457): n is a, c, g, or t
  misc_feature (3460)..(3460): n is a, c, g, or t
  misc_feature (3463)..(3465): n is a, c, g, or t
  misc_feature (3470)..(3471): n is a, c, g, or t
  misc_feature (3473)..(3474): n is a, c, g, or t
  misc_feature (3477)..(3477): n is a, c, g, or t
  misc_feature (3480)..(3481): n is a, c, g, or t
  misc_feature (3484)..(3488): n is a, c, g, or t
  misc_feature (3491)..(3492): n is a, c, g, or t
  misc_feature (3497)..(3498): n is a, c, g, or t
  misc_feature (3500)..(3503): n is a, c, g, or t
  misc_feature (3507)..(3510): n is a, c, g, or t
  misc_feature (3514)..(3515): n is a, c, g, or t
  misc_feature (3520)..(3520): n is a, c, g, or t
  misc_feature (3525)..(3525): n is a, c, g, or t
  misc_feature (3528)..(3531): n is a, c, g, or t
  misc_feature (3533)..(3536): n is a, c, g, or t
  misc_feature (3541)..(3541): n is a, c, g, or t
  misc_feature (3544)..(3550): n is a, c, g, or t
  misc_feature (3552)..(3552): n is a, c, g, or t
  misc_feature (3555)..(3555): n is a, c, g, or t
  misc_feature (3558)..(3558): n is a, c, g, or t
  misc_feature (3563)..(3568): n is a, c, g, or t
  misc_feature (3570)..(3574): n is a, c, g, or t
  misc_feature (3576)..(3576): n is a, c, g, or t
  misc_feature (3578)..(3578): n is a, c, g, or t
  misc_feature (3581)..(3581): n is a, c, g, or t
  misc_feature (3584)..(3585): n is a, c, g, or t
  misc_feature (3591)..(3591): n is a, c, g, or t
  misc_feature (3593)..(3594): n is a, c, g, or t
  misc_feature (3598)..(3599): n is a, c, g, or t
  misc_feature (3602)..(3602): n is a, c, g, or t
  misc_feature (3604)..(3606): n is a, c, g, or t
  misc_feature (3608)..(3608): n is a, c, g, or t
  misc_feature (3611)..(3611): n is a, c, g, or t
  misc_feature (3615)..(3615): n is a, c, g, or t
  misc_feature (3617)..(3617): n is a, c, g, or t
  misc_feature (3621)..(3622): n is a, c, g, or t
  misc_feature (3624)..(3624): n is a, c, g, or t
  misc_feature (3627)..(3627): n is a, c, g, or t
  misc_feature (3630)..(3630): n is a, c, g, or t
  misc_feature (3632)..(3632): n is a, c, g, or t
  misc_feature (3636)..(3636): n is a, c, g, or t
  misc_feature (3641)..(3642): n is a, c, g, or t
  misc_feature (3646)..(3646): n is a, c, g, or t
  misc_feature (3648)..(3651): n is a, c, g, or t
  misc_feature (3653)..(3654): n is a, c, g, or t
  misc_feature (3656)..(3659): n is a, c, g, or t
  misc_feature (3661)..(3661): n is a, c, g, or t
  misc_feature (3664)..(3664): n is a, c, g, or t
  misc_feature (3669)..(3669): n is a, c, g, or t
  misc_feature (3676)..(3679): n is a, c, g, or t
  misc_feature (3681)..(3681): n is a, c, g, or t
  misc_feature (3683)..(3683): n is a, c, g, or t
  misc_feature (3685)..(3687): n is a, c, g, or t
  misc_feature (3690)..(3692): n is a, c, g, or t
  misc_feature (3694)..(3694): n is a, c, g, or t
  misc_feature (3697)..(3697): n is a, c, g, or t
  misc_feature (3702)..(3704): n is a, c, g, or t
  misc_feature (3710)..(3710): n is a, c, g, or t
  misc_feature (3715)..(3716): n is a, c, g, or t
  misc_feature (3719)..(3719): n is a, c, g, or t
  misc_feature (3722)..(3723): n is a, c, g, or t
  misc_feature (3725)..(3725): n is a, c, g, or t
  misc_feature (3727)..(3728): n is a, c, g, or t
  misc_feature (3732)..(3732): n is a, c, g, or t
  misc_feature (3738)..(3741): n is a, c, g, or t
  misc_feature (3747)..(3751): n is a, c, g, or t
  misc_feature (3753)..(3754): n is a, c, g, or t
  misc_feature (3757)..(3757): n is a, c, g, or t
  misc_feature (3760)..(3761): n is a, c, g, or t
  misc_feature (3764)..(3764): n is a, c, g, or t
  misc_feature (3767)..(3767): n is a, c, g, or t
  misc_feature (3772)..(3777): n is a, c, g, or t
  misc_feature (3779)..(3781): n is a, c, g, or t
  misc_feature (3786)..(3786): n is a, c, g, or t
  misc_feature (3788)..(3794): n is a, c, g, or t
  misc_feature (3796)..(3797): n is a, c, g, or t
  misc_feature (3800)..(3800): n is a, c, g, or t
  misc_feature (3802)..(3802): n is a, c, g, or t
  misc_feature (3805)..(3808): n is a, c, g, or t
  misc_feature (3810)..(3810): n is a, c, g, or t
  misc_feature (3815)..(3815): n is a, c, g, or t
  misc_feature (3818)..(3818): n is a, c, g, or t
  misc_feature (3820)..(3821): n is a, c, g, or t
  misc_feature (3823)..(3823): n is a, c, g, or t
  misc_feature (3826)..(3826): n is a, c, g, or t
  misc_feature (3828)..(3828): n is a, c, g, or t
  misc_feature (3830)..(3831): n is a, c, g, or t
  misc_feature (3836)..(3836): n is a, c, g, or t
  misc_feature (3838)..(3844): n is a, c, g, or t
  misc_feature (3846)..(3847): n is a, c, g, or t
  misc_feature (3850)..(3851): n is a, c, g, or t
  misc_feature (3853)..(3855): n is a, c, g, or t
  misc_feature (3858)..(3858): n is a, c, g, or t
  misc_feature (3860)..(3860): n is a, c, g, or t
  misc_feature (3864)..(3864): n is a, c, g, or t
  misc_feature (3869)..(3870): n is a, c, g, or t
  misc_feature (3872)..(3874): n is a, c, g, or t
  misc_feature (3876)..(3876): n is a, c, g, or t
  misc_feature (3879)..(3879): n is a, c, g, or t
  misc_feature (3887)..(3888): n is a, c, g, or t
  misc_feature (3890)..(3891): n is a, c, g, or t
  misc_feature (3897)..(3897): n is a, c, g, or t
  misc_feature (3900)..(3900): n is a, c, g, or t
  misc_feature (3902)..(3904): n is a, c, g, or t
  misc_feature (3906)..(3907): n is a, c, g, or t
  misc_feature (3912)..(3914): n is a, c, g, or t
  misc_feature (3916)..(3916): n is a, c, g, or t
  misc_feature (3919)..(3920): n is a, c, g, or t
  misc_feature (3922)..(3922): n is a, c, g, or t
  misc_feature (3925)..(3928): n is a, c, g, or t
  misc_feature (3931)..(3931): n is a, c, g, or t
  misc_feature (3933)..(3933): n is a, c, g, or t
  misc_feature (3936)..(3937): n is a, c, g, or t
  misc_feature (3939)..(3939): n is a, c, g, or t
  misc_feature (3942)..(3942): n is a, c, g, or t
  misc_feature (3944)..(3945): n is a, c, g, or t
  misc_feature (3947)..(3957): n is a, c, g, or t
  misc_feature (3960)..(3962): n is a, c, g, or t
  misc_feature (3965)..(3965): n is a, c, g, or t
  misc_feature (3968)..(3972): n is a, c, g, or t
  misc_feature (3977)..(3977): n is a, c, g, or t
  misc_feature (3980)..(3980): n is a, c, g, or t
  misc_feature (3988)..(3988): n is a, c, g, or t
  misc_feature (3992)..(3992): n is a, c, g, or t
  misc_feature (3994)..(3997): n is a, c, g, or t
  misc_feature (3999)..(4000): n is a, c, g, or t
nnggnnnaanannnnnnncnnanannggnnnnnnnnncncnnnnnnnnnnnnnnnnnnggnnnngngnanannnnnnnnnnnggngnncccnnnnnnnnnnnnnnnngggnnnnnnnnnnnnnnnnnnnnnnnnnnnnnngggngnnnnnnnnnnnngnnanngngnggnnnnnggnnnnnnnnnnnnntntntnanannnnnnnnnnnnnanaagagggntnnnnngngnnnnnngngnnnnnnnnngngnngnnnnnnnngggggngnngnnnnnnnnnnnnggggangnnnnnnggngnnnnntnnncncnnnnnnnnnannnnnnnngngnnnncnannnnnnnncnnnncnccnccntnnnnggggnnggnngngnngngnnnnnnnnnnnncncngngnnngggntntncncnnngngnnnnnggnnnggggnnnccntnncnnncntntnnngnnnngngnngnnnnngngnnnggggggggggnnnntnnccccnnngnnnnnnntnncccnngggntnncnnnnnnnnnnnngnggnnnnnnnanannnnnnnnnngnnnnngnangncnnnncccnnnnngnnncnnnnnngggngnnnngnnnnnnnnnnnngngnnnnncncnnnngngnnnnnngcnnncncnnnnnnngngnngnanannnnnnnggnnntntngnanannnnnnnnnnnnnngnggnntnnnnnnngnnnnnnnccccngnggnnnnnnannngnggnnnnncncntnngngnnnnnnnnnccnnnnnnnnnnnnnnnnncccnnnnnnnnnngnnnnnnnnngnnnnnnnnnccccnnngggggnggngnngnnnnannnnncccnnnnnnncnccncnnngntntnnnanannnnccccnnggggggggggncncnnnngggnntnnncncnnnnnnnnnnnnnnnnnngnnnnnnnnnnncnnnnngnnnnnnnncnnnnnnanngnnncnnnnnnnnnncncnnnngggggnnnnnnncncnnnnnnnncccncnnnnnngggnnnnnngnnnnggggnnncnnnntncccnnngnggnnnnnnngngnnnnnnngnntnttttnnncnntnnnnnntngnnnnnnngnnnnnnnnnnannngnnnnngnannnnnncncnnnggnngncncngggggntttnnnnnnntnnngnnnnnnnnnngnnnnnngngnnnnnntnantncntnnnaaaannnnnnantntncncngnnnannnnnnnnnannnnncnccccncnnnnnncncnncccnnnnnnnnnggggnnnnnnnnnnnnggggggnnngnnnnnnnnnnnangnnnnnnnnnngnnnnnngnnnntnnccnnngnnngnnnnnnncnnncnannngnnntttncnnnncnnnnnngnngnnnnnnnngnngnnnnnngnnnncnnnnnnncnnnntnnnnnnncnnggnnnngnnngnnnnnnncnnggnnnnnnnnnnnnngnnnnnntnnnngnnnnnngnnnnnnnnnnnnnngnngnnnnnnnnntngnnnnnnncntnnnnnngnnnnnnntnnngnnntnnnnnnannngntnnnnngnnnnnnnncnnnnnngnngnnnnnnnnnnnnnnnnnnnnnnnnnnnnnnnnngnntnnnnnnnnnnnntnnnnnannngnnnnnnnnnnnnnannannnnnggncnnngnnnnnncnnnngnnnncnnngnngntnnnnnnnnnnnncnngnannnnnnnnngnnnnnnnnnannnccntnnnnnnnngnnnnnncnngntnnnnnnnnngncnnnnnntnnnnnnnnnntnnntnnnntnnnnnnntnaagtgttaatgattacactgcaaaggtaggggagttaatgaatctatacaaatgaatttctctatatcgatataagcatcatttatactttgcctctacctncttcatncggngcacaaacgaancccgcccctacgactgtccaagtgaggacgtgccgtaggggcggggtgtagtctatggggagtagtcccttaggcttcagcaggtgcttcttcttcagcgggagcttcagcaggagcaggagcttcttccttcttttcttcagccttaggagcgtcggagaggacttcgacggggatttctacagccacttccttgtgcaggcgcacgatagcggtgtagttaccgatttccttgatagccttgatgtagacgagcttgcggtcggtttcgaggccgagcttcgtgagctcttcagcgatctcagcacccgtgacggagccgtagaggctacccgtagcgacgttggtgtgagccgtgatagagaggcgtacgccctggtacttctgggcacgctcttcggcttccttcttgatagcggcgatcttgtgagcgcgctgacggaggttctctgcgaggatcttcttcgcagcttccgtagcgatgatagccttaccggtggggattagaaagttgcgaccgtagccgttctttactgtgacgacatcgtccttgtagccgagaccgactacgtcttctttcaaaataacttccattgtattctgtctcctctatgtttattcgttactaagtggatgagtaaggggggatagaccttacttagccatgttgtccgtgacgtagggcagcagggcaaggtgacgagcacgcttgacagcctgtgcgacgcgacgctggaacttgaggctcgtgccggtgatacggcgggggaggatcttaccctgttcgttgaggaaacgcttgaggaagtcgggatccttgtagtcgatatacttgataccgctcttcttgaagcggcagtacttcttcttcttgctatctacggtcaggggagtgaggtagcgtacttctgatgcagccattttaattttctcctttcgttaatgggttatgccttacggcttcttctctttgctgcgtattcagctgcgaacttatcctggcggaaggtcaggaagcggaggacattctcatcgcgacggaactgcgtctcgagtacggcgatggtctctggctgagcctggaattcaacgagctggtagtaaccagtcgtcttcttctggatctgataggcgagcttcttcagcccccagttttcttcgttgacgatctcagcgccttcgcccttgaggatgccgacgaactttgcgaccgcttcctttacctgagcttcagataaatcgggagtaagaatgaaaacggtttcgtagttattcatttctctttctgtttagtgagagttaaaaatatcgggcacaaaggtacataaatatatcgttttgaccaagctatgcacctgcgaggtggtgcaaagtgccacacgcgcgtaccattattnnataggtatgtntggggngannnnnngcctngggngggngngngnnantngccnnggangnnntngcgganggccncnnnnnnggnctnnnccccnncnnggnggnngtnnnnnccnncggtnntnnnnccgnnnnggtnngcctnggggnggnnnntnnnncggangcnnnnnnncncgnccnccatnnnnnncnnnnngntncgnccnncggggngnncctnnccngnnngnccnaccncncccnngnggnagncncctncgggnngggngnnnncnngnnnngnggngaggncggcggnnnngncngnnnggnnngnggnggggnnngccagncggannccnccnncnannttgnggaagnnnnccttcnnnnngnnctngannccngcncgctnnnnnngnnnggccngnnnnnnntnnatncntcnnnngncgaanccngnncnggngngnnggggngnnnnnnngnnggnngnnntgncnagcncctgnntnnngntgnggaagggnngnncgcccnccntnnntnnggcgnnngnggnncngcnnnnctngnggnngntcngnntnnnnnnnnnnnccnnnggnttnnnnncgggncgnaggcccgnctgncnnnncnn

SEQ ID NO: 289 - DNA, 4000 bp, Escherichia coli
  misc_feature (100)..(100): n is a, c, g, or t
  misc_feature (158)..(158): n is a, c, g, or t
  misc_feature (238)..(238): n is a, c, g, or t
  misc_feature (562)..(562): n is a, c, g, or t
  misc_feature (566)..(566): n is a, c, g, or t
  misc_feature (673)..(673): n is a, c, g, or t
  misc_feature (788)..(788): n is a, c, g, or t
  misc_feature (816)..(816): n is a, c, g, or t
  misc_feature (871)..(871): n is a, c, g, or t
  misc_feature (1291)..(1291): n is a, c, g, or t
  misc_feature (1513)..(1513): n is a, c, g, or t
  misc_feature (1591)..(1591): n is a, c, g, or t
  misc_feature (2472)..(2472): n is a, c, g, or t
  misc_feature (2811)..(2811): n is a, c, g, or t
  misc_feature (2830)..(2830): n is a, c, g, or t
  misc_feature (2870)..(2870): n is a, c, g, or t
  misc_feature (2895)..(2895): n is a, c, g, or t
  misc_feature (3237)..(3237): n is a, c, g, or t
  misc_feature (3497)..(3497): n is a, c, g, or t
  misc_feature (3694)..(3695): n is a, c, g, or t
  misc_feature (3773)..(3773): n is a, c, g, or t
  misc_feature (3848)..(3848): n is a, c, g, or t
  misc_feature (3869)..(3869): n is a, c, g, or t
  misc_feature (3874)..(3875): n is a, c, g, or t
  misc_feature (3878)..(3878): n is a, c, g, or t
  misc_feature (3890)..(3890): n is a, c, g, or t
  misc_feature (3950)..(3950): n is a, c, g, or t
  misc_feature (3973)..(3973): n is a, c, g, or t
agagccataagcctcttgttgtatttgtagatgaaaataataagataagtcatataaaaaactatgaaaaacatggtttattagttgatcaagactaacngtttttgatcgaattacagtagactgtataggactatcttcgtatttacaatttatangtaccggaggcattattatggaaattataactacaatcgaaaatatacgcagcatagtaaaccattggaaagataaaggntattctattggttttgtaccaacaatgggatatttacatgatggtcatgccgcattgatagatcaagctagaaaggataatgataaggtcattgtatctatatttgttaatccaactcagtttggtgaaaacgaagacctaaattcttatccacgtgatattaatagagataaatccctttgtgaagcccataaggcggatattatattttctccaacgtcagatgaaatgtatcatgatagaaaagcatttgtaaatattgttgagttatctgatacattgtgtggtattagtagacctattcacttcaaaggtgtttgtacngttntaacgaagctatttaatattattcaacctaccaatgcctactttggtgaaaaagatgcacaacaactagccattattcgtaaaatggtttatgatctaaattttccngtcaatataattggagtgccaatcgttcgtgaatcggatggtctagcaaaatcttctcgaaatacatatttatctaaggaagaacgaaaagcggctaccatattatataaagctnttcaaatgggaaaacaaaccattaaacntggtgcttctgctgatagtatcattaatactatgacagaaattattaatactgancccttagccaagatagattatgtttcagttgttgatgctaatacaatgcaaccagttcatgagattacatctccagtattagtcgctatggctgtatatattggatctacgcgacttatcgataacttttccttcgatgcaaattagaagggagaaactatgaactatttacaaacactgactcagttaatttctaaatacttaatggttctaatcatcggtttttcatgtatggcctatatagttccttcatattttacatgggctgttgcttatacaccatttttacttggtatcgctatgttcggcatgggccttacaattaagtttgaaaacctatgtaatatttttaggcatccaaaagatatttgtattggagtgcttgcacaatacacaatcatgcctttattagcatggggnatttgccatatatttaccttaccaccagatattgcaataggcgttatattagttggttgctgtcctggtggcacggctagtaacgttataacctacatcgctaaaggtgatgtaccactatcagtaggaatgacaattacatcgacattaatagcacccattgtaacaccattattaatcttatatattggtggcgcttgggtagatgttgcattgctaccnatgatgattacaatggtgaaagtcattattataccaatcttattaggtggtgtcattcaatatgtttgtaaatcacanattaatacacttaccagtataagtcctatattttcaatgattgctattatattattaatagcagctattattgcagttaatagggataaactattggtttctggcttattaactcttattattgttggtatacataatgtattaggattactattagggttaattgtaggaaaaactcttaaattaaaatacgataaaactactgcattagcaatagaagtaggtatgcaaaatagtgggttagccgtaacgctagcagcaactaattttgctttaaaccctctcgcaactctagtaggagctatttttagtgtatggcataatatatctggcgcaattttcgctagtatacgtagaaataaaatctcaatataacaaaaagacggcaacatatgttgccgtctttttgttatattctatcacgtactaatccaattacaagtccttcaatatgacaatcatcaacaataataggatcaaaattatcattttcaggctgtaaacgaatatgaccattttccttatagaaacgttttacagtcgcttcatcatcaatgcgagctaccacaatatcgccattattggctgtattttgatgacgtacaattaacatatcgccttcatacataccaatattcatcatcgattccccttgaacacgaagcataaagcaatcagaatcacctgtaagctgaacaggtaaggtcaatgtagcctctaaattttcaacagctgtaattggtgtgcctgcttgtactgtaccgataaggggaacttgttttaatccagcaccaaggaattcaaaattatcagagctagtagtttcattgttctctttagatacagaaaccttcggttttccttcatctaaaatcgtaatngcacggtttttattaggatcgcgtttaatatacccaaatttttctaatgtatttaaatgtgattgaacagtggacgtagaactaagacctacataagcacaaatttcacgaacagtagggcaacgatattcattatgtaaagaatctcgaataaactctaatatacgacgttgttttgtattaatatcagtagctgggcgtctcacaggaacctccatatatgtactaaaaatgggatatgtaaaagtgtatactataattattttctttatatccttattatataggtatttttacacttttgcaaacatttgttcttaaaatgcttgaccgaacatncgtttgtgtgctattatcntattgtaaacaaacaaacgttctgaattttatgttcgatntataaaagaggtaatgtattatganacacattatgattatgcttggtatctgttttgcaatggttatcggttatcaacaaacaactcctgctatggaatcacatagtgttcaagagattactgtaaaatctggagataccttatgggatattgcatcacgttcaactgcatctaatgtggatgttcgtgaggtagtacatacagtaaaggaattaaataatatttctgattctggtaatttaacaccagggaccaaaataaaggtgcctgtatataaaactgatagtccaacaagagctatggactatatggctcaaaattaaatatatatgaaatggctagtatagatgttcttcaatgagaaaancatctatactagccattttcattatataatattattttaatcgtttttcaaaaattgttgagataggattatcgacgaatttatttgcctcattaatataacggcgtaccatatttacactgtgatgtcgcgtctgacgcatgatattacgttcctcgacgccataagcggctgcagtcgtagcaaagccatgccttaaactatgagcaccatacatggcaggatcgagtccgataagtgatatatatttttttacgatntctgcaatggacttatcagaaattgccgtttttcgtaatgacattgatttagtaaagccccgaaatacaggtccagatgtaatgccactggcagttaaccatttttttaaagctcgtacggcatccaatggagaaccttgtagacttggaatcgctacaatggcaccttgaccttcttggtcagctttagatgaagnnacaaatatctcaaggccttgtggagaaaactttaagttctctacagttaaggctgcaatttcactgcgtctaaaagcncccataaatccaatgagtaaaattgctttatctcgtaatttctgtatctttggaatatcactaccatcgatacantctaaaatatcttcaatatcntctannaanataggtgtcttnccttgttgaaaggttccttttagacgacgtatccctcgcaaagcttgttttacaagaggngacatacatggattttctctagncccagaagcattgtagttttctgatat

SEQ ID NO: 290 - DNA, 4000 bp, Escherichia coli
  misc_feature (1)..(4): n is a, c, g, or t
  misc_feature (6)..(12): n is a, c, g, or t
  misc_feature (14)..(15): n is a, c, g, or t
  misc_feature (17)..(17): n is a, c, g, or t
  misc_feature (19)..(33): n is a, c, g, or t
  misc_feature (36)..(40): n is a, c, g, or t
  misc_feature (42)..(44): n is a, c, g, or t
  misc_feature (46)..(56): n is a, c, g, or t
  misc_feature (62)..(63): n is a, c, g, or t
  misc_feature (65)..(66): n is a, c, g, or t
  misc_feature (68)..(68): n is a, c, g, or t
  misc_feature (70)..(70): n is a, c, g, or t
  misc_feature (74)..(78): n is a, c, g, or t
  misc_feature (80)..(82): n is a, c, g, or t
  misc_feature (85)..(90): n is a, c, g, or t
  misc_feature (92)..(93): n is a, c, g, or t
  misc_feature (95)..(96): n is a, c, g, or t
  misc_feature (98)..(98): n is a, c, g, or t
  misc_feature (100)..(101): n is a, c, g, or t
  misc_feature (103)..(104): n is a, c, g, or t
  misc_feature (106)..(106): n is a, c, g, or t
  misc_feature (108)..(109): n is a, c, g, or t
  misc_feature (111)..(111): n is a, c, g, or t
  misc_feature (113)..(113): n is a, c, g, or t
  misc_feature (115)..(115): n is a, c, g, or t
  misc_feature (119)..(123): n is a, c, g, or t
  misc_feature (125)..(126): n is a, c, g, or t
  misc_feature (128)..(129): n is a, c, g, or t
  misc_feature (132)..(134): n is a, c, g, or t
  misc_feature (136)..(137): n is a, c, g, or t
  misc_feature (139)..(145): n is a, c, g, or t
  misc_feature (149)..(149): n is a, c, g, or t
  misc_feature (155)..(158): n is a, c, g, or t
  misc_feature (160)..(166): n is a, c, g, or t
  misc_feature (169)..(174): n is a, c, g, or t
  misc_feature (176)..(183): n is a, c, g, or t
  misc_feature (185)..(196): n is a, c, g, or t
  misc_feature (199)..(201): n is a, c, g, or t
  misc_feature (203)..(206): n is a, c, g, or t
  misc_feature (209)..(215): n is a, c, g, or t
  misc_feature (218)..(219): n is a, c, g, or t
  misc_feature (221)..(221): n is a, c, g, or t
  misc_feature (226)..(233): n is a, c, g, or t
  misc_feature (235)..(237): n is a, c, g, or t
  misc_feature (239)..(245): n is a, c, g, or t
  misc_feature (247)..(252): n is a, c, g, or t
  misc_feature (255)..(257): n is a, c, g, or t
  misc_feature (259)..(262): n is a, c, g, or t
  misc_feature (264)..(272): n is a, c, g, or t
  misc_feature (274)..(275): n is a, c, g, or t
  misc_feature (277)..(282): n is a, c, g, or t
  misc_feature (284)..(288): n is a, c, g, or t
  misc_feature (290)..(297): n is a, c, g, or t
  misc_feature (299)..(301): n is a, c, g, or t
  misc_feature (303)..(304): n is a, c, g, or t
  misc_feature (306)..(308): n is a, c, g, or t
  misc_feature (310)..(310): n is a, c, g, or t
  misc_feature (313)..(315): n is a, c, g, or t
  misc_feature (319)..(320): n is a, c, g, or t
  misc_feature (322)..(325): n is a, c, g, or t
  misc_feature (327)..(328): n is a, c, g, or t
  misc_feature (330)..(332): n is a, c, g, or t
  misc_feature (334)..(338): n is a, c, g, or t
  misc_feature (341)..(342): n is a, c, g, or t
  misc_feature (344)..(344): n is a, c, g, or t
  misc_feature (347)..(349): n is a, c, g, or t
  misc_feature (352)..(352): n is a, c, g, or t
  misc_feature (354)..(357): n is a, c, g, or t
  misc_feature (359)..(360): n is a, c, g, or t
  misc_feature (363)..(363): n is a, c, g, or t
  misc_feature (365)..(365): n is a, c, g, or t
  misc_feature (367)..(367): n is a, c, g, or t
  misc_feature (370)..(371): n is a, c, g, or t
  misc_feature (373)..(383): n is a, c, g, or t
  misc_feature (385)..(392): n is a, c, g, or t
  misc_feature (395)..(395): n is a, c, g, or t
  misc_feature (397)..(400): n is a, c, g, or t
  misc_feature (403)..(403): n is a, c, g, or t
  misc_feature (405)..(405): n is a, c, g, or t
  misc_feature (408)..(410): n is a, c, g, or t
  misc_feature (412)..(413): n is a, c, g, or t
  misc_feature (415)..(416): n is a, c, g, or t
  misc_feature (418)..(428): n is a, c, g, or t
  misc_feature (430)..(430): n is a, c, g, or t
  misc_feature (433)..(433): n is a, c, g, or t
  misc_feature (435)..(435): n is a, c, g, or t
  misc_feature (437)..(438): n is a, c, g, or t
  misc_feature (440)..(442): n is a, c, g, or t
  misc_feature (444)..(447): n is a, c, g, or t
  misc_feature (449)..(457): n is a, c, g, or t
  misc_feature (459)..(465): n is a, c, g, or t
  misc_feature (468)..(471): n is a, c, g, or t
  misc_feature (473)..(473): n is a, c, g, or t
  misc_feature (475)..(478): n is a, c, g, or t
  misc_feature (481)..(483): n is a, c, g, or t
  misc_feature (485)..(485): n is a, c, g, or t
  misc_feature (489)..(490): n is a, c, g, or t
  misc_feature (492)..(493): n is a, c, g, or t
  misc_feature (495)..(496): n is a, c, g, or t
  misc_feature (498)..(498): n is a, c, g, or t
  misc_feature (500)..(510): n is a, c, g, or t
  misc_feature (512)..(518): n is a, c, g, or t
  misc_feature (520)..(534): n is a, c, g, or t
  misc_feature (536)..(540): n is a, c, g, or t
  misc_feature (543)..(543): n is a, c, g, or t
  misc_feature (545)..(545): n is a, c, g, or t
  misc_feature (547)..(549): n is a, c, g, or t
  misc_feature (694)..(694): n is a, c, g, or t
  misc_feature (881)..(881): n is a, c, g, or t
  misc_feature (1086)..(1086): n is a, c, g, or t
  misc_feature (1985)..(1985): n is a, c, g, or t
  misc_feature (2163)..(2163): n is a, c, g, or t
  misc_feature (2177)..(2177): n is a, c, g, or t
  misc_feature (2402)..(2402): n is a, c, g, or t
  misc_feature (2505)..(2505): n is a, c, g, or t
  misc_feature (3338)..(3338): n is a, c, g, or t
  misc_feature (3536)..(3536): n is a, c, g, or t
  misc_feature (3863)..(3863): n is a, c, g, or t
nnnntnnnnnnntnntntnnnnnnnnnnnnnnnttnnnnnannnannnnnnnnnnnaaaagnntnncntntatnnnnntnnnagnnnnnntnntnntntnnannananntntnantttnnnnnanntnntannnannannnnnnntttngaaaannnntnnnnnnnaannnnnncnnnnnnnntnnnnnnnnnnnnatnnncnnnngannnnnnnttnntnaattnnnnnnnntnnntnnnnnnntnnnnnnttnnnannnnannnnnnnnntnnannnnnntnnnnntnnnnnnnntnnnanntnnngngannncttnntnnnnanntnnnannnnntanngnaannnttntnnnncnntgnantnctnnannnnnnnnnnncnnnnnnnnaantnnnntangnagnnnanntnntnnnnnnnnnnntnggnanannannncnnnnannnnnnnnnannnnnnnctnnnncntnnnnagnnncntttnnannanngntnnnnnnnnnnnannnnnnnannnnnnnnnnnnnnngnnnnnttntntnnnttttcttttctgtcatatcagttgtattccgtttttcaaggcttcctgcactaccggtgaatcctcatggtcaccgatgacgtcaatcttttggtcgcccaaatgcagtttcaagcgtgcggtcatgcggatgcgtgccaatacncccttcttttctcccgtgctgcggactaataaatcaatatctcctccgcgcttttcgtcattcagacgggaaccgaagagatatacctgcactgtttcaccataaatatctttggctatttggatgatggtctgtatttctttagattgcaaacgcatgcctttattctcctttcttaccgcaaagntacaaattcccctccacatttcctagcgtccgccatccttatttcatcttctccacaaaccccaccggcatatcaaccccagcacatcccagcaaatccagtcttaccaccactttcgcttttccatccacttccaccagttctccttccagaccctttagcggacctttgaccacccgtatcaattctcccggagccaatggcncggtacacatctccaccgcctcgtccgaataatccagcataaatttgaaccgttccatctgttcgtccggaatcaccgccggagtatgttcgccatgcagcaccatataccggctgatggccgacaacgtgagcacctgcgaacgttccgccgcatctacatggacaaaaatcatcatggggataaccacccgttttattttctttttccggtaagtccattggcggatttcttcttgtacaggcaggaagttctctatgttcattgcggtcagccgttcggccgtcttcttttcgtggtgaaggcggacatacgccactagccattttttcatattcggaggaaggaaaagtaatgttagatgttctaaaaaatgaaagaaatgatgcctcttgagcacgctacgctgttacctgtgtcattcccaggtaagcttgtcgttaaattctgatgcaaatatagacatttttttacgataacaagctatttgttcgcaaaaaatgaaaaaattaacaagaatgacgtatttatttatacttttgtgctttttatattttaaatgatattaacattgtggaaaaatcaagatttataagaaaaatagtggcagattgagcttccttcaagagttggaaaaaatcatggccggatatcgcctgtccggtgaaggctacactgatgaggaaatgagagttctgaagcgcatgtgcaaaagtatgttggctgatatagacgagtttctgcggaaaaaggaggaaaagaagaagaaagaacggaaagagaagaaaaagaggaaagaaaggaaataaggagcaaaatgtgaaaagacattaaaaggaagtctcccggttatttgtacacttgtatcataaatgggtattgtaaatcagtgctttacnttgggtaagtgtacaattttaacttttgattgtatgggtttgcaatatacttttgctttcatggtggagggaaatgccctccttttgataatttaaattcatacatgaatggtttataccgatttatgctctttctatttctcggtgttcgatgaacatgccgtggatatgacattgnaagagtttgtgaancttctgcgtggcgaacgctggaaggtgcaagtagaagagtatcagcgcctgaaggcttcgggcagggagacagaggccaagaagttaaagagaaaactggccgcgctggtgatagccgggcgttgcgatgggagccatgccgaaaccaatctgaagcagtggagcggggacgccatgctggatgtggataaatgtaacggccgtgtgtctgagttcttgcaggtnttgaaggacactccttgggtgaaggcggcatggcgcagcgtttcgtacgacgggctgaaactggtggtgcgtgtggaagcggagagtgtggacgagtatcgtntggcatacgcattggtggcatggcacgtggcgcagcttcttgcctttccctgtgacatgagttgcaagaatcccacccgtccttgctttgcatcgtatgatccggaggctttttttcgtccggataccgaagtttttccctggcggcgctttgtgacggagcatcccgacagggtgggggagattctggcggagctgaaagtgaagaccccggcaggtgcgtccgggcctcccgttgcggcttcgggcatgctgcacacattcttcaacgagttcctggagcagaatccctttgtggatggcaaaaagaatgagtttttgttgaagctgggacgtatcgcccgctataaaggagtgggcgaggaagagttggcacggctgaaaacgctggcggtggaaaggctggcgggtatggggtgtgccgccggggatatacctccgcgcatagactccggataccggtatgccgacatgaacaaggggcccgaaacacctgcttccagggctcacaaggctcagggctcacctatgcggtattctgagcccaatgagggggaggaagaggctgagttagagaaacttgaggctgacaagttgcgtcgtgaagttccgtgtcttccggatgaactgttcgaccgtttgcccgactttttgaagcgtggtttgacgcacgtccgcaacaagcgcgagagggatattctgttgctctccatgattaccaacatcagcggttgtctgccgggggtgaggatgaattatggaggaatggtttattccgccgatctctacctggtggctttggccggttcgggcagaggaaagggggtgatgcanctggcggcaattctgcccgcagccattcaggagtattacgatgaattgaacaggaaggatgagcgtgagtaccggcagaagctgctgaagtggaatctggaggaacggcttgccgctcaggaaaagagggttcccgatttggaccaatgcccggagatgccggtggaacgcatcctgaaggtggctcccaatatttcnaaaagccagttgatactggctttggaggcgggtggagcggtcggcttggtgatgaatgcctccgagctggacatgataagttctgccatgcaccaggagtatggaaaacatgatgatgtgatgcgtgccgcctcccagcacgaggaggtgtcttcttatttcaagacggatcaccggcttgttgttgtgagtgaccctcatctggcattatgcgcttcgggtactcccgcccagttgcataaatttatttcttcgctggagaatggaatgtacagccgtgtggctttctatgtgggacaggcccactgggagtataagtcggcaaancccggcaaggcccggctggatatgcgcgcttatttcaaagggatgggcgaggagctgctgcgtatgtttatctttctctccggatcgcctaccgaggtggttttcaccgaggaacaatggaaagagcatacggagcg

SEQ ID NO: 291 - DNA, 4000 bp, Escherichia coli
  misc_feature (3)..(4): n is a, c, g, or t
  misc_feature (8)..(11): n is a, c, g, or t
  misc_feature (14)..(15): n is a, c, g, or t
  misc_feature (17)..(17): n is a, c, g, or t
  misc_feature (19)..(20): n is a, c, g, or t
  misc_feature (24)..(25): n is a, c, g, or t
  misc_feature (28)..(29): n is a, c, g, or t
  misc_feature (33)..(35): n is a, c, g, or t
  misc_feature (37)..(38): n is a, c, g, or t
  misc_feature (40)..(41): n is a, c, g, or t
  misc_feature (45)..(45): n is a, c, g, or t
  misc_feature (47)..(47): n is a, c, g, or t
  misc_feature (49)..(50): n is a, c, g, or t
  misc_feature (54)..(54): n is a, c, g, or t
  misc_feature (56)..(56): n is a, c, g, or t
  misc_feature (58)..(60): n is a, c, g, or t
  misc_feature (63)..(64): n is a, c, g, or t
  misc_feature (66)..(69): n is a, c, g, or t
  misc_feature (73)..(76): n is a, c, g, or t
  misc_feature (78)..(79): n is a, c, g, or t
  misc_feature (82)..(82): n is a, c, g, or t
  misc_feature (84)..(86): n is a, c, g, or t
  misc_feature (89)..(90): n is a, c, g, or t
  misc_feature (92)..(92): n is a, c, g, or t
  misc_feature (95)..(95): n is a, c, g, or t
  misc_feature (99)..(100): n is a, c, g, or t
  misc_feature (103)..(103): n is a, c, g, or t
  misc_feature (105)..(105): n is a, c, g, or t
  misc_feature (107)..(111): n is a, c, g, or t
  misc_feature (118)..(119): n is a, c, g, or t
  misc_feature (121)..(122): n is a, c, g, or t
  misc_feature (126)..(127): n is a, c, g, or t
  misc_feature (129)..(130): n is a, c, g, or t
  misc_feature (132)..(132): n is a, c, g, or t
  misc_feature (134)..(141): n is a, c, g, or t
  misc_feature (144)..(147): n is a, c, g, or t
  misc_feature (149)..(151): n is a, c, g, or t
  misc_feature (154)..(157): n is a, c, g, or t
  misc_feature (159)..(159): n is a, c, g, or t
  misc_feature (164)..(164): n is a, c, g, or t
  misc_feature (166)..(166): n is a, c, g, or t
  misc_feature (169)..(169): n is a, c, g, or t
  misc_feature (172)..(172): n is a, c, g, or t
  misc_feature (174)..(175): n is a, c, g, or t
  misc_feature (178)..(178): n is a, c, g, or t
  misc_feature (180)..(180): n is a, c, g, or t
  misc_feature (182)..(183): n is a, c, g, or t
  misc_feature (185)..(186): n is a, c, g, or t
  misc_feature (189)..(189): n is a, c, g, or t
  misc_feature (192)..(192): n is a, c, g, or t
  misc_feature (194)..(194): n is a, c, g, or t
  misc_feature (196)..(196): n is a, c, g, or t
  misc_feature (198)..(199): n is a, c, g, or t
  misc_feature (201)..(201): n is a, c, g, or t
  misc_feature (203)..(205): n is a, c, g, or t
  misc_feature (207)..(208): n is a, c, g, or t
  misc_feature (210)..(210): n is a, c, g, or t
  misc_feature (212)..(214): n is a, c, g, or t
  misc_feature (217)..(218): n is a, c, g, or t
  misc_feature (220)..(222): n is a, c, g, or t
  misc_feature (225)..(225): n is a, c, g, or t
  misc_feature (228)..(229): n is a, c, g, or t
  misc_feature (231)..(232): n is a, c, g, or t
  misc_feature (235)..(236): n is a, c, g, or t
  misc_feature (238)..(240): n is a, c, g, or t
  misc_feature (247)..(251): n is a, c, g, or t
  misc_feature (254)..(256): n is a, c, g, or t
  misc_feature (258)..(258): n is a, c, g, or t
  misc_feature (260)..(260): n is a, c, g, or t
  misc_feature (262)..(263): n is a, c, g, or t
  misc_feature (267)..(267): n is a, c, g, or t
  misc_feature (273)..(273): n is a, c, g, or t
  misc_feature (276)..(276): n is a, c, g, or t
  misc_feature (278)..(281): n is a, c, g, or t
  misc_feature (288)..(288): n is a, c, g, or t
  misc_feature (290)..(292): n is a, c, g, or t
  misc_feature (294)..(295): n is a, c, g, or t
  misc_feature (297)..(297): n is a, c, g, or t
  misc_feature (299)..(302): n is a, c, g, or t
  misc_feature (304)..(304): n is a, c, g, or t
  misc_feature (306)..(306): n is a, c, g, or t
  misc_feature (308)..(309): n is a, c, g, or t
  misc_feature (311)..(313): n is a, c, g, or t
  misc_feature (316)..(317): n is a, c, g, or t
  misc_feature (319)..(319): n is a, c, g, or t
  misc_feature (321)..(321): n is a, c, g, or t
  misc_feature (325)..(327): n is a, c, g, or t
  misc_feature (330)..(330): n is a, c, g, or t
  misc_feature (332)..(332): n is a, c, g, or t
  misc_feature (340)..(340): n is a, c, g, or t
  misc_feature (344)..(344): n is a, c, g, or t
  misc_feature (347)..(347): n is a, c, g, or t
  misc_feature (351)..(356): n is a, c, g, or t
  misc_feature (361)..(361): n is a, c, g, or t
  misc_feature (363)..(364): n is a, c, g, or t
  misc_feature (366)..(366): n is a, c, g, or t
  misc_feature (369)..(369): n is a, c, g, or t
  misc_feature (371)..(371): n is a, c, g, or t
  misc_feature (373)..(376): n is a, c, g, or t
  misc_feature (378)..(379): n is a, c, g, or t
  misc_feature (381)..(391): n is a, c, g, or t
  misc_feature (393)..(396): n is a, c, g, or t
  misc_feature (399)..(405): n is a, c, g, or t
  misc_feature (407)..(410): n is a, c, g, or t
  misc_feature (412)..(416): n is a, c, g, or t
  misc_feature (418)..(421): n is a, c, g, or t
  misc_feature (423)..(429): n is a, c, g, or t
  misc_feature (431)..(436): n is a, c, g, or t
  misc_feature (438)..(440): n is a, c, g, or t
  misc_feature (442)..(442): n is a, c, g, or t
  misc_feature (444)..(447): n is a, c, g, or t
  misc_feature (449)..(450): n is a, c, g, or t
  misc_feature (452)..(453): n is a, c, g, or t
  misc_feature (455)..(461): n is a, c, g, or t
  misc_feature (463)..(465): n is a, c, g, or t
  misc_feature (467)..(489): n is a, c, g, or t
  misc_feature (491)..(495): n is a, c, g, or t
  misc_feature (497)..(499): n is a, c, g, or t
  misc_feature (501)..(507): n is a, c, g, or t
  misc_feature (509)..(515): n is a, c, g, or t
  misc_feature (517)..(534): n is a, c, g, or t
  misc_feature (536)..(557): n is a, c, g, or t
  misc_feature (559)..(584): n is a, c, g, or t
  misc_feature (586)..(591): n is a, c, g, or t
  misc_feature (593)..(615): n is a, c, g, or t
  misc_feature (617)..(623): n is a, c, g, or t
  misc_feature (626)..(626): n is a, c, g, or t
  misc_feature (628)..(628): n is a, c, g, or t
  misc_feature (630)..(632): n is a, c, g, or t
  misc_feature (634)..(639): n is a, c, g, or t
  misc_feature (642)..(646): n is a, c, g, or t
  misc_feature (648)..(651): n is a, c, g, or t
  misc_feature (653)..(653): n is a, c, g, or t
  misc_feature (657)..(658): n is a, c, g, or t
  misc_feature (660)..(665): n is a, c, g, or t
  misc_feature (669)..(669): n is a, c, g, or t
  misc_feature (671)..(671): n is a, c, g, or t
  misc_feature (673)..(683): n is a, c, g, or t
  misc_feature (685)..(686): n is a, c, g, or t
  misc_feature (688)..(700): n is a, c, g, or t
  misc_feature (702)..(703): n is a, c, g, or t
  misc_feature (705)..(711): n is a, c, g, or t
  misc_feature (714)..(715): n is a, c, g, or t
  misc_feature (717)..(717): n is a, c, g, or t
  misc_feature (719)..(719): n is a, c, g, or t
  misc_feature (721)..(722): n is a, c, g, or t
  misc_feature (724)..(724): n is a, c, g, or t
  misc_feature (726)..(728): n is a, c, g, or t
  misc_feature (730)..(730): n is a, c, g, or t
  misc_feature (733)..(738): n is a, c, g, or t
  misc_feature (740)..(742): n is a, c, g, or t
  misc_feature (744)..(747): n is a, c, g, or t
  misc_feature (749)..(758): n is a, c, g, or t
  misc_feature (760)..(768): n is a, c, g, or t
  misc_feature (771)..(782): n is a, c, g, or t
  misc_feature (784)..(786): n is a, c, g, or t
  misc_feature (788)..(794): n is a, c, g, or t
  misc_feature (799)..(826): n is a, c, g, or t
  misc_feature (828)..(836): n is a, c, g, or t
  misc_feature (838)..(857): n is a, c, g, or t
  misc_feature (859)..(877): n is a, c, g, or t
  misc_feature (880)..(880): n is a, c, g, or t
  misc_feature (882)..(882): n is a, c, g, or t
  misc_feature (886)..(887): n is a, c, g, or t
  misc_feature (889)..(890): n is a, c, g, or t
  misc_feature (896)..(896): n is a, c, g, or t
  misc_feature (904)..(904): n is a, c, g, or t
  misc_feature (907)..(907): n is a, c, g, or t
  misc_feature (910)..(910): n is a, c, g, or t
  misc_feature (913)..(913): n is a, c, g, or t
  misc_feature (915)..(915): n is a, c, g, or t
  misc_feature (919)..(919): n is a, c, g, or t
  misc_feature (922)..(922): n is a, c, g, or t
  misc_feature (925)..(925): n is a, c, g, or t
  misc_feature (928)..(928): n is a, c, g, or t
  misc_feature (932)..(932): n is a, c, g, or t
  misc_feature (949)..(950): n is a, c, g, or t
  misc_feature (952)..(954): n is a, c, g, or t
  misc_feature (958)..(958): n is a, c, g, or t
  misc_feature (1098)..(1098): n is a, c, g, or t
  misc_feature (1263)..(1263): n is a, c, g, or t
  misc_feature (1281)..(1281): n is a, c, g, or t
  misc_feature (1347)..(1347): n is a, c, g, or t
  misc_feature (1371)..(1371): n is a, c, g, or t
  misc_feature (1491)..(1491): n is a, c, g, or t
  misc_feature (1974)..(1974): n is a, c, g, or t
  misc_feature (1989)..(1989): n is a, c, g, or t
  misc_feature (2005)..(2005): n is a, c, g, or t
  misc_feature (2071)..(2071): n is a, c, g, or t
  misc_feature (2192)..(2192): n is a, c, g, or t
  misc_feature (2202)..(2202): n is a, c, g, or t
  misc_feature (2271)..(2271): n is a, c, g, or t
  misc_feature (2388)..(2388): n is a, c, g, or t
  misc_feature (2943)..(2943): n is a, c, g, or t
  misc_feature (3287)..(3287): n is a, c, g, or t
  misc_feature (3387)..(3387): n is a, c, g, or t
  misc_feature (3478)..(3478): n is a, c, g, or t
  misc_feature (3589)..(3589): n is a, c, g, or t
  misc_feature (3672)..(3672): n is a, c, g, or t
  misc_feature (3705)..(3705): n is a, c, g, or t
  misc_feature (3742)..(3742): n is a, c, g, or t
  misc_feature (3814)..(3814): n is a, c, g, or t
  misc_feature (3960)..(3960): n is a, c, g, or t
  misc_feature (3994)..(3994): n is a, c, g, or t
aannatgnnnntannancnnagtnncanngaannngnntnntacnantnntgangntnnnagnntnnnnacannnntnnagntnnnttnntnagnagannagntntnnnnncagatanngnnagannannanannnnnnnnatnnnnannnaannnnanattananttnaantnnttncnanngnnaanatnangnanntngnnnannanannnagnntnnnganatnnannaannannntttctannnnntcnnntncnanncaangagtantgngnnnnggaaatngnnnannanannnnanangnnannnctnntncnattnnngtntntattactncaanatnagannnnnnttcgntnncntancntnnnnanntnnnnnnnnnnnannnnatnnnnnnnannnngnnnnnannnntnnnnnnntnnnnnntnnnanannnnanngnntnnnnnnnannnannnnnnnnnnnnnnnnnnnnnnnannnnntnnntnnnnnnngnnnnnnngnnnnnnnnnnnnnnnnnncnnnnnnnnnnnnnnnnnnnnnntnnnnnnnnnnnnnnnnnnnnnnnnnnannnnnngnnnnnnnnnnnnnnnnnnnnnnnannnnnnnaantntnnnannnnnnttnnnnnannnngnggannannnnnntttnantnnnnnnnnnnntnntnnnnnnnnnnnnngnntnnnnnnnggnntngngnngnannngnaannnnnncnnntnnnngnnnnnnnnnntnnnnnnnnnggnnnnnnnnnnnncnnncnnnnnnnaaaannnnnnnnnnnnnnnnnnnnnnnnnnnngnnnnnnnnntnnnnnnnnnnnnnnnnnnnntnnnnnnnnnnnnnnnnnnnaananatgnncnnttggtnaaggggtnaanacnccncntttncanggnggnaacncgggttcgaatcccgtnngnnntatntttcgagtaacttaggttactctttttattttgtttcttttttttatatgttataatagcttataatactattttgaggtgaatttatgtctaaagtttttgtttttggtcatcaaaaccctgattctgatgcaatcggntcttcttatggatacgcttatttgaaacgtcaacttggtgttgatgctgaagctgttgctttgggtactcctaacgaggaaactgcttttgttcttgattattttggtgttgaagcaccacgagtggttgagtctgctcaatcagagggagttaatcaagttatncttacagaccataatgantttcaacaatctatttcagatattaaggacgttgaagttattgaggtagtcgaccatcaccgtgtngctaactttgaaactgctaatccnttaatgatgcgattggaacctgttggatctgcatcttcaattgtttttcgtatgtttaaagaaaacaatgttgaagttcctaaggaagttgctggtttgcttttgtcaggtttgatttcngatactcttcttcttaaatctccaactacacatgcttcagatcctgcagttgcagctgaacttgcagaaattgctggtgttaatctagaagaatatggtcttgctatgcttaaagctggtactaatctttcttcaaaatctgctgaagaactcattgacattgatgcaaaaacatttgaattgaatggtaatcaagttcgtgttgcacaagttaatacagttgatatttctgatgttctttctcgtcaagcggaaattgaagaagctattaataactcaattaaaaacaatggttactctgactttgtcttaatgattactgatattcttaattctaattcagaaattcttgcacttggttcaaatactgataaggttgaagctgcttttaattttgttttagaaaataatcatgctttccttgaaggagctgtttctcgtaagaaacaggtagttcctcagttgactgaaagctttaatgcntaaaattaggccatnaggcctttttttagtnctctgattaatggtataatacttcttatgataatacaatttaacccaaacaaactatgtaagcaanctttttttatggaaatagtgaattatctatatcttaatcagcctgtgaccctgagagcaataaaaaggcagtttccttttcaaaagaatatcgataaattaattgaggagtttgtaaaagnaggctatatngaacgattcgagaaacgttaccgtttattaattagtcttgtgtcggattcttctaaaattgatttagancagcatttttttattaatgatgattctacttgttatttagaactattaaatcgtagatttgttactgagataagtaattctactaatgaagttgttattattgaacaaacgagtatnacgagagacgatcttacgatttcaaattatttctataaattaagagaaaatctaccattatcggaagagcagaatagattatatgatatattaggggatgttaatcctgaatattttttgaaacatgttacgacttttcttttaaaatacgtaaggaaggaatatgcacttcaaaaaaggaggaatatttttgttgatgctttagaattattagggtatcttgttcaagtagaagaagggcgttatcttttgaatatggatttagattccgaagcattagtttttagtgcaaaaaaagactagtattattactagtcttttttatgacaactttaacgattccttagttcaagataacgtttgtaccagatgttaacataagattgtgaaaatggccccttaccattgttaatccaatctaccaagattttaacatgttcctttaagatatagtcaatatcaggagagtaatgcatttcttttttatgtgtttcatactcatctacatctagcaattttttttcaccatcagcgaagactttgacatctaggtcntagtcaatatattttagtgcttcttggtccaaaatatatggactagctaaattgcagtagtaggaaatgccgttatccctaatcatggctataatattaaaccagtattttttgtggaaataaacaatagcaggttcacgtgttacccatcgtcttccgtctgcttcagtaacgagggtgtggtcgttaacgccaataacagcattctcagttgtctttagtaccatagtatcgcgccaagtacggtgcaaactaccatcatgcttataactttgaattgtgataaagtcgccttcttttggtaatttcatggcgtcctctttctacaataagggttatccccnttattgtatcataattttgtgaaaagagggggaatacctataaatattctcttagagcggatgctatcgcatcaaagtcataaccttttcgggctaaagnttgtgtcaagcgttgcttaagctcataaccgtcgtattttttactaaatttttgatattgcttatcaatttctttataaaggagagcttgntcattttcttcatctgcttcaagttctagatgatcgattgctagtttactttcttggaatgaaaaacctttattgataaggctttgagttaatttatcttttagggctttngatggtagttttccctgatattttcgtaacagttttgaagctactttaatggctatttctgagaaatcaaattggcttaaaanatcgtcaatgatttgtttgttacaacctttttnaagccatttttgcttcagcacataggcccctttatcncctgaattcagattttgttgagctagactttctaggagtttgtaatcatcaatccaatgatctttttttagnttatcaataatttttggaattatatgagggtttatttcatgtttaaaaaggtaatcttttacctctttctcagtacgttgtttaaatgaaataaaatagagagctaagtttttaccatgcgagaactgagcaaaggatttaatatnctctagttgatctttgtccagtatcatttctttngtcaac

SEQ ID NO: 292 - DNA, 4000 bp, Escherichia coli
  misc_feature (1976)..(1976): n is a, c, g, or t
  misc_feature (1980)..(1980): n is a, c, g, or t
  misc_feature (1992)..(1992): n is a, c, g, or t
  misc_feature (2003)..(2003): n is a, c, g, or t
  misc_feature (2013)..(2013): n is a, c, g, or t
  misc_feature (2033)..(2034): n is a, c, g, or t
  misc_feature (2043)..(2043): n is a, c, g, or t
  misc_feature (2046)..(2046): n is a, c, g, or t
  misc_feature (2051)..(2051): n is a, c, g, or t
  misc_feature (2125)..(2125): n is a, c, g, or t
  misc_feature (2146)..(2146): n is a, c, g, or t
  misc_feature (2257)..(2257): n is a, c, g, or t
  misc_feature (2427)..(2427): n is a, c, g, or t
  misc_feature (2491)..(2491): n is a, c, g, or t
  misc_feature (2556)..(2556): n is a, c, g, or t
  misc_feature (2587)..(2587): n is a, c, g, or t
  misc_feature (2593)..(2593): n is a, c, g, or t
  misc_feature (2609)..(2609): n is a, c, g, or t
  misc_feature (2615)..(2615): n is a, c, g, or t
  misc_feature (2626)..(2626): n is a, c, g, or t
  misc_feature (2755)..(2755): n is a, c, g, or t
  misc_feature (2842)..(2842): n is a, c, g, or t
  misc_feature (2977)..(2977): n is a, c, g, or t
  misc_feature (2996)..(2996): n is a, c, g, or t
  misc_feature (3007)..(3007): n is a, c, g, or t
  misc_feature (3049)..(3049): n is a, c, g, or t
  misc_feature (3487)..(3487): n is a, c, g, or t
  misc_feature (3569)..(3569): n is a, c, g, or t
  misc_feature (3795)..(3795): n is a, c, g, or t
  misc_feature (3818)..(3818): n is a, c, g, or t
  misc_feature (3946)..(3946): n is a, c, g, or t
ttccagcctttactaatttaatatacagttccaacatcttaattacctcccgtctttgcttcatacagttccgctactgcgttcataataatgagctgattttcttctgttgcgagcagtttttcatagagttctgcctgtgctcccatgctgatcagaatgttctcgtttactttttcagtgttctcttcctgctggatcagattataatactcttcttcactcaggaaacgatactcgcatgtatagcccacttctttctcttcgctgccatccatactgtctcgttcgatacgattgatatttcttctctggatgtaagtattggcatttaccatttccaacgtttcaggcagtgaggagcaattctctgttttccatccttgcatttttatttgcctccttgtccattttagatatgatgcgtttgaccgccctcacgcttataagtggcttaatatacatcagataccactcataggtgtcagagtgtgttatccagcccatcagggaaataaaacccttgcagagccttaatggatatttcttcttttccatcttctttttattgagtttccttgctatcctcgcaatatgtatcagcgtatgctttcttatgattacccgatttcgatagaacagccagcccattgccgatacttccctgccggttctcctgccattctttttaatgtactcaaaccggaacacctgccagtcacctttcattttcagcctgatttttccaagccactgcttaatgaatataatcgccatgtgcagcttctttttattatcatctgccatcgtgaaattatccatataccggataaagtgtgctattttcagcttgcactttatcagaaaatccagctcctgcaggagaaagtttgccagccactgtgacaaataaaagcccagtggcagcttatctggaaaccatgtcaggcacacatctatcagatacataaataaagcatctttgatacgttttaacagttttggtcggataaacttatactttgcatggtcataaaaatgtcggatatcgcactgtgcaaaattccggatacctttcccagactgaatccatcttttcatcgctttcattccccgatgtgatccacgcttgggaaaagacgaatagctgtgatggtaactgctcccttgaataatcggctccagaattagcacaataacgtgctgtatccacaattcaaccattgtcggtacatatatgacccttgttttcccagcttcttttataataaccgggttatgctttggtggtttaaattccagttccggattttccaccttccatccggctggcttcgtattctggataattttctgtattttctcaacccatccatctaaatcttcctccaccatttgaatatcttttctgtcactttttccacgcttcatccgcttaaatgcccggaggataacacccttttggcaagccagcgtgtataaatatctgtaacttttctttttcttccaaggaatgccggtctctttttcaatgtcatatttgaacttatgcattttatcttctatctcctcgccgctttcgaacattgctcactacttgcagctcctgaccggaataatttccactcaccaaaacctataaaggcggatataacagtatttcaactgtcagcggtgtatatgactatcggtaacattttggacttatagtttcttgatagaatcaggacgccccgtagttccaccaggcgttagcagcgacattgttcagtgtgcgagcccagagcccgtcattagcaccgttgttgcaattgccgaaccgcagcgaaaccgccggagagggagttccgatagcccctcaagatctttaaaaaatcattcctatattttatacaaagcagttgggggaagacccccaaaccccctatctgcagcttacgctgcagcaggtgctggaagaagtttggacgccccgnagtnccaccaggcgtnagcagcgacancgtccagtgngcgagcccagagcccgtcannagcaccgtngtngcaancgccgaaccgcagcgaaaccgccggtatttctgcgttcacccaagtgtgatcgcagtatccagtagcagaactncatgcgatttcatcatttggnactgcaccaaaatcctttaccacctgagttgttgcataatatccgttttttgccaaattcactccagtatccagatatttagccccggttaagtcataggtataatccggngacacctttattcttccgttaatcaggagcatatacggatctctctgccacagcatataactccccataacgcagctatggaaaatcttattgaaggacttattatcattagaaccataaaactgtcctccgccaatgactgtattgattttcgttccgtaatgttgtgntttatcttcaacgtaggtagaacacatgcctgatccaaaagcagtctgagagtcggtgctcttnctcagcagaatacagatgtctgccaatgtattcgttaatgcaccgccaaagaaaagagctttgcnggatgctgcctgaattgctgtatactgctcngcagtnccgattgcttttccgnttgcantgtctgcagcngaaccggaggctgttaagcagctccactgccctgcaatacttctcatctttccattggaatcaatggagccatagaacatcgggatcagcatataatctctttcttttccaagtacattaaatcctacngcatggaaatcatcatccacttttctttcacagaaatatacatagcggtcatttccaaccttatattccttcttgtagattttcttnacgattgccatcgcatcaccggcataatcaatattagccgcatcagagttcgttccatccgctttcttcgtataatcgtccggatctaagaagtaatcaatacctccatcccaattacacataaccggtacattngctttcagccagtcccagncagcccatganccataattcatggcgtgcgtgctcatgttcatgctcataggngtaaagtccttgttcgcaccaaggtactccactcttgtggacggattcaggtcggaagcttcatggataaccattccataaatcggtgcatcatccggtaccagatttctcaccagcttttccacctgctcctgcacttcaagcagtgtttcctgctctgcaataaaaacctttttcgacattttctacctcgtttccagcataatataacactttacgttttatatttgcttattttgttagattataacgtaatacgttatttttacagttcctcataatataaatgaccgttttccatgcctaatcgcatcttcccaccgttcacgtcatcctcaaagatcttcgcatccctgcggttggcttttccgttgttgagaagctgggcatatcgctcattaaagtaatctgcatgtgccggtgtggtaggctccagancctccatctgttcgttgtaaaccggctcatcctgaatcgttaaattcttcgccatgtcctgcctccctaaaatgtatcgttnatatagaaagtcatgctgatatccgcatcctttccttttgcggtaaaacgcttgatggtaacgatatccccatccgcatcatagagtccgatttcgctaatcgcagcacccggaagctcactctcctttagctcacattcatacttgcacttcgtatcgctcaacatggtgtaagtatcgtatttctttctgagcaattcgttcttcagttctgattctgcctccngcggtgcgataacatttccatcngcatccacaccaccatcaccaaatacaaagcccacaatcttaggcagctggatttctccagctctggctctcagcatctttttccttcctgcaattgtaataatctgattctgtgtaaggttctctgncattttacaattcctcctctcgccttatggcatctaatatccttgttccattta

SEQ ID NO: 293 - DNA, 4000 bp, Escherichia coli
  misc_feature (85)..(85): n is a, c, g, or t
  misc_feature (1988)..(1988): n is a, c, g, or t
  misc_feature (2228)..(2228): n is a, c, g, or t
  misc_feature (2834)..(2834): n is a, c, g, or t
  misc_feature (3232)..(3232): n is a, c, g, or t
  misc_feature (3901)..(3901): n is a, c, g, or t
  misc_feature (3948)..(3948): n is a, c, g, or t
ttttcataccgccagcagctattgctgcttcacgctcagctatttcggcctcgcactctgcctgacgggctatagcggcatctangtctgcttgtatcaccgtaagtgagttttgtccatttacctctgtctgaccttttagtatttctacggcttcgtcgtagcttagtcgtgggaatggcttagcaacagtctctaacttagaaatgtctcttcccagcacttctagttcttcaggacattttgcgataacctcttgcactactgcacgcaagaaagcctcgatggtgtccatattctcaaatatgtcacaaaaggccatctctggctctatcatccaaaattctgataagtgacgtcgtgttttacttttttcggctctaaaggtggggccaaaggtgtatatcttacccatcgccatcgccattgcttctccgtataattgtccactctgcgtgaggtaagcaggcttaccatagtagtctgtttcaaataggtcggttgtgccttcggcagcatttccagtaaatataggggcatccatctgcacaaatccttctgcctgaaaaaagttgtgaatagcatatgtaattgcgtttcgtacacgcataatcgcccattgacgtctgcttcgtagccataagtgtcggttatctaccaaaaagtctaccccgtgttctttattcgaaatgggataatctttcgcattttggtacacttctaccgtggtagcgtgtatttcgtatccgcctatttgacgttcatcggctactacttttccagttacagcgatagaactttcttggccaagagatttagcaacagcaaataaatcttcgcctatttcctccacgcccagaatgcattgacagatccctcgaccatctcttaagttgatgaatactaccgttttactttctcgcttgttggctacccatccctttacggtaacctcttgtcctacatattggtctaattgtttggtatgcattttgctagtcgtggatttctccctaattttgaacagcaaaagtaagtgctatcacttatttttcaatgtgtatatgttaaaacaacatttaagtcaaaagctactacaaaagttaagtcctcagcagatacaatttataaaattgttgcagctcaatacactcaattttgaagagcgagtagaggaggaaatcctcgataatccagctctagaaagtggtaaagatgaggacgaagaatcgagttatgaggagtccgatgatttagatttcggctccaaggaggaagaatttgatgtctctgattatatgaatgacgacgatggaggaattcaaatgagcggggagtatcaaagtaccgatgaggaaaaagagtttatgccagtgatcaactacgcatcctttggcgaacggcttatggagcaagttacgggattgctcaaaaacgagacagaagaacagctcgtggagcaaattattgggacattagatgatgacggatacttacgaagacctctttccgcgattaaaaatgacctgctattcactcaaaatatacgcactaccgaagaggatttggaacgcatattgggctacatacacgagctagaccccgctggggttggtgctcgagatttgaaagagtgtctgttattgcaaataaaacgtaaacaagaggcaggggatactccagtttacaagttagcttatcgtatcttagatgagatgatggaggatttctccaagaaacactacccgcgtatcatcaaaaaattcgaaatatcagaagattacctgcgtgaaacattagctttcatcgctaagttgaatcctaagcctgcacaaagtggtgctgacggtgctactatgaaggattttattatccctgattttattgtaaaagaagagtatggtgagctgcaagtgtcgctcaatcagaagaatgctcctgagcttaaagtgagtagagcatatagcgaaacactcaaaagctacgangctagtaaagaaaaatcaaagtcccaaaaagatgcggtgcagtacatcaaacaaaaattggatggggccaagtggtttatagattctgtaaaacaacgccaaaatacacttttgcttaccatcagaaaaatagttgagatacaacacaactttttcataagtggcgacgagtctgatctcaagccgatgatactaaaggatatagccgaggagattaacatggatatatcgaccattagnagggtagctagtagtaagtatgtggagacggattttgggatattcttgctcaaagacttttttacagaaggtatcactatggaaagcggtgaagaggtgagtaatagagaggtgaaaaaaatcttaaaagaagcaatagacgcagaaaacaagcaaaaaccacttacagatgaggctttgaaaaacatcttacaggaaaaaggatataaaatagcccgccgtactattgctaagtatcgcgagcaactcaatctgccagtggctaggctccgtaaagaattatagatgaaaaaggtattacaagcactggctgtgcttacgcatcccatatttttaccgctttttagtttggtgatttatttgcctatcgtagctaaatacgcagagaatgcttttgtacttagtatggtatgggtaggttttgtttatctcatactgcccttagtctatttcaaatttgtacgcaaaatgaacttggcagaaccgagtttggaccaacgtagatcaatatatcgagcgtatacattggttaatgtaggctttgcactcgtaagtgtcttcattatgactgagtacattagtttctgtttggctgctgcattcttncacttatttatgttactcttagcttttttagaaatgaaagcaagttggcactcggcggtatggtcctttctcgtcgttgtaggtcttatggtacagtataactatacttttgtggggcaagggtctatgttgctactgcctatagtcatacttgttgcggtgctactcataaggcgattgtcaaaggctcatacgtggtttgaactcgggatgggagcagcggtgggagctattgctgcattccccgttttatttttttaaaaaattgattcatgaatttagaaacgataggatatacaaccaacaatgaaattgtaacgataaccctcaaaagacctgaacgttataatgcttttgatgagcaaatgcgtaaagaacttctgcaagcattgctagangcggagcgtgatgagcaatgtagagtggtagtgctcacaggagcaggtaaggctttttgctcaggacaagacttaaaagatatagaaggaaagaagattgatttttcagattttttaaaaaacggatataaccccattatcaaagcgatgcgagatatgtcaaagcctatcattgctcgggtaaatggggtggccgctggagcaggttgctccttggctctagcttgtgattatatcatagcagatgatagagcaagttttatagaagtatttgtgggtataggcttagttttagattctggttcgtcctacttcttgcctcgtatgataggcagtacgcgtgcttttgaactagccacgatgggtaataagttgagtgcttctaaagcggtagagtggggaatgataaataaagcggtagataccgaaaccttagataatgaggtgaataaggtagctgcgtattacgcatctgcacctacgctagcaatttcatccatgaaaaaaatgctcaatgcttctatgaccagtacgcttgatgagatgttggagatggaagctcattttcagcagatagcaggtagttctcaggactataaagaaggggttgtagcttttgtcgaaaagcgtaaacctaattttaaaggacattagcttcacctcaagaantaaggcgttctggtttggattccttattttcgaaggcttattgtcgntatgcgtaaaatcttaattgtaaccagcttatttatcctcctagttacaaag

SEQ ID NO: 294 - DNA, 4000 bp, Escherichia coli
  misc_feature (26)..(27): n is a, c, g, or t
  misc_feature (74)..(74): n is a, c, g, or t
  misc_feature (86)..(86): n is a, c, g, or t
  misc_feature (95)..(95): n is a, c, g, or t
  misc_feature (104)..(104): n is a, c, g, or t
  misc_feature (107)..(107): n is a, c, g, or t
  misc_feature (635)..(635): n is a, c, g, or t
  misc_feature (878)..(878): n is a, c, g, or t
  misc_feature (1307)..(1307): n is a, c, g, or t
  misc_feature (1925)..(1925): n is a, c, g, or t
  misc_feature (1988)..(1988): n is a, c, g, or t
  misc_feature (1990)..(1990): n is a, c, g, or t
  misc_feature (1995)..(1995): n is a, c, g, or t
  misc_feature (2023)..(2023): n is a, c, g, or t
  misc_feature (2051)..(2051): n is a, c, g, or t
  misc_feature (2053)..(2053): n is a, c, g, or t
  misc_feature (2152)..(2152): n is a, c, g, or t
  misc_feature (2253)..(2253): n is a, c, g, or t
  misc_feature (3055)..(3055): n is a, c, g, or t
  misc_feature (3301)..(3301): n is a, c, g, or t
  misc_feature (3319)..(3319): n is a, c, g, or t
  misc_feature (3397)..(3397): n is a, c, g, or t
  misc_feature (3457)..(3457): n is a, c, g, or t
  misc_feature (3544)..(3544): n is a, c, g, or t
  misc_feature (3556)..(3556): n is a, c, g, or t
  misc_feature (3559)..(3559): n is a, c, g, or t
  misc_feature (3787)..(3787): n is a, c, g, or t
  misc_feature (3795)..(3795): n is a, c, g, or t
  misc_feature (3826)..(3826): n is a, c, g, or t
  misc_feature (3843)..(3843): n is a, c, g, or t
  misc_feature (3850)..(3850): n is a, c, g, or t
  misc_feature (3918)..(3918): n is a, c, g, or t
  misc_feature (3993)..(3993): n is a, c, g, or t
  misc_feature (3998)..(3998): n is a, c, g, or t
cagcatgagtaatttcattactattnncaaggttttcactttcctctaaacgactaattacctcatgacctttntcctgaagagcncgcctaagnattgctgancgncccatattttcatcgactagaataattttaagggcagtctgattcattgtattttttttcataattctaagtttttataaccatcaataatatacctcattagcacaaaggttataaatggattaaagttttattattaggccctccactgcagaatatattctttagtggaggattttaagtttgagtttatatattaaaaatagttacttaacgacaaactctgggtatgcctcgagtccacattctgagatatccactccatcttcctcttcttccttggatacgcgaataccaattaatgctttaagagccagccaaagtaagaatgatgtcacaaaaacccaaataaatattgttgtagcaccaataatttgacctgaaaatggaacttcactatttgttaagggcactgctaaaagaccccaaagaccaacaacaccatgaactgaaattgcaccaactggatcatcgatcttgagtttacgatcaagcattacaattgaaatcactacaatcacaccaccnactgctccgattaaacttgcaactagagcacttggcgtatctggtccagcagtaatggcaactagacctgctagagctccattaagtgtcatcgttaaatctgctttaccaaaccatagtttcgcaaatataagtgctgcaataacacctcctgcagccgctgcattggtattaacaaaaaccattgccactgcatctgcactctccttacttgccattgctaacactgatccaccattaaanccaaaccatcctagccataagataaaagtacctaaagtcgccaaagggagatttgcacctagaattggctttgaattcccatccttatcatatttaccctttcttggaccaagaactattacgccagcaattgctgctgctgctccagccatatgcacaatgcctgatcctgcaaagtcatagaagccaaaatcacctaaattatatagaccaaaaacatcctttccaccccaagtccatgagccttccaatgggtaaatgatagtagtaaaaattattgcaaaagcaaaaaatgtaaatagcttcattctttctgctaccgcacccgaaacgattgacatcgctgtcgctacaaagactacctgaaagtaaaagtcagatgcatttgagtatgtttcgccttgtccactaattccagaaagaaaagcnccgccaccatacattaagtcatagccatagaccatatacatagtacatgcaattgcaaaaagaccaatatttttagttaatatttctgcggtatttttactcctcacaagaccagcttctagcattgaaaagccagctgccatccacatgacaagggcgcccattactaggaagtaaaaggtatcaattgcatattgtaattctaatatttgattttccattttcctctcctatagtgcttctggaccagactcattcgtacgaatacgaacgacctgttccagatttgtaacaaaaatctttccatcaccaattttgccgccgttaatcttacaagcagtgctaatggtctcaatgacctcctcaacctgctcatcagtaattgcaatctctaactttacttttggaagaaactcaaccacatactcagcaccgcgataaagttctgtatggcctttttgccttccaaaacccttaacttcggttactgaaaccccatttatatctatatctgagagaacttgtctcacactatccagtctttttggctgaatataagctgtaatcattttcatatcattgctccaatgtcaaaaacaaaaaagcccactaccttcnagaaagtagtgggcttctataccatttcagctcatctttaaactgacgaaaaaaaacgcttancnaggcnagtgcccaaataaacgtctatgtctttncttgataccaacattggcttcaagttgnantaattatatagaaaatatttttatatatttagtttttttagatattcagattctgaaaggatttcaacaccattatttttggccttattcatttttgantgacccacattttctccaataatgagaaaatcagtttttgagctgacagattttgatactttaatgcctaatgactttgcttgtttctcaagatcagatcnaggctgattcatagtgcctgtaaacacaatttttttgctataaaacggatttgagcttgtatcttcatcagcaatcaaaatggttttttctagatcaaaaccgccagatactaatacttcatattgggatttaatagacaacaacccatcaaaaataacctctgcagttagctctgcaaaaccatctatctctgcaatgctagctattgaaaggctaaagacttcatcaattgaataattttttaataaattttcacaattacccattccaagtctatgaacaccaaaagcggccaagaaacgccaatcttcaatactttcttgacgtgatctttgaagttgattaataaggttttgagaggttttttcaccaaaacccatagaaactaattcatctatattaagaagataaatatcacttacttggcgtattccttcatcatataatttttgaatcgttgcatgtccgaatccatcattgttgcccaagattcgaaaaaaatagatcatcttgccaaccacctgatctgggcaatcattttcattggaacacatcaaaaaatctgagtcccatattaatagagaattgcagctcggacagttcaaaggtatatcaacttctgcagttttaagaaccttatttattttaggaatgaccatcccacttcgagttaactcaataatacttccagcgcctagaccttgttctttgacaagcccgtagtgatgaccagttgccctataaatagtcgcgccgcttaattgagttggctccaactctgcaacaggggttatctttccngtccttcctacttgagccgtcactgaaataactttaacttgtgctttttccttattttctttgtaagcaatctgccagcgatggaacttacgatttgaacccataaattcttttaattcaggattgacaatttcaaagactaccccatcaatatcaaaatcaacaccctcctcaagcttaattactatatctaagaattgatttttgaactcatcaatattccccttccaaaatggaagttgcttnaaaggaacaaataaagcngcctttgcatcaattgcatctctagcaaacttatctaattctttttccttaatgagacttgcttgaaaatttcttggntactcaaaatcattacttaaatggtcttcaaagtaactcctcttaacaacaatctctccngggccttggcctctttcactatcatttaaaataccaagacctctttgaaacactctgctaatatcacttcccttattaccatcaccncgagtgtaaagnttntttccatcgtcataaccggcaaatccgtctaattttgcagtccctttaatttgaatttcagatagttgaacatttatttcttcagaaaattttgatattctttcaagccacttctcgatctctccccaagtataagccttgtcagttgagagcattttttctgggagcttaattttttcatctgaaaatccttcactttcagattcaaccttttgaagaaagggatgnttgggcantcttttttgaagctcaggaataaagatgaantcgtaattttcatcggnaactatngggcttccgcttcgataactatcattagctagaacacaaaactcaagtaaatctgaatcagaaaggtnatttgccaatgtagtttcattagcaatgttttgaatctgtttttttgtcagcatgatttactaaaatctagcttnatttnaa

SEQ ID NO: 295 - DNA, 4000 bp, Escherichia coli
  misc_feature (140)..(140): n is a, c, g, or t
  misc_feature (172)..(172): n is a, c, g, or t
  misc_feature (254)..(254): n is a, c, g, or t
  misc_feature (314)..(314): n is a, c, g, or t
  misc_feature (335)..(335): n is a, c, g, or t
  misc_feature (344)..(344): n is a, c, g, or t
  misc_feature (550)..(550): n is a, c, g, or t
  misc_feature (1403)..(1403): n is a, c, g, or t
  misc_feature (1424)..(1424): n is a, c, g, or t
  misc_feature (1991)..(1991): n is a, c, g, or t
  misc_feature (1994)..(1994): n is a, c, g, or t
  misc_feature (3660)..(3660): n is a, c, g, or t
  misc_feature (3725)..(3725): n is a, c, g, or t
  misc_feature (3845)..(3845): n is a, c, g, or t
cctcctcgctctccacgaacagccccaggccgctgaacgcgagcttggccgtgcccgcgatgtggtcggtgtcggcgttgaaggactgcttgacgaagcgcagcgccgtgggcgagagggcgaggatctcgtcggcccancggcggacctcggcgcgcagctcgtccggcgncacgacctggttgacgaggccccagcgctcggccgtggcggcgtcgtactggcggcacagcatccagacctcgcgggcgcgnttctcgccgatggcccgggccaggtaggcggtgccgaagccggcgtcgaacgagcccacncgcgggccggtctggccaaancgcgcagtntcggccgcgatggagagatcacagagcacgtggagcacgtggccgccgccgatggcgtagccgttgaccgccgcgatgacgggcttggggatgtcgcggatgagcgtgtgcaggcgctcgacctcgaacagccccgacgccgacgggccgtagtcgccggtctcggctcgctgcttctggtcgccgccggtgcagaaggcacggtngccggcgccggtcaggcagacgacgccgacgtcggagctcgcccacgcgcgcgtgaagcaggcgatgagctcgtccacggtgtgggcgcggaacgcgttcagccgctcgggccggtcgatcgtgatccaggccagcccgccctccacctcgtagcggacgtcggtcagctcctccatcgggcgctctccttcggtcgggtccacgtacgctagggccgcgatggccgagggcgagcgggtggcgctggtgaccgggggcggcggcgggatcggccgggcgatcgcgctggcgctcgcggccgctgcgcgagcggtcgcggtggccgacgtgcggatcgagggcgcggagcaaacggccgcggccgtggcggcacagggcgggcgcgcgctggcggtggaggtcgacgtcaccgacaccgggtcggtcgccgcgggcctcgcaggcgctgcggatgccctcggcccggtcgacgtcgtggtcaacaacgcgggctgggacgagttgcgcccgttcctcgacaccgacgaggcgttctgggagcgcatcgtcgccatcaacttcctcggcgctgtgcgggtgacccacgcggtcctgccggggatggtcgagcgggggttcggccgggtggtgaacatcggctcggacgcggggcgcgtcggctcgtcgggcgaggcggtctactcgggtgcgaagggcggcgtgatcgccttcacgaagaccgtggcacgcgaggtcgcgcgctcgggcgtgaccgcgaacaccgtgtgcccggggccgacgcgcacgccgatgctcgaggccatggcggccgaggacgcggccggcagcaagctcgtcgacgcgctgacgcgngcggtgccgatgcgccggctnggcgagcccgaggacgtcgccgccgcggtcgccttcttcgcctccgacgccgccggctacgtgaccggtcagacgctgtcggtcagcggcggcctcacgatggcctgagccgcgggcgacctagactggaggaagcccacccgcccccatggtgtagcggttagcacgcgggcctttcacgcccgtagcgggggttcgattccccctgggggtactgctcaggcggcggccagaaaggcgttgatctgcctggtgcaacgccatcggcgcgatcaccgccggggcctcggtagcctcgaacgcggtgcggcgacgagcgctttggatcctggtgggcgcggtggtgctgaccgcggtgggcgccgcggtcgtgtacgccgccacccggcccgaccgcaacgacggaacggtcacggtcaaccggctgcaggacgtgcagcgccgcgccgaggcgacccggatcgcgcaccggcgctggttcgcggcccgcaaggccgacctcttgcgccagatccacgccgccaaggcgcgcaacgaggccgcggcggccccgccgcagcccgcagngancggcagcgtgcccgagccgcagatcgtgcgccgcttcatccccttcggggccaagcgcaaggccgagacccgcgcctacgcccaccgccactacggcatctcgaccgacaagctcgtcgaccccaaggtcatcgtcgagcactacaccgagagcgccgacgcccagtcggccatcaacacgttcgcgacggaccagcccgactccgagctgcacgagctgccccagacctgcgcccacttcgtcatcgacagcgacggcaccatctaccagctcgtctcgctcaccgagatctgccgccacacggtcgggctcaactacaccgcgttcgggatcgagatggccggcttctccgaccagcagatcctcgaccgcaagccggaactcgatgcggccctgacgctcacccgttggctgcgctgccgcttcggcatcgacgtgcacaacgtcatcggccacaacgagagcctgagctcgccctaccaccgcgagcgcgtcgccagcctgcgcacgcagacgcacgacgactggaagcacgccgacatgaacgtgttccggcgcaagctcgccgccctcggcggctgctgacactcatacccacgtctttcgcaggcgcagttagtgtcgcgccatgcgaggtcgagcggcccttgcggccgtcgtgttgtgcggtggcgtcggtgtaggggtcgcggccggctgcggtagcagctcgagcgaccagcacgacgcctctgtggccagccaagccgtgcagcaggcgttggccaagcagcgccagcagcaggaggacgcggcgcagaaggccaagctgcgcaagctgcagcgcaagctcgcgcacgagaagggacaggacgcgcagaaggcggccagcgcggccgccgggggaagcggcggctcgggcggctcgggctcccagcagggcggcggcccgcacgactgcggctcgggcgtgaccgccaacaacggcggcacgacctgctcgttcgcgctcaacgtcgccgagcagtaccgcgccagcggcggcgccagcgcgatccaggtctacagccccgtgaccaagcagacctacacgatgtcctgcgtcggcgcctcgaccaccacctgcaccggcggcaacaacgcgtcggtgaccttcagctgacccgcgccctcgtcgcgctcgcggccgcggcgttggtcgcggcgggctgcggcggccagcacgagcagaagcgttcgacgccgggcagcagctggccagcacagtggcgcgctggctggccgaccacgccagtgcggtgacgggctcgggctcgccctgctgagcggtaccgatgagatttccgccgcagggcggtctcaaagccatgagcacaaatctgccccgcatcgcctcccacgaggagtggctggctgcccgcaaggagctgctggccaaggagaaggagctgacccgcgcccgcgacgcgctcagcgcgcagcggcgccgcctgcccatggtcgagatgaccaagccctacatcttcgagggacccgacgggacggtgggcctggccgacctgttcgagggccgcagtcagctcatcgtcggccatttcatgttcgaccccgattgggtcgacggctgcccgagctgcagcgccggcgctgaggagatgtcggccgggcacatcgcgcacctcaacncgcgcgacaccacgatggcctacgtctcgcgcgcgccgctcgagcgcatcgaggactacaagcgncgccggggctggaccttcccctggtactcgtcccacggcagcgacttcaactacgacttcgcggtcacgctcgacccggcgcacgcgccgcccgagtacaacttccgccccttcgcagtngaggagtcgaccgagatgcccggcctgagctgcttcctgcgcgacggcgaccgcgtcttccacacctactcgatgtacgcccgcggggccgagcagatcggcggctcgtactacctcctcgatctgaccgccctcggccgccaggaggactggga

SEQ ID NO: 296 - DNA, 4000 bp, Escherichia coli
actgaacagcaggtacagcgtgccgatgtccttgtggttggtggcaaaaacccagcgacgccagccatgggggtgatcgtgcgcatgatcgtcatggcccgcgtggccgtagtggtcgagtactgcactcatgagttttccttcaagacttgatgctggaattacttgcgggcggttttgatgtcagcgggctgcaccacctggcccgtctggttggcccaggcgttcttggtgtaggtgaccaccgctgcaatttccgtgtctgaaagctgcttccatgctggcatggaaccaccaccggcgccgttgagcaacacgctgatctgctgggagttgtcgtcagccaatacgatcttcgagcccaccagacccttgatggggccggcaccagcgccgtcagccttgtggcaggccgcgcaattggcgttgtagaccttttcgccgcgggccacgagttcggccagcttccattccttgttggggtcgtcagccttggctgcggccttcttcttttcgccatccacccacttgctgtagtcctcttgagagaccaccttcacatgaatgggcatgtaggcgtgttccttgccgcacagctcctgacactggccgtagtagtcgccgatcttttcagcgcggaaccaggtgtcgcgcacgaagccggggatggcatcttgttttacagcgaaggccggtacggcccaggcgtggatcacatcgttggcggtggtgatgatgcggatcttcttgtccaccggcaccaccacggcgttgtccaccttgagaagatagttatcgatggcctcgggcttgccgctgtcgctcatcatgcggtgcttggcgtctaaagtggccaggaagctgatgccttcaccctcgcccttgaggtagtcgtagccccacttccactggtaacccgtggccttgatggtgatgtcagcgttggtggtgtccttcatggccacgaccgatcgggtggccatggcgcccatgccaatcacgatgatgaagggaatgacggtccaggcgatctccaccgccacgctttcgtggaactgagcgggcttatggcccagcgacttgcgatgcttgaagatggaataaaacatcacaccgaagaccgccacgaagatcaccaggcagatcaccaacatggcgatgtgcaggctggagacatccgcggcaatgcgggttaccgccgggtgcaggttcagttggttgacggctgggccgcccggcaggtcgttcaccgtggatgccacggcagcggacatgcccgacagggcggccagtgcgagcgcggcacgacgtgcctgcgcagcaaaaaggtgatccatcttcatcatcgtcacttcagttcaaaccctcgccagaggccgcggttgcggtgtgcacgcgcagcgcctgacgcaattcccgcgccagcatctggcgccactcgggccgcagatagcgacccacgaatgtcttgcggcccgcgccagacaactccaacagcgagccctgaccttgtgccggctccacccgcagccaatcggcgcggaactcggagcgctccacccggttgccgcagtgatgttccaccgctaccgtcgagttcttcaacgtgatggtttcatggtcggccgcatggcgcgcgtacaccagcagcgccgcgcccaagagcagcaactccaggcccgcgaagtacagcactggcacggcgccgaaccaggcaaaaacgcaggcgatcgaaagcgacaccaggcataacgcgaaatatgccgccagcacctgacgcggagccaacgagcaattgcggcgcatcacccagcgcagcccgccgcccggactgtcgtccagcggggaggccctccagggggatccgagggccaagaagcccggcaggttcagagatgcggatgtcggtgtcatgtcgtactgcagaccgctcagcgatgtccgcgtcaagcacccttgcggatgcacacacagacccgctcggctctctagagtgtactccagtaaccgggagaaccctaataccctattgccaacctagagagggcggcgctgcgttctcaccatgtggcgcatatcgtccagcgacaccgtggtggtggcctgcatgcggctgcgcggtaccggcctgaaggcatgaccgtagatgatttcaaagctcagggccagccgcccatcggggcctgctgccgcgtgcagggccgcctccaggcgggcgcgccaacggggggtacggcagccggcgtggcggccgggatgggcgttacgacccatggtgcgcaactcggctagggctgcatcggcgctggcccaggtcagggtgaccgtttcctggtccatcacggggtcggcaaagccggcggctaccaggtcgtcaccccagtcgtgcatgtcgcgaaaaggctgtgccggcggaccccagccctcctgatcccacaggctgcgccactggcgcagggtgtcggggccgaaggtgctgaacatcaagaagccgttggccgccagcgctgcatgccagcgctgcaacacctcggccggatgtgcgtgggtgtgcaagccgaggttggaccacaacagctggccgtggccagccggcacctcggtgtccaagaaacccccaagcagcgcagccgtttcagacgacatgcccgccccggatggtgccgcaagccgtgcgagttgccgcccaatcggattaaaggtccgctgcgccagatccctcaggcccgccaacagcccggccttggccgtggcctgtgggccagactgtgggagcacgccggtgcaaccgcaggctctcgccaaggcggcgcggttcggtgccaccggcacccatcgggcgtgcgggtacgcggcttgtaatgcggcacgcgactgcccagccggggtatcccactccagcaccacctcgggctgcacccggatcaccgacagccgctcggccatgcgccgggcgacctcttggtgcagccaaggcagcgacgcccccgcggcccatcgctgccgggctcggccccacgcggctgcgtggacgggcagtgccggtgttggcgcctcgttcgtgctggcagccgcggctgtagaccctgcccccaaggggtgtggcaggggggagtcggggctgggagccatggatcggtcagtatattgagccgatgtcaacactcgaagctgaagggctggtgcgtgctgttggccaaggctgggcccggctcagagctggcccctggcccctgccccaacgatgcctgctgtgcagtgactgggcccatcaagccctgtgcgcgccgtgtctgggcctgtatgcaggccaacaggccgtgcacagccggccgcgctgcccggcgtgtggcctgcggctggccaccggcctgctgcgttgtgcaagctgcgagcgagcgtccacgtcccacggcatggtgcgggtggcggtggactatgcccacccttgggaccgtgtgctgatgcagttcaagttcggctcgcgccctgacttcgcagcggccatggccctggtgatgagctgtcacatcaaggctcagcacggtgctgctgcgctcgggcccacgcgcctggtgccagtgcccttgtcccgtgagcgcctcgcgcaacgcggctataaccaggcctgggaattggctcggcggctggcgcggcaggtggggctgcaagccagggccgatgccttgatgcgttgcgttcatctgcccgggcaagccgagcagggccgcgccgcccgcctcaagcggctgcagggggtgttccagctcagccctgccggccgggcctgggtggcgggccagcgcgtggccctggtcgacgatgtgtacaccaccggcgccacggccaccgaagcggcgcgcaccctgctggctgcgggtgcgctgcaggtgcaggtatgggcctttgcccgcaccccagcgcccgaggaggggccctcctagggcgggcttgcaccacaatccgcggccatgttcaacatcgttctggtgcaccccga

SEQ ID NO: 297 - DNA, 4000 bp, Escherichia coli
  misc_feature (2)..(2): n is a, c, g, or t
  misc_feature (4)..(7): n is a, c, g, or t
  misc_feature (9)..(9): n is a, c, g, or t
  misc_feature (12)..(12): n is a, c, g, or t
  misc_feature (14)..(20): n is a, c, g, or t
  misc_feature (23)..(34): n is a, c, g, or t
  misc_feature (37)..(39): n is a, c, g, or t
  misc_feature (41)..(41): n is a, c, g, or t
  misc_feature (44)..(48): n is a, c, g, or t
  misc_feature (52)..(52): n is a, c, g, or t
  misc_feature (55)..(57): n is a, c, g, or t
  misc_feature (62)..(64): n is a, c, g, or t
  misc_feature (66)..(67): n is a, c, g, or t
  misc_feature (69)..(69): n is a, c, g, or t
  misc_feature (72)..(72): n is a, c, g, or t
  misc_feature (75)..(76): n is a, c, g, or t
  misc_feature (78)..(78): n is a, c, g, or t
  misc_feature (86)..(88): n is a, c, g, or t
  misc_feature (90)..(92): n is a, c, g, or t
  misc_feature (95)..(95): n is a, c, g, or t
  misc_feature (97)..(103): n is a, c, g, or t
  misc_feature (107)..(109): n is a, c, g, or t
  misc_feature (111)..(113): n is a, c, g, or t
  misc_feature (115)..(115): n is a, c, g, or t
  misc_feature (119)..(119): n is a, c, g, or t
  misc_feature (122)..(123): n is a, c, g, or t
  misc_feature (125)..(128): n is a, c, g, or t
  misc_feature (131)..(132): n is a, c, g, or t
  misc_feature (134)..(136): n is a, c, g, or t
  misc_feature (140)..(140): n is a, c, g, or t
  misc_feature (142)..(145): n is a, c, g, or t
  misc_feature (147)..(147): n is a, c, g, or t
  misc_feature (149)..(150): n is a, c, g, or t
  misc_feature (152)..(154): n is a, c, g, or t
  misc_feature (156)..(157): n is a, c, g, or t
  misc_feature (159)..(159): n is a, c, g, or t
  misc_feature (163)..(163): n is a, c, g, or t
  misc_feature (167)..(167): n is a, c, g, or t
  misc_feature (169)..(171): n is a, c, g, or t
  misc_feature (173)..(173): n is a, c, g, or t
  misc_feature (175)..(176): n is a, c, g, or t
  misc_feature (178)..(178): n is a, c, g, or t
  misc_feature (180)..(180): n is a, c, g, or t
  misc_feature (182)..(183): n is a, c, g, or t
  misc_feature (185)..(186): n is a, c, g, or t
  misc_feature (189)..(189): n is a, c, g, or t
  misc_feature (191)..(192): n is a, c, g, or t
  misc_feature (194)..(194): n is a, c, g, or t
  misc_feature (197)..(200): n is a, c, g, or t
  misc_feature (204)..(204): n is a, c, g, or t
  misc_feature (207)..(207): n is a, c, g, or t
  misc_feature (210)..(210): n is a, c, g, or t
  misc_feature (212)..(213): n is a, c, g, or t
  misc_feature (215)..(219): n is a, c, g, or t
  misc_feature (222)..(224): n is a, c, g, or t
  misc_feature (228)..(230): n is a, c, g, or t
  misc_feature (236)..(237): n is a, c, g, or t
  misc_feature (239)..(249): n is a, c, g, or t
  misc_feature (252)..(252): n is a, c, g, or t
  misc_feature (255)..(255): n is a, c, g, or t
  misc_feature (257)..(257): n is a, c, g, or t
  misc_feature (259)..(266): n is a, c, g, or t
  misc_feature (268)..(269): n is a, c, g, or t
  misc_feature (272)..(273): n is a, c, g, or t
  misc_feature (275)..(275): n is a, c, g, or t
  misc_feature (277)..(278): n is a, c, g, or t
  misc_feature (280)..(281): n is a, c, g, or t
  misc_feature (284)..(290): n is a, c, g, or t
  misc_feature (293)..(293): n is a, c, g, or t
  misc_feature (296)..(297): n is a, c, g, or t
  misc_feature (299)..(300): n is a, c, g, or t
  misc_feature (303)..(303): n is a, c, g, or t
  misc_feature (305)..(312): n is a, c, g, or t
  misc_feature (314)..(315): n is a, c, g, or t
  misc_feature (317)..(317): n is a, c, g, or t
  misc_feature (319)..(323): n is a, c, g, or t
  misc_feature (325)..(326): n is a, c, g, or t
  misc_feature (328)..(337): n is a, c, g, or t
  misc_feature (339)..(339): n is a, c, g, or t
  misc_feature (341)..(341): n is a, c, g, or t
  misc_feature (343)..(344): n is a, c, g, or t
  misc_feature (348)..(349): n is a, c, g, or t
  misc_feature (351)..(351): n is a, c, g, or t
  misc_feature (355)..(358): n is a, c, g, or t
  misc_feature (360)..(370): n is a, c, g, or t
  misc_feature (373)..(375): n is a, c, g, or t
  misc_feature (377)..(377): n is a, c, g, or t
  misc_feature (380)..(382): n is a, c, g, or t
  misc_feature (384)..(388): n is a, c, g, or t
  misc_feature (391)..(391): n is a, c, g, or t
  misc_feature (393)..(393): n is a, c, g, or t
  misc_feature (395)..(395): n is a, c, g, or t
  misc_feature (398)..(403): n is a, c, g, or t
  misc_feature (405)..(405): n is a, c, g, or t
  misc_feature (407)..(407): n is a, c, g, or t
  misc_feature (409)..(410): n is a, c, g, or t
  misc_feature (412)..(417): n is a, c, g, or t
  misc_feature (422)..(422): n is a, c, g, or t
  misc_feature (424)..(425): n is a, c, g, or t
  misc_feature (427)..(430): n is a, c, g, or t
  misc_feature (433)..(435): n is a, c, g, or t
  misc_feature (437)..(437): n is a, c, g, or t
  misc_feature (439)..(439): n is a, c, g, or t
  misc_feature (443)..(443): n is a, c, g, or t
  misc_feature (445)..(446): n is a, c, g, or t
  misc_feature (448)..(451): n is a, c, g, or t
  misc_feature (453)..(453): n is a, c, g, or t
  misc_feature (455)..(456): n is a, c, g, or t
  misc_feature (460)..(469): n is a, c, g, or t
  misc_feature (471)..(471): n is a, c, g, or t
  misc_feature (474)..(478): n is a, c, g, or t
  misc_feature (480)..(483): n is a, c, g, or t
  misc_feature (487)..(491): n is a, c, g, or t
  misc_feature (493)..(494): n is a, c, g, or t
  misc_feature (496)..(497): n is a, c, g, or t
  misc_feature (500)..(504): n is a, c, g, or t
  misc_feature (506)..(507): n is a, c, g, or t
  misc_feature (509)..(510): n is a, c, g, or t
  misc_feature (512)..(515): n is a, c, g, or t
  misc_feature (517)..(517): n is a, c, g, or t
  misc_feature (519)..(522): n is a, c, g, or t
  misc_feature (524)..(536): n is a, c, g, or t
  misc_feature (538)..(541): n is a, c, g, or t
  misc_feature (543)..(545): n is a, c, g, or t
  misc_feature (548)..(548): n is a, c, g, or t
  misc_feature (553)..(554): n is a, c, g, or t
  misc_feature (556)..(562): n is a, c, g, or t
  misc_feature (565)..(565): n is a, c, g, or t
  misc_feature (567)..(575): n is a, c, g, or t
  misc_feature (577)..(581): n is a, c, g, or t
  misc_feature (583)..(583): n is a, c, g, or t
  misc_feature (585)..(586): n is a, c, g, or t
  misc_feature (589)..(591): n is a, c, g, or t
  misc_feature (593)..(593): n is a, c, g, or t
  misc_feature (596)..(598): n is a, c, g, or t
  misc_feature (600)..(600): n is a, c, g, or t
  misc_feature (602)..(606): n is a, c, g, or t
  misc_feature (612)..(614): n is a, c, g, or t
  misc_feature (616)..(618): n is a, c, g, or t
  misc_feature (620)..(620): n is a, c, g, or t
  misc_feature (625)..(630): n is a, c, g, or t
  misc_feature (634)..(635): n is a, c, g, or t
  misc_feature (637)..(637): n is a, c, g, or t
  misc_feature (640)..(641): n is a, c, g, or t
  misc_feature (643)..(644): n is a, c, g, or t
  misc_feature (646)..(646): n is a, c, g, or t
  misc_feature (650)..(651): n is a, c, g, or t
  misc_feature (654)..(656): n is a, c, g, or t
  misc_feature (661)..(662): n is a, c, g, or t
  misc_feature (666)..(666): n is a, c, g, or t
  misc_feature (669)..(669): n is a, c, g, or t
  misc_feature (671)..(671): n is a, c, g, or t
  misc_feature (674)..(675): n is a, c, g, or t
  misc_feature (677)..(682): n is a, c, g, or t
  misc_feature (686)..(686): n is a, c, g, or t
  misc_feature (691)..(692): n is a, c, g, or t
  misc_feature (695)..(696): n is a, c, g, or t
  misc_feature (698)..(704): n is a, c, g, or t
  misc_feature (706)..(709): n is a, c, g, or t
  misc_feature (711)..(711): n is a, c, g, or t
  misc_feature (715)..(718): n is a, c, g, or t
  misc_feature (720)..(721): n is a, c, g, or t
  misc_feature (723)..(724): n is a, c, g, or t
  misc_feature (726)..(726): n is a, c, g, or t
  misc_feature (731)..(731): n is a, c, g, or t
  misc_feature (733)..(733): n is a, c, g, or t
  misc_feature (744)..(745): n is a, c, g, or t
  misc_feature (747)..(747): n is a, c, g, or t
  misc_feature (749)..(753): n is a, c, g, or t
  misc_feature (755)..(755): n is a, c, g, or t
  misc_feature (758)..(758): n is a, c, g, or t
  misc_feature (761)..(761): n is a, c, g, or t
  misc_feature (763)..(764): n is a, c, g, or t
  misc_feature (766)..(776): n is a, c, g, or t
  misc_feature (778)..(779): n is a, c, g, or t
  misc_feature (781)..(782): n is a, c, g, or t
  misc_feature (790)..(791): n is a, c, g, or t
  misc_feature (794)..(794): n is a, c, g, or t
  misc_feature (796)..(797): n is a, c, g, or t
  misc_feature (799)..(801): n is a, c, g, or t
  misc_feature (803)..(814): n is a, c, g, or t
  misc_feature (817)..(822): n is a, c, g, or t
  misc_feature (825)..(826): n is a, c, g, or t
  misc_feature (828)..(835): n is a, c, g, or t
  misc_feature (838)..(838): n is a, c, g, or t
  misc_feature (841)..(844): n is a, c, g, or t
  misc_feature (848)..(851): n is a, c, g, or t
  misc_feature (853)..(853): n is a, c, g, or t
  misc_feature (856)..(858): n is a, c, g, or t
  misc_feature (860)..(861): n is a, c, g, or t
  misc_feature (863)..(866): n is a, c, g, or t
  misc_feature (870)..(874): n is a, c, g, or t
  misc_feature (876)..(877): n is a, c, g, or t
  misc_feature (879)..(879): n is a, c, g, or t
  misc_feature (881)..(881): n is a, c, g, or t
  misc_feature (884)..(889): n is a, c, g, or t
  misc_feature (892)..(892): n is a, c, g, or t
  misc_feature (895)..(895): n is a, c, g, or t
  misc_feature (899)..(899): n is a, c, g, or t
  misc_feature (904)..(908): n is a, c, g, or t
  misc_feature (911)..(911): n is a, c, g, or t
  misc_feature (913)..(918): n is a, c, g, or t
  misc_feature (921)..(926): n is a, c, g, or t
  misc_feature (928)..(928): n is a, c, g, or t
  misc_feature (930)..(932): n is a, c, g, or t
  misc_feature (935)..(939): n is a, c, g, or t
  misc_feature (941)..(941): n is a, c, g, or t
  misc_feature (943)..(944): n is a, c, g, or t
  misc_feature (946)..(946): n is a, c, g, or t
  misc_feature (948)..(948): n is a, c, g, or t
  misc_feature (950)..(950): n is a, c, g, or t
  misc_feature (952)..(952): n is a, c, g, or t
  misc_feature (954)..(957): n is a, c, g, or t
  misc_feature (960)..(960): n is a, c, g, or t
  misc_feature (962)..(964): n is a, c, g, or t
  misc_feature (966)..(967): n is a, c, g, or t
  misc_feature (972)..(973): n is a, c, g, or t
  misc_feature (975)..(978): n is a, c, g, or t
  misc_feature (980)..(983): n is a, c, g, or t
  misc_feature (985)..(985): n is a, c, g, or t
  misc_feature (987)..(988): n is a, c, g, or t
  misc_feature (991)..(1000): n is a, c, g, or t
  misc_feature (1002)..(1005): n is a, c, g, or t
  misc_feature (1008)..(1014): n is a, c, g, or t
  misc_feature (1016)..(1016): n is a, c, g, or t
  misc_feature (1018)..(1018): n is a, c, g, or t
  misc_feature (1020)..(1020): n is a, c, g, or t
  misc_feature (1025)..(1027): n is a, c, g, or t
  misc_feature (1031)..(1033): n is a, c, g, or t
  misc_feature (1035)..(1043): n is a, c, g, or t
  misc_feature (1046)..(1048): n is a, c, g, or t
  misc_feature (1051)..(1051): n is a, c, g, or t
  misc_feature (1053)..(1056): n is a, c, g, or t
  misc_feature (1058)..(1058): n is a, c, g, or t
  misc_feature (1061)..(1062): n is a, c, g, or t
  misc_feature (1064)..(1066): n is a, c, g, or t
  misc_feature (1068)..(1068): n is a, c, g, or t
  misc_feature (1070)..(1071): n is a, c, g, or t
  misc_feature (1075)..(1080): n is a, c, g, or t
  misc_feature (1083)..(1085): n is a, c, g, or t
  misc_feature (1088)..(1090): n is a, c, g, or t
  misc_feature (1093)..(1093): n is a, c, g, or t
  misc_feature (1097)..(1097): n is a, c, g, or t
  misc_feature (1099)..(1099): n is a, c, g, or t
  misc_feature (1102)..(1103): n is a, c, g, or t
  misc_feature (1105)..(1105): n is a, c, g, or t
  misc_feature (1108)..(1108): n is a, c, g, or t
  misc_feature (1111)..(1113): n is a, c, g, or t
  misc_feature (1117)..(1120): n is a, c, g, or t
  misc_feature (1122)..(1122): n is a, c, g, or t
  misc_feature (1125)..(1125): n is a, c, g, or t
  misc_feature (1127)..(1127): n is a, c, g, or t
  misc_feature (1132)..(1132): n is a, c, g, or t
  misc_feature (1137)..(1137): n is a, c, g, or t
  misc_feature (1139)..(1139): n is a, c, g, or t
  misc_feature (1141)..(1141): n is a, c, g, or t
  misc_feature (1144)..(1144): n is a, c, g, or t
  misc_feature (1149)..(1150): n is a, c, g, or t
  misc_feature (1153)..(1154): n is a, c, g, or t
  misc_feature (1156)..(1156): n is a, c, g, or t
  misc_feature (1159)..(1159): n is a, c, g, or t
  misc_feature (1161)..(1164): n is a, c, g, or t
  misc_feature (1167)..(1169): n is a, c, g, or t
  misc_feature (1173)..(1173): n is a, c, g, or t
  misc_feature (1175)..(1177): n is a, c, g, or t
  misc_feature (1179)..(1179): n is a, c, g, or t
  misc_feature (1181)..(1181): n is a, c, g, or t
  misc_feature (1183)..(1183): n is a, c, g, or t
  misc_feature (1187)..(1187): n is a, c, g, or t
  misc_feature (1189)..(1189): n is a, c, g, or t
  misc_feature (1191)..(1193): n is a, c, g, or t
  misc_feature (1201)..(1201): n is a, c, g, or t
  misc_feature (1206)..(1207): n is a, c, g, or t
  misc_feature (1210)..(1210): n is a, c, g, or t
  misc_feature (1212)..(1214): n is a, c, g, or t
  misc_feature (1244)..(1244): n is a, c, g, or t
  misc_feature (1455)..(1455): n is a, c, g, or t
  misc_feature (1989)..(1989): n is a, c, g, or t
  misc_feature (1993)..(1993): n is a, c, g, or t
cngnnnntnggncnnnnnnntgnnnnnnnnnnnnagnnntncgnnnnntgcnaannngaatnnnanngnganccnnantttgcccnnnannntgncnnnnnnnatgnnnannncnatgnccnncnnnnttnncnnncggntnnnnangnntnnnannangggntttngnnngntnngntntnngnnggngnntnggnnnncgcnaangancnngnnnnngannnggannncaaaanngnnnnnnnnnnnccngangntnnnnnnnntnntgnngntnntnntgnnnnnnntgnttnnanntcngnnnnnnnntnngncnnnnngnngnnnnnnnnnncntngnnttcnncntttnnnncnnnnnnnnnnncannnanggnnncnnnnnaantnanggnnnnnngnangnncnnnnnnttggncnngnnnntgnnnangntggngnncnnnntngnnaccnnnnnnnnnncnggnnnnncnnnncccnnnnnannannccnnnnntnnanngnnnncnannnngnnnnnnnnnnnnngnnnntnnnttnggggnngnnnnnnnggnannnnnnnnngnnnnngncnncgnnnanttnnncnannnnnttgtcnnncnnntnggggnnnnnntcgnngnganngnngntgannacnnnggggnnaacnaangngcnnannnnnntttncagcnngtnntnnnnnnngnnnncngggnnnncnncnngncgcangncggggggcagnncngnnnnnancancgncnngnnnnnnnnnnngnnanngttggagnnatngnncnnntnnnnnnnnnnnngtnnnnnnccnngnnnnnnnnccngcnnnncggnnnncncgnnngnnannnngcgnnnnnanngncngannnnnnggncgncganggggnnnnngangnnnnnnaannnnnncntnnnaannnnntnannanangnangnnnntangnnngnntttanncnnnncnnnnantnnttnnnnnnnnnntnnnnttnnnnnnngncntngtcgnnnaaannntnnnnnnnnnggnnntcntnnnngncgnngnnnangnncctnnnnnnggnnntcnnnaangcgntnttnnanaangtnnnccannnngnggntnagcangaggntncnaangcccnnganncnttngnnnnaannngggncnnngntngngagntngnnngagaggcnaagcnnccngnnngccacgagcactgctgcgccgttaaagaanatgatgagggcgttgtctgattttgtgttggtcatcgtttttactccgattgaatagttattttgtggatttgatgcggtcgaggacggattgggcggtgacgcgggtggcgtcaccgtagcccgcgtcggccatacggtctgcgattgagccatggtttaggtccttattgatgtccgacagaatttcgctgtgctcaaaaggatcatcncggccaagcacgcggccaatgagttcttcggcctcttcgacgctgcttgaattactgtgcattggtcccatccgcatttggatatcttgttcgcggcggacagcgcgggcttggatagcaccttgtttcaggtcgataatgcggcggtggcctgcctcgatactagagcggaggcgcaggaccttttgctctagacggcgcagtgtctcggtgcggatcgtcagttcgttttccatttgtgcgatggcatttgcagcctcaatcgccatgtcttcgttacccgcatcgagtgctactttggcgcgtttggtcaggtcgttgaccctgttttgcaggccgctgcgttgctgttcttcagagcgttgacgctggatcaggcttgcgagggtggccttggcggccttgaggttgccctcggcttcgcggattttctggtcgatcaattcgatcgcaaaggcgtcgcggaccctgtcttctgtacgggcattcgcgccgaggatgagtgtactaagtgtcttgaacatctgtctctcnattngtgaacgttgttcatgaacttgttatagaaagaccagccctgtcccgcaagtaaaaaattgaacaacgttcatatttttacgaagaacgcgccaattgccttaaaataagggcgatcatggtatcgatattgtcggtttgcacgcccgcattggcctcatccagccccaaaagcacgatcccatgcacggatgagaatagtcctttggtcaaaagtagccgctgattctggtccatcgcggggaaaatcgccataagcgggtcgtggatataggtgaagagctggctgagctcggtcacataccattcgggggccgcttcccctttgggcctgtcgagatcaaagagcgcccgccacaggttatgatgctcggccgcaaaggcgtggtaggcctgcgccatgacaacgagttgctcgacgggggcttgcggggcagttgccagcgaggccgcaacttcggcacccaacgcatgaaacgttcgcgcattcacggccagaaccaaatcgttcagatcgccaaagacgttatagattgcccccagcgcacagcccgcctcggtcgccaaatcgcgggccttgaggcctgaaagcccttcgcgggcaatcgtcgcctctgcgatattgatcaaatcttcccgcagcgccttacgccgttctgcgaccttacctgccattgcgtgtctcccgttgaacgtggttcactatagaccagcaatggcaaacaagaaagtcaggctttcacaggggcgccgcctgcgaagttgttgacctcgtggtagctgataggctcgttttgcatttgcaggtgcaacccgtcgccatcatagggatgcgcgcgcgcgaggtcttcgtccacatcaatgcccagtcctgcggcagtggggacggggatatagccgccctcaacgcttaggctgttcttgatcagggcaaagtggaagtcggtttcaatggtttcggccatcaggatgttcgggattgatgctgccagttgaatgttggccgcccattcaatcgggcctgcataaagatgcggcgccatctgcgcgttataggtttcggcgatgacagcgattttcttggcttcccagatgcctcctgcgcgcccaagggcgggctgcaagatttgcacgccagctttgagggctgcgacgaattcggatttggtcgtcagtcgctcgcccgttgccacagggacacggacagcgctggtcacagccgacatatcggcatcgggcggcgtgggttcttcataccagagcggcgagaagggctccaaagcttggccgatgcggatcgcgcctgcggtgctgaactgcccgtgggtgccaaaaagtaggtccgcctgattgccaactgcttctcggatcgttctgcaaaaggtgaccgaagtgtcgatgtcgtgcatcgacggcatatgtccgccacggatcgtataggggccagcggggtcgaatttgacggctgtatagccttgcttgaccagcgccacggcactttcggccgccatatccgcatcggcccaaaaggcaggcagcgggtggtgtttgagcggatagaggtaggtgtaggcgcggatgcggtcgttcacgcgtccgccaatcattgcatgcacagggcggttgcggtccttgccgaccatatcccagcaggccatctccaagccagaccacgtgcccatgaccgtcaggtcagggcgttgggtgaagcctgtcgaatagacgcggcggaacatcagttcgatattctcgggattttcgccagccatatgccgcgcaaagacatcggtgataacggctttcattgcctctggcccgacggaggaggcgtagcactcgccccagcctacgatgcctgtatcagaggtgactttcaccaagatccaataacggccaccccaaccgggtgcaggtggggcggtgatgatgatgtcgagatcgctgagtttcatggcggtggtcctgcgtggttattgccctcacagtgccaccgcatgaaatggatgca

SEQ ID NO: 298 - DNA, 4000 bp, Escherichia coli
  misc_feature (1921)..(1921): n is a, c, g, or t
  misc_feature (1923)..(1924): n is a, c, g, or t
  misc_feature (1929)..(1930): n is a, c, g, or t
  misc_feature (1935)..(1936): n is a, c, g, or t
  misc_feature (1944)..(1944): n is a, c, g, or t
  misc_feature (1948)..(1948): n is a, c, g, or t
  misc_feature (1950)..(1951): n is a, c, g, or t
  misc_feature (1956)..(1957): n is a, c, g, or t
  misc_feature (1962)..(1962): n is a, c, g, or t
  misc_feature (1977)..(1978): n is a, c, g, or t
  misc_feature (1986)..(1987): n is a, c, g, or t
  misc_feature (1990)..(1990): n is a, c, g, or t
  misc_feature (1995)..(1996): n is a, c, g, or t
gtcttcacattcgtttcaaagtccaccactgttatagggacattgagaatatccatcaatcttgtctcttttacatcgaagaacttctttccgtcctttgttctaccactctgtttgatacctttatctgcaaaactcatatcattatttgttattgttctccataaattcttacaatctccccacttacaccagccccagtatgaagctcgtatctcgcggttacgtttccggctttttattcgtttcacctttcgggcaaagttctttttcatatttttacgcatccgaacattatctttcgtgaagcaatagcccaaaaagttaatccttcttcctcttactacgttttcgctttctatgctttttgttcccattttttgtttctgttcctatcggagcaatacaactgtttgctttaactaccaacccaacttttgcactttcccgttcatacgcacgaataagaaacaacgcttcggccttagaacgagccagcataacattatcatcgcaatatctatgcaggcatttgacacgatatttctccttcattgtatgatctatccggcttgccgcaaaattcccgataggttggcttgtaaatgctccaatcggaacacctcttcttccgttcaacttcattctccaatacgtcaactaactctgttccgctgtcatacgataaaacagctatctcgatcaatttaataaatcgttcatctttgaatttccttctcaatgcagcaacaataagctcatgaagaatactttgatagaactttttgaaatcagtctttacgaaccatttgtattccgggtaccggtgaagaaaacgtttcattctccttactccaaaatgtaatccctttcccttgatacacgcacttgtatcataaatcaaatttctataaacatcttcttcaatcaccctcataattgcatggtgcaatatacgccacgggaaatatttctgtttgacaatatctcgaacctttcctgcatcactttttactctcattacgctataatccggtgccggaaaatccaatgtcaggatcatcaactgcaaagctcggaggtcttcttccgggtgtagattatgccgcctgataaagcggtttttcttaaccttcccatcttgtgcttctttgtccgcttcacgtaaattatttatctctgctatacgttcaagaatatacccggctcttttagatttctttccaccgtttgcttctatccgtttattgtcagcctctatcctttccgctataattctatcaatttcattatgcgatagactcttccaatcaatatcacttcttccaatattcactgctgctttgttttaaaatttacaccatacttccaattttgtcttgttcagactattttaattattccgataactgcaagctgtttttacttgcttgaataattcgcccggagctttcgagaaccaacctactaacaccgcttgttgcctttcgcaaattgggcaacctttccgcattcttgattttctgacatcgtaaccaattgattactacgttgcaacgatataaatcctgcaaggtcatggctcggagaactcgcagattactctacgataaataagtatggcgagagccgatattcgcattcgagttcgaccaatcgttattcgagttcgcataagcgaggccgcaattcgcaccgttattcgcattaccgccccaaagaaccagctcttgttcccctctgccaaccgtccacgcctttcggctttcgtcccgttatccgttgccgtaaaacgagaaggtggacgggttttaattaattgaaattcaaagaactaatatttcaaaatctattatgcagccatcaaagatgcaccgctaacaaatgttaaattcccaaaatacgcaaggcgagagccgananncgcanncgagnncgaccaancgtnanncgagnncgcanaagcgaggccgcaanncgcaccgnnatncgcannaccgccccaaagaaccagctgcccagtagtgtttgcccatgaataatcagcccaataagaagtgctgtttccaccaatctttttcgggaaaatatcaaaatgctccccaagaattatttcctgcacttgaccggaagctgtctgacgggtagcttgtctgtattcaccatttggatgcgcagctaattcagcagtagtcggtaaacggtttcctttgtaaatgaaaatttccgttccactttgagcactattgttggaactaccgcaaaatactccttgcagaaattcccactgccacccataaggatcttctatacccatcatgttcacccgtgaacaatccactccagtattacttccattcaccacagaaatagctattttgccccaattgtcaccgagactctttgttgcgccagtttgcaatgctgccgcagcagcccacaagtctttactggagctaccacccacaccataaccaagtttggcttgaatattggtatctccgtactgggacagccccaacatcataataagctttctctgatcgtaatcggtcagtccccattccttaccgttcacttgtgcagcattccaaaatgcgttgattgtcttgctgcctgccggtgcaactcctgaacgtgaaacaagtgcgctacctgacatggagcctttgtatgcaccgatacagttatacattccaccatttgccccaccaataaactcaccgccaataggtagcatcgagagccataagactggtacaccacttacactgtcagtctgtacacgataatacaaacgtggccctatccacatcacatgccctttggtttcatccaccgcagtaccatcagcaaacaccgcactattggtaggggacattttagcagcccttccatcattcgttacgagataacggccacaatacaacttgtattctgtccatgcggctgtattacctatcacaccatagttcgtgctactttgggttgattgtttgattggaatcccccaagccacctgcctcaacatttgttcgtcaccattattaatagcattcatgaagttttccacggtaatgcgtctgacactaccaccaacttccaccaatactgtattggaacgcagaatggaggtcaccaatgtttcatttcctaatcctttagttgccataatattattttgtttttatgttaattaaaatgacattctgccaaaacatcaacatcatattgagtcccgtttctgtcagtttccgttgttgttacagatatagaatttgttgtagaatgtttcaaactcttccagttttccttatccatcacatccatagtccacgatgcggaagtaggagtataagttgaccccgtagtcatatttacaatcttggcacttactgtaacgggttgtccggtatcaacctctttgttggaagaagttatataacatacaatttgaaattcatctgccgtatcaatgatacgtaccccggcacgtgctatcggttgtgaagcacttgaagactgataaacttctgctatgaataactgggtaccgtccacatcaccacgggtaacagttacacttttctgtccgttcttatcagtccaagccgccgtgtccttataccattttatatagtaatcggtaatggcattggcaccggcatacagcttggtagtcagagtacaacttgttactttgcttgttaactgttcggtacttgcaagaatagcaagatagtaagagctggctcccatattctgaatggcaataggcagttccccggtcaaattatactcaacacctgccgtagaagcgacacatgaataagtcaatgtatctcctgcaatattcgttttgcttgccaagtttccgacaattttaatggcaccggtactggtattcaaagagaatttgcccgtactgtcttttttccaacctccactttccgcaccgttaaaatttaaagccactccattgtaagcccaactatgacca

SEQ ID NO: 299 - DNA, 4000 bp, Escherichia coli
  misc_feature (302)..(302): n is a, c, g, or t
  misc_feature (380)..(380): n is a, c, g, or t
  misc_feature (614)..(614): n is a, c, g, or t
  misc_feature (650)..(650): n is a, c, g, or t
  misc_feature (877)..(877): n is a, c, g, or t
  misc_feature (1097)..(1097): n is a, c, g, or t
  misc_feature (1253)..(1253): n is a, c, g, or t
  misc_feature (1364)..(1364): n is a, c, g, or t
  misc_feature (1394)..(1394): n is a, c, g, or t
  misc_feature (1400)..(1400): n is a, c, g, or t
  misc_feature (1424)..(1424): n is a, c, g, or t
  misc_feature (1467)..(1467): n is a, c, g, or t
  misc_feature (1640)..(1640): n is a, c, g, or t
  misc_feature (1646)..(1646): n is a, c, g, or t
  misc_feature (1658)..(1658): n is a, c, g, or t
  misc_feature (1862)..(1862): n is a, c, g, or t
  misc_feature (1883)..(1883): n is a, c, g, or t
  misc_feature (1946)..(1946): n is a, c, g, or t
  misc_feature (1991)..(1991): n is a, c, g, or t
  misc_feature (2201)..(2201): n is a, c, g, or t
  misc_feature (2213)..(2213): n is a, c, g, or t
  misc_feature (2465)..(2465): n is a, c, g, or t
  misc_feature (3101)..(3101): n is a, c, g, or t
  misc_feature (3158)..(3158): n is a, c, g, or t
  misc_feature (3440)..(3440): n is a, c, g, or t
attcgactatggctacaattcatgtcgatggcaaatcgtacgaagtcaatggctcagagaacttgctgcaagcatgtttgtctttgggtattgatatcccgtacttttgttggcatccatccttaggttctgtcggttcttgccgtcaatgtgccgtgactcaatacgcgaatcctgaagatacgcgtggtcgtttagtcatgtcatgtatgacgcctgcatctgacaatacctacatctcgattgaagacaaagaagcgaaagacttccgtgcgtcaattgttgagttcttgatgacgaancacccacacgactgtccagtctgtgaagaaggtgggcactgtcatttacaagatatgaccgtgatgactcaacacgancgtcgtcgttaccgtttcactaaacgtacacactacaaccaagagctgggctcattcatttcacacgaaatgaaccgttgtatcgcatgttaccgttgtgttcgttactacaacgactatgcgggtggtactgactttggtgtgtatgcaagcgcgtcacgtgtttactttggtcgtcctgagtcaggcactttagagtctgaattctcgggtaacttgactgaagtatgtccnacaggtgtattcaccgacaaaactcactcagaacgntataaccgtaagtgggacatgcagtatgcgccaagcgtatgccaaggctgttcttcgggttgtaatatttctccgggtgagcgttatggcgaacttcgtcgtgtcgaaaaccgtttcaacggtgaagtgaaccaatacttcctttgtgataaaggtcgttttggtacaggttatgtgaaccgtgcagatcgtccacgtcaaccgcagttccgtgatggtgctgaagnaactacagtttctgtagatcaggcattagataccgtgattgcaaatatccaaggcaaaaaagttttgggtattggttctccacgtgcatcacttgagtcgaacttcgcgcttcgcgaattagttggtcaagagaactattcaacaggtatgtctcaaaaagagcaaaacttggttgaattggctgcatcgattatgcaaaccgaaggtgtatataacccnggtatgcgtgaaatcgaaagctatgatgctgtgcttattttgggtgaagacttaacgcaaactgcgccacgtatggcgttgtctgttcgtcaagcggcgaaaaacaaagccaaagaaatggctgcggaacgtcgtactcaagactggttagcaganccgctacaacgtattgctcaagatgcgaaatcaccgattttcatcctcgctgcaacgcaaacacgcttagctgatgttgctgcaggtgaagtggttgcttctccaaacganatcgctcgtttaggttttgccgttgctgcngctgtnaaaggtgatgcaattcttggtctngcggatgatgcgaaagcatttgctcagaacattgcagatacantgaaagcggcgaagaaaccactgatcatttcaggtacaagtttacaagacgcatcaatcatggaagctgctgcacaagttgcgcaaaaccttggtggaaatgctggcttaagcttgacggttcctgaagtgaactctatgggcttagcaatcttcggtggacaaagcttagancaagcntttgcacaagantatgacacggttgtgatcgttgaaaatgatctattccgtcgtttgccagcggtacaagttgaagcagcactttctggtaaagacgtgattgttttagatcactctgaaactgaaactgtgaagaaagcggatatcgtactttctgctgcgtcatttgctgaaggtgatggtacggttgtctctcaagaaggccgtgcacaacgnttctaccaagtgtatgacccnagctactacaaacctgaactggcgatcaaagaatcttggcgctggttacatgccattgaaacnggcgtgaagggcaaagcgatttcttggaccttgcttgatgatgtnatcgagtcagttgcgaaaaacgtacctgcacttgctgcgattcaagatgtggctccagatgcgggcttccgtgtccatggtttgaaagttgcgcgtgaaccgcgtcgttactctggtcgtacctctatgcgtgcaccattgaacgtgcatgaaccgaaacaaccgacagatatcgactcggcattaacattctctatggaaggttatgtngggaaccagacnccgtctccactggtaccatttgcatggtcagcaggttggaactcaccgcaagcttggaataaattccaagataacgtgggtggtcacttaaaaggtggtgattcgggtgtgcgtttattcgatcgtttagcgaagcgcccagcacgtactttcgttgctccagcggttgtggttgcaaaccctgaaagcttccgtttagtgccgatgcatcacatttttgcttctggtgaatttactgtgaaaacacctgcnatggaatcgcgtattcctgaagcggtctttgcagtgggtgagcaagatgcaactcgtttgaatgttcaagatggtcaaaaaatcactgtgaaagcaggtgagacttcgatcgtacttccagttcaagtgattgattatttacctacaggttatattggttatccagttggtcttgcacctacggtttcacttgctgagcctgtatcagtcgcggtaggagcgtaattcatgcaacaagaattaatccgtcaaacgccgctttgggctgagaactggccaattgcctactcagtcattcaagcgattgtgattttactcgttgtagtactcatcgctgcgttgatgtcttttattgagcgtcgtttactgggcttatggcaagaccgttatggtccgaaccgtgtaggtcctggggggatgttccagatcgttgccgacatgttgaaaatcatgttcaaagaagactggacaccaaagtttgctgacaaattgactttccgtttagctcctgctgttgccatggcaacagcggtgatgtcgttcatggttattcctgtatcaccatacttaggtgttgcagacatgagcatcggtctattgttctttatggcaatggcaggtattgcagtctatgcngtattgtttggtggttggtcatcaaacaacaaatatgcattgcttggtggtctacgntctgcagctcaaaccatttcgtatgaagtgttcttgggtatttcattgatgggtgtggttgcaattgcaggctcattcaacatgcgtgaaattgtagaagcacaaaaagatgtatggtttgtcatcccacagttcttaggtttcttaatcttcgtggttgcaggtgttgcggtaactcaccgtcacccatttgaccaaccagaagcagaacaagaattggcggaaggttaccacgtcgagtacggcggtatgaaatgggggatgttcttcgttgcggaatangtcaacgtagttctgatctctgcattgatcgtcacgctattcttcggtggttggttagcgccatttaacatcgatattccgttcattccaccagtattctggttcattatcaaaacagcattctttgtgatgatgtttgtcttggctcgtggttcacttatgcgtccgcgttatgaccaagtgatgaactttggttggaagatttgcttaccattagcgttagttaacttattagttactggcgcagtgattctgtggtaagggcagggagaataaaatgtataaaattctagctgggttcgggtcaatcgtacgttcactgtggatggttttctcacacgtgacacgtaaacgtgacaccattctttacccagaagtgccagccgaacaaattgttccaccacgtttccgtggtcgtatcgtgttaacacgtgacccagatggtgaagaacgttgtgttgcgtgtaacttatgtgcagttgcatgtcctgttggctgtatttcactacaaaaagcagaaaaagaagatggtcgttggtatccggagtttttccgtatca

SEQ ID NO: 300 - DNA, 4000 bp, Escherichia coli
  misc_feature (1443)..(1443): n is a, c, g, or t
  misc_feature (2517)..(2517): n is a, c, g, or t
  misc_feature (2634)..(2634): n is a, c, g, or t
  misc_feature (2658)..(2658): n is a, c, g, or t
  misc_feature (2693)..(2693): n is a, c, g, or t
  misc_feature (2727)..(2727): n is a, c, g, or t
  misc_feature (2745)..(2745): n is a, c, g, or t
  misc_feature (2757)..(2757): n is a, c, g, or t
  misc_feature (2778)..(2778): n is a, c, g, or t
  misc_feature (2808)..(2808): n is a, c, g, or t
  misc_feature (3075)..(3075): n is a, c, g, or t
  misc_feature (3102)..(3102): n is a, c, g, or t
  misc_feature (3129)..(3129): n is a, c, g, or t
  misc_feature (3246)..(3246): n is a, c, g, or t
  misc_feature (3291)..(3291): n is a, c, g, or t
  misc_feature (3313)..(3313): n is a, c, g, or t
  misc_feature (3403)..(3403): n is a, c, g, or t
  misc_feature (3780)..(3780): n is a, c, g, or t
  misc_feature (3867)..(3867): n is a, c, g, or t
  misc_feature (3990)..(3990): n is a, c, g, or t
agatgtgaccacacgatcccctgcccgaacaagatcggggttttcaatgaaatcaaccggcggcgcggcagtattgtcgcccacaacaaaagcacgctgtccagagggttgaacgattgcaggaatttggctgtacgggtccgtcaacaaaataacacggctggtgcgttgacccacacccgaaatgcggcccaccaaacccaagccatccatggcggcccacccgtcacgaatgccgtcttgggcaccgatgttcaacaacaccgattgccgaaagggcgatccgctgtcggccatcacgatgccagaaatatgggtgaattttggatccaatcgcagattgttcaaatccaaaagacgcgcgttttcttgttctaactgcagcgccgcctcgcgccagcttttcatttgttgcagttcgcggcgcagctcttggttttgctcatagagcgacgcataactttggaaatcccgaataaggttgatcgtacccgtcaccggcgccatggcccatgcgaaactggggacatattgatcaatcacatgcgcacggaaccgttcgacgcgcgggctgtcgatgcgccaaatcacaaagatcgcaaacataaccaacaccaacaccaccgtaatcaaacggcggagcggtgttacataatcatcttgctttccacgatgttgggccaagcctacctcttagtcagagagcacttgccttagctgtcgtagtctatggcgtggcgcagttgtttttcatattctagcgctttgccagtccctatggcaacgcaattcaagctttcgtccgcgatggaaacagccaaacctgtctgttcgcgcagcgcaagatcaagatcacccaacaatgcgccaccacctgtcaacatgacgccacgatcaacaatatccgcagccaaatcaggcggcgtgacttctaatgcggtcatgaccgcttcgcaaatctgctggactggctctgacagtgcttcggcaatttgggcttgggttatttcgatttccttgggcacgccattcaacagatcgcgcccacggatcatcatggatgcaccacggccatcgttgggcatacgcgccgtcccgatcgaggttttgatgcgctctgcagtgctttcgccaaccaataggttttgctggcgacgcagatagttgatgatcgcctcgtccatacggtcaccgcccacacgaacagagcgggcgtaaacaatgtcacccaatgacaaaaccgcaacttcggttgtaccaccgccgatgtcgacaaccatgttgcctgtcggatcggtgatcggcatgccggcaccaattgcagcagcaatgggttcggcaatcaatcccgccttgcgcgcacctgcggacaaaaccgattgacgaatcgcgcgtttttcaacgggtgtcgcaccatgtggtacacatacaatgattttcggntttgagaatgtggaccgtttgtgcaccttgcgaatgaaatgtttgatcatttcttcggctacgtcaaaatcggcaatgacaccgtcgcgcatcgggcggatcgcttcgatcgaaccgggcgtgcggcccaacatcagtttcgcatcttcgccaacggccaagacctttttaacaccatccttgacatgatacgcaaccactgacggctcggacagaatgataccgcggccttttacgtaaaccaaagtattcgcggtccctaggtcaatcgccatgtcctgcgaaaacagtcccgtcaaagatgaaagcccaaacatatgctgattatatccccaaatttatggtacgatgcgactcgtcccgtcgaccccaataagttgccaatcttataggtcccaattttgcaacatgaaagaggcgaagtccattttcgacagtgattcaagaattattttgcctttaggcttaagttcgccgacacccaaaaggcccgcataaacacgtgtcgatttacgacgtcacagcggtcaaattgcgcccgcatccccgcaagaggatcgttttttccatcaagaaatagggcataaagtcgtgttttcggaaataagtcgcaaaattgcgataggtagtcggctgaggtctgttaaaatttgcaatcctgctaaacatcatcccaattcaatattggagtcgtctatgaaaacgcacgtaaaagcgctggtcgttggtggtggcgcggttgggtcttccatcgcataccatttggcaaaagctgggtggaaagatgtcatgttgctggaacgcgacgaattgacatcaggatcaacatggcacgcagcaggtttgttgccactgttcaacatgtcctatgcgaccacgcatatccacaaatactcggtcgatttctacaaaacgctagaagaagaaaccggtttgaatgcgggtttctcgatcgtgggtaacctgcgtatggcacaaacccaagaccgcatggacgaatacctgctgtattcatcagttgcggaaacagcgggggtgtatcacgaattcctgacaccaaaagagatcaaagancgctggcctttggttcggaccgaagacctaaagggtgcgttgttccacccccaagacggctatatcaaccctgcggatgtcaccatggcgatggccaagggcgcgcgccaacgtggngttttgatcgaacgcaaatggcangtcgacggttacgaatggacagggtccgaatgganagtcacctgtaccaagatggtggaaaagggcggnaaccttgttcagtctgangaacaaattgtnatcactgccgaacatgttgtnaccgcgacaggcaaccacgcacagcggacngcgaaactgttgggcatcaagatccccgcgatcccagttgagcaccaattcattgtgaccgaacccgatcccatgttgcaagaataccgtgcaaacggtggcgcagaacaccccgttttacgtgatgccgatgcaaaatggtacgtccgcgaagaacgtggcggctggattttgggcccatacgaacgcaatgcacctgcgcgtttcgaatacggcgtgcctgacagcttccgcgcggatctgttcccgcttgatctagagcgcatngaagaagaatacatgtccatgatccancgtcttccgtcatcggaaactgtgggnttgaaagacgactttaacggtccgatctgttacacacccgatggcaaccccttggttggcccagcgcccggtttgcgcaatatgtggttggccgaaggctttagctttggcatcacngcggctggtggtacaggctattaccttgcccagttgatggtcaanggcgaagccgaaatcgacatgncgtcacttgatccaaaacgctatggcagctggatgaccaccgaatatgcagcacgcaagaacgaagaatgctatgagcacgtctttatcntgcatcaccccgacgaagaacgcgaagcctgccgccccttgcgcacagcacccgcgtacgagcgtcaaaaagcccgtggcgcacagtttggccaagtgaacggttgggaacgccccaactatttcgggccgcttgatgcctctgacagctttgatcacgatagccgcagcttccgccgtggcgcgtggtggcaacatgctgtggacgaagcaaaagcgatccgtgaaactgcaggtttgatcgatgcaacagcatttaccaaacatatggtcaaaggcccaggcgcgaccgcattcttggattggttcacctgtaacaagctgccatcggttggtcgcatcaacttgacctatgcgctgacacctgcgggcaccacncgcaccgaatacaccatcgtgcgcacaggcgaaaacgaatactatttggtatctgcaggggcgtggacagattacgatgcggattanctgcgcaaatgcgcagaggataaggccgaagaattcggatatatcgaaatccaaaacgtcacaacgcaatatggtgttttcgccatcgcaggaccaaaatcacgcgatgtcctgaaagaaatnatcaaagacg

SEQ ID NO: 301 - DNA, 4000 bp, Escherichia coli
  misc_feature (29)..(29): n is a, c, g, or t
  misc_feature (32)..(32): n is a, c, g, or t
  misc_feature (38)..(38): n is a, c, g, or t
  misc_feature (478)..(478): n is a, c, g, or t
  misc_feature (484)..(484): n is a, c, g, or t
  misc_feature (488)..(488): n is a, c, g, or t
  misc_feature (841)..(841): n is a, c, g, or t
  misc_feature (1684)..(1684): n is a, c, g, or t
  misc_feature (1992)..(1992): n is a, c, g, or t
tggcactggcgttgccgtcatgcccggcntcnttcagncaggcattcgataactgtgaagggcgttaccagtacgacaacggtgatgcgtactctggcgagtggcgggccggtaagaaacacggccaggggacttatgtgtgggctaatggtcagcgttacgaaggccaatgggtagacggtcgtaaagaggggtttgggagatacttttggcctaatggcgacctctttgagggccagtttctaaacggcatctatcatggcgaaggcaccttaacctatgtgtcgggaaggaaagtggtcggcgagtgggtcgacgggaagcctttcaaggcaacctcttttgatgcgaacggcaaggccgcatacgcctataccgacggtgtgccgcagtgcctcaaggcacagggctgatcgcttgaaaaacccagcgcctcgactgattcgttttttctgtcttgtactcggcctcagtgcgnctattnctgncggagcacatgcagatacggtgccagagactctgatcggcaaggtggtctttatgcgtcatgcgctggctccaggcaatggtgatcccaataactttgacattaatgattgcacgacccagcgtaacctgaatgaggacggtcggcagcaggcccgcttaacgggtcaaaagcttaaagcacttggtattgcctttgaaaccatttacaccagcgagtggtgccgttgccgggagacagcaaagatgctggcagtgggcgaggcggtcccgttacgggcgctcaattcgttttacgatcattatttctcccgcgatgaactgttaccgctgctggaagaaaaattatcgcagntaaggccgagtgatcctcccattctgatggtcacgcattttgtgacgattatgggtattaccggaaaatccgtgagctcgggggatctggtggtttacgatccggccacgggtgagtccgagatgcttcggctctgacgcctatcatgtctgcctcgcctgaccgctagataccaaagcgcgaacgaacgtgggacgtctttatctcattcgacacgcccagtcgcgcaataaccagaactggaccggcagcgattttcatcccgatcgggagccggacccggatatcacggatctgggtcacgcccaggctcgagcacttgctggccatctttcggatcctcaggcagagcctcgtcagcacccttttgcgccctcgggcgaagcgggataccggctcacgcatgttttttgcagcctgatgagccgctctatcctgaccgcgcaatacgttgccaaggcctgcggtctggatttgtcggcccagcctgaggtattcgaaaagtacggtatttatgagtttgacgacgcgcagaatcggatcggactacctgggccgggacgccgttattttgaagaccgtttccccgcgttgcgactgcccgagtcagtggaagagggtggctggtggaatcgacccgtggaggacgaagaggcattcattgagcgaatgcgcgcagtggtcagtcaattcagaaatacgcttaatgcgcgagaggatcatgtggcgctaatcgctcatggggattttattgaccagtttattaatgagcttatgggagtgccccgccacgtgggcaattatcaaacgcattgggtagccaactgggcgtttcataacacntccatatcaagagtggactttgtgagtggggcgcagcacgtggtttatctcaaccgggtggatcacctatctcccgagcttataacctggtgactcagctagggactcggccgcgattacctgcctaagaaaagaaccgcaaacaacacgagcgaaatcaagaacatgacccaactgcgcttgtactgtttctggtaaagcagtatctgccgcttaagctgatcattttcggctttcagggaggcgagttcgtcgtttgttttggtgtgatccatatcgatggtgatggtggattgttcttctagcanaccaccgagccccggtgccatcctcaacgcggcccggatctatcaggcagtcgaaaaatgcgattttgaatacctgcagataaacgtcgcaacggcgcaagtttgcttctcttgcgttgggccgatagccctgtttgccagtatagtcacgtgaaaatttcgagctcaagcctatcctgagcaggagcgctgcttgtttcatcgccggccgctgatcatcaaccaacttcgcggggctaatttcaccaccctggggttgatgtcggggcttgaaggtttcgcgcggggggtcatcgttggccttgttccgttgatcgcgcttgatgtctttggcaccaaagccatggtgtctgtcgtttactttttggcctcaacctttgttgttctcatcactttaaatttggctcggatcgagcggctcattcatcgacgctggctcatcaccatgggctttggttttctcatgattggcgcgacgctgctgtggtcgcatacggaggcagggattgcgctgggaatcggtttacgagcctcggcggcctcgattttttccgtttgtctcgcgctttacatcatggattacatcagcaagcagcagttccgaattatggagtcacgcaggatggtgtttcaggcggtcgcttggatatcggcgccttcgattggaacgtacttatgggatcatgggcaccttacggcaccctttctgatcaccgggctcgcgtcagctggactcattgtgtacttctggacgctgcgcctcggcagtaatccagtcattaagaaaagcgattcaaaaattatcagtccgctcaaagcggtaccgcatttcttttcgcaaaaacgtctccgaattgcctacacgatctgtatttcgagatcggcgttctgggttacgatctttatctacgggccgatctacgttatcgaggcggggctgcccatctggatgagtggcggattgctgtcagccgcgagtggtttgctcttcatcagtccgatggtgagtggtttggccggcaggtacggcgctcgcgccctgatccttaccgggcttggcattagcgttgtttcgctagtaggcctggctttggttggctcacccaagccggcggggttggtgttctggatgctgggctcggtgggggcaaccattctcgatgtcctggggaatatcccttttatgcgatcggtccgccctcgcgagaggcctgcgatgactgtggtgtttactacatggagggagggctcggaattgctgactccagcaatcgccgcactagtcctgtttttcgcaccattttgggttttctacctcgtccttgctgtggttttaagctttgccgctacactcgccgcgcgactaccgaggcggttctgaagcttttggagcggagaccgacgattctggagtttgcttaagcggtcatgacgcggtaaaactggcactcaggggagacgtgttcaggtcctgagccacaaccgtaacctctgctacgacgccaaaaaccagcaggcccatgtattcaatatcaagcactggagcatcacgtcgcgtccttcgcctcgcggtgggcggtcttgtgttaggcgtatttgcggggaccggtaaccccgcgagcgcggacagtgagcacggcattaacttcaatcggagtgccgccaatttttatcttcatgacttttgtgagggcagaaacccgagcgattcctgcgcactggcggtagccgaagatggtttttatggaattgccaacggtccgatactggtcggagtaaaaaaggaagccttgtccgtttgcaagcgcgtttcgactcagccagagacctgtacgatcgtcgatcagaacggaacgtcatcctttatcgcaagcgtttctgcgaccgtcgatgattcaagcccggccagtgactcagattttgacgccaaattaaaggcagcgctcgccgatgcggtcgactccgtaacgagctccgtcgaggccctcaccaccgaaacggcagacga

SEQ ID NO: 302 - DNA, 4000 bp, Escherichia coli
  misc_feature (1952)..(1953): n is a, c, g, or t
  misc_feature (1958)..(1959): n is a, c, g, or t
  misc_feature (1965)..(1965): n is a, c, g, or t
  misc_feature (1977)..(1977): n is a, c, g, or t
  misc_feature (1979)..(1980): n is a, c, g, or t
  misc_feature (1985)..(1986): n is a, c, g, or t
  misc_feature (1991)..(1991): n is a, c, g, or t
aagtttttgcaataccgatttatgcgcgttgttcgtagggttcaagttcgataacccgccgtactgaaatatgataaattcgggtaaaaacgctttgcttccgttattgaagaaatggattcttccggcaaaggctttttcgaagtcctctaaatcgtacgtttcgccgcaataaagcccggctacctctaagtctacttcccatattccggcgttgtcgcactcgcaaaaaaggtacacccaaagcaatttataagcgggcggtaagtcccttataaatcgtttcttaaataggtcggtatctataaatctttttgccattttgttacttttgaaaagctaccccggcccggaaaccggggtagctgggttaatactgctattgctcgataatcgcaatttcggggcttagttcccgaatgcgggctacctgcacgtctataattcggtcgcgcaggtcttccaaaagctggcacgctccggggcttacaagttgtagggttacgtcgcggccgtttaccgaagcgtaaaattccacttcgatagtttccgccggcatacctttgaaaatcggaatttgaagggtaaaggcttccggcaggttactcataaccacgccgctataattgtctttgaagtcgcccttttcgctcttttgcttctctaccttggaatttacggtagcttcgaagtttttaagttcggttacgagcttcatattcgcggttttgtccgggaaaaatgcgcggttcattttgaagaactgccccaactcgttaggttcccaacctttgccggcgttaatcccaaattcggaaaatttggggtgcgtagtcagttttccaacgattcgcccgcgtctatattcgtcgtcttcgttcgtgataagggtaatacttacctgttcacggtctactaagacgtggcagcgcaacgggttaatttgttcggaatcgtaccgccgtaattccaaaaattcaaccggcgcaccgataacaccggaaaggtcgatttttaccgggggcttgggggcaagaactgcgggggcctcgccctcacgtacgataatttccgcctgcgtagttccttcgggaaggtttactactacttttttgttttcgtccatacttttttacttgttgattgtgaaacttttacttggtttgaagtgggctacttcgtgcgccggtacgataatcgtagtaccggcggtaatgttacgggctttcttttcggcccgtttcttcggctggaaggttccgaagccacgaaggtaaacgggttccttgcgctgtacgcattccttaattgcgtctaatgtggcttcgataatcggccttacgtggctatcgttttgcccggtcttactgccaacgactgtaattaaatcttgcttcgtcattgctttgctttttagttgttagtacctgtttttcttccgatttggaaaagtgttgtttgtaattcttcgctgtacgccggccggctctcgataaggtcgccgttctcgttgtagtagccgacttcgcgggcttcttggtcgatgaacttaaagcacctttcggtaacaaattcggctttcttcttcaaaccgtccaaggtcttttttcgctccgtcgtaaggggttccaaacgggccttaaagtccttcatcgcggccgtcttttcttcctcgatgtcgttaatttcgatgtccgtttccgaaaggctttctttcatgcgggccaattcttccggggtaaaaggcttcatataccccttttcttccaccgcgtcgcagttatccataaggaaggctacgcgcttcttgccttgttcaaggtctttccctaattctctttccatgttgcattattttttgattaaaagaaaatcgttataaagaccttcgaactgacggcccgcgtacgtggcgagttcacgggttttatagcaaagccgggagccgacanncgcanncgtatncgaagccgcgtnanncgtanncgcgnacgaaaagccggcagacgcgggattatacacgaaccaaggccaatatttgtactcgttgctattggcccaatccggccgccaaccttcgttaagggcttcggcaatggtctttaacttgcggtaggctatttcgtccttggtaaagcctaacttcgctaatacggtttcgttcatcggctcaatgccaagcacagcgcaagcgtccgcgtaggtctttacgcgcttggtaatgtccttcggggcaaccatttttacggcctgtaatacggtcgtattaacccctaacttctcggccaatcgttcggcttccttgctggcagcctgttcgttctcgtgtttgtacgtcggtgcgccttggccttcggcgtaaaccataaaaaactgcttttccattttgttatttgttaaaaagtgaactttgtttttcttccctcttttgctcgtaaagtattcgcctttgtcgcgcaatactcaaccggacggccctaatagcgtcttcacgcccttttaggctttcttcgtactccaatagttccgcttcgctttgggcgataaaatacccttcggaagtggctattaagcccggtataaggtcgtttgtccttatgtggtttataatcttccttacccgtgcgtcgtttagtttataggaacctttaagggtatttacgatatgcttgtttgtaacggcattttcgcgccctattttcgtcctaagcccccgtacgagaagcggaagaagtacgcccatttcgtaatcgtttaagggctgcgtttcttggtcaaatcctttaatcatatcaaaagggggttttgtcgaaattgattattagccccgcttcggctatatgtacggtcttaccggttgcggctcgcactccggcccggaattgttcggcgttgctgttaccgtcggaaaggtggataagaacaatattatttaccccctttatatcgttggcttgtaacgcctgtacgcaatggtcgtagcttaaatgcgattttagcgtacggttccgaacaacggcgggaatgcgcccggccgctatattcgcgtccaataggtctaagcggtaattacattctatcaatacgttattaagtcctgcaaacttgcaaggcaagtaataggtatcggtagcgaataggatattacccgtttcttcgtgattgatgaagaaccccaaaggctcggcggaatcgtgcttagtcccgaaaggaataattcggaaaccgccgagggtaaaaagggttccggctttgcaaacattcgcgcggcgcgggccttctattggggtgttctcaattgtaccggccgaagcgtagacgggtacggtagctttcaatacttcgttaatgtagcctgcgtggtctttgtgttcgtgggtaattaggcagcctacaaccttcgttatattgtagtctaacgcttgcttcacgctggcgaaccttacgcccgcttccaataacaaggcttcgcggtcgttctccaatatgtagctatttccgtggctgctactgcctaatacttttagaaccattgtaactacgcttctacgattttgcgaaatgctttacgcttcctttttagcggaaggttccggccgatgaagtccatagccgtagcgaatttgcccgaaaatcgaataagggctttgtcttgctgggctacgctctgttcgttctccttcgccatgtccgccgctttgttaatccgggcgttcattgcgtcgatgtcctttgccgtcagaatggcaataccaaaaattactttcatattagaatccaggtgttttaagtggctgtttggttccgttcgtttctgcttggccgaaatcaagtgttccgccggtattggcgttattctgtatttcggtttctacctcgtgggtaacgtccttatattccacgtcttcaacggggccgctttgttcatcagcgtcgccgaagtcgcaaccggttatatactcgtaaagggcttttttggcgcgtcgttcggctttacccc

SEQ ID NO: 303 - DNA, 4000 bp, Escherichia coli
  misc_feature (1990)..(1991): n is a, c, g, or t
  misc_feature (2002)..(2002): n is a, c, g, or t
  misc_feature (2662)..(2662): n is a, c, g, or t
  misc_feature (2699)..(2703): n is a, c, g, or t
  misc_feature (2706)..(2712): n is a, c, g, or t
  misc_feature (2717)..(2721): n is a, c, g, or t
  misc_feature (2730)..(2730): n is a, c, g, or t
  misc_feature (2740)..(2742): n is a, c, g, or t
  misc_feature (2744)..(2744): n is a, c, g, or t
  misc_feature (2746)..(2746): n is a, c, g, or t
  misc_feature (2749)..(2752): n is a, c, g, or t
  misc_feature (2759)..(2765): n is a, c, g, or t
  misc_feature (2781)..(2781): n is a, c, g, or t
  misc_feature (2784)..(2785): n is a, c, g, or t
  misc_feature (2789)..(2789): n is a, c, g, or t
  misc_feature (2791)..(2793): n is a, c, g, or t
  misc_feature (2795)..(2797): n is a, c, g, or t
  misc_feature (2799)..(2800): n is a, c, g, or t
  misc_feature (2802)..(2803): n is a, c, g, or t
  misc_feature (2805)..(2807): n is a, c, g, or t
  misc_feature (2810)..(2812): n is a, c, g, or t
  misc_feature (2814)..(2815): n is a, c, g, or t
  misc_feature (2817)..(2818): n is a, c, g, or t
  misc_feature (2820)..(2821): n is a, c, g, or t
  misc_feature (2823)..(2823): n is a, c, g, or t
  misc_feature (2827)..(2829): n is a, c, g, or t
  misc_feature (2831)..(2831): n is a, c, g, or t
  misc_feature (2835)..(2835): n is a, c, g, or t
  misc_feature (2838)..(2838): n is a, c, g, or t
  misc_feature (2841)..(2841): n is a, c, g, or t
  misc_feature (2843)..(2844): n is a, c, g, or t
  misc_feature (2846)..(2847): n is a, c, g, or t
  misc_feature (2851)..(2851): n is a, c, g, or t
  misc_feature (2857)..(2858): n is a, c, g, or t
  misc_feature (2862)..(2862): n is a, c, g, or t
  misc_feature (2868)..(2868): n is a, c, g, or t
  misc_feature (2873)..(2873): n is a, c, g, or t
  misc_feature (2878)..(2878): n is a, c, g, or t
  misc_feature (2881)..(2881): n is a, c, g, or t
  misc_feature (2886)..(2886): n is a, c, g, or t
  misc_feature (2917)..(2917): n is a, c, g, or t
  misc_feature (2919)..(2919): n is a, c, g, or t
  misc_feature (2940)..(2940): n is a, c, g, or t
  misc_feature (2943)..(2943): n is a, c, g, or t
  misc_feature (2946)..(2946): n is a, c, g, or t
  misc_feature (2954)..(2954): n is a, c, g, or t
  misc_feature (2956)..(2956): n is a, c, g, or t
  misc_feature (2961)..(2961): n is a, c, g, or t
  misc_feature (2967)..(2969): n is a, c, g, or t
  misc_feature (2971)..(2971): n is a, c, g, or t
  misc_feature (2975)..(2977): n is a, c, g, or t
  misc_feature (2979)..(2979): n is a, c, g, or t
  misc_feature (2982)..(2982): n is a, c, g, or t
  misc_feature (2984)..(2984): n is a, c, g, or t
  misc_feature (2987)..(2987): n is a, c, g, or t
  misc_feature (2990)..(2990): n is a, c, g, or t
  misc_feature (2998)..(2998): n is a, c, g, or t
  misc_feature (3016)..(3016): n is a, c, g, or t
  misc_feature (3018)..(3018): n is a, c, g, or t
  misc_feature (3025)..(3025): n is a, c, g, or t
  misc_feature (3035)..(3035): n is a, c, g, or t
  misc_feature (3048)..(3048): n is a, c, g, or t
  misc_feature (3052)..(3052): n is a, c, g, or t
  misc_feature (3062)..(3063): n is a, c, g, or t
  misc_feature (3076)..(3077): n is a, c, g, or t
  misc_feature (3080)..(3080): n is a, c, g, or t
  misc_feature (3090)..(3090): n is a, c, g, or t
  misc_feature (3092)..(3092): n is a, c, g, or t
  misc_feature (3094)..(3094): n is a, c, g, or t
  misc_feature (3096)..(3096): n is a, c, g, or t
  misc_feature (3099)..(3099): n is a, c, g, or t
  misc_feature (3102)..(3102): n is a, c, g, or t
  misc_feature (3104)..(3104): n is a, c, g, or t
  misc_feature (3106)..(3106): n is a, c, g, or t
  misc_feature (3110)..(3110): n is a, c, g, or t
  misc_feature (3112)..(3113): n is a, c, g, or t
  misc_feature (3180)..(3180): n is a, c, g, or t
  misc_feature (3183)..(3183): n is a, c, g, or t
  misc_feature (3191)..(3191): n is a, c, g, or t
  misc_feature (3201)..(3201): n is a, c, g, or t
  misc_feature (3214)..(3215): n is a, c, g, or t
  misc_feature (3221)..(3221): n is a, c, g, or t
  misc_feature (3225)..(3225): n is a, c, g, or t
  misc_feature (3228)..(3228): n is a, c, g, or t
  misc_feature (3231)..(3231): n is a, c, g, or t
  misc_feature (3238)..(3238): n is a, c, g, or t
  misc_feature (3271)..(3274): n is a, c, g, or t
  misc_feature (3314)..(4000): n is a, c, g, or t
ataattaagaaagaagaaacaataacaataagggaaacaacaataaaaaggtatatcaattatattaataaattcaatttagataatgaatataactttgacttaaattataatgaattatgaactattattgaagatagtcctaacaccaaaaataatcaatattcaaataataataatggcaaaatgtttactttattcattaatcgttataaaaattttgttattgaaaaatatttacacctcaataatattgagtaagaaactaataaagaatctaatacaaatttaatcaataatgaaaaatctatatgattatatgattctggagccggagaacatataacatgcaataaatcacacctgaaaaattatacaaaagaaaacatcaatttaatgtgtgcgaataataccgaatgtaaatttgaaggatatggaatatggagaatttgaattcagcataaagaatcatacttttatattaaaacatgtactatattctccaggtgtgattaaaaatattattagtggagtagaatgggcaaaagaggacgtaaatgctttgatcaacagtaataacaataatgtatatttaaacttattagacaaagattataataaaattgcctcttttcaggaaaatagaaacaatgaattacatatcacggctacgcacaaaaataacatcattaacaataaacttccaatattttcaataaacaagaataataatgaatttgaattattgtggcatagaagatttggtcacttttataataaagacttttattcgtatttaaaaaacacacggaatagctcatctcaaaataaaaaaaaaaaaaatattaaaaataacaaaagggtacagattttttatcttttagctttaatttttcaaattaaagtcctgctgacaatgtaaatattgaatttgataaaaacgaaatcaatcaaaacttaataaatgaaaattctaaaaaccgatctgaaaataataaaatttcatctaaaacaattgaaaattttaatcaacaattacttggaaagtagagactgcccatggactagaactgcagcttgagttttaaatagtgccggtattgctgcttgtcttggctacagtttaggactattaggaggtggtgctgatagagtttgtgttactaaattaggttcagaaggcgttgaatgctttaacgacttctggtaaaacaaataatcaatgttacgtccaaaaaatagcataaataaggatagttatcgaaataatttttttttttcattctattttcaatcattaattttaaaatagacaatcggttaataaagatttttccaattacttcttggaagtaatctgtttttcttattccaatgtttaatatggacagaatatcattcgaaaaattttcaaaggtttttcatttaatcctttcctagataaaagattagttaagattagaaattcatttcatatttaaccttatttttataaaaagaataaataagtgtttttataacaaatataacaaacataacaattataatataataataacaatgataaatttaataataaaacttttttatttaataaaaaatttttttaataaaccaaattttataaataaaaaagctttctttcgtaattttagtattttgtttattataatttattataataaactccaaatattagataagaaccattggtaagtattattttctaactcttaatattagtaattagagaagatctgttgaccaaacctattactataaaaaattataaaatatttactgattatatttataattacaataaaaatattatcaaataaaaaataaaataaatttctacttacgtcataatgtagtaggaatgttaaattatatagtaaagatagttatatacattatactttaatatttcattttttataaaataatgtaatgaaataatttgaaaaaaaaaaaaaaaaaaaaaaannttttaaaaaantttttttttcaaattatttaaagtccaatgtctcatgctctaatagaccaaatgtatttagataatatctgttataaatctcaagcattgctttctaatgaatataatttatcaggaaacttttttcattatttgtagagttatcgtctttttttctttgatttatttttattaatttcttatggcttaaattaaattgaatttattaaaaaagtccaaagccttctatttctaaatattaaacatacctagtatttatttttatagtaaaaattgaattttaaatgaaattgtcaataacgaaatctaatttcatttgatctattagtgaatttcattttcaaattcattaatattcaggatagctttgtagaacttattacttcataattttttaaatagaaaacttaatttttagaatttaatagctttaaataaatgattatcaataacaaaacaatggtaaataagcaattgtaccaaaaaaacattcatagcataatattttttattttttattttttatttttttttttttattatttattaaaaaaaattttttattataagtatgatattaaataatgaaataaataatgaaatatatatattataaatatttttaatttttatttattttttttattttatcttattttnatttaatttattttttttttttttttttttttttttnnnnnttnnnnnnnttttnnnnnttttttttnttttcctttnnntncnttnnnnttttttnnnnnnnaaaaaaaaaaaaaaanaannaaanannntnnnanntnntnnnaannntnnannannantttnnntnattnttnttnannannaatnatatanntatntttatnataanttttnatnataanaattttttttaaattattttatttttttttntnttttttttttttatttttttnttnaanattataanantgttntttaannntnttannntnatnanccnttntttatatntatataaatttttataantnattattntagaataatnttttataaaaaanaaanaaaaaaaaannatttttttttttnntcntttttattcnangntncanctncnancatnanntaaaaaaaataaaaaaataatattatattatataataattattattttataattttttaataatatnatnaaaataantaaataaatnattaaaaaaaatnnattaanaaanatnatnatcaatnatttttttttttttttttttttttttttttttnnnntttttttttttttttttttttttttttttttttttttttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 304 - DNA, 4000 bp, Escherichia coli
  misc_feature (1990)..(1991): n is a, c, g, or t
ccacatttgttatcagtatttttacacaaatttttgttggattgggcgccttgattgggatgattccattgattggacctttgattattaaagccatctctatccctgttttttggtttcttaatgccatggggtatgtggtctcaggcgtagctataaaaaaagggtatgccaccgaattagcaaaaagcaggattgttactctggggcttctgataggaattatcattgggtatattttaggccatttaattcccttaagatgaatattttaattttacaaggcccaaaccttaatttgcttggactgaagtcttctgaatccaataaaagcctcacgcttgataaactcaataaagcaattcggaaacacgtccatcaaaaagatgtaaccctgaaattcttgcaaactcataaacaatttcaagcaattaattttcttcaacgaaacagatcttgggcagacgggttaatgattattcctacatcttgggcgaaatatgattggtctatcgcagaatctatccaattaataaacctaccaacggctgtgatttattttgcaccatccttttcatttggcacacaaaaatctgattcaattattaatggagaaaatgtacaatctttcaatgggctcccgatcgaaacttgcctttccggtctggaccatttgataaactgaataaaatgaaattatatattccgtttttattttgcggcttgagtctttctgcccagtccggcgaatcacctaagaattctcatctttccattttatcatccattcaagattcagttgcacttgaaacaacaatacataagacgtttaatccgatttgggttgattccttaaaaattctattaccttgtagtggagtctctgttccaaaaaggaccatgcgcttaccaaatgccccacgtgattatagaagtggcatacaccgtggaattgatttttttgccaattggggcagtcctattatgtcagtcgctgatggtattgttatccgggcagaccatgggtatgtagaggttcccgcagaatttagagtcaatatgctagacgctagtgcaaaagtaggacatacgccttctgacatttttaataacgtcttattaggacaagctatttttttagatcatggctttgatcttattccaggattcagaacaatttccatctatgcacatttatctcacatcaatgaaaatatcaagccgggtacaaaaattaaaatgggagacgttatgggaaaaaccggtaattcaggaatacgagaaagcactttgggctcaagagccggtgctcatcttcattgggaaatgatactacaaaaagatgaacaggaaatttatttagggaaagatgtttcaaacccagacctatatgaaatgttgaaccgaattttttattaatcaattcaataaatttttgacaaaaaaaagggcaggtgaaaacctgcccttttttagtttataatcaagattgatctatttcagcaacatcattttctttgttgaaaagaaatcacctgctttaatggtatagaaatataaaccactacttacgggttttcctgcattatcaatgcctctccattttatatgatgcgtacccggattcatcgtattcaaatcgaatgagttaacctgtttacccaacacgttgtagaccgtgatattaacgtcggaaatttccggaacgtcaaatctgatggtcgtaacggggttaaacgggttcggatagttctcataaagtgcaaactcagttggcaaattcaactcatcttcattagatactgttgatgcagaccatgccaagaaattgcccatgacagcctgttgcgaagaattcggcatcattgacagattgaaggccatgaaaacaacattcccattttgcgttgagacgtcgtatgcgccaccagtccaacctgggagcattgaatcatgactctggaatggactaggtagttggtctggaganncccagccaagtggatcaactatatcggccatactgccagtagcagtcataaatgacggatccaatgtaatctcacttgtattcatctcagcagttaccgccaagtcatctttgacatttacggagtcgtaattaacatcgttcatcacccattctacgcctaagacgtcatgggcaaaatgcccttctggaagtgagatgtcatcccaaccagtgtaggtcccgagtgcctcttcagatgagaaaagaagatatcctccattcgctacaaactcacctaagggatgcacatctgtttcttctgggttctctatccagtcaagaacagcagaataaatgaccgcatcatagtgcgacaatacagaaccgaagtctggttgataattgtcatagacgctccatgtatcatactgttgacccagagcagtcaaattcgaattaacaatagaatccgcaacgcctgcaccataaccccaatacggaacatagatatcgctcattaagagaatatctgcagttgggacaagggtagtaccccaaaatgaaccaatacctgttattgatgttaaaccatcattgtctgtagcagacaactgatagttacagaggcttgtgtctgtccaagctgtgagagtcagagttgctgagtagtgaccttcaccatcatctgtcatggcttctgaataatctgtaccatcaatgtcataaacaacactcacagatgctagtgtcccgtcaccatcaaccgccataccttccacatgagcagtcgtaataccagatgctacaccaaagtgagttgatgatccttcgagatcgaccactggaggagatactgctcctagataacctatcagtgcacccataaattgctcaacagccgatatatcccagcccattgtgtcaccatcaactatataccagtccacagctgcttccggcaaaaaagaaagataaatagctgtaccgttactaccatcctgttggctagttccaacaacattatcatctgcatcatagaagatttcagtagcagtattggcttcaaccaaatctgtccaaccgagaaaatctgggatagtgtggttcaaggtataaccgtctgcaaatggagtatcaaagcttgttgcttcagctccatatacagtgagagtatctccatgaagagatgcgtctccagcggcattcattggatcatttgaacctgctgatataccgaatacgtcgtacataaaatcaccctctgcgaatgtccattccgcaacaccacagtcgaggccacataaaaggtcctggtccattagcacaaggttgttaccggcttcaacaaaggctcgataaccagcatcatgttggtcagttacaggcacagaagagacgccccagccagacacaatgatattggtccagccatgattgataacagatgcatcaatgcctttgttggacggaacgtcccagacttcatagacgaaacctgaattatccatcgcatctaagagtatagactcttgatcctcattaatgttatctaccacaagtaaaatatcggatgccatgttccaaggttcgacaatattgaaagactgaatcgcagagatggattctaatccatcattatccactagttctacccagtactgaactgaatcaccttccattagtgtgtaagtaatatcaaattgataaataccattgccatttgtagcaaccgctgctgaagctgtgagagctccagttgaagtatctccacctgcaacatagtaatatgtcaacatgtcgtttgcatccaatgcagatcctgatgcatcttcatcatcaaaaagatcaacatcaatggttctagttcctgcgatttcatatgtattagaaggctggcttatagaagctactgcaataggagctccccaaggataggtaacctttactaacaccatattatccgtggcgtcgctatatcttccccactggttttcagtccagggaccaccaaaccaggtgtaggatgtg

SEQ ID NO: 305 - DNA, 4000 bp, Escherichia coli
  misc_feature (1)..(4): n is a, c, g, or t
  misc_feature (6)..(11): n is a, c, g, or t
  misc_feature (13)..(16): n is a, c, g, or t
  misc_feature (18)..(18): n is a, c, g, or t
  misc_feature (20)..(23): n is a, c, g, or t
  misc_feature (25)..(27): n is a, c, g, or t
  misc_feature (30)..(35): n is a, c, g, or t
  misc_feature (38)..(45): n is a, c, g, or t
  misc_feature (47)..(49): n is a, c, g, or t
  misc_feature (51)..(65): n is a, c, g, or t
  misc_feature (67)..(67): n is a, c, g, or t
  misc_feature (69)..(72): n is a, c, g, or t
  misc_feature (74)..(82): n is a, c, g, or t
  misc_feature (84)..(88): n is a, c, g, or t
  misc_feature (90)..(99): n is a, c, g, or t
  misc_feature (101)..(108): n is a, c, g, or t
  misc_feature (110)..(113): n is a, c, g, or t
  misc_feature (116)..(123): n is a, c, g, or t
  misc_feature (126)..(129): n is a, c, g, or t
  misc_feature (132)..(133): n is a, c, g, or t
  misc_feature (135)..(137): n is a, c, g, or t
  misc_feature (139)..(144): n is a, c, g, or t
  misc_feature (146)..(150): n is a, c, g, or t
  misc_feature (153)..(153): n is a, c, g, or t
  misc_feature (155)..(162): n is a, c, g, or t
  misc_feature (164)..(171): n is a, c, g, or t
  misc_feature (174)..(174): n is a, c, g, or t
  misc_feature (176)..(180): n is a, c, g, or t
  misc_feature (182)..(184): n is a, c, g, or t
  misc_feature (186)..(186): n is a, c, g, or t
  misc_feature (188)..(195): n is a, c, g, or t
  misc_feature (197)..(197): n is a, c, g, or t
  misc_feature (199)..(206): n is a, c, g, or t
  misc_feature (208)..(214): n is a, c, g, or t
  misc_feature (216)..(222): n is a, c, g, or t
  misc_feature (224)..(228): n is a, c, g, or t
  misc_feature (230)..(232): n is a, c, g, or t
  misc_feature (234)..(244): n is a, c, g, or t
  misc_feature (246)..(250): n is a, c, g, or t
  misc_feature (252)..(253): n is a, c, g, or t
  misc_feature (255)..(256): n is a, c, g, or t
  misc_feature (258)..(279): n is a, c, g, or t
  misc_feature (281)..(286): n is a, c, g, or t
  misc_feature (288)..(288): n is a, c, g, or t
  misc_feature (292)..(297): n is a, c, g, or t
  misc_feature (299)..(302): n is a, c, g, or t
  misc_feature (304)..(312): n is a, c, g, or t
  misc_feature (314)..(314): n is a, c, g, or t
  misc_feature (316)..(318): n is a, c, g, or t
  misc_feature (320)..(321): n is a, c, g, or t
  misc_feature (323)..(328): n is a, c, g, or t
  misc_feature (331)..(333): n is a, c, g, or t
  misc_feature (336)..(337): n is a, c, g, or t
  misc_feature (339)..(339): n is a, c, g, or t
  misc_feature (342)..(343): n is a, c, g, or t
  misc_feature (345)..(350): n is a, c, g, or t
  misc_feature (352)..(353): n is a, c, g, or t
  misc_feature (355)..(355): n is a, c, g, or t
  misc_feature (357)..(358): n is a, c, g, or t
  misc_feature (360)..(366): n is a, c, g, or t
  misc_feature (369)..(370): n is a, c, g, or t
  misc_feature (372)..(372): n is a, c, g, or t
  misc_feature (374)..(374): n is a, c, g, or t
  misc_feature (376)..(377): n is a, c, g, or t
  misc_feature (379)..(379): n is a, c, g, or t
  misc_feature (381)..(396): n is a, c, g, or t
  misc_feature (398)..(399): n is a, c, g, or t
  misc_feature (401)..(405): n is a, c, g, or t
  misc_feature (407)..(424): n is a, c, g, or t
  misc_feature (426)..(426): n is a, c, g, or t
  misc_feature (428)..(430): n is a, c, g, or t
  misc_feature (432)..(438): n is a, c, g, or t
  misc_feature (441)..(458): n is a, c, g, or t
  misc_feature (461)..(465): n is a, c, g, or t
  misc_feature (467)..(467): n is a, c, g, or t
  misc_feature (469)..(475): n is a, c, g, or t
  misc_feature (477)..(477): n is a, c, g, or t
  misc_feature (479)..(480): n is a, c, g, or t
  misc_feature (483)..(487): n is a, c, g, or t
  misc_feature (489)..(495): n is a, c, g, or t
  misc_feature (497)..(503): n is a, c, g, or t
  misc_feature (505)..(510): n is a, c, g, or t
  misc_feature (512)..(516): n is a, c, g, or t
  misc_feature (518)..(526): n is a, c, g, or t
  misc_feature (528)..(540): n is a, c, g, or t
  misc_feature (542)..(550): n is a, c, g, or t
  misc_feature (552)..(554): n is a, c, g, or t
  misc_feature (557)..(558): n is a, c, g, or t
  misc_feature (560)..(561): n is a, c, g, or t
  misc_feature (563)..(565): n is a, c, g, or t
  misc_feature (568)..(569): n is a, c, g, or t
  misc_feature (571)..(576): n is a, c, g, or t
  misc_feature (578)..(586): n is a, c, g, or t
  misc_feature (588)..(613): n is a, c, g, or t
  misc_feature (615)..(621): n is a, c, g, or t
  misc_feature (623)..(625): n is a, c, g, or t
  misc_feature (627)..(645): n is a, c, g, or t
  misc_feature (647)..(653): n is a, c, g, or t
  misc_feature (655)..(657): n is a, c, g, or t
  misc_feature (659)..(660): n is a, c, g, or t
  misc_feature (662)..(679): n is a, c, g, or t
  misc_feature (681)..(697): n is a, c, g, or t
  misc_feature (699)..(706): n is a, c, g, or t
  misc_feature (708)..(727): n is a, c, g, or t
  misc_feature (729)..(730): n is a, c, g, or t
  misc_feature (732)..(735): n is a, c, g, or t
  misc_feature (738)..(751): n is a, c, g, or t
  misc_feature (753)..(753): n is a, c, g, or t
  misc_feature (756)..(756): n is a, c, g, or t
  misc_feature (758)..(766): n is a, c, g, or t
  misc_feature (768)..(768): n is a, c, g, or t
  misc_feature (770)..(774): n is a, c, g, or t
  misc_feature (776)..(778): n is a, c, g, or t
  misc_feature (780)..(787): n is a, c, g, or t
  misc_feature (790)..(800): n is a, c, g, or t
  misc_feature (802)..(807): n is a, c, g, or t
  misc_feature (809)..(842): n is a, c, g, or t
  misc_feature (844)..(856): n is a, c, g, or t
  misc_feature (858)..(866): n is a, c, g, or t
  misc_feature (868)..(875): n is a, c, g, or t
  misc_feature (877)..(884): n is a, c, g, or t
  misc_feature (886)..(889): n is a, c, g, or t
  misc_feature (891)..(895): n is a, c, g, or t
  misc_feature (897)..(899): n is a, c, g, or t
  misc_feature (901)..(908): n is a, c, g, or t
  misc_feature (910)..(918): n is a, c, g, or t
  misc_feature (920)..(927): n is a, c, g, or t
  misc_feature (929)..(933): n is a, c, g, or t
  misc_feature (935)..(939): n is a, c, g, or t
  misc_feature (941)..(941): n is a, c, g, or t
  misc_feature (943)..(944): n is a, c, g, or t
  misc_feature (946)..(950): n is a, c, g, or t
  misc_feature (952)..(953): n is a, c, g, or t
  misc_feature (955)..(958): n is a, c, g, or t
  misc_feature (960)..(983): n is a, c, g, or t
  misc_feature (985)..(1004): n is a, c, g, or t
  misc_feature (1006)..(1006): n is a, c, g, or t
  misc_feature (1008)..(1010): n is a, c, g, or t
  misc_feature (1012)..(1012): n is a, c, g, or t
  misc_feature (1014)..(1017): n is a, c, g, or t
  misc_feature (1019)..(1042): n is a, c, g, or t
  misc_feature (1044)..(1052): n is a, c, g, or t
  misc_feature (1054)..(1055): n is a, c, g, or t
  misc_feature (1057)..(1057): n is a, c, g, or t
  misc_feature (1060)..(1074): n is a, c, g, or t
  misc_feature (1076)..(1077): n is a, c, g, or t
  misc_feature (1079)..(1093): n is a, c, g, or t
  misc_feature (1095)..(1096): n is a, c, g, or t
  misc_feature (1098)..(1098): n is a, c, g, or t
  misc_feature (1101)..(1104): n is a, c, g, or t
  misc_feature (1106)..(1112): n is a, c, g, or t
  misc_feature (1114)..(1116): n is a, c, g, or t
  misc_feature (1118)..(1119): n is a, c, g, or t
  misc_feature (1122)..(1124): n is a, c, g, or t
  misc_feature (1126)..(1139): n is a, c, g, or t
  misc_feature (1141)..(1141): n is a, c, g, or t
  misc_feature (1143)..(1146): n is a, c, g, or t
  misc_feature (1151)..(1151): n is a, c, g, or t
  misc_feature (1154)..(1154): n is a, c, g, or t
  misc_feature (1156)..(1157): n is a, c, g, or t
  misc_feature (1159)..(1160): n is a, c, g, or t
  misc_feature (1162)..(1162): n is a, c, g, or t
  misc_feature (1164)..(1168): n is a, c, g, or t
  misc_feature (1172)..(1172): n is a, c, g, or t
  misc_feature (1175)..(1187): n is a, c, g, or t
  misc_feature (1189)..(1189): n is a, c, g, or t
  misc_feature (1191)..(1193): n is a, c, g, or t
  misc_feature (1195)..(1195): n is a, c, g, or t
  misc_feature (1200)..(1203): n is a, c, g, or t
  misc_feature (1206)..(1206): n is a, c, g, or t
  misc_feature (1208)..(1214): n is a, c, g, or t
  misc_feature (1216)..(1219): n is a, c, g, or t
  misc_feature (1221)..(1223): n is a, c, g, or t
  misc_feature (1227)..(1230): n is a, c, g, or t
  misc_feature (1232)..(1234): n is a, c, g, or t
  misc_feature (1238)..(1240): n is a, c, g, or t
  misc_feature (1243)..(1247): n is a, c, g, or t
  misc_feature (1249)..(1249): n is a, c, g, or t
  misc_feature (1251)..(1252): n is a, c, g, or t
  misc_feature (1254)..(1255): n is a, c, g, or t
  misc_feature (1257)..(1261): n is a, c, g, or t
  misc_feature (1264)..(1274): n is a, c, g, or t
  misc_feature (1277)..(1277): n is a, c, g, or t
  misc_feature (1279)..(1281): n is a, c, g, or t
  misc_feature (1283)..(1286): n is a, c, g, or t
  misc_feature (1288)..(1288): n is a, c, g, or t
  misc_feature (1290)..(1290): n is a, c, g, or t
  misc_feature (1292)..(1292): n is a, c, g, or t
  misc_feature (1294)..(1296): n is a, c, g, or t
  misc_feature (1299)..(1300): n is a, c, g, or t
  misc_feature (1302)..(1315): n is a, c, g, or t
  misc_feature (1317)..(1319): n is a, c, g, or t
  misc_feature (1321)..(1325): n is a, c, g, or t
  misc_feature (1327)..(1328): n is a, c, g, or t
  misc_feature (1332)..(1335): n is a, c, g, or t
  misc_feature (1339)..(1339): n is a, c, g, or t
  misc_feature (1341)..(1343): n is a, c, g, or t
  misc_feature (1345)..(1346): n is a, c, g, or t
  misc_feature (1348)..(1358): n is a, c, g, or t
  misc_feature (1360)..(1360): n is a, c, g, or t
  misc_feature (1363)..(1365): n is a, c, g, or t
  misc_feature (1368)..(1368): n is a, c, g, or t
  misc_feature (1370)..(1372): n is a, c, g, or t
  misc_feature (1374)..(1375): n is a, c, g, or t
  misc_feature (1377)..(1381): n is a, c, g, or t
  misc_feature (1384)..(1384): n is a, c, g, or t
  misc_feature (1386)..(1387): n is a, c, g, or t
  misc_feature (1389)..(1392): n is a, c, g, or t
  misc_feature (1394)..(1394): n is a, c, g, or t
  misc_feature (1396)..(1399): n is a, c, g, or t
  misc_feature (1402)..(1402): n is a, c, g, or t
  misc_feature (1406)..(1407): n is a, c, g, or t
  misc_feature (1410)..(1418): n is a, c, g, or t
  misc_feature (1421)..(1425): n is a, c, g, or t
  misc_feature (1429)..(1429): n is a, c, g, or t
  misc_feature (1431)..(1435): n is a, c, g, or t
  misc_feature (1437)..(1444): n is a, c, g, or t
  misc_feature (1447)..(1448): n is a, c, g, or t
  misc_feature (1450)..(1462): n is a, c, g, or t
  misc_feature (1466)..(1467): n is a, c, g, or t
  misc_feature (1471)..(1471): n is a, c, g, or t
  misc_feature (1474)..(1484): n is a, c, g, or t
  misc_feature (1486)..(1488): n is a, c, g, or t
  misc_feature (1492)..(1503): n is a, c, g, or t
  misc_feature (1505)..(1505): n is a, c, g, or t
  misc_feature (1508)..(1509): n is a, c, g, or t
  misc_feature (1511)..(1518): n is a, c, g, or t
  misc_feature (1522)..(1525): n is a, c, g, or t
  misc_feature (1528)..(1528): n is a, c, g, or t
  misc_feature (1530)..(1530): n is a, c, g, or t
  misc_feature (1533)..(1535): n is a, c, g, or t
  misc_feature (1537)..(1540): n is a, c, g, or t
  misc_feature (1542)..(1542): n is a, c, g, or t
  misc_feature (1544)..(1545): n is a, c, g, or t
  misc_feature (1548)..(1551): n is a, c, g, or t
  misc_feature (1555)..(1557): n is a, c, g, or t
  misc_feature (1559)..(1560): n is a, c, g, or t
  misc_feature (1562)..(1563): n is a, c, g, or t
  misc_feature (1566)..(1566): n is a, c, g, or t
  misc_feature (1568)..(1570): n is a, c, g, or t
  misc_feature (1573)..(1576): n is a, c, g, or t
  misc_feature (1580)..(1580): n is a, c, g, or t
  misc_feature (1582)..(1583): n is a, c, g, or t
  misc_feature (1587)..(1592): n is a, c, g, or t
  misc_feature (1594)..(1605): n is a, c, g, or t
  misc_feature (1607)..(1609): n is a, c, g, or t
  misc_feature (1611)..(1613): n is a, c, g, or t
  misc_feature (1615)..(1620): n is a, c, g, or t
  misc_feature (1622)..(1622): n is a, c, g, or t
  misc_feature (1625)..(1630): n is a, c, g, or t
  misc_feature (1632)..(1632): n is a, c, g, or t
  misc_feature (1634)..(1634): n is a, c, g, or t
  misc_feature (1636)..(1636): n is a, c, g, or t
  misc_feature (1638)..(1641): n is a, c, g, or t
  misc_feature (1645)..(1645): n is a, c, g, or t
  misc_feature (1647)..(1650): n is a, c, g, or t
  misc_feature (1652)..(1653): n is a, c, g, or t
  misc_feature (1655)..(1657): n is a, c, g, or t
  misc_feature (1659)..(1662): n is a, c, g, or t
  misc_feature (1665)..(1666): n is a, c, g, or t
  misc_feature (1668)..(1668): n is a, c, g, or t
  misc_feature (1670)..(1674): n is a, c, g, or t
  misc_feature (1676)..(1676): n is a, c, g, or t
  misc_feature (1678)..(1680): n is a, c, g, or t
  misc_feature (1683)..(1684): n is a, c, g, or t
  misc_feature (1686)..(1692): n is a, c, g, or t
  misc_feature (1695)..(1695): n is a, c, g, or t
  misc_feature (1697)..(1697): n is a, c, g, or t
  misc_feature (1702)..(1702): n is a, c, g, or t
  misc_feature (1704)..(1704): n is a, c, g, or t
  misc_feature (1706)..(1706): n is a, c, g, or t
  misc_feature (1708)..(1708): n is a, c, g, or t
  misc_feature (1710)..(1713): n is a, c, g, or t
  misc_feature (1715)..(1716): n is a, c, g, or t
  misc_feature (1718)..(1718): n is a, c, g, or t
  misc_feature (1722)..(1724): n is a, c, g, or t
  misc_feature (1731)..(1731): n is a, c, g, or t
  misc_feature (1734)..(1737): n is a, c, g, or t
  misc_feature (1739)..(1739): n is a, c, g, or t
  misc_feature (1742)..(1745): n is a, c, g, or t
  misc_feature (1748)..(1748): n is a, c, g, or t
  misc_feature (1752)..(1756): n is a, c, g, or t
  misc_feature (1758)..(1761): n is a, c, g, or t
  misc_feature (1765)..(1765): n is a, c, g, or t
  misc_feature (1767)..(1767): n is a, c, g, or t
  misc_feature (1769)..(1769): n is a, c, g, or t
  misc_feature (1774)..(1774): n is a, c, g, or t
  misc_feature (1777)..(1778): n is a, c, g, or t
  misc_feature (1780)..(1784): n is a, c, g, or t
  misc_feature (1786)..(1786): n is a, c, g, or t
  misc_feature (1792)..(1795): n is a, c, g, or t
  misc_feature (1798)..(1798): n is a, c, g, or t
  misc_feature (1800)..(1805): n is a, c, g, or t
  misc_feature (1810)..(1811): n is a, c, g, or t
  misc_feature (1814)..(1814): n is a, c, g, or t
  misc_feature (1820)..(1820): n is a, c, g, or t
  misc_feature (1822)..(1822): n is a, c, g, or t
  misc_feature (1829)..(1829): n is a, c, g, or t
  misc_feature (1833)..(1833): n is a, c, g, or t
  misc_feature (1837)..(1837): n is a, c, g, or t
  misc_feature (1840)..(1844): n is a, c, g, or t
  misc_feature (1848)..(1850): n is a, c, g, or t
  misc_feature (1852)..(1852): n is a, c, g, or t
  misc_feature (1990)..(1990): n is a, c, g, or t
  misc_feature (1992)..(1992): n is a, c, g, or t
  misc_feature (3746)..(3746): n is a, c, g, or t
  misc_feature (3758)..(3758): n is a, c, g, or t
  misc_feature (3791)..(3791): n is a, c, g, or t
  misc_feature (3806)..(3806): n is a, c, g, or t
  misc_feature (3863)..(3863): n is a, c, g, or t
  misc_feature (3876)..(3876): n is a, c, g, or t
  misc_feature (3880)..(3880): n is a, c, g, or t
  misc_feature (3972)..(3972): n is a, c, g, or t
  misc_feature (3995)..(3995): n is a, c, g, or t
nnnngnnnnnnannnncncnnnnannnagnnnnnncannnnnnnnannngnnnnnnnnnnnnnnngncnnnnannnnnnnnngnnnnncnnnnnnnnnntnnnnnnnntnnnntgnnnnnnnntcnnnnttnncnnntnnnnnntnnnnnttntnnnnnnnntnnnnnnnnttntnnnnnannntntnnnnnnnntngnnnnnnnncnnnnnnncnnnnnnngnnnnntnnnannnnnnnnnnnannnnngnnanntnnnnnnnnnnnnnnnnnnnnnntnnnnnnanttgnnnnnntnnnncnnnnnnnnntngnnnanntnnnnnntgnnntcnncnaanntnnnnnngnngncnncnnnnnnntcnnantngnngnannnnnnnnnnnnnnnntnntnnnnntnnnnnnnnnnnnnnnnnnantnnncnnnnnnntcnnnnnnnnnnnnnnnnnngtnnnnnancnnnnnnncntnnttnnnnngnnnnnnnannnnnnnannnnnnannnnntnnnnnnnnntnnnnnnnnnnnnntnnnnnnnnntnnnctnntnntnnntgnncnnnnnntnnnnnnnnntnnnnnnnnnnnnnnnnnnnnnnnnnntnnnnnnntnnngnnnnnnnnnnnnnnnnnnntnnnnnnnannnanngnnnnnnnnnnnnnnnnnnannnnnnnnnnnnnnnnntnnnnnnnntnnnnnnnnnnnnnnnnnnnntnntnnnnttnnnnnnnnnnnnnntnttntnnnnnnnnnantnnnnntnnnannnnnnnnttnnnnnnnnnnnannnnnntnnnnnnnnnnnnnnnnnnnnnnnnnnnnnnnnnntnnnnnnnnnnnnncnnnnnnnnntnnnnnnnntnnnnnnnntnnnncnnnnnannntnnnnnnnntnnnnnnnnngnnnnnnnngnnnnntnnnnnantnnannnnntnntnnnntnnnnnnnnnnnnnnnnnnnnnnnntnnnnnnnnnnnnnnnnnnnntngnnntngnnnncnnnnnnnnnnnnnnnnnnnnnnnnannnnnnnnntnntnttnnnnnnnnnnnnnnntnntnnnnnnnnnnnnnnngnncnttnnnntnnnnnnnannntnnccnnnannnnnnnnnnnnnntncnnnnccttnttntnngnntngnnnnntttnttnnnnnnnnnnnnntnannntnctttnnnntcnannnnnnntnnnnannnttannnntnnnggtnnnatnnnnntntnnanntnnnnnaannnnnnnnnnnttntnnncnnnnantntntnnnaanncnnnnnnnnnnnnnngnnntnnnnntnnggannnntgtntnnngnntnnnnnnnnnnntntgnnnttntnnnanncnnnnnttntnnannnntntnnnnaanaatnnaannnnnnnnnttnnnnntatnannnnnannnnnnnnagnntnnnnnnnnnnnnnaacnncttncannnnnnnnnnnannnaagnnnnnnnnnnnncnatnnannnnnnnncttnnnnttnantannnannnnangnnttnnnntctnnncnntnngantnnnttnnnnttcntnntcannnnnntnnnnnnnnnnnncnnntnnntnnnnnnanttnnnnnntntntntnnnnggtntnnnnanntnnntnnnnagnntncnnnnntntnnntanncnnnnnnnaantnttttnantncnannnnanntntttnnnattttanttnnnntnttnnnnttnattnnnnntnnnnttcncnanttttnttnnannnnntnaaactnnnntcnannnnnntcaannttntccacnancttgccnacgntaanccnnnnntttnnntngtgaggtacacaggaggtacaaaaaatggcgtaaaaaggcttagcaacgattatcaacgatacttgagcaacaaaaaaggcgcccgtaaagagcgccatattaatcgattataatcaatttaactatttgataatcangnatttacttgccgatgcaaaacttggaaaatatggtcccaagtatttcgtcagtagagatttgaccggtgatttctccgaggtagtgcatgcattctctaatgtcttgggcgaggaagtctccggagaggccggattgtagaccgttgagggtacgtaggattgcgtcgtgggcatttagcagggcttcgtaatgacgtgcgttggtgacgataatgtcattttcgccagtttgtgttgactgtatggtatctgtaagctgtttttcgagtacgtcgatattttggtcatgtgaagctgaaagaaagatgaacgaagtgttgggcttttcacgagtgaggcgtttgtataggtctgtgagctgttgttgggttgcggatccgatcttatctattttgttaaaggcaacgatgaggcgtttatctgtgcagtgggggaggactcttccagcgattttttcaatgtcttgtgtcgatccagtggcatcaataagccagatgacgatgtgggcttgatctagtttttggaaggtgcgttcgatccccatattctcgatggcatcgtgcgtttcccgtataccggcagtgtcgataaagcggaaagtaattccttgtaatacgacggtatcttcgatgacatcgcgggttgtaccgtgtatgtccgagacgatggctttatcttctttgacaaggcggttgagcagtgtcgatttcccggcgttggtttctcctataatggcagtaggtacaccgtttttgatggcattgccgagtgtgaacgaatcggaaaggcgcttaatgactcgttctatttcactggcgaggtcggttagtttctcccgatcggcaaattctacttcttcttcgctgaaatcaagttcgagttcaacgagcgaggcgaatgtgagtagtttttcccgtagttggataagttctcggctgaatcctccacgcatttgttgcatagctaaacgatgcgaggccgccgaggtggaagcgataaggtcggccacggcttcggcttgtgagaggtcaagtttcccattggtaaaagccctacgggtaaattctcccggttgggccaggcggcagcctgctcgcaatagaaggctgatgatttgttgttgaatgtaaatcgacccgtggcaggatatctcgactgtatcttctcctgtaaatgaatggggggcgatgaaaagcgtaacgactacatcgtcaatgggagtttcgttctcatcggcgattgttccgtagtgtgctgtattgggctttgcttcggatagttttttcttgtttgcggtgtgaaatatacgatcggttataatgatagcgtttgttccgcttatgcgaattacggcaatacctcccataccgggagcggtagagatggcgcaaatcgtatcttcgggtattggcttgtttagtttaagttccatatttcaagggataggtcgctttctattttatgttcaatactgtcgggtaagttgtggaaaaaatctattccggtcactcgttccacactgtcgatggtgattgccaactcttttagagacggttgttccgcttcattgtcgaatataaatgcgattcctctgggcgtgccggtatacggaacagcgactactttgaaaaagcgggcagggacgactatctcgtgtcgtccgattgtctttctcggagtagaaacgatgggtccgcaagtaatgagtagtgcactgtctcgttgtacccattcacgtatttgttcttccagntctttccagcgncctcggtttaattcgggaatttgcggacagatntttgagagcaggaangattcttccattgctgtttcgttccatttcatatcggcagccggagccatatgtccncggtcgtatccgntatncgtgtaatcacgggtgtctatcattgtgcccactacatcgtagtcgggggtaaatcggttgttgcgtgtagcactaccttgcagttcgtctngtagtaattcgtaacttacccanttggg

SEQ ID NO: 306 - DNA, 4000 bp, Escherichia coli
  misc_feature (11)..(11): n is a, c, g, or t
  misc_feature (61)..(62): n is a, c, g, or t
  misc_feature (68)..(68): n is a, c, g, or t
  misc_feature (125)..(125): n is a, c, g, or t
  misc_feature (165)..(165): n is a, c, g, or t
  misc_feature (182)..(182): n is a, c, g, or t
  misc_feature (185)..(185): n is a, c, g, or t
  misc_feature (194)..(194): n is a, c, g, or t
  misc_feature (227)..(227): n is a, c, g, or t
  misc_feature (248)..(248): n is a, c, g, or t
  misc_feature (266)..(266): n is a, c, g, or t
  misc_feature (326)..(326): n is a, c, g, or t
  misc_feature (478)..(479): n is a, c, g, or t
  misc_feature (500)..(500): n is a, c, g, or t
  misc_feature (509)..(509): n is a, c, g, or t
  misc_feature (566)..(566): n is a, c, g, or t
  misc_feature (593)..(593): n is a, c, g, or t
  misc_feature (647)..(647): n is a, c, g, or t
  misc_feature (689)..(689): n is a, c, g, or t
  misc_feature (710)..(710): n is a, c, g, or t
  misc_feature (773)..(773): n is a, c, g, or t
  misc_feature (812)..(812): n is a, c, g, or t
  misc_feature (917)..(917): n is a, c, g, or t
  misc_feature (977)..(977): n is a, c, g, or t
  misc_feature (1070)..(1070): n is a, c, g, or t
  misc_feature (1721)..(1721): n is a, c, g, or t
  misc_feature (1921)..(1921): n is a, c, g, or t
  misc_feature (2007)..(2007): n is a, c, g, or t
  misc_feature (2497)..(2497): n is a, c, g, or t
catcttctgcntaggcattactttgataataagcatctacattagcagtaagtccttttgnnaacttntaagttgctcctgcatttactgtccatcttgatactcctgcaaattcttttccatcntaagttccacttgttacctttggtactatgtatgaaactntttctctcaatgttaanttntcaaaatantgtgccattgataattgtgctccaattcttctnacttttccatcaaagttttgnttattagaactgaatggnttagtcttatcataataaatttcatttttagaatttatgtagaatacagaagttgccacngaagtattcttgtaagcgtctcttagtcctatttcaaagatatcattcttttgagtttttacaggtccataccaagctccagcatcttgtattgttggagttcttaaagctcttgtatagttaaagaaaacatttcctgtatcagaatatanntagtttactccaaattcaaanctatcattncttgcatagtcagctgactgaggttttatttcacttaattgccaagtcataggattntaaacttttgaactatattcatatttnactttttctctacgataaccttgagtaaattgccacttaccaaaagttgatttntttgtgatataacccgcaaatgattctcttttatcatcaggngctttttgacttactccattnacaaagacatcatctttaaaatctctttttccatctctatagtcaagtcccaatgtaacatanctatcttttgcataagtgtatttaacttctggtcttaanaaatattcagaagttgaattattttggaatttatctttattatgatagtatccagctgttaggaaaatatcaattttatcatttattttttgattgtatttagcnttgacaatatcatttataccataagtataaccactccaagaacctacttgtcttgggttnttatcaaattgttctttgcttaaagaacctgtatagtaatctttatcttcactatgattatagttgattgcaatacttccattatctaataantattttcctcttaaccaaagactatctgttttatctttcttgttttcatattggggacttctatctctataatctttagatgtacttcctgaataagaagcatttaatagaagtttatctcctacttttccacctaaatgaacattttctcttaaagttctccaagaacctacttctaatcctgctccaccatatacagttttgtttgttggtgctttagtgattatatttactaccccaccaatagctccatctccatacataactgctcctgctccttgaagaacttctatttttgaaatttcttcaactggaacagaattcaaattaaatcctgcaagtccacttacaggtataccatctaacaagataacagtattaaattgtgctgttgctcctgaacctcttaaatctattgttggagaagaaccgtccatttctctaacaacaactccaggtactcctctaagtgcatcagcaatagtttttgcacctttttctttaatttcttttgcatttacaactgtcatatttttagttgtttcacgaacagaagttccaaaactatcagaagttacaactgtttgtttaagctccaaaacaggagtttcttctgcaaaagcactcacacttcctaatacaattaaagcnaataacataaattttttcttcatacttcctcctcttaaatatgtaatattttatgaataaaataaaaaagattaggaaacagaagatgcctaatcaaaaaaatattaataatggtaagtctcctgacttagtttcaacctacttttacaccttcccagtttcccagtggttattgtaatttcgtccaccatacagtagcntttgctgtgtgggattctcacccaacttcctttattaagccaataagcacctatttgtttcttgtctttatggtactatatatgantataattgtcaataaaataaaaaacaccacttattatagaaagtagtgttttcttttattatttactttaatttccaagtagaaccttagggaagtcatatttacaatatgattaagcactttgctcctacacctacaaggacttacctacctgttaaaataattatactctactaagagatatatgtcaaatttttatttattaatcatataccaaaattgtgtggtggaaaataaagtatttctattttcataaactttatatttattgcttttatactttctttttcataacatctccaataataattacatataaaatcagctaattgaatctcaaaattctttgctgaatctacataatatactttatctaaatttatcttggaattaaaataaaactcaccttgtaaatattcttctaatgtgttaatagaaccaacttttattgttttattatctagttttattataagatttgcttgattanttattaaatttagagttgctaatcttgttactaaaagttttataaaataattatataatatattaactttttcaataggtttttctaagttatttttatcaataactataaaaactggaatataaaaattattttttgacattttatttgaaatagatagtagcatgtttcttttatcataattttttatcatagaacctttgatttcaaccatattatctaagttattgttaattttataagtagacaattcttttttaaataattgtctagcctttaaggcattgttagtcaaatatcctcctataataaagtatctatctttactatttttatgtaaatttcctgactcatcaagaattaaatacaaattatccaaaatatcacttcctcaattaatttttccaaacttcacttggtttaaatgtttctgaacttttatcttcaatatcattatgtatttttaactctaattgtatattaaaaccttctcctactaccagagcatgtccagtttttaaatatgataatcttaataattgtgcatctaaaatataaggtatactttttctcatttgttctaaatcaatattatttcttattctatgtaaaataaaattattacattgagataaaactgtttttgatagttcagaaggtctttgactagataaaatcataaatatcccaaattttcttccttcttttgctattttttcaaatacagcaataggattaaagctagtgacatctgtattttctgatatataagtatgtgcttcatcaaaaataaaatggattaaattttttataccactctttctattatttttttctctttcataaatattatttaaaataaaacttgtaataaaaagtaaatcatgattatcataaccactacaatttattatttcaaatgctttatctttgtgttttaataataaattaaatttatttaacttgtttttgtcacttgaaaatagagtttttgaatattgattaattaaattatcaactctagtgattaatggtgagcaataatttctaatttgatttccaccttttgcttcttctattgacaatatagtatccaaagctatttttaaagtcattatatcttttatagaaacttcagcgtctcttaaattaacatataaaaattcttcagcattattttcccctatatactttaagatataattgtctaagctactcaaaaaattttcctctactatttgagtagaaaaattgctatatttagaatcatagttacttaaattttttttaatattttcatcatcaatttcacttaaaaaacttattattttatttctctttgcaactgcatctgtttgttggctttcatataattttttggcacaataaacttttatccagttagatatattatcacttgactttttttctaaaagatttcctaattttaaagtatttattaagataggaagttgaacagcagtagaaggaagtactaaattt

SEQ ID NO: 307 - DNA, 4000 bp, Escherichia coli
  misc_feature (1991)..(1991): n is a, c, g, or t
cgccgtcttcgcctgcgcgttcgtgctcgccgtgacgaaatccttcatcccctcaatctctggttctcgctcgatcgccgctcgcatcgcgcgcatcatctcgcgcgcctccatctcttttgttctcgctctcttttccttggacgcgcgcctcgcggcgtccgctcgttcatcccgagacgcagcgtcgctgcttccgaacgcgttcgtgctccccaaccgtctcgcgttcgacgccgccgcgcgcgatgacgacgatgacgacgaggacgacggcggcggcgacaaccgctcgatcgcccgtcgacgctcctcctcgctcgcgaaccgaggctttgactccctgtcaccgccctcgttcgattccacacgcgcgacgaccgcgccgcgtcgtccgcgaccgacgcgaccgacgcggcgcgccaccgcggacgtcgacaccgacggcgagaccgacgcgcgcgcggctctctccgtcggcaccgcgcgcgtccatcgcgcgacgtccatgaggcgcgcgctcgaatatgattctcgagggactccattctcaccagttcacaggagtacgcgaaagtactctttgagctgagcaaactggaatgatgagtgaccaagaggaagatgaagaaatgaattggataccgacgacgccgacggcgctcgctacgagttttgtaatactacgtacaaccaaaatgttttactacaaatgtactacaaatgattcgaacactcgtgtatacgacgaacacgcgcacacgtagctttaccctccttcaactatgtcgtcgagatgggcccatctacattgccttgtttcattcacgaagcgggcgccgtcgcgtcgcgtcgattgagctcgttcaagacagccaccgcctcgtccatcgtgcgaggtcgcctatcatacgcccgacgtcgggtgaattgttcagccatggagattattcttctatctgccgcgctcccggatttacgaaccgcacccgaagccacgagcacgctcgcgcagcgttcgtgcaactcagtcggcacgagcgccttcatcttttcaaacaagtcttcaagcgagtcgccggcggcggaagcttcctcctgagcgttggcgatggcgacgcgagccgacgcatcgtccaaagcttgccttgcgagctgtttcgcattcattttgaaccccgtgagatctgccaccgttcgtcgaagcacctgcgcacccgacagcgccgcggttgcgccgtcgtcgacgtcccgcgccgcgcgcgcgatcggtccgtacgccgcgaattcttcttcagccctatacacgtgcgagcgagcgaacgaatcgacgacgatgcaaaactcatccgtcagttcaaatcccgtcggggcgggtgtcgagcgtcgaggtcgtgtcgagatcgcaaagcgcgcttgtgtttgacgcaccacttgtgccgattttcgacggaacgaaacggcttcgtgaagacgaacacgagactactcgtcggaaactggcgcgcgcaatcttcgatgcgtctcttgacgctgcgcatgcgcgcgctccatcgcgccgacacccgtcgcgactcgatcgcgtccaacgcatcaatcatgtcctgcgtgagcgggggcgccttgtgcaaacgaaatccatcgttttcatccctggacgccgatcgcgcgtcggcgcttccatcgcgatcgccgcgcggtgcgccaccgtcgtccaccccggccgtcgtcgtcgtcgtcgtccgccgcggctcccgacgacgacccgacggcggccgcggcatgcgtcgatgcgacgcgcgcgggcgtctcgaatcgcgcgccgacgacgcgacgcgtgcgcgcgtcgacgcgtgcggtgcgcccggtcgccgatgcgcgtcgagcgcgcgtcgagtccgcgcgcgcgtcgacctctcgtgggggatcacacatggatgcaaaaacgagttttgttgatttgaattcaaatgtagggttccttcgggcgngaaagcaacgcgacacgtcgacgcgtgaacaacacgcgacgaacgtgaacgttacagacaccgttggggtgcgaggcgtcagattacgtcgtgggcaccgaccatgcgaccgacggtggcgcgctcgacgacgccgaccgcggcggcgacgcgcgcgacacggacgaaacgtccgtcttcgcgcgtctcgcgcgcgcgcggtgcgacgacgccgccgcgagcgacgccgcgaggcgaggatgagggacagcgtcagcgatccgtcgcgccgcgcgcgccggcggcgttcgcgtcgatgacgcgcgtcggtgggcgcggacgattgaggcgcggcgacgcgcacgtcgcgcgcttcctgaagcgcctgttcagccgcgacgaggacgacggtgcggacgaggagagagagaaggaggagtctgaaaaagagaaacccgaagaggtcgtcgacgcgtcgagcgctccggcgcaggcgacgagcgcgcccgcggcgtcgtcgttgcccaaggtggacatgaagacgacgctgagcgatctggacgcgctcttggggatcgatacggaggcggaggcggcgaagaaggcggcagaagaggaggcgtttcgagcgacgctgcgaccgccgtcgacggacgagggcgacgcgtcctcggacgcaccggcgagcgacgacgggatgtccatcagtccgcaggcgctcgacgctttgaaagcggcggaatcgcagcgacgggggttgggacaggataaaagcgcggagttggagaagatgttgaaggatttgggcgagagggcgagcgaaaacaaggcgctggggaaaagcgtgagcgacgacccggagcttcaagcgtcgttcaataaattggttactatgttagaggagcccgaggaagaggtgatctcgcccgaaaatgtcgagcgaatcaagaaggaggtattcggcatgcaaacgttttacgtcacttcggtggaaaatttgggcgccgagatgaacggggcgggtgtcttgttcaagggtaatttgcgaacggagcgcgcggtggtttgggaaacgttacaaaaggaactcaagcgcatgttcaaggacgagtacaccgcattcatgctcgaagaaccgctctcggaggaaggtccgagcggagacgtggcaatcgactccaagtacggaccgcgcgtgagtttcctcatcgtaccgagcgatcgtgcgggtccgattccggataccgcgggttggcagtaccttctcgcgctcgcgctcatggctctcacggtgggttccgccgttcagctgggcttggttgcggaaatctccaagcttccgccggaaaccatgtcgtggttgcaacaagccggcgacgtcgatttacccgaaggcgtgttgccgccgggtttggaagactttgactccgtcgcgtacgtcgaagccgcgcttccgatcacgatcggtgtcatggcggcgagcgtgggacacgagatcggtcatcaaattgcagcgtttatgcgcaagattaaaatcggcgttccgttcttgattccgaactcgcagctcggaacgttcggcacgttgacgcagttcaagagcatacccgagacgcgcgccgatttgttcgacgtcgccgccgcgggcccactcgctgggagcatggtggcgttgaacctgttcgtgtacggtttgacgctctccgtcggcggggacaacccggatttgatccccatcccggactcgttgttcaacaccagccttttgctcggcggtatttcgcagttcttcttgcacgtcagcgctaaaggcgtgctcgtacacccgtatttcatcgccggatggtgcgcgctgacgacgcaagcgctcaacttgctccccgtcggatccatcgacggaggccgcatggcgcaaaccgcgttcggccggcgcgttctcggcgccacctccctcggcacgtacatcagcctcagtttcggcatcatcgccagctcactcgccttaccgtgggccatttacatcgtattga

SEQ ID NO: 308 - DNA, 4000 bp, Escherichia coli
  misc_feature (1)..(2): n is a, c, g, or t
  misc_feature (5)..(5): n is a, c, g, or t
  misc_feature (7)..(7): n is a, c, g, or t
  misc_feature (9)..(9): n is a, c, g, or t
  misc_feature (11)..(11): n is a, c, g, or t
  misc_feature (13)..(20): n is a, c, g, or t
  misc_feature (24)..(26): n is a, c, g, or t
  misc_feature (28)..(35): n is a, c, g, or t
  misc_feature (38)..(39): n is a, c, g, or t
  misc_feature (42)..(45): n is a, c, g, or t
  misc_feature (48)..(49): n is a, c, g, or t
  misc_feature (51)..(54): n is a, c, g, or t
  misc_feature (56)..(57): n is a, c, g, or t
  misc_feature (59)..(59): n is a, c, g, or t
  misc_feature (62)..(64): n is a, c, g, or t
  misc_feature (66)..(66): n is a, c, g, or t
  misc_feature (71)..(71): n is a, c, g, or t
  misc_feature (73)..(73): n is a, c, g, or t
  misc_feature (75)..(80): n is a, c, g, or t
  misc_feature (82)..(83): n is a, c, g, or t
  misc_feature (86)..(86): n is a, c, g, or t
  misc_feature (89)..(90): n is a, c, g, or t
  misc_feature (93)..(93): n is a, c, g, or t
  misc_feature (96)..(97): n is a, c, g, or t
  misc_feature (100)..(101): n is a, c, g, or t
  misc_feature (103)..(104): n is a, c, g, or t
  misc_feature (106)..(110): n is a, c, g, or t
  misc_feature (114)..(114): n is a, c, g, or t
  misc_feature (116)..(119): n is a, c, g, or t
  misc_feature (121)..(121): n is a, c, g, or t
  misc_feature (124)..(127): n is a, c, g, or t
  misc_feature (130)..(131): n is a, c, g, or t
  misc_feature (133)..(134): n is a, c, g, or t
  misc_feature (136)..(136): n is a, c, g, or t
  misc_feature (140)..(143): n is a, c, g, or t
  misc_feature (146)..(152): n is a, c, g, or t
  misc_feature (155)..(156): n is a, c, g, or t
  misc_feature (158)..(162): n is a, c, g, or t
  misc_feature (164)..(164): n is a, c, g, or t
  misc_feature (169)..(169): n is a, c, g, or t
  misc_feature (171)..(174): n is a, c, g, or t
  misc_feature (176)..(177): n is a, c, g, or t
  misc_feature (179)..(183): n is a, c, g, or t
  misc_feature (185)..(185): n is a, c, g, or t
  misc_feature (188)..(189): n is a, c, g, or t
  misc_feature (191)..(192): n is a, c, g, or t
  misc_feature (194)..(204): n is a, c, g, or t
  misc_feature (206)..(209): n is a, c, g, or t
  misc_feature (212)..(213): n is a, c, g, or t
  misc_feature (215)..(219): n is a, c, g, or t
  misc_feature (223)..(233): n is a, c, g, or t
  misc_feature (235)..(236): n is a, c, g, or t
  misc_feature (238)..(241): n is a, c, g, or t
  misc_feature (244)..(244): n is a, c, g, or t
  misc_feature (246)..(246): n is a, c, g, or t
  misc_feature (249)..(249): n is a, c, g, or t
  misc_feature (252)..(252): n is a, c, g, or t
  misc_feature (254)..(266): n is a, c, g, or t
  misc_feature (269)..(275): n is a, c, g, or t
  misc_feature (278)..(282): n is a, c, g, or t
  misc_feature (284)..(289): n is a, c, g, or t
  misc_feature (291)..(294): n is a, c, g, or t
  misc_feature (296)..(296): n is a, c, g, or t
  misc_feature (298)..(298): n is a, c, g, or t
  misc_feature (300)..(316): n is a, c, g, or t
  misc_feature (319)..(336): n is a, c, g, or t
  misc_feature (338)..(341): n is a, c, g, or t
  misc_feature (344)..(345): n is a, c, g, or t
  misc_feature (350)..(350): n is a, c, g, or t
  misc_feature (353)..(353): n is a, c, g, or t
  misc_feature (357)..(357): n is a, c, g, or t
  misc_feature (360)..(361): n is a, c, g, or t
  misc_feature (364)..(366): n is a, c, g, or t
  misc_feature (369)..(376): n is a, c, g, or t
  misc_feature (378)..(380): n is a, c, g, or t
  misc_feature (382)..(382): n is a, c, g, or t
  misc_feature (384)..(385): n is a, c, g, or t
  misc_feature (388)..(389): n is a, c, g, or t
  misc_feature (391)..(405): n is a, c, g, or t
  misc_feature (407)..(410): n is a, c, g, or t
  misc_feature (412)..(418): n is a, c, g, or t
  misc_feature (420)..(420): n is a, c, g, or t
  misc_feature (423)..(425): n is a, c, g, or t
  misc_feature (428)..(430): n is a, c, g, or t
  misc_feature (433)..(448): n is a, c, g, or t
  misc_feature (450)..(457): n is a, c, g, or t
  misc_feature (459)..(460): n is a, c, g, or t
  misc_feature (462)..(469): n is a, c, g, or t
  misc_feature (472)..(474): n is a, c, g, or t
  misc_feature (477)..(477): n is a, c, g, or t
  misc_feature (479)..(479): n is a, c, g, or t
  misc_feature (481)..(482): n is a, c, g, or t
  misc_feature (486)..(486): n is a, c, g, or t
  misc_feature (488)..(493): n is a, c, g, or t
  misc_feature (495)..(497): n is a, c, g, or t
  misc_feature (503)..(506): n is a, c, g, or t
  misc_feature (509)..(510): n is a, c, g, or t
  misc_feature (512)..(515): n is a, c, g, or t
  misc_feature (517)..(518): n is a, c, g, or t
  misc_feature (521)..(521): n is a, c, g, or t
  misc_feature (524)..(527): n is a, c, g, or t
  misc_feature (531)..(537): n is a, c, g, or t
  misc_feature (539)..(546): n is a, c, g, or t
  misc_feature (548)..(550): n is a, c, g, or t
  misc_feature (554)..(557): n is a, c, g, or t
  misc_feature (559)..(561): n is a, c, g, or t
  misc_feature (563)..(564): n is a, c, g, or t
  misc_feature (566)..(566): n is a, c, g, or t
  misc_feature (569)..(569): n is a, c, g, or t
  misc_feature (571)..(572): n is a, c, g, or t
  misc_feature (574)..(574): n is a, c, g, or t
  misc_feature (576)..(576): n is a, c, g, or t
  misc_feature (578)..(583): n is a, c, g, or t
  misc_feature (585)..(593): n is a, c, g, or t
  misc_feature (595)..(598): n is a, c, g, or t
  misc_feature (600)..(600): n is a, c, g, or t
  misc_feature (603)..(605): n is a, c, g, or t
  misc_feature (607)..(609): n is a, c, g, or t
  misc_feature (611)..(611): n is a, c, g, or t
  misc_feature (613)..(613): n is a, c, g, or t
  misc_feature (616)..(616): n is a, c, g, or t
  misc_feature (618)..(624): n is a, c, g, or t
  misc_feature (626)..(626): n is a, c, g, or t
  misc_feature (629)..(630): n is a, c, g, or t
  misc_feature (632)..(634): n is a, c, g, or t
  misc_feature (636)..(640): n is a, c, g, or t
  misc_feature (642)..(643): n is a, c, g, or t
  misc_feature (645)..(656): n is a, c, g, or t
  misc_feature (658)..(658): n is a, c, g, or t
  misc_feature (660)..(666): n is a, c, g, or t
  misc_feature (668)..(670): n is a, c, g, or t
  misc_feature (672)..(674): n is a, c, g, or t
  misc_feature (676)..(685): n is a, c, g, or t
  misc_feature (688)..(690): n is a, c, g, or t
  misc_feature (692)..(692): n is a, c, g, or t
  misc_feature (694)..(696): n is a, c, g, or t
  misc_feature (698)..(705): n is a, c, g, or t
  misc_feature (708)..(710): n is a, c, g, or t
  misc_feature (715)..(718): n is a, c, g, or t
  misc_feature (720)..(721): n is a, c, g, or t
  misc_feature (723)..(733): n is a, c, g, or t
  misc_feature (735)..(739): n is a, c, g, or t
  misc_feature (741)..(743): n is a, c, g, or t
  misc_feature (747)..(750): n is a, c, g, or t
  misc_feature (752)..(755): n is a, c, g, or t
  misc_feature (758)..(765): n is a, c, g, or t
  misc_feature (769)..(779): n is a, c, g, or t
  misc_feature (781)..(781): n is a, c, g, or t
  misc_feature (783)..(785): n is a, c, g, or t
  misc_feature (789)..(800): n is a, c, g, or t
  misc_feature (802)..(803): n is a, c, g, or t
  misc_feature (805)..(806): n is a, c, g, or t
  misc_feature (808)..(813): n is a, c, g, or t
  misc_feature (815)..(827): n is a, c, g, or t
  misc_feature (829)..(838): n is a, c, g, or t
  misc_feature (840)..(842): n is a, c, g, or t
  misc_feature (844)..(849): n is a, c, g, or t
  misc_feature (851)..(851): n is a, c, g, or t
  misc_feature (853)..(853): n is a, c, g, or t
  misc_feature (855)..(861): n is a, c, g, or t
  misc_feature (863)..(871): n is a, c, g, or t
  misc_feature (873)..(875): n is a, c, g, or t
  misc_feature (877)..(880): n is a, c, g, or t
  misc_feature (884)..(890): n is a, c, g, or t
  misc_feature (893)..(898): n is a, c, g, or t
  misc_feature (900)..(901): n is a, c, g, or t
  misc_feature (903)..(934): n is a, c, g, or t
  misc_feature (936)..(941): n is a, c, g, or t
  misc_feature (943)..(950): n is a, c, g, or t
  misc_feature (952)..(953): n is a, c, g, or t
  misc_feature (956)..(958): n is a, c, g, or t
  misc_feature (960)..(960): n is a, c, g, or t
  misc_feature (962)..(964): n is a, c, g, or t
  misc_feature (969)..(969): n is a, c, g, or t
  misc_feature (972)..(972): n is a, c, g, or t
  misc_feature (974)..(974): n is a, c, g, or t
  misc_feature (977)..(979): n is a, c, g, or t
  misc_feature (981)..(987): n is a, c, g, or t
  misc_feature (989)..(994): n is a, c, g, or t
  misc_feature (997)..(1006): n is a, c, g, or t
  misc_feature (1008)..(1010): n is a, c, g, or t
  misc_feature (1012)..(1012): n is a, c, g, or t
  misc_feature (1014)..(1017): n is a, c, g, or t
  misc_feature (1019)..(1023): n is a, c, g, or t
  misc_feature (1025)..(1025): n is a, c, g, or t
  misc_feature (1027)..(1027): n is a, c, g, or t
  misc_feature (1030)..(1032): n is a, c, g, or t
  misc_feature (1035)..(1035): n is a, c, g, or t
  misc_feature (1039)..(1039): n is a, c, g, or t
  misc_feature (1041)..(1044): n is a, c, g, or t
  misc_feature (1046)..(1049): n is a, c, g, or t
  misc_feature (1051)..(1053): n is a, c, g, or t
  misc_feature (1056)..(1058): n is a, c, g, or t
  misc_feature (1060)..(1063): n is a, c, g, or t
  misc_feature (1066)..(1071): n is a, c, g, or t
  misc_feature (1073)..(1073): n is a, c, g, or t
  misc_feature (1075)..(1075): n is a, c, g, or t
  misc_feature (1078)..(1078): n is a, c, g, or t
  misc_feature (1080)..(1085): n is a, c, g, or t
  misc_feature (1087)..(1087): n is a, c, g, or t
  misc_feature (1089)..(1093): n is a, c, g, or t
  misc_feature (1095)..(1098): n is a, c, g, or t
  misc_feature (1100)..(1101): n is a, c, g, or t
  misc_feature (1103)..(1104): n is a, c, g, or t
  misc_feature (1107)..(1107): n is a, c, g, or t
  misc_feature (1109)..(1109): n is a, c, g, or t
  misc_feature (1111)..(1111): n is a, c, g, or t
  misc_feature (1113)..(1113): n is a, c, g, or t
  misc_feature (1115)..(1117): n is a, c, g, or t
  misc_feature (1119)..(1122): n is a, c, g, or t
  misc_feature (1124)..(1128): n is a, c, g, or t
  misc_feature (1130)..(1131): n is a, c, g, or t
  misc_feature (1134)..(1139): n is a, c, g, or t
  misc_feature (1142)..(1142): n is a, c, g, or t
  misc_feature (1145)..(1146): n is a, c, g, or t
  misc_feature (1148)..(1148): n is a, c, g, or t
  misc_feature (1152)..(1154): n is a, c, g, or t
  misc_feature (1156)..(1157): n is a, c, g, or t
  misc_feature (1159)..(1159): n is a, c, g, or t
  misc_feature (1161)..(1166): n is a, c, g, or t
  misc_feature (1168)..(1172): n is a, c, g, or t
  misc_feature (1174)..(1174): n is a, c, g, or t
  misc_feature (1177)..(1177): n is a, c, g, or t
  misc_feature (1179)..(1181): n is a, c, g, or t
  misc_feature (1184)..(1184): n is a, c, g, or t
  misc_feature (1186)..(1186): n is a, c, g, or t
  misc_feature (1188)..(1192): n is a, c, g, or t
  misc_feature (1194)..(1196): n is a, c, g, or t
  misc_feature (1198)..(1208): n is a, c, g, or t
  misc_feature (1210)..(1213): n is a, c, g, or t
  misc_feature (1216)..(1216): n is a, c, g, or t
  misc_feature (1218)..(1221): n is a, c, g, or t
  misc_feature (1223)..(1225): n is a, c, g, or t
  misc_feature (1228)..(1230): n is a, c, g, or t
  misc_feature (1233)..(1233): n is a, c, g, or t
  misc_feature (1235)..(1240): n is a, c, g, or t
  misc_feature (1242)..(1243): n is a, c, g, or t
  misc_feature (1245)..(1253): n is a, c, g, or t
  misc_feature (1255)..(1258): n is a, c, g, or t
  misc_feature (1261)..(1263): n is a, c, g, or t
  misc_feature (1265)..(1268): n is a, c, g, or t
  misc_feature (1270)..(1272): n is a, c, g, or t
  misc_feature (1274)..(1276): n is a, c, g, or t
  misc_feature (1278)..(1282): n is a, c, g, or t
  misc_feature (1286)..(1286): n is a, c, g, or t
  misc_feature (1289)..(1290): n is a, c, g, or t
  misc_feature (1292)..(1296): n is a, c, g, or t
  misc_feature (1298)..(1303): n is a, c, g, or t
  misc_feature (1305)..(1311): n is a, c, g, or t
  misc_feature (1314)..(1314): n is a, c, g, or t
  misc_feature (1318)..(1319): n is a, c, g, or t
  misc_feature (1325)..(1336): n is a, c, g, or t
  misc_feature (1339)..(1343): n is a, c, g, or t
  misc_feature (1345)..(1346): n is a, c, g, or t
  misc_feature (1348)..(1352): n is a, c, g, or t
  misc_feature (1355)..(1356): n is a, c, g, or t
  misc_feature (1358)..(1360): n is a, c, g, or t
  misc_feature (1362)..(1368): n is a, c, g, or t
  misc_feature (1371)..(1374): n is a, c, g, or t
  misc_feature (1376)..(1384): n is a, c, g, or t
  misc_feature (1391)..(1394): n is a, c, g, or t
  misc_feature (1396)..(1397): n is a, c, g, or t
  misc_feature (1401)..(1403): n is a, c, g, or t
  misc_feature (1405)..(1406): n is a, c, g, or t
  misc_feature (1408)..(1414): n is a, c, g, or t
  misc_feature (1416)..(1420): n is a, c, g, or t
  misc_feature (1422)..(1428): n is a, c, g, or t
  misc_feature (1431)..(1432): n is a, c, g, or t
  misc_feature (1434)..(1436): n is a, c, g, or t
  misc_feature (1438)..(1454): n is a, c, g, or t
  misc_feature (1456)..(1456): n is a, c, g, or t
  misc_feature (1458)..(1458): n is a, c, g, or t
  misc_feature (1460)..(1461): n is a, c, g, or t
  misc_feature (1463)..(1465): n is a, c, g, or t
  misc_feature (1468)..(1474): n is a, c, g, or t
  misc_feature (1476)..(1476): n is a, c, g, or t
  misc_feature (1479)..(1486): n is a, c, g, or t
  misc_feature (1488)..(1490): n is a, c, g, or t
  misc_feature (1493)..(1496): n is a, c, g, or t
  misc_feature (1498)..(1510): n is a, c, g, or t
  misc_feature (1512)..(1513): n is a, c, g, or t
  misc_feature (1516)..(1517): n is a, c, g, or t
  misc_feature (1519)..(1520): n is a, c, g, or t
  misc_feature (1522)..(1522): n is a, c, g, or t
  misc_feature (1525)..(1525): n is a, c, g, or t
  misc_feature (1527)..(1529): n is a, c, g, or t
  misc_feature (1531)..(1531): n is a, c, g, or t
  misc_feature (1533)..(1533): n is a, c, g, or t
  misc_feature (1535)..(1536): n is a, c, g, or t
  misc_feature (1540)..(1542): n is a, c, g, or t
  misc_feature (1546)..(1549): n is a, c, g, or t
  misc_feature (1551)..(1552): n is a, c, g, or t
  misc_feature (1554)..(1555): n is a, c, g, or t
  misc_feature (1557)..(1557): n is a, c, g, or t
  misc_feature (1563)..(1563): n is a, c, g, or t
  misc_feature (1565)..(1571): n is a, c, g, or t
  misc_feature (1574)..(1575): n is a, c, g, or t
  misc_feature (1577)..(1577): n is a, c, g, or t
  misc_feature (1580)..(1584): n is a, c, g, or t
  misc_feature (1586)..(1586): n is a, c, g, or t
  misc_feature (1588)..(1588): n is a, c, g, or t
  misc_feature (1593)..(1598): n is a, c, g, or t
  misc_feature (1602)..(1605): n is a, c, g, or t
  misc_feature (1609)..(1609): n is a, c, g, or t
  misc_feature (1611)..(1611): n is a, c, g, or t
  misc_feature (1615)..(1619): n is a, c, g, or t
  misc_feature (1621)..(1622): n is a, c, g, or t
  misc_feature (1624)..(1629): n is a, c, g, or t
  misc_feature (1632)..(1632): n is a, c, g, or t
  misc_feature (1635)..(1635): n is a, c, g, or t
  misc_feature (1639)..(1640): n is a, c, g, or t
  misc_feature (1642)..(1643): n is a, c, g, or t
  misc_feature (1645)..(1646): n is a, c, g, or t
  misc_feature (1648)..(1650): n is a, c, g, or t
  misc_feature (1652)..(1657): n is a, c, g, or t
  misc_feature (1660)..(1670): n is a, c, g, or t
  misc_feature (1672)..(1673): n is a, c, g, or t
  misc_feature (1677)..(1677): n is a, c, g, or t
  misc_feature (1679)..(1681): n is a, c, g, or t
  misc_feature (1683)..(1684): n is a, c, g, or t
  misc_feature (1687)..(1691): n is a, c, g, or t
  misc_feature (1693)..(1693): n is a, c, g, or t
  misc_feature (1696)..(1700): n is a, c, g, or t
  misc_feature (1702)..(1704): n is a, c, g, or t
  misc_feature (1706)..(1711): n is a, c, g, or t
  misc_feature (1714)..(1714): n is a, c, g, or t
  misc_feature (1716)..(1718): n is a, c, g, or t
  misc_feature (1720)..(1720): n is a, c, g, or t
  misc_feature (1723)..(1724): n is a, c, g, or t
  misc_feature (1726)..(1726): n is a, c, g, or t
  misc_feature (1728)..(1739): n is a, c, g, or t
  misc_feature (1741)..(1744): n is a, c, g, or t
  misc_feature (1746)..(1746): n is a, c, g, or t
  misc_feature (1748)..(1750): n is a, c, g, or t
  misc_feature (1752)..(1753): n is a, c, g, or t
  misc_feature (1758)..(1758): n is a, c, g, or t
  misc_feature (1760)..(1761): n is a, c, g, or t
  misc_feature (1764)..(1770): n is a, c, g, or t
  misc_feature (1773)..(1774): n is a, c, g, or t
  misc_feature (1776)..(1776): n is a, c, g, or t
  misc_feature (1778)..(1779): n is a, c, g, or t
  misc_feature (1782)..(1785): n is a, c, g, or t
  misc_feature (1981)..(1982): n is a, c, g, or t
  misc_feature (1989)..(1990): n is a, c, g, or t
  misc_feature (2366)..(2377): n is a, c, g, or t
  misc_feature (2379)..(2398): n is a, c, g, or t
  misc_feature (2400)..(2412): n is a, c, g, or t
  misc_feature (2414)..(2423): n is a, c, g, or t
  misc_feature (2425)..(2481): n is a, c, g, or t
  misc_feature (2483)..(2524): n is a, c, g, or t
  misc_feature (2526)..(2528): n is a, c, g, or t
  misc_feature (2530)..(2572): n is a, c, g, or t
  misc_feature (2574)..(2577): n is a, c, g, or t
  misc_feature (2579)..(2596): n is a, c, g, or t
  misc_feature (2598)..(2650): n is a, c, g, or t
  misc_feature (2652)..(2660): n is a, c, g, or t
  misc_feature (2662)..(2773): n is a, c, g, or t
  misc_feature (2775)..(2778): n is a, c, g, or t
  misc_feature (2780)..(2866): n is a, c, g, or t
  misc_feature (2868)..(2943): n is a, c, g, or t
  misc_feature (2945)..(2986): n is a, c, g, or t
  misc_feature (2988)..(2990): n is a, c, g, or t
  misc_feature (2992)..(3005): n is a, c, g, or t
  misc_feature (3007)..(3046): n is a, c, g, or t
  misc_feature (3048)..(3254): n is a, c, g, or t
  misc_feature (3256)..(3585): n is a, c, g, or t
  misc_feature (3587)..(3595): n is a, c, g, or t
  misc_feature (3597)..(3889): n is a, c, g, or t
  misc_feature (3891)..(4000): n is a, c, g, or t
nnatntntntnannnnnnnnttannnannnnnnnnaannaannnntanntnnnnanntnttnnnanttatnantnnnnnnannatntanntantanntannannannnnnaaantnnnnanaannnnatnnanntnaatnnnnttnnnnnnnttnntnnnnntnaaaanannnntnntnnnnnanatnntnntnnnnnnnnnnnannnnaannannnnnaaannnnnnnnnnnanntnnnnaanantantanannnnnnnnnnnnnttnnnnnnngtnnnnntnnnnnnannnntntnannnnnnnnnnnnnnnnnttnnnnnnnnnnnnnnnnnntnnnnatnnaaaanaanaaantannaannnaannnnnnnntnnntnannaannannnnnnnnnnnnnnntnnnnannnnnnnantannngannnaannnnnnnnnnnnnnnnannnnnnnnanntnnnnnnnnttnnntananannaaanannnnnnannnaaaatnnnntanntnnnnannttnttnnnnaaannnnnnntnnnnnnnnannnaaannnnannnanntnttnanntntnannnnnnannnnnnnnnannnnanaannnannnanantanannnnnnnanttnntnnnannnnntnnannnnnnnnnnnnanannnnnnntnnnannnannnnnnnnnnttnnntntnnntnnnnnnnnaannnaattnnnntnntnnnnnnnnnnnannnnnannnaaannnnannnnaannnnnnnnttannnnnnnnnnnantnnntaannnnnnnnnnnntnntnntnnnnnnannnnnnnnnnnnntnnnnnnnnnnannntnnnnnnanantnnnnnnnannnnnnnnnannnannnnaaannnnnnntannnnnnanntnnnnnnnnnnnnnnnnnnnnnnnnnnnnnnnntnnnnnntnnnnnnnntnntannnanannnataanttntnttnnntnnnnnnnannnnnnaannnnnnnnnnannnantnnnntnnnnnananaannnaanaaantnnnnannnntnnnatnnnannnntannnnnnantntanannnnnntntnnnnnannnntnnannaananantntnnntnnnnannnnntnnatnnnnnnaanaannanaaannnannanannnnnntnnnnnanaancnnnaanantnnnnntnnnannnnnnnnnnntnnnnaantnnnntnnnaannnttnannnnnntnnannnnnnnnnannnnttnnntnnnntnnngnnncnnnnnaaanttnnannnnngnnnnnnannnnnnnttnaaannaaaaannnnnnnnnnnnttnnnnntnnannnnnagnnannnannnnnnntcnnnntnnnnnnnnnattggtnnnnannaaannnanntnnnnnnntnnnnntnnnnnnnttnnannnannnnnnnnnnnnnnnnnantntnnannnttnnnnnnntnacnnnnnnnnannntgnnnnannnnnnnnnnnnnannttnnanntnctntnnnanantnnaaannnaatnnnnannanntngtttanannnnnnnaannantannnnnantnaactnnnnnnaatnnnntttnangcannnnntnnannnnnnttnctntcannanntnntnnnannnnnnctnnnnnnnnnnnannaaancnnncnntannnnntncannnnnannncnnnnnnaanannnanaanntnannnnnnnnnnnnannnnanannntnntaagnannttnnnnnnnatnnantnnaannnnaaaaaaagaccttccaaaaggaaggtcactgttgcctggcaacgttctagtctcgcagggcgtaaacccaactacattcgacgctaaagagcttaacttctgtgttcggtatgggtacaggtgtgtcctcttcgctatcgccaccagacgaaaacttcatacatctattatatcatcatttattcctttgtcaacnncttactnnaaagaacttcacttgattaagtcctcgacctattagtattagtcagctgaatgtgttaccacacttacactcctaacctattctccttgtcgtcttcaaggggtcttaatatccgtgggaaatctcatctcgaggggggcttcatgcttagatgctttcagctcttatcccttccatatttagctacccagctatgccactggcgtgacaactggtacaccattgatatgtccatcccggtcctctcgtactaaggacagctcctctcaaatttcctacgcccacgacggatagggaccgaactgtctcacgacgttctgaacccagctcgcgtaccgctttaatgggcgaacagcccaacccttgggaccgactnnnnnnnnnnnntnnnnnnnnnnnnnnnnnnnntnnnnnnnnnnnnngnnnnnnnnnncnnnnnnnnnnnnnnnnnnnnnnnnnnnnnnnnnnnnnnnnnnnnnnnnnnnnnnnnncnnnnnnnnnnnnnnnnnnnnnnnnnnnnnnnnnnnnnnnnnncnnncnnnnnnnnnnnnnnnnnnnnnnnnnnnnnnnnnnnnnnnnnnncnnnncnnnnnnnnnnnnnnnnnncnnnnnnnnnnnnnnnnnnnnnnnnnnnnnnnnnnnnnnnnnnnnnnnnnnnnnannnnnnnnncnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncnnnncnnnnnnnnnnnnnnnnnnnnnnnnnnnnnnnnnnnnnnnnnnnnnnnnnnnnnnnnnnnnnnnnnnnnnnnnnnnnnnnnnnnnnnncnnnnnnnnnnnnnnnnnnnnnnnnnnnnnnnnnnnnnnnnnnnnnnnnnnnnnnnnnnnnnnnnnnnnnnnnnnnncnnnnnnnnnnnnnnnnnnnnnnnnnnnnnnnnnnnnnnnnnncnnncnnnnnnnnnnnnnncnnnnnnnnnnnnnnnnnnnnnnnnnnnnnnnnnnnnnnnntnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntnnnnnnnnntnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 309 - DNA, 4000 bp, Escherichia coli
  misc_feature (63)..(63): n is a, c, g, or t
  misc_feature (177)..(177): n is a, c, g, or t
  misc_feature (201)..(201): n is a, c, g, or t
  misc_feature (222)..(222): n is a, c, g, or t
  misc_feature (227)..(227): n is a, c, g, or t
  misc_feature (255)..(255): n is a, c, g, or t
  misc_feature (312)..(312): n is a, c, g, or t
  misc_feature (331)..(331): n is a, c, g, or t
  misc_feature (345)..(345): n is a, c, g, or t
  misc_feature (438)..(438): n is a, c, g, or t
  misc_feature (489)..(489): n is a, c, g, or t
  misc_feature (615)..(615): n is a, c, g, or t
  misc_feature (648)..(648): n is a, c, g, or t
  misc_feature (663)..(663): n is a, c, g, or t
  misc_feature (909)..(909): n is a, c, g, or t
  misc_feature (1105)..(1106): n is a, c, g, or t
  misc_feature (1992)..(1992): n is a, c, g, or t
  misc_feature (2347)..(2347): n is a, c, g, or t
  misc_feature (2557)..(2557): n is a, c, g, or t
  misc_feature (2623)..(2623): n is a, c, g, or t
  misc_feature (2710)..(2710): n is a, c, g, or t
  misc_feature (2758)..(2758): n is a, c, g, or t
  misc_feature (2839)..(2839): n is a, c, g, or t
  misc_feature (2926)..(2926): n is a, c, g, or t
  misc_feature (2938)..(2938): n is a, c, g, or t
  misc_feature (2998)..(2998): n is a, c, g, or t
  misc_feature (3028)..(3028): n is a, c, g, or t
  misc_feature (3055)..(3055): n is a, c, g, or t
  misc_feature (3133)..(3133): n is a, c, g, or t
  misc_feature (3163)..(3163): n is a, c, g, or t
  misc_feature (3177)..(3177): n is a, c, g, or t
  misc_feature (3180)..(3180): n is a, c, g, or t
  misc_feature (3211)..(3211): n is a, c, g, or t
  misc_feature (3213)..(3213): n is a, c, g, or t
  misc_feature (3215)..(3215): n is a, c, g, or t
  misc_feature (3220)..(3221): n is a, c, g, or t
  misc_feature (3226)..(3226): n is a, c, g, or t
  misc_feature (3229)..(3230): n is a, c, g, or t
  misc_feature (3232)..(3235): n is a, c, g, or t
  misc_feature (3238)..(3238): n is a, c, g, or t
  misc_feature (3241)..(3241): n is a, c, g, or t
  misc_feature (3244)..(3246): n is a, c, g, or t
  misc_feature (3250)..(3250): n is a, c, g, or t
  misc_feature (3253)..(3255): n is a, c, g, or t
  misc_feature (3258)..(3262): n is a, c, g, or t
  misc_feature (3264)..(3264): n is a, c, g, or t
  misc_feature (3269)..(3271): n is a, c, g, or t
  misc_feature (3273)..(3273): n is a, c, g, or t
  misc_feature (3277)..(3277): n is a, c, g, or t
  misc_feature (3283)..(3284): n is a, c, g, or t
  misc_feature (3286)..(3288): n is a, c, g, or t
  misc_feature (3291)..(3291): n is a, c, g, or t
  misc_feature (3295)..(3297): n is a, c, g, or t
  misc_feature (3299)..(3300): n is a, c, g, or t
  misc_feature (3303)..(3303): n is a, c, g, or t
  misc_feature (3308)..(3310): n is a, c, g, or t
  misc_feature (3312)..(3312): n is a, c, g, or t
  misc_feature (3316)..(3318): n is a, c, g, or t
  misc_feature (3322)..(3322): n is a, c, g, or t
  misc_feature (3324)..(3324): n is a, c, g, or t
  misc_feature (3327)..(3327): n is a, c, g, or t
  misc_feature (3332)..(3333): n is a, c, g, or t
  misc_feature (3335)..(3336): n is a, c, g, or t
  misc_feature (3340)..(3340): n is a, c, g, or t
  misc_feature (3342)..(3342): n is a, c, g, or t
  misc_feature (3344)..(3346): n is a, c, g, or t
  misc_feature (3349)..(3350): n is a, c, g, or t
  misc_feature (3352)..(3355): n is a, c, g, or t
  misc_feature (3359)..(3366): n is a, c, g, or t
  misc_feature (3369)..(3369): n is a, c, g, or t
  misc_feature (3372)..(3372): n is a, c, g, or t
  misc_feature (3374)..(3374): n is a, c, g, or t
  misc_feature (3376)..(3376): n is a, c, g, or t
  misc_feature (3379)..(3380): n is a, c, g, or t
  misc_feature (3385)..(3389): n is a, c, g, or t
  misc_feature (3391)..(3391): n is a, c, g, or t
  misc_feature (3394)..(3396): n is a, c, g, or t
  misc_feature (3398)..(3398): n is a, c, g, or t
  misc_feature (3400)..(3400): n is a, c, g, or t
  misc_feature (3404)..(3405): n is a, c, g, or t
  misc_feature (3408)..(3410): n is a, c, g, or t
  misc_feature (3412)..(3412): n is a, c, g, or t
  misc_feature (3415)..(3420): n is a, c, g, or t
  misc_feature (3423)..(3423): n is a, c, g, or t
  misc_feature (3425)..(3427): n is a, c, g, or t
  misc_feature (3429)..(3435): n is a, c, g, or t
  misc_feature (3437)..(3437): n is a, c, g, or t
  misc_feature (3442)..(3442): n is a, c, g, or t
  misc_feature (3444)..(3444): n is a, c, g, or t
  misc_feature (3446)..(3446): n is a, c, g, or t
  misc_feature (3448)..(3448): n is a, c, g, or t
  misc_feature (3454)..(3462): n is a, c, g, or t
  misc_feature (3465)..(3465): n is a, c, g, or t
  misc_feature (3467)..(3470): n is a, c, g, or t
  misc_feature (3472)..(3474): n is a, c, g, or t
  misc_feature (3476)..(3478): n is a, c, g, or t
  misc_feature (3480)..(3481): n is a, c, g, or t
  misc_feature (3483)..(3485): n is a, c, g, or t
  misc_feature (3488)..(3489): n is a, c, g, or t
  misc_feature (3491)..(3492): n is a, c, g, or t
  misc_feature (3495)..(3496): n is a, c, g, or t
  misc_feature (3498)..(3498): n is a, c, g, or t
  misc_feature (3500)..(3500): n is a, c, g, or t
  misc_feature (3502)..(3503): n is a, c, g, or t
  misc_feature (3505)..(3509): n is a, c, g, or t
  misc_feature (3511)..(3513): n is a, c, g, or t
  misc_feature (3518)..(3518): n is a, c, g, or t
  misc_feature (3520)..(3521): n is a, c, g, or t
  misc_feature (3523)..(3525): n is a, c, g, or t
  misc_feature (3531)..(3531): n is a, c, g, or t
  misc_feature (3533)..(3533): n is a, c, g, or t
  misc_feature (3535)..(3535): n is a, c, g, or t
  misc_feature (3537)..(3539): n is a, c, g, or t
  misc_feature (3543)..(3543): n is a, c, g, or t
  misc_feature (3545)..(3550): n is a, c, g, or t
  misc_feature (3552)..(3557): n is a, c, g, or t
  misc_feature (3559)..(3560): n is a, c, g, or t
  misc_feature (3562)..(3562): n is a, c, g, or t
  misc_feature (3564)..(3566): n is a, c, g, or t
  misc_feature (3571)..(3571): n is a, c, g, or t
  misc_feature (3573)..(3573): n is a, c, g, or t
  misc_feature (3578)..(3581): n is a, c, g, or t
  misc_feature (3583)..(3584): n is a, c, g, or t
  misc_feature (3587)..(3587): n is a, c, g, or t
  misc_feature (3591)..(3591): n is a, c, g, or t
  misc_feature (3593)..(3593): n is a, c, g, or t
  misc_feature (3595)..(3597): n is a, c, g, or t
  misc_feature (3599)..(3600): n is a, c, g, or t
  misc_feature (3604)..(3607): n is a, c, g, or t
  misc_feature (3609)..(3611): n is a, c, g, or t
  misc_feature (3614)..(3615): n is a, c, g, or t
  misc_feature (3617)..(3619): n is a, c, g, or t
  misc_feature (3621)..(3625): n is a, c, g, or t
  misc_feature (3627)..(3628): n is a, c, g, or t
  misc_feature (3633)..(3635): n is a, c, g, or t
  misc_feature (3637)..(3639): n is a, c, g, or t
  misc_feature (3641)..(3644): n is a, c, g, or t
  misc_feature (3647)..(3653): n is a, c, g, or t
  misc_feature (3657)..(3660): n is a, c, g, or t
  misc_feature (3662)..(3663): n is a, c, g, or t
  misc_feature (3665)..(3668): n is a, c, g, or t
  misc_feature (3670)..(3671): n is a, c, g, or t
  misc_feature (3673)..(3677): n is a, c, g, or t
  misc_feature (3679)..(3681): n is a, c, g, or t
  misc_feature (3683)..(3685): n is a, c, g, or t
  misc_feature (3688)..(3688): n is a, c, g, or t
  misc_feature (3690)..(3690): n is a, c, g, or t
  misc_feature (3693)..(3694): n is a, c, g, or t
  misc_feature (3697)..(3698): n is a, c, g, or t
  misc_feature (3701)..(3703): n is a, c, g, or t
  misc_feature (3705)..(3705): n is a, c, g, or t
  misc_feature (3707)..(3709): n is a, c, g, or t
  misc_feature (3711)..(3712): n is a, c, g, or t
  misc_feature (3716)..(3716): n is a, c, g, or t
  misc_feature (3719)..(3719): n is a, c, g, or t
  misc_feature (3722)..(3722): n is a, c, g, or t
  misc_feature (3725)..(3725): n is a, c, g, or t
  misc_feature (3727)..(3728): n is a, c, g, or t
  misc_feature (3732)..(3733): n is a, c, g, or t
  misc_feature (3735)..(3742): n is a, c, g, or t
  misc_feature (3745)..(3747): n is a, c, g, or t
  misc_feature (3749)..(3749): n is a, c, g, or t
  misc_feature (3752)..(3752): n is a, c, g, or t
  misc_feature (3756)..(3757): n is a, c, g, or t
  misc_feature (3759)..(3761): n is a, c, g, or t
  misc_feature (3763)..(3768): n is a, c, g, or t
  misc_feature (3771)..(3772): n is a, c, g, or t
  misc_feature (3774)..(3775): n is a, c, g, or t
  misc_feature (3777)..(3784): n is a, c, g, or t
  misc_feature (3787)..(3788): n is a, c, g, or t
  misc_feature (3790)..(3790): n is a, c, g, or t
  misc_feature (3794)..(3796): n is a, c, g, or t
  misc_feature (3798)..(3804): n is a, c, g, or t
  misc_feature (3806)..(3806): n is a, c, g, or t
  misc_feature (3809)..(3818): n is a, c, g, or t
  misc_feature (3822)..(3822): n is a, c, g, or t
  misc_feature (3827)..(3828): n is a, c, g, or t
  misc_feature (3832)..(3832): n is a, c, g, or t
  misc_feature (3834)..(3836): n is a, c, g, or t
  misc_feature (3838)..(3841): n is a, c, g, or t
  misc_feature (3843)..(3844): n is a, c, g, or t
  misc_feature (3847)..(3847): n is a, c, g, or t
  misc_feature (3849)..(3851): n is a, c, g, or t
  misc_feature (3853)..(3854): n is a, c, g, or t
  misc_feature (3856)..(3861): n is a, c, g, or t
  misc_feature (3863)..(3864): n is a, c, g, or t
  misc_feature (3866)..(3867): n is a, c, g, or t
  misc_feature (3872)..(3872): n is a, c, g, or t
  misc_feature (3876)..(3876): n is a, c, g, or t
  misc_feature (3880)..(3886): n is a, c, g, or t
  misc_feature (3889)..(3889): n is a, c, g, or t
  misc_feature (3891)..(3893): n is a, c, g, or t
  misc_feature (3896)..(3896): n is a, c, g, or t
  misc_feature (3898)..(3898): n is a, c, g, or t
  misc_feature (3900)..(3903): n is a, c, g, or t
  misc_feature (3908)..(3908): n is a, c, g, or t
  misc_feature (3911)..(3911): n is a, c, g, or t
  misc_feature (3913)..(3913): n is a, c, g, or t
  misc_feature (3916)..(3917): n is a, c, g, or t
  misc_feature (3920)..(3920): n is a, c, g, or t
  misc_feature (3923)..(3923): n is a, c, g, or t
  misc_feature (3925)..(3927): n is a, c, g, or t
  misc_feature (3929)..(3931): n is a, c, g, or t
  misc_feature (3933)..(3937): n is a, c, g, or t
  misc_feature (3939)..(3940): n is a, c, g, or t
  misc_feature (3942)..(3942): n is a, c, g, or t
  misc_feature (3945)..(3945): n is a, c, g, or t
  misc_feature (3947)..(3953): n is a, c, g, or t
  misc_feature (3955)..(3955): n is a, c, g, or t
  misc_feature (3957)..(3965): n is a, c, g, or t
  misc_feature (3967)..(3967): n is a, c, g, or t
  misc_feature (3969)..(3970): n is a, c, g, or t
  misc_feature (3974)..(3975): n is a, c, g, or t
  misc_feature (3977)..(3979): n is a, c, g, or t
  misc_feature (3981)..(3981): n is a, c, g, or t
  misc_feature (3983)..(3983): n is a, c, g, or t
  misc_feature (3987)..(3988): n is a, c, g, or t
  misc_feature (3992)..(4000): n is a, c, g, or t
ccataaccacggcctggcttacagtcattacaatcgccaaatacaaagcctgcaattttatcnagtgcgcccataagttttagtgtgctcatcatcctgtcaattctatacggtgcttcgtcgatatcttctaaaaataaaattgcgccattaaagtcaggtaaataattcgagccngcaagggctgtcagtaccgttaanttaccgccgattaatcgtccngaggntttacctgatgtaatcgtttgggtcagntactgagtgttaacaagctcatcatcggcttttggtaagttttggaaatgcatcaanttacgcgcttcgaacatgntcttaaattgcgcnacatgaaacgggttccagtcacttgatgcatttggaccatgaaagctgattaacccagcttgagacagtaatgcattgtgaagagcggtaatntctgaatagcccattagaggttttgggttgttacggatcattgcgtagtcnagcaaaggtagaatacgggcagcgcctgaaccgccacgtaaacacaaaatggcatcaacctctttgtcgctgaataaactatttaagtcgccggctcgcattgcatcagtgccagctaaatgaccncgtcttgctaaaatgtttggtgcaagcttagcnttgtaacccagtgcntctataacgccttgtgctaataaaatatcagcgtgtgcagcagtggcagctgaagggctacatatcccaattgtgccgcctttaggaagagcttttggcttaattaatgtttgggtgctagcattctgcgccgccattaaaggagctgatgtcagacttgcgccagcggcaagaattgaaagtgactttaaaaatgaccgtttattcatagcgagcctcatgtttttatagtatgagtatcgcatngaagaaaatatttcaaatatttgttacgaaatggaatagatgattctttttaggcaggcaaaaaggtgtttttcagcagagagtgtttctctgctgtgtaactaagctgttagctggtgtgattagaataaaggttatcgattaactcatcttctagctcaaagcgcagttcaagtgcttcgcctaagattgatanntctttatcaaactcatcaagcaagtcatctttgtcaacttctgcgtatttgtcgttaaagtcgagtgccacatctgtggtttcagaaatgcgcgggtataaggcattagccagcttttggctttcaggacctttttcttcacacgctttggcaatgtcgtcgtaaatttcgaaatggccagcagaaaggtaatccatcagaatttggcaaaagttttgaatttgcagctgatcaggaagggcgtgatctttcttttcgtacggtgaaaagcctgcaatacggcagaacaacacaagcagctcttgacgttctgtgagccatttgtcgattacagagtgactaccaccccacttttgttgagctttttccaaacgcgtcagcatatttcatctcctcgctgagtaggttttcctttgtatatataaaaaggaaatatgacacaaagatcaactaaattcttagtgtctaattgcaacagattgtaaaagtcattctaaaggcatagttttcagcattgaataagctaaaaaattccttgttttttagagtggactttttttgctctcattgcagtgtatgggaattgattcaaaactactagtattaattttgcgatttttatctaagcggatgagttgtaatttgctgatttagaaaagaaaaaaccaccaaaattggtggtttaattctttttctaagacttgttaaaacaagcgttcttattattatgggaagattgttgttcttattgttataagatttttattattgtttttgttaacgcgggataagttataccaagcttttttgtatgttgcaaatttattaatgaaaagttttaaatttattttgttttcgctcaaaaaacacactataggcttaggtnggcttaaaaaacatgatctatatctagccttgattatctatccatagtgagacgcgcaatatggtgatacaatctgctcaatttcattcagttctaggattctatacgcatgagcgaattaaaaaacgatcgttatttacgtgcactacaaaagcaacctgttgatgtcacaccggtatggatgatgcgccaagctggccgttatttacctgaataccgtgctacacgtgcccaagcaggcgactttatgagtttatgtaaaaacgctgaacttgcttgtgaagtaacgttacagccattacgtcgttatccgcttgatgctgcaattctattcagtgatattttaactattccngatgctatgggcttaggtctttactttgaaacaggtgaaggtccaaaatttgaacgtccgatttcttcattagcagatgttaaaaaaatcccaaatatcgatccaactgatgagcttggttatgtgatgaatgcggtaagtacgattcgtcgcgaattaaaaggtgaagtaccgctaattggtttctctggttcaccttggacacttgcnacttacatggttgaaggtggtagcagcaaaacattcggtaaaatcaagaaaatggcctttgcaganccacaaacactgcacctattacttgataaattagctgactcagtaatcgactatttaaacgcgcaagttaaagcgggcgcgcaatcnttaatggtatttgactcatggggcggtgtattaagcccacgtgactanaatgagttttcattacaatacatgcacaagattgttgatggcttaattcgcgaatacgatggccgtaaagtgccagtgacnttatttactaaaaatggtggtcagtggattgaagcaattgcagcaacaggctgtgatgcagtaggtctagactggactattaacatnggtgatgcaaancgtcgtgttggcgataaagtcgcgctgcaaggtaacatggacccagcaatgctgcatggnacgcctgagcgtattcgccaagaagttgcnactatcctagaagactttggtacaggntctggccatgtattcaacctaggtcacggtattacaccagatgtagacccagaaaacgcaggtgtatttatcaacgcngttcatgaattcagtggtaaataccacaantaagcaaaagctantcntaaaaaagcccgcattaagcgggcttttttntnanttacnnaaacnaannannnnaancanttnnngcanctnnncgnnnnncntcagnnntngtcnggtagnngnnngtngtannnannaantaatnnntnttannnccgncnttnttttnntnnatantngnnnganngnnnngaannnnnnnngangcncncncanngaagnnnnncncannnantncttnnttnnnancannnnnnaanannntnnnnnnncnacccncntngntgccannnnnnnnngcncnnnntnnntnnntnnannnagnncnnccnncntngnnannnnntnnngcagntnntnnntcttgntntntnnnaccnannnnnntnnnnnnanngntnnnataantncctgnnnnannatnaatnancnnntnntcannnnannnacnncnnncnnnnncnncggcnnnannncnnnnttnnnnnnntgcnnnncnngnnnngnntnnnnnannnannncancnccnncannatnnntntnnncnncttntgnttngtntnnttcnntnnnnnnnngcnnncnacnaccnncnnntnnnnnnccnncnncnnnnnnnnttnntntgtnnntnnnnnnngnacnnnnnnnnnnaaanaaaanncagncnnntnnnncnngcntnnntnntnnnnnntnnannaccanacantcannnnnnnttncnnnacnancnnnntcttnatnangannaanaanannncnnntnnnnnannantgntnnnnnnnancnnnnnnnnntncnncatnnannnangnaagnnggcnnnnnnnnn

SEQ ID NO: 310 - DNA, 4000 bp, Escherichia coli
  misc_feature (2)..(2): n is a, c, g, or t
  misc_feature (5)..(5): n is a, c, g, or t
  misc_feature (7)..(8): n is a, c, g, or t
  misc_feature (10)..(10): n is a, c, g, or t
  misc_feature (13)..(14): n is a, c, g, or t
  misc_feature (20)..(20): n is a, c, g, or t
  misc_feature (26)..(26): n is a, c, g, or t
  misc_feature (31)..(32): n is a, c, g, or t
  misc_feature (35)..(36): n is a, c, g, or t
  misc_feature (38)..(38): n is a, c, g, or t
  misc_feature (46)..(46): n is a, c, g, or t
  misc_feature (48)..(48): n is a, c, g, or t
  misc_feature (57)..(58): n is a, c, g, or t
  misc_feature (62)..(62): n is a, c, g, or t
  misc_feature (65)..(66): n is a, c, g, or t
  misc_feature (68)..(68): n is a, c, g, or t
  misc_feature (71)..(72): n is a, c, g, or t
  misc_feature (76)..(76): n is a, c, g, or t
  misc_feature (78)..(79): n is a, c, g, or t
  misc_feature (82)..(82): n is a, c, g, or t
  misc_feature (85)..(85): n is a, c, g, or t
  misc_feature (87)..(87): n is a, c, g, or t
  misc_feature (93)..(93): n is a, c, g, or t
  misc_feature (95)..(95): n is a, c, g, or t
  misc_feature (100)..(100): n is a, c, g, or t
  misc_feature (103)..(103): n is a, c, g, or t
  misc_feature (106)..(106): n is a, c, g, or t
  misc_feature (110)..(110): n is a, c, g, or t
  misc_feature (114)..(114): n is a, c, g, or t
  misc_feature (116)..(119): n is a, c, g, or t
  misc_feature (126)..(126): n is a, c, g, or t
  misc_feature (129)..(131): n is a, c, g, or t
  misc_feature (134)..(134): n is a, c, g, or t
  misc_feature (139)..(139): n is a, c, g, or t
  misc_feature (142)..(142): n is a, c, g, or t
  misc_feature (146)..(148): n is a, c, g, or t
  misc_feature (150)..(150): n is a, c, g, or t
  misc_feature (153)..(153): n is a, c, g, or t
  misc_feature (155)..(159): n is a, c, g, or t
  misc_feature (162)..(162): n is a, c, g, or t
  misc_feature (164)..(165): n is a, c, g, or t
  misc_feature (172)..(172): n is a, c, g, or t
  misc_feature (180)..(180): n is a, c, g, or t
  misc_feature (182)..(182): n is a, c, g, or t
  misc_feature (184)..(184): n is a, c, g, or t
  misc_feature (188)..(188): n is a, c, g, or t
  misc_feature (191)..(191): n is a, c, g, or t
  misc_feature (194)..(194): n is a, c, g, or t
  misc_feature (198)..(198): n is a, c, g, or t
  misc_feature (201)..(201): n is a, c, g, or t
  misc_feature (204)..(206): n is a, c, g, or t
  misc_feature (211)..(211): n is a, c, g, or t
  misc_feature (214)..(217): n is a, c, g, or t
  misc_feature (220)..(220): n is a, c, g, or t
  misc_feature (225)..(225): n is a, c, g, or t
  misc_feature (227)..(227): n is a, c, g, or t
  misc_feature (229)..(229): n is a, c, g, or t
  misc_feature (236)..(236): n is a, c, g, or t
  misc_feature (242)..(242): n is a, c, g, or t
  misc_feature (245)..(247): n is a, c, g, or t
  misc_feature (254)..(255): n is a, c, g, or t
  misc_feature (257)..(257): n is a, c, g, or t
  misc_feature (260)..(260): n is a, c, g, or t
  misc_feature (264)..(265): n is a, c, g, or t
  misc_feature (267)..(267): n is a, c, g, or t
  misc_feature (272)..(275): n is a, c, g, or t
  misc_feature (277)..(277): n is a, c, g, or t
  misc_feature (281)..(281): n is a, c, g, or t
  misc_feature (284)..(285): n is a, c, g, or t
  misc_feature (287)..(288): n is a, c, g, or t
  misc_feature (295)..(295): n is a, c, g, or t
  misc_feature (297)..(297): n is a, c, g, or t
  misc_feature (302)..(303): n is a, c, g, or t
  misc_feature (307)..(307): n is a, c, g, or t
  misc_feature (309)..(311): n is a, c, g, or t
  misc_feature (313)..(314): n is a, c, g, or t
  misc_feature (318)..(318): n is a, c, g, or t
  misc_feature (322)..(322): n is a, c, g, or t
  misc_feature (326)..(326): n is a, c, g, or t
  misc_feature (329)..(329): n is a, c, g, or t
  misc_feature (333)..(337): n is a, c, g, or t
  misc_feature (340)..(340): n is a, c, g, or t
  misc_feature (345)..(345): n is a, c, g, or t
  misc_feature (347)..(347): n is a, c, g, or t
  misc_feature (354)..(355): n is a, c, g, or t
  misc_feature (357)..(358): n is a, c, g, or t
  misc_feature (360)..(362): n is a, c, g, or t
  misc_feature (364)..(365): n is a, c, g, or t
  misc_feature (372)..(373): n is a, c, g, or t
  misc_feature (377)..(378): n is a, c, g, or t
  misc_feature (384)..(385): n is a, c, g, or t
  misc_feature (387)..(387): n is a, c, g, or t
  misc_feature (389)..(390): n is a, c, g, or t
  misc_feature (392)..(393): n is a, c, g, or t
  misc_feature (402)..(406): n is a, c, g, or t
  misc_feature (408)..(408): n is a, c, g, or t
  misc_feature (412)..(412): n is a, c, g, or t
  misc_feature (419)..(420): n is a, c, g, or t
  misc_feature (422)..(422): n is a, c, g, or t
  misc_feature (428)..(432): n is a, c, g, or t
  misc_feature (437)..(437): n is a, c, g, or t
  misc_feature (447)..(449): n is a, c, g, or t
  misc_feature (452)..(452): n is a, c, g, or t
  misc_feature (457)..(457): n is a, c, g, or t
  misc_feature (459)..(461): n is a, c, g, or t
  misc_feature (464)..(464): n is a, c, g, or t
  misc_feature (467)..(467): n is a, c, g, or t
  misc_feature (470)..(470): n is a, c, g, or t
  misc_feature (473)..(474): n is a, c, g, or t
  misc_feature (477)..(477): n is a, c, g, or t
  misc_feature (480)..(480): n is a, c, g, or t
  misc_feature (488)..(489): n is a, c, g, or t
  misc_feature (491)..(491): n is a, c, g, or t
  misc_feature (499)..(499): n is a, c, g, or t
  misc_feature (506)..(506): n is a, c, g, or t
  misc_feature (509)..(510): n is a, c, g, or t
  misc_feature (513)..(513): n is a, c, g, or t
  misc_feature (516)..(517): n is a, c, g, or t
  misc_feature (519)..(519): n is a, c, g, or t
  misc_feature (521)..(522): n is a, c, g, or t
  misc_feature (527)..(527): n is a, c, g, or t
  misc_feature (530)..(532): n is a, c, g, or t
  misc_feature (536)..(536): n is a, c, g, or t
  misc_feature (540)..(542): n is a, c, g, or t
  misc_feature (547)..(547): n is a, c, g, or t
  misc_feature (550)..(550): n is a, c, g, or t
  misc_feature (552)..(553): n is a, c, g, or t
  misc_feature (555)..(555): n is a, c, g, or t
  misc_feature (558)..(559): n is a, c, g, or t
  misc_feature (561)..(561): n is a, c, g, or t
  misc_feature (564)..(564): n is a, c, g, or t
  misc_feature (568)..(569): n is a, c, g, or t
  misc_feature (572)..(572): n is a, c, g, or t
  misc_feature (575)..(575): n is a, c, g, or t
  misc_feature (580)..(580): n is a, c, g, or t
  misc_feature (582)..(582): n is a, c, g, or t
  misc_feature (586)..(586): n is a, c, g, or t
  misc_feature (589)..(589): n is a, c, g, or t
  misc_feature (593)..(593): n is a, c, g, or t
  misc_feature (598)..(598): n is a, c, g, or t
  misc_feature (601)..(602): n is a, c, g, or t
  misc_feature (606)..(607): n is a, c, g, or t
  misc_feature (613)..(613): n is a, c, g, or t
  misc_feature (616)..(616): n is a, c, g, or t
  misc_feature (619)..(619): n is a, c, g, or t
  misc_feature (622)..(622): n is a, c, g, or t
  misc_feature (624)..(624): n is a, c, g, or t
  misc_feature (627)..(628): n is a, c, g, or t
  misc_feature (630)..(630): n is a, c, g, or t
  misc_feature (632)..(632): n is a, c, g, or t
  misc_feature (634)..(634): n is a, c, g, or t
  misc_feature (640)..(640): n is a, c, g, or t
  misc_feature (663)..(664): n is a, c, g, or t
  misc_feature (675)..(675): n is a, c, g, or t
  misc_feature (699)..(699): n is a, c, g, or t
  misc_feature (714)..(714): n is a, c, g, or t
  misc_feature (717)..(717): n is a, c, g, or t
  misc_feature (720)..(720): n is a, c, g, or t
  misc_feature (725)..(725): n is a, c, g, or t
  misc_feature (729)..(729): n is a, c, g, or t
  misc_feature (733)..(733): n is a, c, g, or t
  misc_feature (745)..(745): n is a, c, g, or t
  misc_feature (748)..(750): n is a, c, g, or t
  misc_feature (820)..(820): n is a, c, g, or t
  misc_feature (823)..(823): n is a, c, g, or t
  misc_feature (825)..(825): n is a, c, g, or t
  misc_feature (828)..(828): n is a, c, g, or t
  misc_feature (834)..(834): n is a, c, g, or t
  misc_feature (837)..(837): n is a, c, g, or t
  misc_feature (840)..(840): n is a, c, g, or t
  misc_feature (843)..(844): n is a, c, g, or t
  misc_feature (846)..(846): n is a, c, g, or t
  misc_feature (853)..(853): n is a, c, g, or t
  misc_feature (890)..(890): n is a, c, g, or t
  misc_feature (902)..(902): n is a, c, g, or t
  misc_feature (907)..(909): n is a, c, g, or t
  misc_feature (913)..(913): n is a, c, g, or t
  misc_feature (915)..(915): n is a, c, g, or t
  misc_feature (918)..(919): n is a, c, g, or t
  misc_feature (922)..(922): n is a, c, g, or t
  misc_feature (927)..(927): n is a, c, g, or t
  misc_feature (938)..(938): n is a, c, g, or t
  misc_feature (952)..(952): n is a, c, g, or t
  misc_feature (1023)..(1023): n is a, c, g, or t
  misc_feature (1314)..(1314): n is a, c, g, or t
  misc_feature (1452)..(1452): n is a, c, g, or t
  misc_feature (1992)..(1992): n is a, c, g, or t
  misc_feature (2002)..(2002): n is a, c, g, or t
  misc_feature (2013)..(2013): n is a, c, g, or t
tntcntnntntcnntgtcgntgttgntgagnntgnnanctcgaagngntctcgtcanntaantcnncntcnnaccncnnaanaanantacaangngacgngtnaantcanacanannnngatcacnctnnnacngtccnaancttnnncnaanannnnngtnanngagattntttttgtnangnactnagngtnttcncgnacnnnctcantcnnnnctncttgntngngacaaanagaggngannngaaacgnnanacnactnngnacgannnngnaacngtnnannacgacgntnaaagnncaanannnanntatnaaantttnaangaannnnnctncgtcnanggatcannannannntnntcttttnncgannaaaagnngngnnanncgcaatcannnnnancgcncgtcgtnnangacaannnnnagaanaaatttgaannnganaaaantnnnganganagngtnnagncanataagaannangacggagnaaaacgnctnnatnctnntntnnatganttnnngtgnatcnnncgatnatnanngnagnngntcnttcnnganaanaacgncngaanagncgtntcagnggnnaagnncatcgncantgncgncncanncncnanagtcgncgccgccgccgagtccgccgccnntgcctccgccntctccaccgtcgccgccgccgccnagtccgccgccgagnccnccnccatngccnccgncgtctcctccgncgnnnccgccgccgagtccgccgcctttgccgccgccgtctcctccgtcgccgccgccgccgagtccgccgccgncgncnccnccgtcnccnccnccnncncctccgncgccgccgccgccgcctccgccgccgccgccgccgcngccgccgccgcngccgnnnccgncnccnncgncgccnccgccgccgcngccgccgccgccgncgccgccgccgccgagtccgccgccatcaccaccgccgttgccgccgccgagtccgccgccgtcgccgccnccaccaccgtcgccgagtccaccgccgtcgccgccgccaagtccggcatccgcctcggctgctttgcgcatttacttgaacggctacagtaaggaagaattcgaggtgaacgaggtgtcggctttgtttcgaagcgggatgattgcgttcttcaagaacgcctcgggtggagcaaacgtgccggcggcggttgagatcgtagaagttgtcgacgttcgagcgccaccgcctccgagtccaccaccgtctccaccaccgagtccaccgccgaatccgccaccgtcgccgccnccatcgccgccaccgccgagtccgcctccatcgccgcctccatcgccgcctccatcgccgccgcctccgtcgccaccgccgtctccaccacctttgccgccgccgtctccgccgccttcacctccgccgccgccgtcnccaccgccctcgcctccaccgagtccgccgccgtctccaccgcctccgagcccaccaccgaatccgccgccttcgcctcctcctccgagcccgccgccgagtccgccgcctttaccgcctccgagcccaccgccgtctccaccaccgtctccaccgccgagtccaccaccgtcgccgccaccaccgagcccaccaccgtctccaccaccgtcgccgccaccatcgccgccaccaccgagtccgccgccatctcctccgtcgccaccgccaccgagtccgccaccgagtccgccgccgtcgccgccgccgccgccatctcctccgccatctcctccatcgccaccgccgtcgcctccatcgccgcctccgtcgcctccatcgccgccaccaccgagtccgcctccatcgccgcctccatcgccgccacctactgagagaaggagaagaagacagttgttgctcgaaagatcgaccaaggcgacgacgagcacgattgcggttgagtttctcgttttggggaccacggaagcagacgccaangcgtttgtgnctttctacaangcagtatctgtcgaggacatcgagtggcacctcgacaacgcgggattatttacggaatcgatcgtgaaggatgcgcagatcactggtgttcgcgcgccgccgccgccttcgccgccgccgagaccgagtccacctccatcgcctcctcctcctccttctccgccgccgtcgccgccttcgcctccaccaccggcgccgttgccaccaccaccgccgtcgcctccaccagacgcgccgccgtcgccgccgcctccaccgaacccgcctcctttgaatcctccgccgccaaagccgagtcctccgccgccgtcgccgcctccaccgtcgcctccggcgctctctccaccaccggctccggaaggatcggcgtcgccaccacccaacgcaccacctccggcaccaccggctttggttgttggtcgcgccatcgacgcgtatttgaagaactgcgacgcgtttatggatgaaaatggagatcgtaaatactcgagaggcgaagcgtattcgcaaacggatagtttgggtggctacgagtttcagccgaacaactacgacgccgcggcatcggcatacctcgtcgttctgatgcgcaacgaaagtcgcacgggaacgtcgagcgagtgcgtggatgcttatacgggacaagctccgggactgaaaattttggaagcgccgccggggtcgaaagtgatttcgccgatgactacgctcattggcgaggtcatcagactgtactctggtgacgtcgacatgactgtcgctgaagcgacgaccatgatcaactccgcttttggtttgggcaacgcggaacacacgcaaatcgatccgatttacgccgcctcgaacggtgaagtggctgtttacggtccagtcgtcggcgcaatcaatatgattgcgaacctcgtctcctccgtcggcacgttattgtttggcatgtccagtctgaatggcggcagattgagtgcagcagattgtgaattgaaggtatattctggcattgcccgtgaaattaacgaggctttacttgtcgcttcgcgaggtggtaaccgaaagttactcacgacgcacttgttagatttggccaactcagattcaatctccggcattgcgaaatcttcgttatactccgcgagtttgacgaacattcagttgatgggtgctggttattctccagcagcgttggagtccacggtgtccatgtcagccaactctggggcggcgatcaagaatagcttgagcgatttgtcggatccgacaaccttcttgaaaaaagtcaccgcggcttccaaggttgctcaagatccagctgttctgagtgcccttctcagtagcgctacgaacgaagcgacggaggatgaactcactactttgaatggcgtacaggatgcagagctgtacgcgagtaaagcgacggctgaaactgagaccatcgcggtgtcaattccgctttatccgcctccgccgtcgccgccacctccggggtttccacctccatacgtttctagaggaccgatattgaatccagcggaattatctgctgctatcacggttccaacgctctttgtgttcattgtagctttggctttgacgttgaggtatattgcaaagaatagaagagcgagacgattagcgagatatgaaactaggattgagagagagcagttagcggcgcaaaagtcagtgaagaaactcaacgatgacaagattaaacgcgaattagcggcgttaacggatgagaaagcggctgagcgaaagttgatcaagaaatacgagcagcacatgcaaaagtcgaaagagaaagtagaaaaagcaatcgcgttgcgaattcaagcagagaaacagaagaagaaggataaaaaggcagccgagaaagccgccttgcgatgatatagatgaattcgtgattgagatacgattactttaggcacagcacataacatatatcatgtatagaaacagaaacgctttattaattttaaaaatacaa

SEQ ID NO: 311 - DNA, 4000 bp, Escherichia coli
  misc_feature (1991)..(1992): n is a, c, g, or t
  misc_feature (2064)..(2064): n is a, c, g, or t
cgaagccgcgctcgagggcggtttccgccacacgcacgcgcgcttgatcgctcacgcggaggaaatcgccttattagacgggggcaaacgcgagattgagattttagatgaaggcttggataatttggtcgtcacgcagcgctggcatgcgctgcagcgtattcgcaagagcgtcgccgacaacgtatccaagttccaaggcttgctcgtgggcagtattttcgtacacgtcccgttcatgatgaaggcatcagtgtccgaaggcgagcgcatttcatccttccgagccaccgaggagctcatgcttcgatgcggcggcgcgttcaccgaagtgttgcttctcggcaaaaatctcgacgaactcgccggatacacgcaccggctttcgcaactgttcaaaacgttggatctcgcgagcaaggaagcgcgcgaagacaaggctaaactggcttcggcaggcgctgaccacgccgaaggctcgccgatcgtgttcgataaagtcaccgtaggagcgcccgagccggatggctcgcaacgcgtgttggtgaaggacttgacgctcgccgtggcgtcgggtcaacacttgttgataactggtccgaatggatgcggaaaaacgtcattgcttcgcgtgttggctggattatgggcgcccgtgtccggcaccgtcaccagaccgtctggcgtatccagcatcatgtggttgccgcaacggccgtacttgttgcaaggatcgttgcgcgatcaagtcgtgtacccgcgcgacgcgcgcacggagaagatcgacgacgcgcgcgtgaaggagtgtctgatgatggctggcctggccaaattcgtggacggctccatgaacgttggattaaacacgcggcacttggagtggaacgatgtgttgtccggcggcgagcgtcagagaatcggtttcgcccgcctttactatcacgcgccaaagtttgccattcttgacgaagcgacgagcgcaatcaatccagacgaagagtccaagctgtacgaacgtctcatcgaaaccgacaccaccgtcgtgagcatcgcgcacaggctcgagcttagaaaattccacaagttggaactcaaaatcgcgggcgacggcgaaggcggttttcgaatcctcaaactttagattacttgtgatagcacgtatattacattaatgcgtcgacgtcgtcaagtatgcgaacaacagcatgggcgcgccgaagaggccgaccatggtgagcatcgcctgcgtgttcagcgccttgacttcttcttcgtcgatttcgcccgcaaacttttcgttcgccatcttgatcaggtactcgtcgtacgcgtctagttttgcggcgtccatgtaatcgaataagtccgatttcatcttcttggaagccgtcgtcatcccccaaatcattcgatccgcttgcttggacacgtttccgtactggtttccgatgcaccgacgatactgcttcaacgcctcatctcggcgctgcaagttgtccagacagatggcgtagttgaagattatcctcccgcccatctccgtcttttgcccgatgcgatcgagcgcccacggctcgagcaaatcgagcgcgtcttgcatgtatcctcgcttcatcgcctcgcccgaacgctccaaaacctcccgcacctccgcgtactccgcgttcgtcagcgtcatcccctgatcctcgcgatatttcgccaatttcttcgccactctcgcccttcgcgccgcgatcgcctcctcgtcctccaactcctcccgtttaacggttcgtccgccgccgtacgtcttcgatatatccggcggtcgctcgaacaccccccacgtgctcaccgacggtttatacaccgcgtcctccacgtcgtaccccaccgccttctcgtccgcgtcgaacgggtcgtaatcccggtcccgcgtcaagatgcgcaccgtcacctcccgtttgcgcgtcgcccccgtcgcgccgtcgctcgccgtctcgcccgcnngcgtcccgtccgtcgtcgacgcctccatcgcgtcgtcccgatcgcctccgtcgccctccgcgcgcgcgcgcnccatcgccgccgcgtactcgcgcgcctttttcacgcgatcctccaccgacgcgcgcagatcgatcctcgcgtccgcgtcctcgcgcggcgccgcgcgcgcgcgaaagcgacgccgtcgcgcgacgcgcgtcggcgcccgcggccgcgcgacgcgcgcgacgcgcgccgcgcgcgccatcgcgcgcgccgctctcgcgcgatcgcgcgcgcgcgaccgcgcgacgttcgcgtctcgaggttcgacgtcgaaaccgacgcgaggttcgatcgcgcgcgctcgaacctcgcgatcgcgggttcgatcgcgcgcgcgccgacgtcactgcgcgtcgatgcccgcgaccgggacggcgtcgtcgcgcgacgagatcgtgcccccgcgacgaggcgcgcgaaatccatgggtgctcgtcggtgcgggcgccacggcggcggtgttgctcgcgggattcgtcgcgttcagggctggggacgcgcgcgcgtcgcagcggatgatgcgcgcgcgggtgctcgcgcagggcgcgacggtggcgctgatggtggcgacgtccgcgggaggactgtcgagcgcgacgtcttggacgctcgcgcgtcccggcgcgggcgggacggcgggcgaggggtgacggacgcgcgggcgaacgcgcgcgggttcgcggcgagcgcgacgacgacgcgcggcgacgacgacgcgtcgacgtcgcgcgacggaggcgcgagcgatggtggggagcgcgggcgcgacggtgacgcgagagacgcgcgcgcgaggcgggacgaggaggcgcgcgcggtgctgcgcgaacgcgcgctgcgagcggcgttgaagcgcgtgcgcgagctgggatggacggacgccgccgtcgacgcgggattgagggatttgaatttatcgcccgcgatgcgcgcgatcgttcgcggcgacgcgggggcgggcgcgagggactcgggaccgggcgacgggctcgcgggggagttggcgggatactttgaggagtgcgcggacgcggcgtttcacgcgaaggtcgtcgccgagggcgagacgctgcgcgcgatgaagtcgcgcgagcgcgtgaagtggctgatgcgcgcgcgtttggagatgatcgagtccaagctcgattcgtggccgcgcgcgctcgccgcgatggcgacgccgcggtacgcgatgacgacgcttcggcgtcgcgccgcgctcgcggatttcatcgccgacgccgcggacgtcgacgccttggacgtgcttccggattcgttggatacgtttcgttggcacgccgaacgcgccgcgatgctcgcgctgtacgccgccaccgagttacgcttgttgacggattcgagcaaggatcgtcgcaagacgtgggcctttctcgacgcccgcgtcgacgacatcgcgcgatcccgcgtcgacgtcctcgagctcaagtcgtacatcgacgtcttcgcgcgcgacgccgacttgacgacgctcggcgcgtcgttcgcgagcaaagacgcgctcgccgcggcgttcgcgcccgtcgccgacgtcttcgctcgcgcgtctcgcgccgtcttctcgaccccttcgcgcgacgcgtccgagcgcgacccgccgcgcgactcgcccgatcgatagtttacccggtagtcttaatgctcacgcgcgcgcctttaaccgacttcgcgcgcgctcgccgtcgcgttttgtgtcgcttcggtcgctccactcccgggtgtttcatccgaatcgtcgcgacctaaacccgaatcgtcgcgccgccgcgcgccgcgcgtcacgcgcgcgcgcgctcgagcgatgtcgttcgacctgcgctgcgccgtcctgtgctacgccctcgccggcgtcgcgcacgagctcgcgcacgtcctcgcgcacgccgcgctcgcgctcgcgaagcgtcgcgggtcggtcgccgtcttcgacgcgtgcgcc

SEQ ID NO: 312 - DNA, 4000 bp, Escherichia coli
  misc_feature (216)..(216): n is a, c, g, or t
  misc_feature (228)..(228): n is a, c, g, or t
  misc_feature (230)..(230): n is a, c, g, or t
  misc_feature (255)..(255): n is a, c, g, or t
  misc_feature (335)..(335): n is a, c, g, or t
  misc_feature (389)..(389): n is a, c, g, or t
  misc_feature (491)..(491): n is a, c, g, or t
  misc_feature (1985)..(1985): n is a, c, g, or t
  misc_feature (2072)..(2072): n is a, c, g, or t
  misc_feature (2942)..(2942): n is a, c, g, or t
ggatgtagtggcatgacctatgttttaggttttgatgttccaaaaactgatgatgaaattttctctattgagggtattccttgttgcatggaaaaatcgcatcagatttatgtatatggaatggagatagattggcaaggtggtctgaatagccgtggatttacttttaaaaatccgaatgcttctagtacctgcggatgtggtacttcatttgcngtttaaaattantngaaaaaatacatcattctcgctctntatcgcgaagctcataaaaaaaggccctgattactcaaggccttttttatatcaattcaatgttgaattatttctttttntcttcacgacctaatgggcgtgtttttgcaaagtcaactagtacgggtgccgcnacaaagatagaagagtaagtacctgtgataactccaattaacattgcgaatgcaaaacctcttgttacttctccaccaaagatgaataagattaaaatagtnatgaacacggttaaagaagtcataatagtacgactcaatgtttggttaatggctttattaatgatagtagcattatctacacctttcattaattggctgtcctcacgaatacggtcatatacaattacagtatcgttcatagagaaaccaattacggttaatatagctgcgataaagtgttggtcaatctctaatgggaatggcaccacttttcttaagaaactaaatacgattaaagtaacaaatatatcgtgcaataaagagaagatagttcctaaagaatatctccaatcacggaaacgaataaagatgtataaacaaattgcaattaaagcaaaaatggttgctttcgtagcacctgcttttaaatcatcagagatagtaggtaatactgtttgagaactttgcttatactgagagtcgaactcttttaaagaagttcctgcaggtaattgcttctctaaacctttgaataataaagcttctacttcttggtcaatattattgccttgttctttaattttataagaagtggtaatattaatttggttcttagaatctactgttttaattataggagactcgccaaacacttttttcaagtcttctcttactgtttcaatattcaccgctttggcaaacttaatagtataacttcttcctccagcaaattcaacaccttcgtcgaatccgttaaagaaactagcaatacccattactaatacaacagcagataacatataagcatactttctgaattcaataaatttgaatgatgcatgcttaaagatacctcttgaaattttagtgaaatattcgaagtgtctgtttttgcttgtgtagatatcggtaattaaacgagatactaaaattccgcagaataaagaaagtaaaataccaatgatttgcgttgtagcgaaaccaagtactggacctaaaccaaagtaagctaagatacaagctgttaatagggtagtaacgtgtgcatccaatactggagacatagaacgtttgtaaccatctgtgacagccaactgataactttttccttttgttaattcctctttaattctttcaaatataattacgttggtatcgaccgccataccaatagttaatactaaacctgcaataccaggtgctgttaaagtaaaacctaaggcgcttaatataccaatagtgaaaagtaagtttaatactaatgcaatgttcgctacccatccacctgtgttaaagtataataacattaaagcgaaaatgacaaggaaagatattccaaatgccatcgcaccaccttgaatagaagccaaacctaaagttggacctactaattgctcttgtacaattttagcaggcgctggtaatttaccactctctaaaatttcagctaagtcttgtgctgtttttaaagtatagtttccagagatagaagagttacctgtagtaatagcatcatttacattcggcgctgaataaacaatattatcaagtacnatcgcaagtggcttacctacattttttgaagtcatcttagcccaaatgctggtacctaatttatccatattcattttgatggctacntttcctctttcatcaaaatcttgtgctgcattcgcaacatggtcaccttctaattctgcttgaccattatctaaagttttaatagcataaataggaactacatctttgcttttaggatcttcgctttcatttttaccatacataaataccaagttcgatgggaacttagattttacttctggcatggctaaataggcgtttagtttacttgtatcagctttgaaagtgtacccaatttcagcagggtaaatagattgaccattttttccttgataaggctgcgtaaactgaaccatttttaataaaggatttttattaaggttcaatttagaagtatctgcttttactaaactcgtatctgaaattccatttaaacttgcttcaatagctttatcggcagcaacaataccattttgaagatccctgttctcaaaagtgtatacttcaaagaattgtaggttagccgtagattgtaaataagaacgtacacgctctttatcgttcacacctgctaattcaatattgataatacctttagcggcatccggattgatattaggagaggctagaccaaagcggtcaatacgcgttcttaaaatacggtatgtattattgaaagcctgtgtagattgttcttttaagtaagtaacggctgcgtcatcagtagcgtcgaactttaatttgccattacttcttgcagcaaataaaggggctaatttacccgttgggttaatagttgcatattcatctctgaataaagaaattaagtcggcacggctgttcgcttttttctgaactgcattgtttaaagcagtattgaatgaaatgtccttggtatagttggcgagtgatttaattaaaccatctaancctacttccatggtgacactcataccaccttgtaaatcaaggcctagcattaattctttttctttagcagaagcataagtggttaaaccaaaagccaatttactgtctttggtactgtctaataacttcttataataagctttttgaatatcgtttaagctatcgttgtataataactgctcttctttattagaagggtatacttgatctgcttttgggaacttcttcacccatgaactagctttcgcttccatggctttttcgtgacttcttacgaaccaagtaaatgacaattgataaagacaaattaaaataagcgcaatggtaaaaaagcgcactaatcctttgagttgcataatagtgtggttaactgatttttagtcggcaaatataatggaaacgggccaaaataaaggctaaaaagccattattttaccttcgataggcttacatcaaagtacaagggggcgttgcctggaatctcgccacttcctctagatccataacctaatgtagatggtataaggattttgatttggccgccttcacctattaagggaagggctacttgccagcctggaataaggttatttaaaggataagtgatagtaccgctatcaaaggtcttatcgttcattaatttacctgtataagtaactgtaattgtgctagttagcctaggtttattgctatttcctgcagtaattatttgatataagacgccagatgggtctgatacataggtaatattattcttttttgcatagctaatcatttggtcagcttcactagccgaagacttactacagcccatttggctaaatgttcccactatgacaagggttgcgatggttaaattgcgaaaaatgagggttattggggttttggaattcattagattcattaggttcattttttattttttaagtgcttgagttcattaaatctttgttcattcatctcggaggtaaattgctggtagagccatgcaaatccaaaagagaatagtacaatagcaatcataatccatatttcattacccctcatattggctacca

SEQ ID NO: 313 - DNA, 4000 bp, Escherichia coli
  misc_feature (1353)..(1353): n is a, c, g, or t
  misc_feature (1983)..(1983): n is a, c, g, or t
  misc_feature (1989)..(1990): n is a, c, g, or t
  misc_feature (1992)..(1993): n is a, c, g, or t
  misc_feature (2001)..(2002): n is a, c, g, or t
  misc_feature (2004)..(2005): n is a, c, g, or t
  misc_feature (2014)..(2014): n is a, c, g, or t
  misc_feature (2019)..(2020): n is a, c, g, or t
  misc_feature (2025)..(2025): n is a, c, g, or t
  misc_feature (2028)..(2029): n is a, c, g, or t
  misc_feature (2034)..(2035): n is a, c, g, or t
  misc_feature (2040)..(2040): n is a, c, g, or t
  misc_feature (2043)..(2044): n is a, c, g, or t
  misc_feature (2046)..(2046): n is a, c, g, or t
  misc_feature (2049)..(2050): n is a, c, g, or t
  misc_feature (2055)..(2056): n is a, c, g, or t
  misc_feature (2058)..(2059): n is a, c, g, or t
  misc_feature (2063)..(2064): n is a, c, g, or t
tccaagtctgaaatctactctgacatcagcggtctgcacaattacaccaagattcttgaccatgcaaatagtatcggtggaattgaggcatatccggccttcgaagccgtcgagaaatggaatgatatgtacagtataaatgaataccgcccacctcgtaataccacaggctggtttattccttcctccggtcagtggtgggacatccttcagaatctgggcggttgtccggctatggcggataaaggtcagcaaacctcgtcggattccggtgatttccgttggctaggtcaaggcgatgttccagctgccttgaatgcttggatgaataaaattgcagccgacagcaagaatgattttaccaccggtgaccgtttttggtcgtcatcggagttaaatcagttccgcgcacggaactggaacgtgtactcctctgattacgtgtgctgcgactttgtctataagaaatggagtaacgctgtccgtcccgtccttgctttctgaactatttgcctatttagtcctttaagaatatgaagatacaaaacatataccacctcttgcaagctgcgttgctcctgctgcttgtatcctgcacgcaagaagagttccctgccgtgcaagacaaggcgcagcaactgacaatctccgttaccgatggcggatatacatcggctgttgagaatatgaaaacccgtgtcgagacccgtgccgtggagaacggctacaccaccgagttcaccgaaggcgatgcctgcggattctacatggtgcgcggcggaaagccggtttattcaaacgtgaagctgacagccgaaaaggatgccgccacgggcggcatcatgtggaaaaccgacggtacgacgcttgccgccggaatggatggagagagctactacctctactatccttatcaggcggacatggcgggcaagactgccacacctgcggagggggcggtcatgaccgatgccgagttcttcaagccgctcattgatggctggcaacccggggacgaccagagcacccatgccgcttacaccgcctccgacctgatgacagccggaggctcaacgacagggacgggcaacaccatccacctctctttcgccatgaaacaccgcatggcgttggccgtcatcgagatgccgaagaccgtttacaagtttatcgacgcgaatgttcccgactacaccgtgggggcagaagctacgttcacaggcaccgccaagccgctgcgcatggctgacggcacttaccgctacttggtgcactcgtccatgccgactatcgagggatgttatgacggggggaacagggagtttaccatcaccacgtccgcgtcccatcctntcgtaggggaatacaagagatacaaggtggacggtgcgcaggctatggaaaagaattataacttgcagatgggcgactacctgtgcaagaattccgatggtaattggtatattatccccggtgaggaaatgccgaatgaggagtgcatcgccatcgtgttccatgccggtcatcacgaaaacgatgcctccgattactccgccaccggtatcggtcagcagaagtgccacggctatgccattgccttgcaggatgccacaaacggttattgtcagtggggcgtttacggaaccgagttgggttgctgccccacggatggaagcggaaacaaacagaacaattactctacacctgacatcgactggagcggctacgcctggacacagaaaatcatcgccgctgccggaggtacgggcaacttgaatgccgccgaagattccggttatcctgccacctactatgccgttgtggattatgcgagcaaagtcccgtcccctgccaatagcagcggttggtttcttccttctatcggtcagatgtggaatgtttatcaaaaccgtacttctttgtttgacggcaagacagtggtatcaggcttaaagtccgattggtactggtcctcctcggagnactacnncnntccggcgnncnncgctctttntgtgnntgtgnacnncggcnncgtgnacnncnacnntaagnncnncagnnatagctacgtgcgtccggtcttggctttctgacctatttacctattcaatctatttatctatttgcggcgtagccgctcatttaaaagatggaatacccgcgaagcgggtcggaaaaatttttgaaaaatcgagttatggcattatccgaagaattacccctataccgcgacacttaccggttgttgaacaacctgttgatcctgacgcaggattttccgcgcttcttccgctacagtatgggcagccgtatggtggatttgactttggatatgctttctctgatttacaaggcgaacagcagctatgaaaaagtgggcgtattgaccgaatttctcgaccgttaccgcatgttgcagatgcttttccgcgtatgtgtggagcagaaggtcattaccgagcgcaaatacgcctcgttcgggctgctgttggagaagataggcaagcaggctacgagctggaaacaatataacgaacgcggaatgaagaaacaggaagataaaaggcaatgatttatcagtcgggattcgggcggtcaaggcttcccgaagcgaactgtttattattgaaaaagggttgtcggcaggctttcctcgtgcagggaggctcgcaaagacaaaaacagacaacatttactggtcctcctcggagaactacaacaatccggcgaacaacgctctttatgtgaatgtgaacaacggcaacgtgaacaacaacaataagaacaacagaaatagctacgtgcgtccggtcttggccttttcaataaaaactttacgataaacaaaatggtattgcgatatggagttacaacaaagtcttttcacggatgaggaactcggaggcattccgttggaggatgttttcgaggcgtatttcgagtgccgtaaaaagaaacgcaatacctgtaatgcccttgccttcgagagcgattacgaacgcaggtgtgtggaactgtggcgggaaatcaatgccggcacataccgcccttcgcgttccatcgctttcattatcaacaaacccgtgaaacgggagattttcgctgcagacttccgcgaccgtgtggtacaccacctcatagcccgcaggctcgttccgcttttggaagagaagttcatcaatgacagctacagcacccgcaagggaaaaggtacgctctatggcatcgaacatgtggcggaacatatccggctctgttcggaaaactacacgaaagagtgctacatcctgaaaatagacatccgttcgttcttcatgaaaatatcgaagaggcggctgtatgacctgaccgaagaactcttgcacgaacgctacgggggaaacgacctggcgatactgctctatctgctccgtgagactatattcaaccgtccggaaaagaactgcatccgcaagacgcctccccaaagctggcgcggattgcccaaagacaagagcctgttccattccgacggctcgtgcggactgcctatcggcaacctgacaagccagttgctcgcccttaacttcctggacggactggaccatctcatcagcgaagaatggggcgtgaagcactacggcaggtatgtggacgacatggtgcttgtccatccctcgaaagagcacctgatagaggtgaaagcgaaaattgccggctggctctccgaacacgggctgtcgttgcacccgcgcaagatctatctgcaacattacacgaaaggtgtcctgtttatcggagggatgatacttccggggcggaaatacctgagcaaccgcacagtcggcttctgctacgatgccatcgaccgcctgaaccgcttggcggcaggctcgcccgattacgtgaaaacccacggggaggagtttgtcagtacgataaactcctatttgggaatgatgcggcatttttcctcctacaacctgcggtgcaaggtcatgagccgtatcggtaagga

SEQ ID NO: 314 - DNA, 4000 bp, Escherichia coli
  misc_feature (162)..(164): n is a, c, g, or t
  misc_feature (167)..(172): n is a, c, g, or t
  misc_feature (174)..(176): n is a, c, g, or t
  misc_feature (178)..(179): n is a, c, g, or t
  misc_feature (181)..(184): n is a, c, g, or t
  misc_feature (186)..(189): n is a, c, g, or t
  misc_feature (192)..(197): n is a, c, g, or t
  misc_feature (199)..(204): n is a, c, g, or t
  misc_feature (206)..(206): n is a, c, g, or t
  misc_feature (208)..(217): n is a, c, g, or t
  misc_feature (222)..(223): n is a, c, g, or t
  misc_feature (226)..(226): n is a, c, g, or t
  misc_feature (228)..(238): n is a, c, g, or t
  misc_feature (240)..(243): n is a, c, g, or t
  misc_feature (245)..(246): n is a, c, g, or t
  misc_feature (249)..(250): n is a, c, g, or t
  misc_feature (252)..(254): n is a, c, g, or t
  misc_feature (256)..(256): n is a, c, g, or t
  misc_feature (258)..(258): n is a, c, g, or t
  misc_feature (260)..(264): n is a, c, g, or t
  misc_feature (266)..(268): n is a, c, g, or t
  misc_feature (270)..(273): n is a, c, g, or t
  misc_feature (275)..(277): n is a, c, g, or t
  misc_feature (279)..(279): n is a, c, g, or t
  misc_feature (281)..(283): n is a, c, g, or t
  misc_feature (285)..(285): n is a, c, g, or t
  misc_feature (287)..(288): n is a, c, g, or t
  misc_feature (290)..(293): n is a, c, g, or t
  misc_feature (295)..(295): n is a, c, g, or t
  misc_feature (297)..(297): n is a, c, g, or t
  misc_feature (299)..(300): n is a, c, g, or t
  misc_feature (303)..(303): n is a, c, g, or t
  misc_feature (306)..(306): n is a, c, g, or t
  misc_feature (308)..(308): n is a, c, g, or t
  misc_feature (310)..(312): n is a, c, g, or t
  misc_feature (314)..(318): n is a, c, g, or t
  misc_feature (321)..(322): n is a, c, g, or t
  misc_feature (324)..(328): n is a, c, g, or t
  misc_feature (332)..(342): n is a, c, g, or t
  misc_feature (344)..(345): n is a, c, g, or t
  misc_feature (347)..(350): n is a, c, g, or t
  misc_feature (352)..(357): n is a, c, g, or t
  misc_feature (359)..(359): n is a, c, g, or t
  misc_feature (362)..(373): n is a, c, g, or t
  misc_feature (375)..(375): n is a, c, g, or t
  misc_feature (377)..(387): n is a, c, g, or t
  misc_feature (390)..(408): n is a, c, g, or t
  misc_feature (412)..(412): n is a, c, g, or t
  misc_feature (414)..(417): n is a, c, g, or t
  misc_feature (419)..(423): n is a, c, g, or t
  misc_feature (426)..(427): n is a, c, g, or t
  misc_feature (430)..(433): n is a, c, g, or t
  misc_feature (435)..(438): n is a, c, g, or t
  misc_feature (440)..(440): n is a, c, g, or t
  misc_feature (443)..(446): n is a, c, g, or t
  misc_feature (448)..(451): n is a, c, g, or t
  misc_feature (453)..(456): n is a, c, g, or t
  misc_feature (459)..(475): n is a, c, g, or t
  misc_feature (477)..(478): n is a, c, g, or t
  misc_feature (480)..(484): n is a, c, g, or t
  misc_feature (486)..(487): n is a, c, g, or t
  misc_feature (489)..(499): n is a, c, g, or t
  misc_feature (501)..(509): n is a, c, g, or t
  misc_feature (511)..(516): n is a, c, g, or t
  misc_feature (518)..(523): n is a, c, g, or t
  misc_feature (525)..(525): n is a, c, g, or t
  misc_feature (529)..(531): n is a, c, g, or t
  misc_feature (533)..(533): n is a, c, g, or t
  misc_feature (535)..(537): n is a, c, g, or t
  misc_feature (539)..(543): n is a, c, g, or t
  misc_feature (545)..(545): n is a, c, g, or t
  misc_feature (548)..(550): n is a, c, g, or t
  misc_feature (552)..(552): n is a, c, g, or t
  misc_feature (555)..(556): n is a, c, g, or t
  misc_feature (558)..(558): n is a, c, g, or t
  misc_feature (560)..(563): n is a, c, g, or t
  misc_feature (565)..(565): n is a, c, g, or t
  misc_feature (568)..(579): n is a, c, g, or t
  misc_feature (581)..(583): n is a, c, g, or t
  misc_feature (585)..(588): n is a, c, g, or t
  misc_feature (590)..(591): n is a, c, g, or t
  misc_feature (593)..(593): n is a, c, g, or t
  misc_feature (595)..(597): n is a, c, g, or t
  misc_feature (600)..(602): n is a, c, g, or t
  misc_feature (605)..(605): n is a, c, g, or t
  misc_feature (610)..(615): n is a, c, g, or t
  misc_feature (617)..(617): n is a, c, g, or t
  misc_feature (619)..(621): n is a, c, g, or t
  misc_feature (623)..(623): n is a, c, g, or t
  misc_feature (625)..(626): n is a, c, g, or t
  misc_feature (629)..(629): n is a, c, g, or t
  misc_feature (631)..(631): n is a, c, g, or t
  misc_feature (634)..(638): n is a, c, g, or t
  misc_feature (640)..(640): n is a, c, g, or t
  misc_feature (642)..(643): n is a, c, g, or t
  misc_feature (645)..(646): n is a, c, g, or t
  misc_feature (648)..(650): n is a, c, g, or t
  misc_feature (652)..(656): n is a, c, g, or t
  misc_feature (658)..(667): n is a, c, g, or t
  misc_feature (669)..(676): n is a, c, g, or t
  misc_feature (679)..(684): n is a, c, g, or t
  misc_feature (686)..(688): n is a, c, g, or t
  misc_feature (690)..(695): n is a, c, g, or t
  misc_feature (697)..(698): n is a, c, g, or t
  misc_feature (700)..(706): n is a, c, g, or t
  misc_feature (709)..(709): n is a, c, g, or t
  misc_feature (712)..(712): n is a, c, g, or t
  misc_feature (714)..(714): n is a, c, g, or t
  misc_feature (716)..(730): n is a, c, g, or t
  misc_feature (733)..(734): n is a, c, g, or t
  misc_feature (736)..(739): n is a, c, g, or t
  misc_feature (741)..(748): n is a, c, g, or t
  misc_feature (750)..(750): n is a, c, g, or t
  misc_feature (752)..(755): n is a, c, g, or t
  misc_feature (757)..(760): n is a, c, g, or t
  misc_feature (762)..(762): n is a, c, g, or t
  misc_feature (764)..(766): n is a, c, g, or t
  misc_feature (769)..(772): n is a, c, g, or t
  misc_feature (774)..(774): n is a, c, g, or t
  misc_feature (777)..(777): n is a, c, g, or t
  misc_feature (780)..(781): n is a, c, g, or t
  misc_feature (784)..(787): n is a, c, g, or t
  misc_feature (789)..(789): n is a, c, g, or t
  misc_feature (794)..(807): n is a, c, g, or t
  misc_feature (809)..(812): n is a, c, g, or t
  misc_feature (815)..(816): n is a, c, g, or t
  misc_feature (818)..(818): n is a, c, g, or t
  misc_feature (820)..(820): n is a, c, g, or t
  misc_feature (823)..(825): n is a, c, g, or t
  misc_feature (827)..(847): n is a, c, g, or t
  misc_feature (849)..(849): n is a, c, g, or t
  misc_feature (852)..(854): n is a, c, g, or t
  misc_feature (859)..(862): n is a, c, g, or t
  misc_feature (864)..(866): n is a, c, g, or t
  misc_feature (869)..(871): n is a, c, g, or t
  misc_feature (874)..(876): n is a, c, g, or t
  misc_feature (878)..(880): n is a, c, g, or t
  misc_feature (882)..(883): n is a, c, g, or t
  misc_feature (886)..(887): n is a, c, g, or t
  misc_feature (889)..(894): n is a, c, g, or t
  misc_feature (896)..(902): n is a, c, g, or t
  misc_feature (906)..(907): n is a, c, g, or t
  misc_feature (909)..(909): n is a, c, g, or t
  misc_feature (911)..(917): n is a, c, g, or t
  misc_feature (919)..(927): n is a, c, g, or t
  misc_feature (929)..(934): n is a, c, g, or t
  misc_feature (936)..(939): n is a, c, g, or t
  misc_feature (941)..(947): n is a, c, g, or t
  misc_feature (949)..(949): n is a, c, g, or t
  misc_feature (953)..(956): n is a, c, g, or t
  misc_feature (958)..(961): n is a, c, g, or t
  misc_feature (963)..(963): n is a, c, g, or t
  misc_feature (965)..(965): n is a, c, g, or t
  misc_feature (967)..(968): n is a, c, g, or t
  misc_feature (970)..(976): n is a, c, g, or t
  misc_feature (978)..(980): n is a, c, g, or t
  misc_feature (984)..(990): n is a, c, g, or t
  misc_feature (992)..(997): n is a, c, g, or t
  misc_feature (999)..(1002): n is a, c, g, or t
  misc_feature (1005)..(1007): n is a, c, g, or t
  misc_feature (1009)..(1018): n is a, c, g, or t
  misc_feature (1021)..(1023): n is a, c, g, or t
  misc_feature (1026)..(1026): n is a, c, g, or t
  misc_feature (1030)..(1030): n is a, c, g, or t
  misc_feature (1032)..(1035): n is a, c, g, or t
  misc_feature (1038)..(1038): n is a, c, g, or t
  misc_feature (1041)..(1041): n is a, c, g, or t
  misc_feature (1044)..(1044): n is a, c, g, or t
  misc_feature (1048)..(1048): n is a, c, g, or t
  misc_feature (1050)..(1050): n is a, c, g, or t
  misc_feature (1052)..(1053): n is a, c, g, or t
  misc_feature (1055)..(1056): n is a, c, g, or t
  misc_feature (1058)..(1059): n is a, c, g, or t
  misc_feature (1061)..(1064): n is a, c, g, or t
  misc_feature (1066)..(1066): n is a, c, g, or t
  misc_feature (1068)..(1075): n is a, c, g, or t
  misc_feature (1077)..(1079): n is a, c, g, or t
  misc_feature (1081)..(1094): n is a, c, g, or t
  misc_feature (1096)..(1101): n is a, c, g, or t
  misc_feature (1103)..(1107): n is a, c, g, or t
  misc_feature (1109)..(1109): n is a, c, g, or t
  misc_feature (1111)..(1111): n is a, c, g, or t
  misc_feature (1114)..(1116): n is a, c, g, or t
  misc_feature (1119)..(1123): n is a, c, g, or t
  misc_feature (1125)..(1126): n is a, c, g, or t
  misc_feature (1128)..(1128): n is a, c, g, or t
  misc_feature (1130)..(1131): n is a, c, g, or t
  misc_feature (1133)..(1139): n is a, c, g, or t
  misc_feature (1142)..(1142): n is a, c, g, or t
  misc_feature (1146)..(1146): n is a, c, g, or t
  misc_feature (1148)..(1151): n is a, c, g, or t
  misc_feature (1153)..(1153): n is a, c, g, or t
  misc_feature (1155)..(1156): n is a, c, g, or t
  misc_feature (1158)..(1160): n is a, c, g, or t
  misc_feature (1162)..(1166): n is a, c, g, or t
  misc_feature (1168)..(1168): n is a, c, g, or t
  misc_feature (1170)..(1171): n is a, c, g, or t
  misc_feature (1174)..(1177): n is a, c, g, or t
  misc_feature (1180)..(1184): n is a, c, g, or t
  misc_feature (1189)..(1189): n is a, c, g, or t
  misc_feature (1191)..(1197): n is a, c, g, or t
  misc_feature (1200)..(1200): n is a, c, g, or t
  misc_feature (1202)..(1204): n is a, c, g, or t
  misc_feature (1206)..(1206): n is a, c, g, or t
  misc_feature (1208)..(1208): n is a, c, g, or t
  misc_feature (1211)..(1217): n is a, c, g, or t
  misc_feature (1220)..(1221): n is a, c, g, or t
  misc_feature (1223)..(1228): n is a, c, g, or t
  misc_feature (1230)..(1232): n is a, c, g, or t
  misc_feature (1234)..(1234): n is a, c, g, or t
  misc_feature (1236)..(1236): n is a, c, g, or t
  misc_feature (1238)..(1241): n is a, c, g, or t
  misc_feature (1243)..(1243): n is a, c, g, or t
  misc_feature (1245)..(1251): n is a, c, g, or t
  misc_feature (1253)..(1253): n is a, c, g, or t
  misc_feature (1257)..(1258): n is a, c, g, or t
  misc_feature (1260)..(1261): n is a, c, g, or t
  misc_feature (1263)..(1264): n is a, c, g, or t
  misc_feature (1268)..(1272): n is a, c, g, or t
  misc_feature (1275)..(1275): n is a, c, g, or t
  misc_feature (1277)..(1284): n is a, c, g, or t
  misc_feature (1286)..(1293): n is a, c, g, or t
  misc_feature (1295)..(1297): n is a, c, g, or t
  misc_feature (1300)..(1301): n is a, c, g, or t
  misc_feature (1305)..(1305): n is a, c, g, or t
  misc_feature (1307)..(1314): n is a, c, g, or t
  misc_feature (1318)..(1318): n is a, c, g, or t
  misc_feature (1320)..(1335): n is a, c, g, or t
  misc_feature (1337)..(1339): n is a, c, g, or t
  misc_feature (1341)..(1342): n is a, c, g, or t
  misc_feature (1345)..(1345): n is a, c, g, or t
  misc_feature (1348)..(1349): n is a, c, g, or t
  misc_feature (1351)..(1351): n is a, c, g, or t
  misc_feature (1353)..(1355): n is a, c, g, or t
  misc_feature (1357)..(1359): n is a, c, g, or t
  misc_feature (1362)..(1362): n is a, c, g, or t
  misc_feature (1364)..(1365): n is a, c, g, or t
  misc_feature (1367)..(1367): n is a, c, g, or t
  misc_feature (1369)..(1376): n is a, c, g, or t
  misc_feature (1379)..(1380): n is a, c, g, or t
  misc_feature (1382)..(1382): n is a, c, g, or t
  misc_feature (1384)..(1384): n is a, c, g, or t
  misc_feature (1387)..(1400): n is a, c, g, or t
  misc_feature (1404)..(1412): n is a, c, g, or t
  misc_feature (1414)..(1421): n is a, c, g, or t
  misc_feature (1423)..(1426): n is a, c, g, or t
  misc_feature (1428)..(1429): n is a, c, g, or t
  misc_feature (1431)..(1431): n is a, c, g, or t
  misc_feature (1433)..(1433): n is a, c, g, or t
  misc_feature (1437)..(1438): n is a, c, g, or t
  misc_feature (1450)..(1451): n is a, c, g, or t
  misc_feature (1454)..(1454): n is a, c, g, or t
  misc_feature (1456)..(1458): n is a, c, g, or t
  misc_feature (1460)..(1462): n is a, c, g, or t
  misc_feature (1466)..(1469): n is a, c, g, or t
  misc_feature (1471)..(1474): n is a, c, g, or t
  misc_feature (1476)..(1481): n is a, c, g, or t
  misc_feature (1484)..(1485): n is a, c, g, or t
  misc_feature (1487)..(1493): n is a, c, g, or t
  misc_feature (1495)..(1495): n is a, c, g, or t
  misc_feature (1987)..(1987): n is a, c, g, or t
  misc_feature (1993)..(1993): n is a, c, g, or t
  misc_feature (2001)..(2001): n is a, c, g, or t
  misc_feature (2004)..(2005): n is a, c, g, or t
  misc_feature (2019)..(2019): n is a, c, g, or t
  misc_feature (2025)..(2026): n is a, c, g, or t
  misc_feature (2028)..(2028): n is a, c, g, or t
  misc_feature (2034)..(2035): n is a, c, g, or t
  misc_feature (2040)..(2040): n is a, c, g, or t
  misc_feature (2044)..(2044): n is a, c, g, or t
  misc_feature (2046)..(2046): n is a, c, g, or t
  misc_feature (2050)..(2050): n is a, c, g, or t
  misc_feature (2058)..(2058): n is a, c, g, or t
  misc_feature (2063)..(2064): n is a, c, g, or t
  misc_feature (2841)..(2841): n is a, c, g, or t
  misc_feature (2846)..(2846): n is a, c, g, or t
  misc_feature (2849)..(2850): n is a, c, g, or t
  misc_feature (2854)..(2855): n is a, c, g, or t
  misc_feature (2859)..(2859): n is a, c, g, or t
  misc_feature (2861)..(2861): n is a, c, g, or t
  misc_feature (2863)..(2863): n is a, c, g, or t
  misc_feature (2865)..(2865): n is a, c, g, or t
  misc_feature (2871)..(2871): n is a, c, g, or t
  misc_feature (2874)..(2874): n is a, c, g, or t
  misc_feature (2879)..(2879): n is a, c, g, or t
  misc_feature (2890)..(2890): n is a, c, g, or t
  misc_feature (2893)..(2893): n is a, c, g, or t
  misc_feature (2895)..(2895): n is a, c, g, or t
  misc_feature (2900)..(2900): n is a, c, g, or t
  misc_feature (2904)..(2905): n is a, c, g, or t
  misc_feature (2912)..(2912): n is a, c, g, or t
  misc_feature (2916)..(2916): n is a, c, g, or t
  misc_feature (2919)..(2919): n is a, c, g, or t
  misc_feature (2921)..(2921): n is a, c, g, or t
  misc_feature (2926)..(2927): n is a, c, g, or t
  misc_feature (2929)..(2929): n is a, c, g, or t
  misc_feature (2932)..(2932): n is a, c, g, or t
  misc_feature (2934)..(2934): n is a, c, g, or t
  misc_feature (2936)..(2936): n is a, c, g, or t
  misc_feature (2938)..(2938): n is a, c, g, or t
  misc_feature (2944)..(2944): n is a, c, g, or t
  misc_feature (2946)..(2946): n is a, c, g, or t
  misc_feature (2948)..(2948): n is a, c, g, or t
  misc_feature (2952)..(2953): n is a, c, g, or t
  misc_feature (2958)..(2958): n is a, c, g, or t
  misc_feature (2962)..(2962): n is a, c, g, or t
  misc_feature (2964)..(2964): n is a, c, g, or t
  misc_feature (2967)..(2967): n is a, c, g, or t
  misc_feature (2971)..(2972): n is a, c, g, or t
  misc_feature (2974)..(2974): n is a, c, g, or t
  misc_feature (2976)..(2978): n is a, c, g, or t
  misc_feature (2981)..(2981): n is a, c, g, or t
  misc_feature (2983)..(2984): n is a, c, g, or t
  misc_feature (2991)..(2991): n is a, c, g, or t
  misc_feature (2995)..(2995): n is a, c, g, or t
  misc_feature (3002)..(3002): n is a, c, g, or t
  misc_feature (3005)..(3007): n is a, c, g, or t
  misc_feature (3009)..(3014): n is a, c, g, or t
  misc_feature (3016)..(3016): n is a, c, g, or t
  misc_feature (3021)..(3025): n is a, c, g, or t
  misc_feature (3028)..(3028): n is a, c, g, or t
  misc_feature (3031)..(3033): n is a, c, g, or t
  misc_feature (3035)..(3037): n is a, c, g, or t
  misc_feature (3039)..(3039): n is a, c, g, or t
  misc_feature (3041)..(3047): n is a, c, g, or t
  misc_feature (3049)..(3050): n is a, c, g, or t
  misc_feature (3053)..(3053): n is a, c, g, or t
  misc_feature (3056)..(3056): n is a, c, g, or t
  misc_feature (3058)..(3058): n is a, c, g, or t
  misc_feature (3061)..(3061): n is a, c, g, or t
  misc_feature (3063)..(3068): n is a, c, g, or t
  misc_feature (3071)..(3073): n is a, c, g, or t
  misc_feature (3075)..(3078): n is a, c, g, or t
  misc_feature (3080)..(3081): n is a, c, g, or t
  misc_feature (3087)..(3090): n is a, c, g, or t
  misc_feature (3094)..(3094): n is a, c, g, or t
  misc_feature (3097)..(3100): n is a, c, g, or t
  misc_feature (3104)..(3106): n is a, c, g, or t
  misc_feature (3108)..(3109): n is a, c, g, or t
  misc_feature (3111)..(3114): n is a, c, g, or t
  misc_feature (3116)..(3116): n is a, c, g, or t
  misc_feature (3118)..(3121): n is a, c, g, or t
  misc_feature (3124)..(3125): n is a, c, g, or t
  misc_feature (3129)..(3132): n is a, c, g, or t
  misc_feature (3134)..(3134): n is a, c, g, or t
  misc_feature (3137)..(3137): n is a, c, g, or t
  misc_feature (3139)..(3145): n is a, c, g, or t
  misc_feature (3149)..(3151): n is a, c, g, or t
  misc_feature (3153)..(3157): n is a, c, g, or t
  misc_feature (3159)..(3159): n is a, c, g, or t
  misc_feature (3161)..(3163): n is a, c, g, or t
  misc_feature (3167)..(3167): n is a, c, g, or t
  misc_feature (3169)..(3169): n is a, c, g, or t
  misc_feature (3171)..(3173): n is a, c, g, or t
  misc_feature (3176)..(3177): n is a, c, g, or t
  misc_feature (3180)..(3191): n is a, c, g, or t
  misc_feature (3193)..(3197): n is a, c, g, or t
  misc_feature (3199)..(3199): n is a, c, g, or t
  misc_feature (3202)..(3204): n is a, c, g, or t
  misc_feature (3206)..(3206): n is a, c, g, or t
  misc_feature (3212)..(3212): n is a, c, g, or t
  misc_feature (3215)..(3225): n is a, c, g, or t
  misc_feature (3227)..(3230): n is a, c, g, or t
  misc_feature (3232)..(3232): n is a, c, g, or t
  misc_feature (3234)..(3235): n is a, c, g, or t
  misc_feature (3238)..(3239): n is a, c, g, or t
  misc_feature (3241)..(3241): n is a, c, g, or t
  misc_feature (3243)..(3244): n is a, c, g, or t
  misc_feature (3246)..(3246): n is a, c, g, or t
  misc_feature (3248)..(3251): n is a, c, g, or t
  misc_feature (3253)..(3253): n is a, c, g, or t
  misc_feature (3255)..(3256): n is a, c, g, or t
  misc_feature (3258)..(3259): n is a, c, g, or t
  misc_feature (3261)..(3262): n is a, c, g, or t
  misc_feature (3264)..(3266): n is a, c, g, or t
  misc_feature (3269)..(3271): n is a, c, g, or t
  misc_feature (3273)..(3277): n is a, c, g, or t
  misc_feature (3280)..(3281): n is a, c, g, or t
  misc_feature (3284)..(3286): n is a, c, g, or t
  misc_feature (3288)..(3290): n is a, c, g, or t
  misc_feature (3293)..(3294): n is a, c, g, or t
  misc_feature (3298)..(3305): n is a, c, g, or t
  misc_feature (3307)..(3308): n is a, c, g, or t
  misc_feature (3310)..(3312): n is a, c, g, or t
  misc_feature (3314)..(3315): n is a, c, g, or t
  misc_feature (3317)..(3320): n is a, c, g, or t
  misc_feature (3325)..(3330): n is a, c, g, or t
  misc_feature (3332)..(3334): n is a, c, g, or t
  misc_feature (3336)..(3337): n is a, c, g, or t
  misc_feature (3339)..(3340): n is a, c, g, or t
  misc_feature (3342)..(3343): n is a, c, g, or t
  misc_feature (3345)..(3346): n is a, c, g, or t
  misc_feature (3349)..(3352): n is a, c, g, or t
  misc_feature (3354)..(3355): n is a, c, g, or t
  misc_feature (3357)..(3358): n is a, c, g, or t
  misc_feature (3360)..(3363): n is a, c, g, or t
  misc_feature (3365)..(3370): n is a, c, g, or t
  misc_feature (3372)..(3378): n is a, c, g, or t
  misc_feature (3383)..(3383): n is a, c, g, or t
  misc_feature (3386)..(3387): n is a, c, g, or t
  misc_feature (3389)..(3389): n is a, c, g, or t
  misc_feature (3391)..(3392): n is a, c, g, or t
  misc_feature (3394)..(3410): n is a, c, g, or t
  misc_feature (3412)..(3413): n is a, c, g, or t
  misc_feature (3415)..(3426): n is a, c, g, or t
  misc_feature (3428)..(3429): n is a, c, g, or t
  misc_feature (3433)..(3435): n is a, c, g, or t
  misc_feature (3437)..(3437): n is a, c, g, or t
  misc_feature (3439)..(3439): n is a, c, g, or t
  misc_feature (3443)..(3444): n is a, c, g, or t
  misc_feature (3446)..(3452): n is a, c, g, or t
  misc_feature (3454)..(3456): n is a, c, g, or t
  misc_feature (3458)..(3458): n is a, c, g, or t
  misc_feature (3461)..(3462): n is a, c, g, or t
  misc_feature (3464)..(3465): n is a, c, g, or t
  misc_feature (3469)..(3469): n is a, c, g, or t
  misc_feature (3472)..(3475): n is a, c, g, or t
  misc_feature (3477)..(3477): n is a, c, g, or t
  misc_feature (3479)..(3480): n is a, c, g, or t
  misc_feature (3482)..(3483): n is a, c, g, or t
  misc_feature (3485)..(3486): n is a, c, g, or t
  misc_feature (3489)..(3489): n is a, c, g, or t
  misc_feature (3492)..(3495): n is a, c, g, or t
  misc_feature (3497)..(3500): n is a, c, g, or t
  misc_feature (3502)..(3504): n is a, c, g, or t
  misc_feature (3506)..(3506): n is a, c, g, or t
  misc_feature (3508)..(3509): n is a, c, g, or t
  misc_feature (3511)..(3511): n is a, c, g, or t
  misc_feature (3513)..(3516): n is a, c, g, or t
  misc_feature (3518)..(3518): n is a, c, g, or t
  misc_feature (3520)..(3525): n is a, c, g, or t
  misc_feature (3528)..(3531): n is a, c, g, or t
  misc_feature (3533)..(3534): n is a, c, g, or t
  misc_feature (3536)..(3537): n is a, c, g, or t
  misc_feature (3539)..(3540): n is a, c, g, or t
  misc_feature (3542)..(3542): n is a, c, g, or t
  misc_feature (3544)..(3548): n is a, c, g, or t
  misc_feature (3550)..(3551): n is a, c, g, or t
  misc_feature (3553)..(3555): n is a, c, g, or t
  misc_feature (3557)..(3561): n is a, c, g, or t
  misc_feature (3565)..(3565): n is a, c, g, or t
  misc_feature (3567)..(3567): n is a, c, g, or t
  misc_feature (3569)..(3570): n is a, c, g, or t
  misc_feature (3572)..(3572): n is a, c, g, or t
  misc_feature (3574)..(3575): n is a, c, g, or t
  misc_feature (3577)..(3577): n is a, c, g, or t
  misc_feature (3579)..(3579): n is a, c, g, or t
  misc_feature (3582)..(3583): n is a, c, g, or t
  misc_feature (3586)..(3586): n is a, c, g, or t
  misc_feature (3589)..(3601): n is a, c, g, or t
  misc_feature (3603)..(3604): n is a, c, g, or t
  misc_feature (3606)..(3607): n is a, c, g, or t
  misc_feature (3611)..(3615): n is a, c, g, or t
  misc_feature (3617)..(3619): n is a, c, g, or t
  misc_feature (3621)..(3624): n is a, c, g, or t
  misc_feature (3626)..(3628): n is a, c, g, or t
  misc_feature (3630)..(3635): n is a, c, g, or t
  misc_feature (3637)..(3641): n is a, c, g, or t
  misc_feature (3644)..(3644): n is a, c, g, or t
  misc_feature (3647)..(3649): n is a, c, g, or t
  misc_feature (3651)..(3653): n is a, c, g, or t
  misc_feature (3655)..(3657): n is a, c, g, or t
  misc_feature (3660)..(3663): n is a, c, g, or t
  misc_feature (3666)..(3671): n is a, c, g, or t
  misc_feature (3673)..(3680): n is a, c, g, or t
  misc_feature (3682)..(3684): n is a, c, g, or t
  misc_feature (3687)..(3690): n is a, c, g, or t
  misc_feature (3694)..(3694): n is a, c, g, or t
  misc_feature (3696)..(3697): n is a, c, g, or t
  misc_feature (3699)..(3699): n is a, c, g, or t
  misc_feature (3701)..(3703): n is a, c, g, or t
  misc_feature (3705)..(3709): n is a, c, g, or t
  misc_feature (3711)..(3712): n is a, c, g, or t
  misc_feature (3714)..(3717): n is a, c, g, or t
  misc_feature (3720)..(3731): n is a, c, g, or t
  misc_feature (3734)..(3736): n is a, c, g, or t
  misc_feature (3738)..(3738): n is a, c, g, or t
  misc_feature (3740)..(3751): n is a, c, g, or t
  misc_feature (3753)..(3755): n is a, c, g, or t
  misc_feature (3757)..(3758): n is a, c, g, or t
  misc_feature (3760)..(3762): n is a, c, g, or t
  misc_feature (3767)..(3770): n is a, c, g, or t
  misc_feature (3772)..(3774): n is a, c, g, or t
  misc_feature (3777)..(3780): n is a, c, g, or t
  misc_feature (3782)..(3783): n is a, c, g, or t
  misc_feature (3786)..(3793): n is a, c, g, or t
  misc_feature (3795)..(3795): n is a, c, g, or t
  misc_feature (3797)..(3797): n is a, c, g, or t
  misc_feature (3801)..(3802): n is a, c, g, or t
  misc_feature (3807)..(3809): n is a, c, g, or t
  misc_feature (3812)..(3816): n is a, c, g, or t
  misc_feature (3818)..(3818): n is a, c, g, or t
  misc_feature (3820)..(3828): n is a, c, g, or t
  misc_feature (3830)..(3830): n is a, c, g, or t
  misc_feature (3833)..(3839): n is a, c, g, or t
  misc_feature (3841)..(3844): n is a, c, g, or t
  misc_feature (3846)..(3851): n is a, c, g, or t
  misc_feature (3853)..(3854): n is a, c, g, or t
  misc_feature (3856)..(3858): n is a, c, g, or t
  misc_feature (3860)..(3860): n is a, c, g, or t
  misc_feature (3862)..(3863): n is a, c, g, or t
  misc_feature (3866)..(3866): n is a, c, g, or t
  misc_feature (3868)..(3869): n is a, c, g, or t
  misc_feature (3871)..(3873): n is a, c, g, or t
  misc_feature (3875)..(3879): n is a, c, g, or t
  misc_feature (3882)..(3884): n is a, c, g, or t
  misc_feature (3886)..(3891): n is a, c, g, or t
  misc_feature (3895)..(3895): n is a, c, g, or t
  misc_feature (3898)..(3900): n is a, c, g, or t
  misc_feature (3904)..(3905): n is a, c, g, or t
  misc_feature (3907)..(3909): n is a, c, g, or t
  misc_feature (3912)..(3923): n is a, c, g, or t
  misc_feature (3926)..(3928): n is a, c, g, or t
  misc_feature (3930)..(3931): n is a, c, g, or t
  misc_feature (3935)..(3935): n is a, c, g, or t
  misc_feature (3938)..(3938): n is a, c, g, or t
  misc_feature (3940)..(3946): n is a, c, g, or t
  misc_feature (3948)..(3950): n is a, c, g, or t
  misc_feature (3955)..(3955): n is a, c, g, or t
  misc_feature (3957)..(3957): n is a, c, g, or t
  misc_feature (3960)..(3962): n is a, c, g, or t
  misc_feature (3965)..(3965): n is a, c, g, or t
  misc_feature (3967)..(3970): n is a, c, g, or t
  misc_feature (3973)..(3975): n is a, c, g, or t
  misc_feature (3977)..(3977): n is a, c, g, or t
  misc_feature (3979)..(3980): n is a, c, g, or t
  misc_feature (3982)..(3986): n is a, c, g, or t
  misc_feature (3988)..(3993): n is a, c, g, or t
  misc_feature (3996)..(3996): n is a, c, g, or t
  misc_feature (3998)..(3998): n is a, c, g, or t
  misc_feature (4000)..(4000): n is a, c, g, or t
cgggcagcgttgtgagcgactggatgttacgccagtgcaccggtgccccgaagacggccacggacaagtgcgtggcaacctttgacgccgccacgggcgtgatgactttcaccatgatcctgctcccgcagacactcgccaacgctttggtgcttgagatannnccnnnnnncnnngnntnnnngnnnnacnnnnnnannnnnntnannnnnnnnnngttgnnggncnnnnnnnnnnntnnnnannccnncnnngngnannnnncnnngnnnncnnntngnnnangnncnnnngnanannggnacnangnnngnnnnnatnngnnnnntgcnnnnnnnnnnngnntnnnnannnnnntnccnnnnnnnnnnnntnannnnnnnnnnngcnnnnnnnnnnnnnnnnnnnggcngnnnncnnnnnaannggnnnngnnnnanaannnnannnntnnnnacnnnnnnnnnnnnnnnnngnncnnnnngnnannnnnnnnnnngnnnnnnnnngnnnnnntnnnnnntntgannntnannngnnnnntnctnnntnccnntngnnnngnggnnnnnnnnnnnncnnncnnnncnnangnnnagnnnccnctgcnnnnnncngnnnangnngcncngcnnnnnancnncnncnnngnnnnngnnnnnnnnnngnnnnnnnnggnnnnnngnnngnnnnnngnngnnnnnnntgntancnannnnnnnnnnnnnnncgnntnnnncnnnnnnnncncnnnngnnnncnannntgnnnncnatnggnngannnncnatgannnnnnnnnnnnnncnnnnacnncngncannnannnnnnnnnnnnnnnnnnnnncnaannnggcgnnnncnnngcnnncgnnntnnngnncgnnannnnnntnnnnnnntatnncnannnnnnnannnnnnnnntnnnnnncnnnntnnnnnnnancgannnnannnncnangnngnnnnnnncnnnacgnnnnnnnannnnnngnnnncgnnngnnnnnnnnnncgnnnacncgcnannnnacncanccnccgncntnntnncnncnnnngncnnnnnnnncnnngnnnnnnnnnnnnnntnnnnnncnnnnncnangannnacnnnnngnnantnncnnnnnnnganatgncnnnnangnngnnnannnnnancnncannnncannnnngactntnnnnnnnctncnnnancngannnnnnnggnnannnnnngnnntncngnnnnangnnnnnnncntacnncnncnncgtnnnnnccngnnnnnnnnannnnnnnncnnncannggcngnnnnnnnnacgncnnnnnnnnnnnnnnnntnnncnngancannancnnngnnngcncnnanannnnnnnnaanntngncgnnnnnnnnnnnnnngacnnnnnnnnnannnnnnnngnnnngnncnanctcnntgccgacggcannatngnnngnnnagannnnannnngnnnnnngannannnnnnnancgttatcgccatcgtgttccatgccggtcatcacgaaaacgatgcctccgattactccgccaccggtatcggtcagcagaagtgccacggctatgccgttgccttgcaggatgccacaaacggttattgtcagtggggcgtttacggaaccgagttgggttgctgccccacggatggaagcggaaaaaaacagaacaattactctgcacctgacatcgactggagcggctacgcctggacacagaaaatcatcaccgctgccggcggcaaggacaagttgaatgccaccgaagattccggttatcctgccacctactatgccgttgtggattatgcgcacaaagtcccgtcccctgccaacagcaccggctggtttttgccctccatcggccagatgtggaatgtttatcaaaaccgcgcttctttgtttgaaggcaagacagtggtatcaggcttaaagtctgactggtactggtcctcctcggagttctncgaccntccggcgngcnncgctctttatgtgngtgtgnncngcggcnncgtgnacancnacantaaggacnacagnnatagttacgtgcgtccggtcttggctttctgacctatttacctattcaatctatttatctatttgcggcgtagccgctcgttgataaaggctgaatacccgcgaagcgggtcggaaaaatttttgaaaaatcgagttatggcattatccgaagaattacccctataccgcgacacttaccggttgttgaacaacctgttgatcctgacgcaggattttccgcgcttcttccgctacagtatgggcagccgtatggtggatttgactttggatatgctttctctgatttacaaggcgaacagcagctatgaaaaagtgggcgtattgaccgaatttctcgaccgttaccgcatgttgcagatgcttttccgcgtatgtgtggagcagaaggtcattaccgagcgcaaatacgcctcgttcgggctgctgttggagaagataggcaagcaggctacgagctggaaacaatataacgaacgcggaatgaagaaacaggaagataaaaggcaatgatttatcagtcgggattcgggcggtcaaggcttcccgaagcgaactgtttattattgaaaaagggttgtcggcaggctttcctcgtgcagggaggctcgcaaagacaaaaacagacaacatttactggtcctcctcggagttctacaacaatccggcgaacaacgctctttatgtgaatgtgaacaacggcaacgtgaacaacaacaataagaacaacagaaatagttacgtgcgtccggtcttggctttttcaataaaaactttncgatnaannaaanngtanancnanatgganttncaacnaagtctttttncanangaggnactnngaggcantccnttngnggatnncntcnangngnatttcnantnccgnnaaaanaaangnaanaccnncnannnccntnncttcganagcnattacgnacnnngnnnnnngnaccgnnnnnggnaannnannncngnnnnnnncnnccnttncngtncnnnnnnttnnntnnnnannaacccnnnnaaanggnnnntttnnncnncnnnntncnnnnacnntgtnnnnancancnnnnnnncccnnngnnnnntncnnntttngnannnaanntcnnnnnnnnnnnntnnnnntnccnnnangggaanggnnnnnnnnnnngnnnnanannggnngnannancnnnncngnntnncnncnnngannncnnnnnggnnttnnntnnnctnnaaannnnnnnncnntnnntnntnnnnaaaannnnnnannngnngnngnntnnccnnnncnnannannnntnnnnnnannnnnnnggggnaannancnngnnnnnnnnnnnnnnnnncnncnnnnnnnnnnnntnnaccnnncngnaaannannnnnnncnnnanacnncnncccnaannnngngnngnntnnccnaannnnannnncnnntncnntncnnnngntnnnnnngannnncnntnngnnancnnnnnanncnnntnnnnncccntnanntncnngncngannggnccnnnnnnnnnnnnnannanngggnnnnnannncnnnngnnngnnnnnngnnnnnatngtnnntnnncnnnccnnnnaannnnnncnnnnnnnngnnnaannnnaaantnncngnnngnnnnncnnannnnggnnnnnnnnnnnnccnnncnannnnnnnnnnnnannntnnannnaaggnnnncnnnttnnnngnnggnnnnnnnntncngggnngaaannnctnnnnnancnnnnnnnnngnttnnnnnnngnnnncnnnnnncnncnnnancnnttngnngnnngnnnnnccnnntnnnnnnaaanccnnngggnngnnnttnnnnnnnnnnnnaannncnntttnggnannnnnnngnnnttttncnccnnnaancnnnngtnnnangnnannnnncnnnnnngtnangn

SEQ ID NO: 315 - DNA, 4000 bp, Escherichia coli
  misc_feature (4)..(4): n is a, c, g, or t
  misc_feature (11)..(11): n is a, c, g, or t
  misc_feature (21)..(21): n is a, c, g, or t
  misc_feature (24)..(24): n is a, c, g, or t
  misc_feature (31)..(31): n is a, c, g, or t
  misc_feature (75)..(75): n is a, c, g, or t
  misc_feature (79)..(79): n is a, c, g, or t
  misc_feature (138)..(138): n is a, c, g, or t
  misc_feature (196)..(196): n is a, c, g, or t
  misc_feature (1870)..(1870): n is a, c, g, or t
  misc_feature (1938)..(1938): n is a, c, g, or t
  misc_feature (1987)..(1987): n is a, c, g, or t
  misc_feature (3751)..(3751): n is a, c, g, or t
ggantattttntaaaattttnacnatttcgnaaatattcagatttaatcctttttcgtcatttaaagagaaatgnatcnagaagaattttaaactctttttgaacaaaccgatgaccacgttttgagcttgctagatnaatgcattttctcatttactttaattttaattcaaatatacaatgaaaaaatataatnatcagctacatgacccaatcagagaacactcactttaaaggtcttattgaaaaggcctccgacagcaaaaaaatagatcttctggctcaatgggctctttgcgaatttgatcttttttattccagcttccagacgataacagaatcagcaaagactgcattcgaaactcgcgactaccaagcgtcgctgacaattagtaggaaacgactgtctctatacagtgacagtatgttcaaattgggggaaaagcttgcggatgctttctctcctatctcaagagatcaggcactatgggaagtaattgaagaaaaatatcggcagcttgttagaaaccgttatgagggggacctcgctctggcatatattcattcagttcgtcggtcgctcttcctaggagaatggagccccgtagcctattccttcgataccccaagcaaggccaacacaaacttttccaactttctgttcgagacttttcaaacggaattaatcaccactgaccttcttattgatatactccgtgtccctggattcaacgtccagtatcgtgaactgaaggtggacgcaatgttggcagcacaacgagttaaagctgatctggatgacagattcagcacatataaaattcagaaaatcgaagtcattaaaggggagttctaccgtaatcggggtgcctacatcgtcggaagaattgtacttgataatcagtcaatggtaccacttgtcatcgcgttgctgaatgatgaaaaagggatttatgttgatgcgattctcacttcagagtctgccactttcaatattttcagtacaacccgggcaaactttcatgttaacaacgaatactatcatgaactttcagaatttcttcacagtattataccaaaacgatctctgggtctagcctattctacaatcggatttaatcattttggtaaagttgcagtaatggaagaattgaaggaagaacttttgtctactgatggaaagcttgattttgctataggttttaagggtactgttgcaataggtttccagtcccctcaatcgggttacaatcttaaagttattcgtaatacacctactgagcaatataagtggggagtgtttgaaggagttccctctgtgctggaaaaatacggtcgtgtccacgttattaatcggacaggcagtatgctggacaacattattttctatcgcgttaaacttgaaagagcttggttcaccaatgcactactgcaagaacttttgaacgacgcgagtgaatgtgtgacactgcaaggtgaatctctatttttcagacaccttatcgtacagagtaaattgatccccttgccggtctacctagaaaactcatcgcaggctgaaagcgaggccgcaataatcaatcttgggcactgcatcaaaaacaatatggctgccaatatattcaataaggacctcgatgccagaaactatggtgtcggtgtattcggaggagtgtacttgtttgattacgacgctctggaacagtttactgaagttaagatccgcactaatcagaaccagttcgaaggagaagaagatattccagagtggttctttgaggacggtgtgatattcctgcccgaggaaatagaatctggcctgagaatacccaatcgctctctgcgacaattgtttagggaggtacatggngacttgctgcaagtagattactatgagcgtattcaggatgaactaggtgtgggtaaagtccccagtgntagagtctatccagagcggtaccagatcaattagaaagtctatgcacancattgcaagggtaattgagaatcaccctttcggagtatgagacgatcatgtctgtctcttgcttaataaatatcaagagaaattcattttgttgatgaccttcatcctattaattgcaataatacacgattaaaatctgttagcttataatcctcagtcgtacagttacttaaacttgttccaacgttcacttctttcattcagcgaatcgagagtaattattagattgtttcattgcagggcacagcttgacttgtccatctcataaggagtttacagcatgaaggtatgtattgttggagctggagccatcggcggttacatggctgttcgcattgcaaatgcaggacataatgtttcggtaatagcacgtggtcctcatttggctgctataaaagccagagggatgaagttgatcgaggagaacgatgaatttgtagctgagaatttgaccgccactgaatttgtaggggaacttggaccaatggacgtggttctcttggcacttaaagcccatcagatagtccctattgtgaatgacatgtctgtacttcttggccccaacactgtcattgtcacccttcagaatgggatcccatggtggtatttccaaaatttcgttggtgactatgccaaccgggtagtggaaactgttgatcctggcggtttgctatttaagagtatcgatccggatcgcttgattggctgcatagcctatcctgctacaactatttctaaaccaggagtgatccagcatatcgagggtaatcgttttccagtgggagaactatgcggcatgaaaacagagcgagttcagatggtgtctgacttatttactgaatcaggattcaagtctagaattctcgatgatattcgctctgaaatctggttgaaattgtggggaaatctgactttcaatccaatcagcgctctctcccattcaacgcttgtcgacatatgtcagttcccgttgaccagacaattggctgccacaatgatgaccgaggcgcagactgtcggagaacgcctgggggctcatttccgcatacccatggaaaagcgcattgccggtgcagagagtgtcggcaaacacaagacctcaatgctccaggatgtggaggctgggaaacccgtggaaatagaaagcatgctgggtgctgtgattgagttggctgaagttacaggagtgcaaacccctaccttgagggctatttacgcttgcgtgagcttactcgacaaaacactgagtcaagaaaaaatcttaatcaaagggatatcgaaagaataaacctaaatttttttaataaataagttgtcaagaaacaaggttactcgtttttccgtcaacgaagttctcgatattatcaactacttgattagacgattgtttgctacctagatccagcggtctgcgtaactacatacaaatatactacggcatcttgctggtgtttgtatatttttggtgttcaaattgagactgctaaacgaactttacgctattactgatttagtaatgtgccgactgcggcaatgggaatttttgggttttttacactaaaaggagacttaccacaaatgactcaatggatacgttttgattaccaggaaaagacggagatcgggacactgactggcgatactgtctcagaatacaaaggaggactttttgatagaccccagcctacaggccgttcaatgccacttgcagatgtccagttgaaagccccgctagtaccgcattccatttttgcattgtggaanaactttcacgaacgtgcccaaaaagaaagccagacgcttcccgatgtaccactttacttcatgaagccgataaccagcgtgattggtcctggacagactatctatcgtccccgcggacatcatggacgggtaatatttgaggctgaattgggtattgttctcggctcgacctgccgagagatcagcgaagaggaggccggccaatatatttttggctatacctgtgtcaatgatgttacagcaattgag

SEQ ID NO: 316 - DNA, 4000 bp, Escherichia coli
  misc_feature (670)..(670): n is a, c, g, or t
  misc_feature (706)..(706): n is a, c, g, or t
  misc_feature (724)..(724): n is a, c, g, or t
  misc_feature (871)..(871): n is a, c, g, or t
  misc_feature (988)..(988): n is a, c, g, or t
  misc_feature (1285)..(1285): n is a, c, g, or t
  misc_feature (1318)..(1318): n is a, c, g, or t
  misc_feature (1420)..(1420): n is a, c, g, or t
  misc_feature (1555)..(1555): n is a, c, g, or t
  misc_feature (1597)..(1597): n is a, c, g, or t
  misc_feature (1618)..(1618): n is a, c, g, or t
  misc_feature (1702)..(1702): n is a, c, g, or t
  misc_feature (1759)..(1759): n is a, c, g, or t
  misc_feature (1801)..(1801): n is a, c, g, or t
  misc_feature (1870)..(1870): n is a, c, g, or t
  misc_feature (1987)..(1987): n is a, c, g, or t
  misc_feature (3101)..(3101): n is a, c, g, or t
  misc_feature (3194)..(3194): n is a, c, g, or t
  misc_feature (3196)..(3196): n is a, c, g, or t
  misc_feature (3199)..(3199): n is a, c, g, or t
  misc_feature (3349)..(3349): n is a, c, g, or t
  misc_feature (3510)..(3510): n is a, c, g, or t
  misc_feature (3558)..(3558): n is a, c, g, or t
  misc_feature (3582)..(3582): n is a, c, g, or t
tgtcgatttgtgatgtgctggtctattccgaagggctggacgaccctgtcgcgcgggcatcgctgacctatgccattccgccacgctgattgtaccccacactgacgggtacaatcgaaaaaagggccggtatttaccggcccgagtgaagaggtctggactgcgccacagggacgttacgccttccagaacacccgaatagactcatcatgagcctgtcgcggtgtgagtcccacgtctgccaactgccaaggctcaagctgcgcgagcgctttgcgtgtccggcgacgcgatgccatcttcgtgacgcagaccgcaaatttgaccgcaagaacagcggcaaacggtgtgctgcgctggttcaggattgccacagtttcgtggttgagggtcagggtctgtgtcatgagaatctcctatttctgaattgtattgacacaatgttacgttttgccgtaacaaaggggtacaaaatgcgatacattttgaaaaggaaaacattgtaatgggtacaatttggcaacctgatcaaattgacgggcctggccctaaatacaaagccgttgttacaatgatacgaaacggtatctcgaacggcgctttatcggcgggggaaaaactgccgccggtgcgggaactggcatggaagcttggcgtcacgccggggacngtggcacgggcctatacgatgctgaccgaaagcggnacgttgcaggccgaggtngggcgcggcacctttgtcgccctgccgcccacgacccccgatcgcaacagcccgatcgagatggatgtgatcgcccaccacgtgcatcaagggacaaagaactaccccgcggacacctatgccgtgaacatgttctcgccgcacctnccatcggcggggcaggcgacgctgatccgcaatctgatggccgaggtcgctcaggatccggcgtcaggtgtgatgcattatcccagccgcaccggggcgcgccccgcccgcgaagcngtggtcaaatggctggccggcacgccgctgggatcctttaccgaggccgatgtgatcctgtctcacggcgggcaaaacggtctgtctctcgtgttccagtccatcctgcaaggccgacgccccgccatcgcgattgaagagctgtcgtaccccggtttccgccgcgcgggcgagctgctgcgcgccgatgtcattccggtggcgatggataaagacggcgtgatccccgaagcgctggacgaggtggcgcggaaccatgatcttcagattttctgcacctcgcccgaagtccataanccgaccgccggcttcacacctgtggcgcgccgngaggcgctggtcgaggtggcgcgcaaacatgactttcaaattgtcgaggacgattgttatcgcatgcgcgtagagcgtgcgccgacctaccggatgcttgcncccgaacgcggctggtatgtctcgtcactggccaagaccctgacccctgcgctgcgcatcggcttcgccatcggcccgcgccagcgcacacccgatctgcgtcgcgtggccgagtacaattgcttcggccttgcnaccccgttgatcgacctttgtgccaagctgctggtgcatccngatatcgacgccatcgccganggcacgcgtcagggctttaacgcctatgtccaaagcgcggtgaatatactgggcggatatgatgtggcgtggcgcaccaacgtnccgtttttgtggctgagcctgccggttggctggcgggcgggtgcgttctgtcaggcngctgaagggcagggtgttcaaatccgctcggccgaggaattngtctgccgcgatgcccgcgcgccccatgcagtgcggcttgcgatcaacgcaggcgtggcgctgcacagntttgaggatgcgatcatgcgcctgcgacatctgctggactctccacccgagcagttgagtgtgtgatttttgtggggtataataatacctaatttgcaaggcattgtttttgtgagnaaaaatagggaatgtggcgcttgacgtggcgaagggcgtgtttataacccagccatcagatagcggggttcggtttcggaccctttcaccaaagtaacgggaattccctccatgaaaaccttttctgcaacaccggcagatatcgacaagaaatggatcatcgtcgacgctgaaggcgtcgtccttggccgtcttgcgtcgatcattgccatgcgtctgcgcggcaagcacaagccttcctacacacctcacatggattgcggcgacaacgtcatcgtgatcaatgccgagaaaatccagatgaccggcaagaagcgtgaagaaaacttctactggcacactggccaccccggcgggatcaaagagcgtaccaaagctcagatccttgaaggtgcgcaccccgagcgtgttgtgacccaagcggtcaagcgcatgctgcccggcaaccgcctgagccgccagatcatgaccaacctgcgcgtttacgccggttccgaacacccccacgaggcgcaaagccccgaggttctggacgtgaaatccatgaactctaaaaacacgcggagtgcataagcatggctgatgaaatcaaaacactcgaaggcctcgaagcggccgtaaccgagaacatcggtggcgttcaggggacagaagttgaaatgaccccacgcgagcccgtgcgtgacgcgcaaggccgcgcctatgcaaccggtaagcgtaaagatgcggttgcccgcgtctggatcaaaccaggttccggtaaagtcatcgtaaacggcaaagcgcaaaacgaatattttgcacgccccgttctgcagatgatcctggcacagccattcaccatcacaggcaccgacggtcagttcgacgttgttgcaactgtgaaaggtggcggtctgtccggtcaggcgggcgcggtgaagcacggtgtttccaaagcactgcagctctacgatccctccctgcgcggcgcgctgaaagcggcaggcttcctgacacgcgacagccgtgttgttgagcgtaagaagtacggtcgtgcgaaagcgcgtaagagcttccagttctccaagcgttaagctttactttacagtttttggaaaaggccgctcctgcnggggcggcctttttcgtatgcgcctgaggccagccgacccttcggggagagtttatttcgcaaaatgaagccggcggggtggttttgttttcnangcngcgtgcttaggtaaaggatgcgttaaaaacggagccgccccatgcgatattcagtccttgatctttcccccgtgcccgaagggtcagatgcccgccaggccattgcgaatacgattgatctggcaaagcggaccgaagcggcgggatatnatcgctactggatggcagagcatcacaacatgccggggatcgcctctgccgcgacatcggtgttgatcgggcatgtggcggatcacacctctcgcatccgtgtgggcgcggggggcatcatgttgccgaaccacgcgccgctggcgattgcagagcagttnggcacgcttgccacgattcacggagaccggattgatctgggccttggncgcgcgcccggtggggatcaggcngtgtaccatgccttgcggcgcgggatgcaagggggcgaccgtttccccgaagatgtggccgagctgatcggctatcttggcgaggcccctgcgggggcgcgtgtgatggcgcatccggggcagggcacgcatgtgccggtgtggatcctgggctcttcgctttatggcgcgcagctggcggcgcatttcgggctgccctatgcctttgcctcgcattttgcccccgatgcgttggaagacgccgtggcgatttaccgtcgcgatttcaaaccctcggcgcagtgggagaaaccgcatttcatgttggcggcgaatgttttcgcggcggataccgatgaagagggggcctaccttcggacctccatgcagcaggcttttgtgcggttgcgcaccggcaaaccgggcaagctgccgcgtc

SEQ ID NO: 317 - DNA, 4000 bp, Escherichia coli
  misc_feature (1968)..(1968): n is a, c, g, or t
  misc_feature (1970)..(1970): n is a, c, g, or t
  misc_feature (1972)..(1975): n is a, c, g, or t
  misc_feature (1977)..(1977): n is a, c, g, or t
  misc_feature (1982)..(1987): n is a, c, g, or t
  misc_feature (1989)..(1997): n is a, c, g, or t
  misc_feature (2045)..(2050): n is a, c, g, or t
  misc_feature (2052)..(2057): n is a, c, g, or t
  misc_feature (2059)..(2073): n is a, c, g, or t
  misc_feature (2122)..(2126): n is a, c, g, or t
  misc_feature (2128)..(2141): n is a, c, g, or t
  misc_feature (2143)..(2152): n is a, c, g, or t
  misc_feature (2154)..(2155): n is a, c, g, or t
  misc_feature (2157)..(2158): n is a, c, g, or t
  misc_feature (2160)..(2164): n is a, c, g, or t
  misc_feature (2166)..(2168): n is a, c, g, or t
  misc_feature (2171)..(2171): n is a, c, g, or t
  misc_feature (2173)..(2174): n is a, c, g, or t
  misc_feature (2176)..(2179): n is a, c, g, or t
  misc_feature (2183)..(2184): n is a, c, g, or t
  misc_feature (2186)..(2188): n is a, c, g, or t
  misc_feature (2191)..(2195): n is a, c, g, or t
  misc_feature (2197)..(2204): n is a, c, g, or t
  misc_feature (2206)..(2212): n is a, c, g, or t
  misc_feature (2214)..(2215): n is a, c, g, or t
  misc_feature (2217)..(2217): n is a, c, g, or t
  misc_feature (2219)..(2222): n is a, c, g, or t
  misc_feature (2224)..(2230): n is a, c, g, or t
  misc_feature (2232)..(2233): n is a, c, g, or t
  misc_feature (2235)..(2238): n is a, c, g, or t
  misc_feature (2240)..(2242): n is a, c, g, or t
  misc_feature (2245)..(2245): n is a, c, g, or t
  misc_feature (2247)..(2252): n is a, c, g, or t
  misc_feature (2254)..(2256): n is a, c, g, or t
  misc_feature (2259)..(2265): n is a, c, g, or t
  misc_feature (2267)..(2269): n is a, c, g, or t
  misc_feature (2272)..(2281): n is a, c, g, or t
  misc_feature (2283)..(2283): n is a, c, g, or t
  misc_feature (2285)..(2285): n is a, c, g, or t
  misc_feature (2288)..(2305): n is a, c, g, or t
  misc_feature (2309)..(2309): n is a, c, g, or t
  misc_feature (2312)..(2313): n is a, c, g, or t
  misc_feature (2315)..(2317): n is a, c, g, or t
  misc_feature (2320)..(2320): n is a, c, g, or t
  misc_feature (2322)..(2322): n is a, c, g, or t
  misc_feature (2324)..(2328): n is a, c, g, or t
  misc_feature (2330)..(2333): n is a, c, g, or t
  misc_feature (2336)..(2339): n is a, c, g, or t
  misc_feature (2341)..(2342): n is a, c, g, or t
  misc_feature (2344)..(2344): n is a, c, g, or t
  misc_feature (2346)..(2347): n is a, c, g, or t
  misc_feature (2352)..(2355): n is a, c, g, or t
  misc_feature (2357)..(2367): n is a, c, g, or t
  misc_feature (2370)..(2370): n is a, c, g, or t
  misc_feature (2372)..(2383): n is a, c, g, or t
  misc_feature (2385)..(2386): n is a, c, g, or t
  misc_feature (2388)..(2391): n is a, c, g, or t
  misc_feature (2393)..(2395): n is a, c, g, or t
  misc_feature (2398)..(2398): n is a, c, g, or t
  misc_feature (2401)..(2405): n is a, c, g, or t
  misc_feature (2407)..(2409): n is a, c, g, or t
  misc_feature (2413)..(2418): n is a, c, g, or t
  misc_feature (2421)..(2422): n is a, c, g, or t
  misc_feature (2425)..(2426): n is a, c, g, or t
  misc_feature (2428)..(2440): n is a, c, g, or t
  misc_feature (2442)..(2444): n is a, c, g, or t
  misc_feature (2446)..(2447): n is a, c, g, or t
  misc_feature (2449)..(2452): n is a, c, g, or t
  misc_feature (2454)..(2455): n is a, c, g, or t
  misc_feature (2457)..(2457): n is a, c, g, or t
  misc_feature (2459)..(2460): n is a, c, g, or t
  misc_feature (2462)..(2463): n is a, c, g, or t
  misc_feature (2465)..(2468): n is a, c, g, or t
  misc_feature (2470)..(2472): n is a, c, g, or t
  misc_feature (2475)..(2475): n is a, c, g, or t
  misc_feature (2477)..(2482): n is a, c, g, or t
  misc_feature (2484)..(2486): n is a, c, g, or t
  misc_feature (2489)..(2495): n is a, c, g, or t
  misc_feature (2497)..(2499): n is a, c, g, or t
  misc_feature (2502)..(2505): n is a, c, g, or t
  misc_feature (2507)..(2516): n is a, c, g, or t
  misc_feature (2518)..(2529): n is a, c, g, or t
  misc_feature (2532)..(2532): n is a, c, g, or t
  misc_feature (2535)..(2537): n is a, c, g, or t
  misc_feature (2540)..(2540): n is a, c, g, or t
  misc_feature (2543)..(2545): n is a, c, g, or t
  misc_feature (2547)..(2549): n is a, c, g, or t
  misc_feature (2554)..(2559): n is a, c, g, or t
  misc_feature (2561)..(2563): n is a, c, g, or t
  misc_feature (2566)..(2572): n is a, c, g, or t
  misc_feature (2574)..(2576): n is a, c, g, or t
  misc_feature (2580)..(2587): n is a, c, g, or t
  misc_feature (2589)..(2595): n is a, c, g, or t
  misc_feature (2597)..(2601): n is a, c, g, or t
  misc_feature (2603)..(2614): n is a, c, g, or t
  misc_feature (2617)..(2617): n is a, c, g, or t
  misc_feature (2620)..(2622): n is a, c, g, or t
  misc_feature (2624)..(2626): n is a, c, g, or t
  misc_feature (2631)..(2636): n is a, c, g, or t
  misc_feature (2638)..(2640): n is a, c, g, or t
  misc_feature (2643)..(2649): n is a, c, g, or t
  misc_feature (2651)..(2653): n is a, c, g, or t
  misc_feature (2657)..(2657): n is a, c, g, or t
  misc_feature (2659)..(2676): n is a, c, g, or t
  misc_feature (2678)..(2682): n is a, c, g, or t
  misc_feature (2684)..(2687): n is a, c, g, or t
  misc_feature (2689)..(2689): n is a, c, g, or t
  misc_feature (2691)..(2691): n is a, c, g, or t
  misc_feature (2694)..(2694): n is a, c, g, or t
  misc_feature (2697)..(2699): n is a, c, g, or t
  misc_feature (2701)..(2703): n is a, c, g, or t
  misc_feature (2708)..(2713): n is a, c, g, or t
  misc_feature (2715)..(2717): n is a, c, g, or t
  misc_feature (2720)..(2726): n is a, c, g, or t
  misc_feature (2728)..(2730): n is a, c, g, or t
  misc_feature (2734)..(2734): n is a, c, g, or t
  misc_feature (2736)..(2741): n is a, c, g, or t
  misc_feature (2743)..(2755): n is a, c, g, or t
  misc_feature (2757)..(2764): n is a, c, g, or t
  misc_feature (2766)..(2768): n is a, c, g, or t
  misc_feature (2770)..(2771): n is a, c, g, or t
  misc_feature (2773)..(2776): n is a, c, g, or t
  misc_feature (2778)..(2780): n is a, c, g, or t
  misc_feature (2783)..(2783): n is a, c, g, or t
  misc_feature (2785)..(2790): n is a, c, g, or t
  misc_feature (2792)..(2794): n is a, c, g, or t
  misc_feature (2797)..(2803): n is a, c, g, or t
  misc_feature (2805)..(2807): n is a, c, g, or t
  misc_feature (2810)..(2813): n is a, c, g, or t
  misc_feature (2815)..(2819): n is a, c, g, or t
  misc_feature (2821)..(2840): n is a, c, g, or t
  misc_feature (2842)..(2845): n is a, c, g, or t
  misc_feature (2847)..(2848): n is a, c, g, or t
  misc_feature (2850)..(2853): n is a, c, g, or t
  misc_feature (2855)..(2857): n is a, c, g, or t
  misc_feature (2860)..(2860): n is a, c, g, or t
  misc_feature (2862)..(2867): n is a, c, g, or t
  misc_feature (2869)..(2871): n is a, c, g, or t
  misc_feature (2874)..(2880): n is a, c, g, or t
  misc_feature (2882)..(2884): n is a, c, g, or t
  misc_feature (2887)..(2890): n is a, c, g, or t
  misc_feature (2892)..(2921): n is a, c, g, or t
  misc_feature (2924)..(2924): n is a, c, g, or t
  misc_feature (2927)..(2933): n is a, c, g, or t
  misc_feature (2935)..(2935): n is a, c, g, or t
  misc_feature (2939)..(2943): n is a, c, g, or t
  misc_feature (2945)..(2947): n is a, c, g, or t
  misc_feature (2951)..(2956): n is a, c, g, or t
  misc_feature (2959)..(2962): n is a, c, g, or t
  misc_feature (2964)..(2996): n is a, c, g, or t
  misc_feature (2998)..(2998): n is a, c, g, or t
  misc_feature (3001)..(3001): n is a, c, g, or t
  misc_feature (3004)..(3010): n is a, c, g, or t
  misc_feature (3012)..(3012): n is a, c, g, or t
  misc_feature (3016)..(3020): n is a, c, g, or t
  misc_feature (3022)..(3024): n is a, c, g, or t
  misc_feature (3028)..(3033): n is a, c, g, or t
  misc_feature (3036)..(3039): n is a, c, g, or t
  misc_feature (3041)..(3042): n is a, c, g, or t
  misc_feature (3044)..(3057): n is a, c, g, or t
  misc_feature (3059)..(3065): n is a, c, g, or t
  misc_feature (3068)..(3075): n is a, c, g, or t
  misc_feature (3078)..(3078): n is a, c, g, or t
  misc_feature (3081)..(3087): n is a, c, g, or t
  misc_feature (3089)..(3089): n is a, c, g, or t
  misc_feature (3093)..(3097): n is a, c, g, or t
  misc_feature (3099)..(3101): n is a, c, g, or t
  misc_feature (3105)..(3110): n is a, c, g, or t
  misc_feature (3113)..(3116): n is a, c, g, or t
  misc_feature (3118)..(3143): n is a, c, g, or t
  misc_feature (3145)..(3152): n is a, c, g, or t
  misc_feature (3154)..(3155): n is a, c, g, or t
  misc_feature (3157)..(3160): n is a, c, g, or t
  misc_feature (3162)..(3164): n is a, c, g, or t
  misc_feature (3167)..(3167): n is a, c, g, or t
  misc_feature (3169)..(3174): n is a, c, g, or t
  misc_feature (3176)..(3178): n is a, c, g, or t
  misc_feature (3181)..(3187): n is a, c, g, or t
  misc_feature (3189)..(3191): n is a, c, g, or t
  misc_feature (3194)..(3201): n is a, c, g, or t
  misc_feature (3203)..(3210): n is a, c, g, or t
  misc_feature (3212)..(3227): n is a, c, g, or t
  misc_feature (3229)..(3229): n is a, c, g, or t
  misc_feature (3232)..(3232): n is a, c, g, or t
  misc_feature (3235)..(3237): n is a, c, g, or t
  misc_feature (3239)..(3239): n is a, c, g, or t
  misc_feature (3241)..(3241): n is a, c, g, or t
  misc_feature (3246)..(3246): n is a, c, g, or t
  misc_feature (3248)..(3249): n is a, c, g, or t
  misc_feature (3251)..(3251): n is a, c, g, or t
  misc_feature (3253)..(3254): n is a, c, g, or t
  misc_feature (3258)..(3259): n is a, c, g, or t
  misc_feature (3261)..(3263): n is a, c, g, or t
  misc_feature (3266)..(3268): n is a, c, g, or t
  misc_feature (3272)..(3292): n is a, c, g, or t
  misc_feature (3295)..(3296): n is a, c, g, or t
  misc_feature (3298)..(3303): n is a, c, g, or t
  misc_feature (3306)..(3306): n is a, c, g, or t
  misc_feature (3309)..(3309): n is a, c, g, or t
  misc_feature (3312)..(3314): n is a, c, g, or t
  misc_feature (3316)..(3316): n is a, c, g, or t
  misc_feature (3318)..(3318): n is a, c, g, or t
  misc_feature (3323)..(3323): n is a, c, g, or t
  misc_feature (3325)..(3326): n is a, c, g, or t
  misc_feature (3328)..(3328): n is a, c, g, or t
  misc_feature (3330)..(3331): n is a, c, g, or t
  misc_feature (3335)..(3336): n is a, c, g, or t
  misc_feature (3338)..(3340): n is a, c, g, or t
  misc_feature (3343)..(3345): n is a, c, g, or t
  misc_feature (3349)..(3381): n is a, c, g, or t
  misc_feature (3383)..(3383): n is a, c, g, or t
  misc_feature (3386)..(3386): n is a, c, g, or t
  misc_feature (3389)..(3391): n is a, c, g, or t
  misc_feature (3393)..(3393): n is a, c, g, or t
  misc_feature (3395)..(3395): n is a, c, g, or t
  misc_feature (3400)..(3400): n is a, c, g, or t
  misc_feature (3402)..(3403): n is a, c, g, or t
  misc_feature (3405)..(3405): n is a, c, g, or t
  misc_feature (3407)..(3408): n is a, c, g, or t
  misc_feature (3412)..(3413): n is a, c, g, or t
  misc_feature (3415)..(3417): n is a, c, g, or t
  misc_feature (3420)..(3422): n is a, c, g, or t
  misc_feature (3426)..(3445): n is a, c, g, or t
  misc_feature (3447)..(3458): n is a, c, g, or t
  misc_feature (3460)..(3460): n is a, c, g, or t
  misc_feature (3463)..(3463): n is a, c, g, or t
  misc_feature (3466)..(3468): n is a, c, g, or t
  misc_feature (3470)..(3470): n is a, c, g, or t
  misc_feature (3472)..(3472): n is a, c, g, or t
  misc_feature (3477)..(3477): n is a, c, g, or t
  misc_feature (3479)..(3480): n is a, c, g, or t
  misc_feature (3482)..(3482): n is a, c, g, or t
  misc_feature (3484)..(3485): n is a, c, g, or t
  misc_feature (3489)..(3490): n is a, c, g, or t
  misc_feature (3492)..(3494): n is a, c, g, or t
  misc_feature (3497)..(3499): n is a, c, g, or t
  misc_feature (3503)..(3505): n is a, c, g, or t
  misc_feature (3507)..(3533): n is a, c, g, or t
  misc_feature (3535)..(3535): n is a, c, g, or t
  misc_feature (3537)..(3537): n is a, c, g, or t
  misc_feature (3540)..(3540): n is a, c, g, or t
  misc_feature (3543)..(3545): n is a, c, g, or t
  misc_feature (3547)..(3547): n is a, c, g, or t
  misc_feature (3549)..(3549): n is a, c, g, or t
  misc_feature (3554)..(3554): n is a, c, g, or t
  misc_feature (3556)..(3557): n is a, c, g, or t
  misc_feature (3559)..(3559): n is a, c, g, or t
  misc_feature (3561)..(3562): n is a, c, g, or t
  misc_feature (3566)..(3567): n is a, c, g, or t
  misc_feature (3569)..(3571): n is a, c, g, or t
  misc_feature (3574)..(3576): n is a, c, g, or t
  misc_feature (3580)..(3597): n is a, c, g, or t
  misc_feature (3599)..(3612): n is a, c, g, or t
  misc_feature (3614)..(3615): n is a, c, g, or t
  misc_feature (3617)..(3618): n is a, c, g, or t
  misc_feature (3620)..(3624): n is a, c, g, or t
  misc_feature (3626)..(3628): n is a, c, g, or t
  misc_feature (3631)..(3631): n is a, c, g, or t
  misc_feature (3633)..(3634): n is a, c, g, or t
  misc_feature (3636)..(3639): n is a, c, g, or t
  misc_feature (3643)..(3644): n is a, c, g, or t
  misc_feature (3646)..(3648): n is a, c, g, or t
  misc_feature (3651)..(3655): n is a, c, g, or t
  misc_feature (3657)..(3658): n is a, c, g, or t
  misc_feature (3660)..(3682): n is a, c, g, or t
  misc_feature (3684)..(3688): n is a, c, g, or t
  misc_feature (3691)..(3691): n is a, c, g, or t
  misc_feature (3694)..(3694): n is a, c, g, or t
  misc_feature (3697)..(3700): n is a, c, g, or t
  misc_feature (3703)..(3704): n is a, c, g, or t
  misc_feature (3710)..(3710): n is a, c, g, or t
  misc_feature (3713)..(3715): n is a, c, g, or t
  misc_feature (3720)..(3720): n is a, c, g, or t
  misc_feature (3723)..(3724): n is a, c, g, or t
  misc_feature (3728)..(3731): n is a, c, g, or t
  misc_feature (3734)..(3751): n is a, c, g, or t
  misc_feature (3753)..(3756): n is a, c, g, or t
  misc_feature (3758)..(3765): n is a, c, g, or t
  misc_feature (3768)..(3768): n is a, c, g, or t
  misc_feature (3771)..(3771): n is a, c, g, or t
  misc_feature (3774)..(3777): n is a, c, g, or t
  misc_feature (3780)..(3781): n is a, c, g, or t
  misc_feature (3787)..(3787): n is a, c, g, or t
  misc_feature (3790)..(3792): n is a, c, g, or t
  misc_feature (3797)..(3797): n is a, c, g, or t
  misc_feature (3800)..(3801): n is a, c, g, or t
  misc_feature (3805)..(3808): n is a, c, g, or t
  misc_feature (3811)..(3842): n is a, c, g, or t
  misc_feature (3845)..(3845): n is a, c, g, or t
  misc_feature (3848)..(3848): n is a, c, g, or t
  misc_feature (3851)..(3854): n is a, c, g, or t
  misc_feature (3857)..(3858): n is a, c, g, or t
  misc_feature (3864)..(3864): n is a, c, g, or t
  misc_feature (3867)..(3869): n is a, c, g, or t
  misc_feature (3874)..(3874): n is a, c, g, or t
  misc_feature (3877)..(3878): n is a, c, g, or t
  misc_feature (3882)..(3885): n is a, c, g, or t
  misc_feature (3888)..(3900): n is a, c, g, or t
  misc_feature (3903)..(3904): n is a, c, g, or t
  misc_feature (3907)..(3920): n is a, c, g, or t
  misc_feature (3923)..(3923): n is a, c, g, or t
  misc_feature (3926)..(3932): n is a, c, g, or t
  misc_feature (3934)..(3934): n is a, c, g, or t
  misc_feature (3938)..(3942): n is a, c, g, or t
  misc_feature (3944)..(3946): n is a, c, g, or t
  misc_feature (3950)..(3955): n is a, c, g, or t
  misc_feature (3958)..(3961): n is a, c, g, or t
  misc_feature (3963)..(3963): n is a, c, g, or t
  misc_feature (3965)..(3971): n is a, c, g, or t
  misc_feature (3973)..(3973): n is a, c, g, or t
  misc_feature (3975)..(3995): n is a, c, g, or t
  misc_feature (3997)..(3997): n is a, c, g, or t
  misc_feature (4000)..(4000): n is a, c, g, or t
agtgtatgcatgtgtggtccaatgatgtacgtagtggagattccgacaaccttgaagcaagagctgctgcttattattggagaaacgtctttacaacatatccgaactttgtaagagacagagaaggaacacctcctaataacctcttaaattatggttatgctattcttcgtgccataatagcacgagcattagtaggaagtggtttactgccaaccttagggatccatcatcacaataggtataatgcttattgtcttgctgatgatattatggagccttatcgtccttatgtagaccagttagtgttagatatcattcaatgcaacttagaaatatctgatatcacacgagatttaaaaatgcaacttctcggtattccaatgttagatgtagtgataaatggcaaacgaagtcctttaatgattgctgctcaacaaactacagcctcacttgcaaaatgttttgcaggggaatgtaaacgcattagttacccagaaatgtaaacttatatgtcaggatttgagcgcttcagtgagtaccgaattatgtggattcttgtattctttgatctaccaacggaaaccaagaaagagaagaaagcctatacagatttccggaaatcccttataaaggatggattcactatgtttcagttttctatatatgtacgacattgtgcaagtatggagaatgcagaagtacacatgagacgtgttcgtgcattattacctaagataggaaaagtagggatactttgcatcactgacaaacaattcgccaacattcaactcttctatggacaaaagacacaaactccaaatgctgctggacaacaattagaactattttaaaacagcccaatatcattaaaaaagaagaaaggaaatagataattcatagtatcaaaacaatgaaattaattttgattacttttgctgtcattttaacattcgcttctaactcattgtaatcaaggaatttattcatggaggagaaatgacaagaatgacagcaaaattgattatataaaaatttgcatacttatagtgtgctaagagacacacagaaaaaaaattataaatcatagcaccctcatatttactctacaaggcttttcgttgaaacatcatttctttccatttggaaaaataatcttagctttgaaagaattgctgatacagattacgagatgactacagattatggagttgtacacgtagaaaacattctcttccataagcatacaaaggaaaaaagatatctaccataaaacaagaaaaatcacatatcagaataagaccaagaaagggaaaatcagattatatatctctgctgaccaatgattatcagatggcggcagaagatataatagctatctataagaaacgatggctaatagagaacttatttaagcaattaaaacagaattttcctctaagatacttctatggagagagggcgaatgctataaaaatatggattacacttatagccaatctgtttataacacttgtgaagaataaaataaagagaccctggagcttctcaggcttggctacaatgataagaattctacttatgagttatgtatcaatacaaagtttctttgagcagcaacatagagattgggaaagattgattacccaggtaaaagccccgccagaagagctgtcattggtctaggggtggtggtatttgaaattagaactaatcatgagtatttcagcagggttgggagagaatattgcagcatatagtggttttatcggacagcaatatattacaatacagtcgctttaatcaatatacaatacaaaaaatcccattcaaaaggaatgggattttgagttgtggatcaaaatttatttttacaacaactttatatgtcgctaacacacaatgctttaccacatatcagttgttattgataccacaaaggtaagacttttcaagcaaatcacaacnanannnnanttccnnnnnntnnnnnnnnngttgttattgataccacaaaggtaagacttttcaagcaaatcacaacnnnnnntnnnnnntnnnnnnnnnnnnnnnagttgttattgataccacaaaggtaagacttttcaagcaaatcacaacnnnnntnnnnnnnnnnnnnntnnnnnnnnnntnntnntnnnnncnnnaangnnannnntttnnannnaannnnnannnnnnnnannnnnnntnntntnnnntnnnnnnntnntnnnnannncanannnnnnannnttnnnnnnnannncannnnnnnnnntnancgnnnnnnnnnnnnnnnnnngttnttnntnnnacnanannnnnannnnttnnnnannanannacaannnncnnnnnnnnnnngtnannnnnnnnnnnntnntnnnnannncanaannnnnannntttnnnnnnaanncannannnnnnnnnnnnnannntnnannnntnnantnntnntnnnnannncanannnnnnannnttnnnnnnnannncannnnannnnnnnnnngnnnnnnnnnnnnaantgnnnttnttnnnannncaaannnnnnannnttnnnnnnnannncaannnnnnnnannnnnnnannnnnannnnnnnnnnnnttnttnnnannncaaannnnnnannnttnnnnnnnannncaanannnnnnnnnnnnnnnnnntnnnnnannnngntnttnttnnnannncaaannnnnnannnttnnnnnnnannncaanannnnnnannnnnnnnnnnnnannnnnnnngnnntnntnnnnannncanannnnnnannnttnnnnnnnannncannnnannnnnannnnnnnnnnnnnnnnnnnntnnnntnntnnnnannncanannnnnnannnttnnnnnnnannncannnnannnnnnnnnnnnnnnnnnnnnnnnnnnnnnttnttnnnnnnncnaaannnnnannntttnnnnnnaannnnannnnnnnnnnnnnnnnnnnnnnnnnnnnnnnnntnttnttnnnnnnncnaaannnnnannntttnnnnnnaannnnannannnnnnnnnnnnnntnnnnnnnttnnnnnnnnttnttnnnnnnncnaaannnnnannntttnnnnnnaannnnannnnnnnnnnnnnnnnnnnnnnnnnnannnnnnnntnntnnnnannncanannnnnnannnttnnnnnnnannncannnnnnnntnnnnnnnntnnnnnnnnnnnnnnnntnttnttnnnancncaaangnnananntttnnannnaannncaannnnnnnnnnnnnnnnnnnnnaannannnnnnttnttnttnnnancncaaangnnananntttnnannnaannncaannnnnnnnnnnnnnnnnnnnnnnnnnnnnnnnntnttnttnnnancncaaangnnananntttnnannnaannncaannnnnnnnnnnnnnnnnnnncnnnnnnnnnnnntnttnttnnnancncaaangnnananntttnnannnaannncaannntnnnnnnnnnnnnnnnnnnnnnnnnnnngntnttnttnnnancncaaangnnananntttnnannnaannncaannnnnnnnnnnnnnnnnnannnnnnnnnnnnnntnntnntnnnnncnnnaangnnannnntttnnannnaannnnnannannnnnnnnnnnnnnnnnnnnnnntnnnnnttnttnttnnnnccnnaaaggnaannnttttnaannaaannnnaannnnnnnnnnnnnnnnnnannnnannnnnnnnttnttnttnnnnccnnaaaggnaannnttttnaannaaannnnaannnnnnnnnnnnnnnnnnnnnnnnnnnnnnnnttnttnttnnnnccnnaaaggnaannnttttnaannaaannnnaannnnnnnnnnnnnttnntannnnnnnnnnnnnnttnttnnnnnnncnaaannnnnannntttnnnnnnaannnnanannnnnnntnannnnnnnnnnnnnnnnnnnnntnttn

SEQ ID NO: 318 - DNA, 4000 bp, Escherichia coli
  misc_feature (1271)..(1271): n is a, c, g, or t
  misc_feature (1277)..(1277): n is a, c, g, or t
  misc_feature (1295)..(1295): n is a, c, g, or t
  misc_feature (1986)..(1986): n is a, c, g, or t
  misc_feature (2326)..(2326): n is a, c, g, or t
ttcaaccataaaattgcttcttgctttgatacaattttttcttttgaatctggctctaataatacataatgatctgatgctcttattagtggatttgacataatgaaaattcttcttggattaattctttgcttgatttttcaaggaatttttttagaaagttcttttgctctagtagattctaacgtacgagagtttttggaaaatcgtgtaaatcaatggccagaattatatttgccaaattttaaattatcggatacttctaaggatttaatttatcctaaatggttcgaggggaattggcttgttacttctcaagatatagttaatgattcagaagagccagttatttataaagtaaatttctttaagaatgattcagatttaattgttggtaatcgtgcaaaaaattctgaatctattggaaaagcaatatttggtgaaaccttaatcaaggttgtaaatgatcctcaatctattaataatcaaattacttatttaaaagatgatttttatatcgattcaagaattacagggagaaatcagatccaagatgatgatatttttttcgcagatgagctagttatacaaacagcacataagccaggtgcttcaaggattaatcaggtagagaccattagtaaatttcaaaaatgttccgaagaaatattggaagttgataattcaatcaaaccatcaatttgtggagtgcaatatgttgcttcttatggttcaaaagttggtgatccttctattcatgctataaaaacaaataaatataaattgaagtttgaatttattgagagttagcactaaaaagatattcttctaagttgttcctccaaatgaaaagattttctaaataagggttgtttatgtattcttggctcccctctcctgaaagaattggtcctgcagactttggaaatttaagaagggataattgagcagcaattgaaatatctgcaattgataaactatctccaactaaatatttcttgttgatcaaggattttgataaagcttccagtaatttttggagttctaaattatctttagaagacaaaactacattagaaattttactaagattttcaaaaggtaatttatcaacaatacttttaactgaagaaggtatttcatctggaagtaatgcagttcttagctgtggattttctattgcagattttattaaagcttttctacaagttgtagccattgtagtatctgcccagtcttcaattagtttgcattgtgcaaataatattggntcctcnggaaaaagtggattgttntcattttttttatctatatattcgcaaatagttgaagagtcattaataacttgatcattactatcgactattacaggtacttgtttttgacctgataatttaaagatttcaaattggcctattccaggtgttacttcttcaactcgatattgtagtttttttgcatgaagagccattcttgtttttaaacaaaaagcactatgcctaaattgatataatgtaatcatgctgtttaatgtttgttaaaacttagctaaaaaagtaatctatttgtggagctgatgggcgaatttttctctaatgttgcgagatatccaaagtatttgatatctatcattgttgggggacttgttgctttgcttgaacctttattcaagaatagatcaaatccactcacaatagtaggtttgatatcttctgtcttaagtgctttcataactgtttattttgtcttgcaagcgatgacaaacccaataaatttacaaccataatgccaaataattaccgtcttgcaaaagtttcttctcttttgaagaaagaaataacccttattttgcagaatgatttagaaaatgatcttattagagatcatttcgtcaatatttctaagattgatttatcaggtgatttgcaacactgtaaaatttatataacttcaactgctcaagagaaagtgaggaaagagattgtngcaaacttgaatactgctaaaagctctataaggcatagtttaggaaaaagaattgagatgagaagagttccagagataatttttaaagacgatgttgttcttgataaaggattatcagtcttgaaacttctcgatgaattaaaaaataaaaatcaaaatcataatgttgaggacaaggatgccaaaagttgatctaccccttgatcaaagaaatataattattactcgatcaaaagaagggatattggatataaaaaagatattcataagcaagggcgctaatgtatttgatttacctgcaataagtattgctgatcctgatgatttgaatcctcttgangaagcattaaatcaaataaatgattttcattggattattttttccagtagtaatgggatcaaatttgtggataaaagacttagatactttaatagttcattaaaagaatgttctaaaaaaacaaaaatcgccgtagtcggagaaaaaacctcaaaaactcttgatgattttgggattaaggctgatttcatacctccagaatttgttgctgaaagtttaattgataatttcccagtatctggttatggacttcgagtttttgtaccaagagttcaaacaggtggtagggatttaattgcagatcaatttagaaaggctggttctcgtgtatttgaggttgctgcatatgaaactagatgtcctgaatcaattccggaagaaacaattgatattatttctaatcgaaaagtcgatgcaattattttctcaagcggtaaaaccgtagtaaatgctgcttttttactagaaaaaaaacttggtaaacaatggttagaatattttgatcaaattaagttattaactattggacctcagacaacaaaaatatgtaacaagatttttggaagagttgatagtcaggcacaaaaatatacttttgaaggactactagatgtagcaattaatatttttaattagaaaaattttttgtatagttcttttcaactaaatctttgaacctatcaatattggcctgtaattcgtttgtaaccattttgcctaaaatattttcttccataaaccgagcaatcatttttggtagttcataagttattgctaaatttaccgttgtgatttgatcagttttactttcgaaaactactgatccctcagttggtaaacctcctattgatttccatttaagtttgcttttttcaaccctttctgtaatttgagctttccatttaaacctaaagccatttgcagctaaagtccattctgttaaatctggtaacgtattagtttcttcgtcaactgtttttacagattcaatccagctcatccaaagtgacattgagtctaaatcgctccatgtgtcccatacattttcaagaggcgcattaacaactgttattacgtcatgttttagccaagtacccattaattaacttactgcaagattttttgctaattcggctttcttctctaaaattgcggcggcagctaaatgaccactcattgtagctccctccatagagtctatataatcttgttttgtataactaccagccatgaagaaattagatatagatgttttttgatcgggtctgaaaggttccataccgggagcttctctatagagtgattgtggaatttgtaccacgttactccaaagcaatttaaggttttttgaggatgggaatagacggcgaacctctttatcaatttcttttgtaattctttctgtggatcttcccatccatctatcgccaggagttaaaacacattggagaagcgatcccatatctttttttctatagtctgctggacttgctagtgctaaatcagcaaaacaactgaaagaggcatcagcagaataaagaaggttatctagtccaattggttcgtttccagtattatctttttgtaattcagtaacccaaccgtcatatcttaattggattgtggcaacagctacagctctaagtttttttaaaccttcaaattctttaaatt

SEQ ID NO: 319 - DNA, 4000 bp, Escherichia coli
  misc_feature (1940)..(1940): n is a, c, g, or t
  misc_feature (1942)..(1943): n is a, c, g, or t
  misc_feature (1945)..(1946): n is a, c, g, or t
  misc_feature (1951)..(1952): n is a, c, g, or t
  misc_feature (1954)..(1955): n is a, c, g, or t
  misc_feature (1960)..(1961): n is a, c, g, or t
  misc_feature (1963)..(1964): n is a, c, g, or t
  misc_feature (1966)..(1967): n is a, c, g, or t
  misc_feature (1972)..(1973): n is a, c, g, or t
  misc_feature (1981)..(1981): n is a, c, g, or t
  misc_feature (1984)..(1985): n is a, c, g, or t
  misc_feature (1987)..(1987): n is a, c, g, or t
  misc_feature (1990)..(1991): n is a, c, g, or t
  misc_feature (1993)..(1993): n is a, c, g, or t
aattctgtattacagtatcagccaaggcccgaagattggggtttagaattagttcttggtgccgttggtacagaagcgcatggggcgcattcgggaaaaagcctttcaaatccaacagtaaaaccgcaccttcccggccatacctccggtaatgccaatgaagctgttccttcaggcggcggaagtgccagtgaaggcccttccccttttggcttgctccgttgtcgtgaatcatacaggggccatataaaggggtcagaacttcattacaaagggctttgtggatttgtcgatctgtaatatggggtgcatctatgggccgtactttgccccgctcacataaggtgaagtgggtacatttcataggcttccagttttgatccaaaaccttccgccgtctgttggccgttcctgaaaacaggtgtccttcaaagttctgaacactctgtttccaccgtaccccgttacagcacttcttcccatagaagaacattttgcgataggaaaagatcttttccataggcccaagggcattacaccgggcctgttttctcgcttgccgctttgctttgcggcgctggtatcttgcttcatgccgttcttggcttgtcataaaaataagtattcgcctttcgtacagataaattgtagggtgccgtctaatctgctttgcccttgcacatgaaatgggatatggcacgatcccccaccatgcaagaagcgtccgtgtaagggcatcaaagggcagttttagggattggctacccaaggaagtatctctccttttgcgaaggtcgtctttcacctgaaatccaaaagccgggtttctgttactccatttgacctcgcaatcgcaaaatccgggccgcacgccagccgagtagtaagcgttgttattgttgttgttgccgttgttgttgacattgcagaaattgttattgttgttgtaattaggggaacgcaaccaccaccacaccgccgaggtcacattaacagagatacacctaatttttttgaagttaagttttcaatcttgaacctacattcttaatggcccctttcaaaagttcattttctttgtcgatcagttcaccaagattttgcgccatcttatccaatttttccattgcgtcttgtgatttgactgcatttcccttggaagtagtaaaggccccttccgggttctggttcaaaatcagataaacatgggttaggcgaacatcaagcgccatcagggaagcccttgcttcaagcaaatgcgccttccgcaaactcacccgctgttggtctgaaggaaaaatgctgttggccttttccgcatggtctatgatctcaccggccagctttgcgattggctccgcaatcagccgggaataccgggcggaaaggcgggtgagaaagttgatggtttcaacatagatttggttagctgtattgatgaattcagccttacttgtggttcgcttttgcttcagtacggacacggttacacccctcttggtgtgttgtcaatttcaatcgggccttgctctctttctacatcttccaagtgctttagaagcacatattcaatgtagttggttattgaccgatgatcacgggttgcaagcgccccgattttgtcaaatacttcatctgataatcgcaaggtaaaaacccgcttattggtcgccatcctataacctccaaaaattttgcataagattattgtatggcgtttttcggtttgtgtatgcgctctaaagacaggtaagtgatagcactttgaacggaaaaagcaatttttcaaaaatcgcgtcggcgcttacgcgccgaatatttttttattttcctttcacccggcgaagccgcccccttgcgggggcgggatggggccgggataatcctgcgggggattagacagcaaagccgggccgcacgccagccgagtagtaagcgtngnnanngttgnngnngccgnngnngnngacanngcagaaantgnnantgnngntgtaataaggggaacgcaaccaccaccacaccgccgaggtggtgctggtgtgattattggctactttgctgttaccagctttgtaataatcatattgcacctgataattttgttcatagctatttgcatagcttctggaaccgaacacttcatattcagccagtaaaaacaagtaatcggtggtgctggtcacattgctttgggtattgccggtattgttgcccacattatccgtgtacttggttacaggcttcatcacattccgcaaggcggaaggcaaagccgccaacagcgaattggaaggggggcttgtgggtgtgccggtgttgcccaacagcgttttccgcatatagctttctttccaaccaccactattgctattattaggattcatattgaaatagccattgttgttttgattactgttatattggctatcgcaaagggcaaccgctgtggtgccgattttgccaatctggaagtgaattttgttattcccttccttgccgctgttgtggttgaagcccaaaatgaaggtgttgatggtcagattggagaaagtgaagttcccaaccttgccgttgatctgaatggacttcatatcaccaaccgcccaatagctggaacccttaccggaatcactgacttgtttaatggtggcccaatcgttatcattcagggtattcgtgggaagcgtgacattaacggaacaggttttatcagccggggcagtatagttggtatctgcggccacgctgacggtaattgtggcgtttccttttgccttgccggtaacagttaccacattcccggaaacgctcacagaagccacgctgggggcgctggacacggcgctgattacgccggtgccggggcgggtcacggtgattgtgtcagacattttagaaacattcagggaaatggaagatttgttcaaagaaaggcttcctgtggcctttccaatcgtccaagcaacggctttttccgcacttcccccatccgtccattggtaattagaaccgggggtgaaagtggcattatagcttccagcgttggtgccgctggtagtgccgccgatggtcattttagaactgtcataaccggcccaagtcgggctttgagtggaaccggtataagtaaggcttccgctttgagaagggacagaaaccgtggccctgttgattgtccaagttacctgtttgggggtctgcgttccatctgtccacttatactttcctttgggggtgaaggtggcggtataagttcccgcattggtggcggttgtggttccgccaagggtcaaagtttccgggttgtagctgttccaagacgggctttgttccccgccattataggttagggtgccgttctgcgacggaacaacatcaatggtataaatcaaccctgacacagcttccaaggccgaatccgccgtttcctgtgcggtctgtgcggcggaaagggcttttttcacagtttcccgaatatcagcatgggcggaagggctttcattgtgggtgttaatggcttcttcaatcgcttctgtggggtcagaactggaatcgggaagctgttcaggcttcaccttaccatcttccccaagatccgcttttccggccaaggaatcatcatgggcttttagggccgtatcaattttatccatattgcggttctgatcgtccacattgtagaaatcttcttgggctggtttcaccagatcataattaggtgtgaactgtgccatctgtcatttcctttctgatagatttgttttccagccctccaagctgggcatgggtgaagggccgaagtgttttgtgtggggtacattcatgggtttgaagttcttctgttcttacttcagaatgggtgtaccaagcaagttgggcatgggtaaacccgcccaatacttggtgaatattgaacaactgttgaactaccaaaaccaagttgactggggcaactcttttcagcaaggtttgaacatcttggaaatttttctttgcg

SEQ ID NO: 320 - DNA, 4000 bp, Escherichia coli
  misc_feature (121)..(121): n is a, c, g, or t
  misc_feature (132)..(132): n is a, c, g, or t
  misc_feature (232)..(232): n is a, c, g, or t
  misc_feature (307)..(307): n is a, c, g, or t
  misc_feature (441)..(441): n is a, c, g, or t
  misc_feature (457)..(457): n is a, c, g, or t
  misc_feature (509)..(509): n is a, c, g, or t
  misc_feature (583)..(583): n is a, c, g, or t
  misc_feature (604)..(604): n is a, c, g, or t
  misc_feature (775)..(775): n is a, c, g, or t
  misc_feature (964)..(964): n is a, c, g, or t
  misc_feature (1223)..(1223): n is a, c, g, or t
  misc_feature (1277)..(1277): n is a, c, g, or t
  misc_feature (1282)..(1282): n is a, c, g, or t
  misc_feature (1373)..(1373): n is a, c, g, or t
  misc_feature (1781)..(1781): n is a, c, g, or t
  misc_feature (1793)..(1793): n is a, c, g, or t
  misc_feature (1985)..(1985): n is a, c, g, or t
  misc_feature (3771)..(3771): n is a, c, g, or t
gggaaagtaattaatgcgtacagttattataatattgctaattaattttgcttcaaatgcttgggccaataatgttgtttctggaagtgagggtagcaaattagaaggaaaagttgtttcngaattcaacancccttgggcgatgtcttttgttgacagtgacaacctaattatcactacaaaagctggaaagctttggctcgtaaataggagtggtaaaaagtctttagtntctggagttccaaaggtttttgcaggtggtcaaggaggtttaggtgatgtcgtttttcatccaaattttacaaanaataaactagtttatatttcttacataaattcagacaatgcaggaaaaacacgatatgcgaccataatacggggcacgctagagaggttagataaacctcagctgaaaaatattgaaaccatttggaagcaaangcccgctcgatcaggnaaagggcatttttcccacagaattgtatttggccttgaaggaacacaacacnccagaaaaatttttattacgtcgggcgatcggcaagagcaatctcctgcacaaagatgggacatggcattaggnaaaattatccgccttaatgangatggaaccatacctacagacaacccatttcaggacaaaggtgacctcgcaaagactttttggacactcggtcatagaaatgcccttggaattgcatttgccaaaaatggtcaactgtgggcgcacgaaatgggtccaaggcacggagatgagcttaatttaatagttgcnggtaaaaattatgggtggccagtagtatcagaaggcaatcactatagtggagcaaaaattccagttcatgaaacaaggccagaatttatggcgccaaaactttattgggtgcctacggtagctccatcaggattaattttttatgaaggagatgaattttctgaatggaaaggaaatgcatttattggnggattgaaaagtaaggcactggttagaattgactttaataatggagagccgtttgaggctgaacgcttcagttggtctaaaagagtgagagaagtcgaaatagacgataaaggtgcgatttgggtgttagaggatggtcaatctggtaggttaataaaattcacaaaaccaaacaaatagattgagtataagcctgccttggcgttgaattagttttgctacagttatagcaatcgcaaaagatggaaaacttaaatcnaatttttctgagcaaattgcgactaatcttcactggaaacttttaaccgtaganaattnggaaaaactggcgctagactgtgcttggtctcaattagcatatgaagacaagattatagagctagcaaaagcagttcttctaaaaaattanaaaatttgaatgtcagaatctgaagatttttcaattacatagcgtgcgtttggtaaatcattacttaacgtgcgcttctttgcatcttgtgtatccaacccatgcctaagccatctattcagcaaacgctgctctaaggtatctataccaggatttatgaaaattgtttggtcccaagttttttttaatttagtccatggttcttcttcaatgagcaaataatttccttcaacaatcaacaccttgtcttttgttgatatgatgctcgatccagcaatagataaatctttatttctatcaaattctggaataactacatcatcttcaaaattacttagcctgttcattaagtgaataaaacctgcagtatcaaaagtagctggtgcacctttgcgatctaatagattncggtccaccaanattgaattgtccaaatgaaatccgtccatagaaataatttttgcttgaatagatttttcttttaacaataaaagaagcgcctgagcaaatgtagacttacccgctcctggtggccccgcaatagccacgatatagcgttttcgaccttcagaattttcaataatataatcgctgagagcctttggtttcatnttgcagccaaagcttcaggtggtggctccattgctcctgtcatcatggccacagcatcagacatcgaaattatttttggatcaactgtgcaaaggcgtctacccaagcgatgaatgtgaatacgatcacaaacctcaaaaatgtgaggcatattatgcgaaattagtacaatgggaatacctttagattttacatcttgaatcaaatctaaaactcggcgagattcttttacacctaaagctgctgtaggctcatccataattacaactttagaaccaaaggcagcagctcttgctactgctactccctgacgctgcccaccagataaagtttcgactgcctggttaatattttgaattgtaagcagtcccaactctgaaagtttatcacgtgcaaatgtttccatttgtttatgatctaatttgcgaaatagcttgcccattatccctttttcacgaatctcgcggccaagaaacatattatctgcaattgataaggctggcgacaaagccaagttttggtatactgtttcaataccagcattccgagcgtcatctggagtatgaaaatttacaagttttccgtcgagctctataaccccatggtcaggtgcagtagcaccagaaatggcacggatcagagtagttttacctgcaccattgtcacctataactcctaaaacttcatttggataaagatcaaagtctgcaccattcatcgcgacaaccgtgccatatcttttcatcaaacctttagcttgaagtacgggctctaaattatgagtaatattcttcattgtgtagccctccgcagccattgatctaaggcaacagcgattaaaacaagattacccacggcaaacatttgccagtaatcatccacaccagctagcgataatcctgtagtgaatactcccacaattaatgcacctagcacggagccaggtatagatcctcgtcctccaaacaatgatgtgccaccaattacaacggcagtaatggtagccaaattaatttcttcaaatgagattggagaaattgaaccaacgcgtccaatagcaacccaggctccaaaaccacaaattagtccagctacagcataaacagaaattaatgttctatcagttttaatacctgatagggcagcagcttctgggtcgtctccaattgcataaacatgacggccccaagcggtgtgttgcagaatgaaccaaaaaactgcggctaataaaattaatgcaattccaccatatgtaatagtagccccaaaaggacgtgctgctgcttcaccaaaccaaagaagtgaaggtgcatttgcttcaatgtcagaatttcgaatagattctgatccagaataccacaattttagtgctgtaaatacagatagcgttcccagcgttacgatgaacggaggtagtttaatcttagctacaaggaagccattaaaagcacccatcagtgtgccaattgccataccagcggcaatcgcaattggaagtgggaccccatatgacacagaaagccgacccatcacgaatgttgaaagaaccaaaattgcaccaactgaaaggtctatccctgcagttagtattatcaacgtttgtgcgattgcaacaatgccaataacagttacctgttgaaggactaaagacaaaacaccaggacttaagaatctaggtgcaatgataccaaaaattagaatgctaacgattaaaactaatgcagggacaagtgttggataatttcttacagcatttcgcacattcgatagaaacgtccgatcatcncgctcaaatacagcaactgcgctatctgcactgtttaagtttgtttcaaattcagattgactcactacacccgagctccccagcatatattttatttataaactttgaacataaagggcggcaaatgcaccgccctttaattttactttaatcatatattttaaattattcaaattaaccccagcagagttcggtgccttttgtagagtcaattgacggaacaccatca

SEQ ID NO: 321 - DNA, 4000 bp, Escherichia coli
  misc_feature (94)..(94): n is a, c, g, or t
  misc_feature (287)..(287): n is a, c, g, or t
  misc_feature (561)..(561): n is a, c, g, or t
  misc_feature (889)..(889): n is a, c, g, or t
  misc_feature (1132)..(1132): n is a, c, g, or t
  misc_feature (1251)..(1251): n is a, c, g, or t
  misc_feature (1881)..(1881): n is a, c, g, or t
  misc_feature (1929)..(1929): n is a, c, g, or t
  misc_feature (1936)..(1936): n is a, c, g, or t
  misc_feature (1948)..(1948): n is a, c, g, or t
  misc_feature (1963)..(1963): n is a, c, g, or t
  misc_feature (1966)..(1966): n is a, c, g, or t
  misc_feature (1980)..(1980): n is a, c, g, or t
  misc_feature (1984)..(1986): n is a, c, g, or t
  misc_feature (2402)..(2402): n is a, c, g, or t
  misc_feature (2408)..(2408): n is a, c, g, or t
  misc_feature (2627)..(2627): n is a, c, g, or t
  misc_feature (2823)..(2823): n is a, c, g, or t
  misc_feature (3161)..(3161): n is a, c, g, or t
  misc_feature (3260)..(3260): n is a, c, g, or t
  misc_feature (3278)..(3278): n is a, c, g, or t
tatgtcagtgcgcacatcaatatcaagtccaagctcgggtaggctaacgtcaccggcccgggggcttactgctagaagtggacagggctttggnttgcgccgacaaaaatccgcgaaatctccggcgtattgctgggggacgatcactaaattgcattgcacgaaacccggggccataccgctagtaggttcattgaatttgccctgacgtgcagcaagccgcagctgctcgggtgccataagcttaagagggtctccaacgctcacttttatctcctttgctttanctcgctgcgcgctcttgtatagtgggagaaacataccattgcgagagccctgatgccccatatatcaattactgcagctgaaactccacacaaacccgccttcatcatggctaactccggagagatggtcacctatggtgaattagaggctaggagtaatcagatcgcccatttgtttcgtctctgcgggcttaagtctggtgatcacgtcgccattatggtggaaaactgtcggcagtttctcgaaattacgacgggtgccatgcggtctggnattatcttcacgccaatcagcacgcatctcaaagaagacgaaacggcttatatcttagagaactgtggggccaaattgtttgttgcatcgcattctctggcatctgtggcggttcatatgattggtagcgctgctgcgctcaagcatttttatatgataggcggcattgaagatgggtttctctcttgggaggaaaccgttgatacattacctataacggctattgatgaccaatctatgggtacaacgatgttgtattcatcgggaaccacaggaaagcccaagggggtttataacaagccctacaccgaggtttttgatgagccantgcccttgacgttgtctttgggagccgcttttgggtttggtccggagacaacgtacctgtctcctgcgccgctctatcacgccgcgcctttgcactacaacatggttgttctggatacgggtggcacctccatcatcatggaaaagtttaatgcccttcgtgcattggaactaatagaggagcatcgcatcacccacagccaatgggtgcccataatgttcgttcgaatgctcaagctccctnaggcgcagcggacccagttcgatactagctcgatgcagatggctatacacgccgcagcgccgtgtcccattgatgtaaaagagcaaatgattgattggtggggtcctgtgatcctcgantactactcatcgagtgagggggcgggctttaccctgattgactctaatgattggctaaaccacaaaggctcggttggtcgtccgctgtttggcgttcctcacgtattggacgaggagggtaatgagctaccagctggcgaggtcggaggaatctggttttccgatattgcaaataagtttgagtatcacaatgagcctgataaaaccgctgaagcctacaacaaagatggctggacctctgtaggtgacatggggtacctcgatgaagagggttatttgtatcttaccgatcgaaagaacttcacgatcatatcgggtggcgtcaacatttatcctgcagagattgaaaacctactcatcaatcatgccaaagtcgccgatgtggcagtttttggcgttccatgtgatgaatttggtgagactgttcaagccgttgtgcagcccgccaactggggtgatgctaccgacgaaacggccttagagctgaaggaatggttacaagaacggttgtctcacatcaaaattcccagaaatttagatttcatggagcagctgccaagaatggataacggaaagctctacaagcgccacttgatggaggcgtatcgaaacaaaaatacctgatggtantgtctgaagccttggttttagtggctcgggtgttgggctataaatgcntcagtancaatgaataatntagttgcagttaagnttncaagctattgatanatannnatttaaatgaaaataggttgtcggtcgctccgatttttcgagcattaattgtctcagtccatatacccgaaggcccaacagtaataagcttggctctgttcctatagtggtatgaggtgagggtgcggaataaacggaagctcaaagcgttggcacgggacatggccaatagcgagaactacgccgattggttaggtgcagctcgtgatcacgacgaccttacgggaatgacagactggcggcatatagagcacacggacctgtatgactacgcacaaatccgtctgcgactcgatcggctaagaaatctgcgtgctcggtcagaccaccagggcctactttacgcactcaatgaaggtatccatggcaacatgggtggcatgggtaagggcgtgctgtatcgaatggctaaggcnggtacnaagcgcctcatagaagattacattgatgaaatcgacgcctcgctaaaattactggctgaactcgatgacggcattattcctgcgcagcaaaaaatggatttcttctatcgggccaacatttgctttggtcgctcagcgttaatgctcagtggcggtggcgttctaggctttcttcacctgggggtcgttaacgttttactggaacagggcctgcttccnagagtcatttctggctcaagtgcgggggctctcgtcgcaggggtgctggcttgtcacactgatgatgaagtggccgatcttgaagagctcgcgatactacaaaatggcgcgaaagaagataccggcttcctacgcaaattattaacgggcggccctagtatttctctcgatgatcttgagcagcttgttgagcgcntgattcccaattcaacatttgaagaggcttatgcaaaaactggcaggcaggtcagtattaccattgcacccgctgagccacaccagcgatcgcggctgctaaatgcagtgacctcgcctaacgtttacatacgatccgccgttatggcctcttgcgcagttccaggcgtttttcccgctgtgatgttgatggcccgcaatgttcacggtgagcctcagccgtatttgccggggcggcgttggatagacgggtctgtggcggacgatttacctgccaaacggttgtcccgcttgtttggtacgaaccaccacatcgtaagcatggtaaaccctattgcnacagcttttatttccaaagatgaagaccgcggaggcctgtctaaggcagcaggggctttaggtgttggtgttggaagggagtttctcaatttttatagnggtctagctcagaagcgnggagacaagtggccgcgcttcaatatgatgctacacggtctacatgcgctcatggatcaagaatacacgggtgacatcaatattatgccaagctttaggctcgctaacccactgcgcttgttgtcacacctcaatgaagaagagttgattcggctaacccaccatggcgcgcacgcctgttacgaaaaagttgaagctatcaggcgctgcacccaaatttcgcgaacgttggaagatattctttatcgatacgaatacggtgatttgcgtcccgacccggctgcggtcaggaagccccgttcctcgcgtcgcagaccagcccctacccttgcacagcgcgaaaggctcagcggtaggtctgactctacccgtgttcctatgaagcctaggagtggccgcgcaggctcaggcaagtctgcagaggcatctaaggtggcgcaaaagccagtgagaaaggccgtgagagtgacacactgaggctaaacctaaacccatcgggttagtctttcatgtacgacatgcctagttcagcgagtggttgcacgagattacctcggctctctgcctcggcacttgaagccgtgccatcaagtgcacgcttttttacgccctgtacaattgctgcaaggcggaaaaagcaaaacgccaaatagaaattccaatgctttatttcatcgcggccggtccgttcacagtaactcgtgacgtagctgttgtcctct

SEQ ID NO: 322 - DNA, 4000 bp, Escherichia coli
  misc_feature (90)..(90): n is a, c, g, or t
  misc_feature (165)..(165): n is a, c, g, or t
  misc_feature (336)..(336): n is a, c, g, or t
  misc_feature (450)..(450): n is a, c, g, or t
  misc_feature (606)..(606): n is a, c, g, or t
  misc_feature (708)..(708): n is a, c, g, or t
  misc_feature (1119)..(1119): n is a, c, g, or t
  misc_feature (1664)..(1664): n is a, c, g, or t
  misc_feature (1829)..(1829): n is a, c, g, or t
  misc_feature (1985)..(1985): n is a, c, g, or t
  misc_feature (1991)..(1991): n is a, c, g, or t
  misc_feature (2009)..(2009): n is a, c, g, or t
  misc_feature (2054)..(2054): n is a, c, g, or t
  misc_feature (2132)..(2132): n is a, c, g, or t
  misc_feature (2186)..(2186): n is a, c, g, or t
  misc_feature (2189)..(2189): n is a, c, g, or t
  misc_feature (2450)..(2450): n is a, c, g, or t
  misc_feature (2706)..(2706): n is a, c, g, or t
  misc_feature (2709)..(2709): n is a, c, g, or t
  misc_feature (2795)..(2795): n is a, c, g, or t
  misc_feature (2849)..(2849): n is a, c, g, or t
  misc_feature (2888)..(2888): n is a, c, g, or t
  misc_feature (2992)..(2992): n is a, c, g, or t
  misc_feature (3065)..(3065): n is a, c, g, or t
  misc_feature (3092)..(3092): n is a, c, g, or t
  misc_feature (3266)..(3266): n is a, c, g, or t
  misc_feature (3290)..(3290): n is a, c, g, or t
  misc_feature (3431)..(3431): n is a, c, g, or t
  misc_feature (3653)..(3653): n is a, c, g, or t
  misc_feature (3755)..(3755): n is a, c, g, or t
  misc_feature (3965)..(3965): n is a, c, g, or t
gcgatcaaggattcgacggtgtgcggtctctcgcgcgccaacgaccgcgacatcgggcgcgcggccgaggccctgaagggcgccgcccgngggcggatccacaccttcatcgcaacttcgccgcttcacatggaaaagaagctgcgcatgtcgcccgacgaggtncatgagcaggccaggctggccgtgcgcttcgcgcgcaaccagatcggcgacgtggagttcagcccggaagacggctatcgcagcgaccccgacttcctgtgccgcgtgctcgagaccgtgatcaacgagggcgccaccaccatcaacgtgcccgacaccgtcggctacgcnatccccgagctctacggcaacttcatcaagatgctgcgcgagcgcattcccaacagcgacaaggcgatctggtcggtgcactgccacaacgacctgggcatggccgtggcgaantcgctggccggcgtgaagatcggcggcgcgcgccaggtggagtgcaccatcaacggcctgggcgagcgcgcgggcaactgctcgctcgaagaggtcgtgatggctgtgaagacccgcaaggactacttcggtctcgacctgcgcatcgacacgcancacatcgtggccgcgagccgcatggtcagccagaccaccggtttcgtggtgcagcccaacaaggcggtggtgggggccaatgccttcgcgcacgcttcgggnatccaccaggacggtgtgctcaaggcgcgcgacacctacgaaatcatgcgcgccgaggacgtgggctggacggccaacaagatcgtcctgggcaagctcagcggtcgcaacgccttcaagcagcgcctgcaggagctgggcgtggccatggacagcgagggcgagatcaacgccgccttcctgcgcttcaaggagctggccgaccggaagtcggagattttcgacgaggacattcttgcgctcgtcagcgccgaagaggtgtcgaacgttggtgagcagtttgctttcgtctctctctcccagcacagcgaaaccggcgagcgcccccaggcgaaaatcgtgttcaccgtccagggcaaggaagtcaccggcgaatccgacggaaatggcccggttgatgcttccctgaangccatcgagtcgcacgtcaagagcggtgccgaaatggttctttactctgtaaatgccatcagcggctcgacggaaagccagggagaagttacagtccggttacaaaacgcagggcgggtggtcaacggtgtgggtgcagatccggacatcgttgtcgcttcggctaaggcttatttgagtgcgctcaacaagttacagagccaagctgagagagttgcggcacaaggttaggttttcgggcgatccttgatattcgaatgaagaagaggatgcaagtaactgatattgcgtgtcttttttgatttcgatacactgcggtcctcgtttttgccgctggagattttttaatgcctgaagcccgcctacgccgagtttccagccagcggttcctgcccgctttcaaagccatcgccgtcgcgctctgcgccacggcgtttttgctgcctggcgcccaggccgcgaagaaggaaaagcccgccgccgccaagaccgccgtcgcctccaagaaggcgaaggggccggtgccggtcgaagtcaagcgcaangccgcttcctccaagaccgccactgtcgccaagcgcggcggccgtgccgaaaaggccgaacgtgccgagaaggtggttcgcggcggccgcaacgtcgtcgccaccatccacaagaagaacggcaagaccgtggtggccgtgcagcgccgctcggtggttcgcgtngtcgaggcgcccgcgcgccagtccttcggccagatggccgggctgcatggaaccgaagatgcgctcgacctgaagtcgagcgtcgccctggtcatcgaccaggacacccacgaagtgctgttcagcaagaacgaccacgccgtgctgccgatcgcntcgctnaccaagctcatgaccggnctgctcatcagcgaggcccatctgccgaacgacgaactcatcacnatcacccaggacgacgtcgacaccgagaagcgcagcagctcgcgcctgacggtaggcaccacgctctcgcgcggcganctgctgcacctggcgctgatgtcgagcgaaaaccgcgccgcgcacgcgctgggncgnacctacccgggtggcctgacgaccttcgtgagcatcatgaacgccaaggccaagatgctcggcatgaaggacacgcgctacgtggagcccacgggcctctcgagccgcaaccagtcgagcgcgcaagacctggcgctgctggtcaatgccgcctatgccgatgccacggtgcgttcgctgtccacctcgcctgaataccaggtcgaagtcggcaaccgagtgctgcagttcaacaccaccaaccgcctcgtgaagagcccngactgggaaatcggcgtgcagaagaccggctacatctccgaagcgggccagtgcctcgtgatgcaggcgcgggtggcgggccgcaagctgatcatggtgttcctggattcggccggcaagttcagccgtatcgccgatgcggagcgcgtccgccgctgggtggaagccacgcactcggtgggctcgccggcggcttcgtcgcgcaatgctgcttaccaggtggctggctgatcagccgatcgggcaagtcccggcnctncacctccaacgaaaaacaggccctctcggggcctgttttgcttgggggtggctgtttggcccgcttgtcagacgctggccgatggngcagacccccccgagggtgacggcgttgccggcatgccttccttgaaccccagngcacccgagatttcgtttgccgtcgcctgcagcttgggnagccagccctcgtccagccggtcggccggcgcggagatcgacagccccgccaccagcttgccctggtcgtcgtagatgcctgcggccatgcagcgcacacccanctccagttcttcgttgtcgcgggcaatgccgtattggcgcgccttcgacaactcgcgctccagcgccggcagntgggtgatgctgttgcgcgtgtggccngccaggccggtgcgggtggcgtagctgcgcacccgttgcgggtcatcggccgccaggaacagcttgccggtcgaagtcaggtgcagcgcggcgcggccgccgatggcacgcaccacctgcatgcccgagcgctcgctgtaggagcgctcgatgtacacgatctcgtcgccctgncgcatgctgaggttgacgggctgntgcgtcagcttgtgcagctcgcgcatcgggcccagggccgcgtcgcgcacgttgagccggcccttgaccaggttgcccagctccagcaggcgcatgccgagccggtagctgccggcctcggggcggtcgacgaaacggccnacggccaggtcgttgaggatgcggtgcgtggtcgacgggtggagccccgtcttttcgctgatctccttcagcgaaatggcgtcctcgcgagatgccaggacgtcgatcagcgcaaacatgcgctcgatcacctggatcacgggaacggcgggaatgtcggattggttttttctcatggcgctctgcggtgatgaccgagcgccattttaccttgtgaaatcncttggcggctgccagcggccatccaacaacacttcatgaggggagaagcgcgccttgtagttcatcttggggctgtgctcgatccagtagcccaggtagacntgcggcagcccgagcttgcgggcctgctcgatctgccatagcacgctgtaggtgccgtagccggcgctcgaatcgggctcgtagaaggtgtagacggccgagatgccgtcgttgagcacatcgaggatcgacaccatcctgagcgctcccgcgctgccgtcgggctgggtctcgcggaattccaccagccgcgagttgacgcggctttgnagcaggaactgggtgtactggtcgatgctgtcgtg

SEQ ID NO: 323 - DNA, 4000 bp, Escherichia coli
  misc_feature (1)..(3): n is a, c, g, or t
  misc_feature (5)..(6): n is a, c, g, or t
  misc_feature (8)..(24): n is a, c, g, or t
  misc_feature (26)..(34): n is a, c, g, or t
  misc_feature (36)..(41): n is a, c, g, or t
  misc_feature (43)..(44): n is a, c, g, or t
  misc_feature (46)..(69): n is a, c, g, or t
  misc_feature (71)..(80): n is a, c, g, or t
  misc_feature (84)..(84): n is a, c, g, or t
  misc_feature (86)..(97): n is a, c, g, or t
  misc_feature (99)..(104): n is a, c, g, or t
  misc_feature (106)..(114): n is a, c, g, or t
  misc_feature (116)..(119): n is a, c, g, or t
  misc_feature (121)..(125): n is a, c, g, or t
  misc_feature (127)..(129): n is a, c, g, or t
  misc_feature (131)..(133): n is a, c, g, or t
  misc_feature (135)..(142): n is a, c, g, or t
  misc_feature (144)..(144): n is a, c, g, or t
  misc_feature (150)..(150): n is a, c, g, or t
  misc_feature (152)..(153): n is a, c, g, or t
  misc_feature (155)..(156): n is a, c, g, or t
  misc_feature (158)..(162): n is a, c, g, or t
  misc_feature (164)..(171): n is a, c, g, or t
  misc_feature (174)..(174): n is a, c, g, or t
  misc_feature (176)..(181): n is a, c, g, or t
  misc_feature (185)..(185): n is a, c, g, or t
  misc_feature (187)..(193): n is a, c, g, or t
  misc_feature (195)..(203): n is a, c, g, or t
  misc_feature (207)..(213): n is a, c, g, or t
  misc_feature (215)..(220): n is a, c, g, or t
  misc_feature (222)..(229): n is a, c, g, or t
  misc_feature (233)..(233): n is a, c, g, or t
  misc_feature (237)..(237): n is a, c, g, or t
  misc_feature (242)..(244): n is a, c, g, or t
  misc_feature (247)..(249): n is a, c, g, or t
  misc_feature (251)..(251): n is a, c, g, or t
  misc_feature (254)..(258): n is a, c, g, or t
  misc_feature (260)..(262): n is a, c, g, or t
  misc_feature (264)..(264): n is a, c, g, or t
  misc_feature (266)..(271): n is a, c, g, or t
  misc_feature (273)..(274): n is a, c, g, or t
  misc_feature (276)..(276): n is a, c, g, or t
  misc_feature (278)..(279): n is a, c, g, or t
  misc_feature (281)..(282): n is a, c, g, or t
  misc_feature (286)..(286): n is a, c, g, or t
  misc_feature (288)..(291): n is a, c, g, or t
  misc_feature (293)..(294): n is a, c, g, or t
  misc_feature (298)..(299): n is a, c, g, or t
  misc_feature (301)..(303): n is a, c, g, or t
  misc_feature (305)..(309): n is a, c, g, or t
  misc_feature (311)..(312): n is a, c, g, or t
  misc_feature (314)..(314): n is a, c, g, or t
  misc_feature (316)..(317): n is a, c, g, or t
  misc_feature (319)..(328): n is a, c, g, or t
  misc_feature (331)..(333): n is a, c, g, or t
  misc_feature (335)..(337): n is a, c, g, or t
  misc_feature (339)..(349): n is a, c, g, or t
  misc_feature (351)..(361): n is a, c, g, or t
  misc_feature (363)..(368): n is a, c, g, or t
  misc_feature (370)..(371): n is a, c, g, or t
  misc_feature (373)..(374): n is a, c, g, or t
  misc_feature (376)..(385): n is a, c, g, or t
  misc_feature (387)..(387): n is a, c, g, or t
  misc_feature (389)..(395): n is a, c, g, or t
  misc_feature (397)..(398): n is a, c, g, or t
  misc_feature (400)..(404): n is a, c, g, or t
  misc_feature (406)..(409): n is a, c, g, or t
  misc_feature (411)..(411): n is a, c, g, or t
  misc_feature (413)..(415): n is a, c, g, or t
  misc_feature (417)..(417): n is a, c, g, or t
  misc_feature (420)..(426): n is a, c, g, or t
  misc_feature (428)..(432): n is a, c, g, or t
  misc_feature (436)..(441): n is a, c, g, or t
  misc_feature (443)..(443): n is a, c, g, or t
  misc_feature (445)..(445): n is a, c, g, or t
  misc_feature (447)..(449): n is a, c, g, or t
  misc_feature (451)..(453): n is a, c, g, or t
  misc_feature (456)..(461): n is a, c, g, or t
  misc_feature (463)..(480): n is a, c, g, or t
  misc_feature (482)..(482): n is a, c, g, or t
  misc_feature (484)..(489): n is a, c, g, or t
  misc_feature (491)..(493): n is a, c, g, or t
  misc_feature (495)..(497): n is a, c, g, or t
  misc_feature (499)..(502): n is a, c, g, or t
  misc_feature (504)..(507): n is a, c, g, or t
  misc_feature (509)..(527): n is a, c, g, or t
  misc_feature (529)..(537): n is a, c, g, or t
  misc_feature (539)..(545): n is a, c, g, or t
  misc_feature (547)..(547): n is a, c, g, or t
  misc_feature (549)..(549): n is a, c, g, or t
  misc_feature (551)..(562): n is a, c, g, or t
  misc_feature (564)..(565): n is a, c, g, or t
  misc_feature (567)..(571): n is a, c, g, or t
  misc_feature (573)..(581): n is a, c, g, or t
  misc_feature (583)..(597): n is a, c, g, or t
  misc_feature (599)..(599): n is a, c, g, or t
  misc_feature (601)..(618): n is a, c, g, or t
  misc_feature (620)..(621): n is a, c, g, or t
  misc_feature (623)..(623): n is a, c, g, or t
  misc_feature (625)..(644): n is a, c, g, or t
  misc_feature (646)..(648): n is a, c, g, or t
  misc_feature (650)..(651): n is a, c, g, or t
  misc_feature (653)..(656): n is a, c, g, or t
  misc_feature (658)..(668): n is a, c, g, or t
  misc_feature (670)..(675): n is a, c, g, or t
  misc_feature (677)..(683): n is a, c, g, or t
  misc_feature (685)..(709): n is a, c, g, or t
  misc_feature (711)..(719): n is a, c, g, or t
  misc_feature (721)..(729): n is a, c, g, or t
  misc_feature (732)..(735): n is a, c, g, or t
  misc_feature (737)..(743): n is a, c, g, or t
  misc_feature (745)..(748): n is a, c, g, or t
  misc_feature (750)..(756): n is a, c, g, or t
  misc_feature (758)..(765): n is a, c, g, or t
  misc_feature (767)..(767): n is a, c, g, or t
  misc_feature (769)..(772): n is a, c, g, or t
  misc_feature (774)..(776): n is a, c, g, or t
  misc_feature (778)..(781): n is a, c, g, or t
  misc_feature (783)..(783): n is a, c, g, or t
  misc_feature (787)..(790): n is a, c, g, or t
  misc_feature (792)..(793): n is a, c, g, or t
  misc_feature (795)..(801): n is a, c, g, or t
  misc_feature (803)..(817): n is a, c, g, or t
  misc_feature (819)..(824): n is a, c, g, or t
  misc_feature (827)..(831): n is a, c, g, or t
  misc_feature (833)..(838): n is a, c, g, or t
  misc_feature (840)..(845): n is a, c, g, or t
  misc_feature (848)..(848): n is a, c, g, or t
  misc_feature (851)..(855): n is a, c, g, or t
  misc_feature (857)..(877): n is a, c, g, or t
  misc_feature (879)..(897): n is a, c, g, or t
  misc_feature (899)..(906): n is a, c, g, or t
  misc_feature (908)..(910): n is a, c, g, or t
  misc_feature (912)..(924): n is a, c, g, or t
  misc_feature (926)..(932): n is a, c, g, or t
  misc_feature (934)..(952): n is a, c, g, or t
  misc_feature (954)..(996): n is a, c, g, or t
  misc_feature (999)..(1000): n is a, c, g, or t
  misc_feature (1002)..(1002): n is a, c, g, or t
  misc_feature (1004)..(1010): n is a, c, g, or t
  misc_feature (1013)..(1021): n is a, c, g, or t
  misc_feature (1023)..(1028): n is a, c, g, or t
  misc_feature (1030)..(1033): n is a, c, g, or t
  misc_feature (1035)..(1037): n is a, c, g, or t
  misc_feature (1040)..(1047): n is a, c, g, or t
  misc_feature (1049)..(1055): n is a, c, g, or t
  misc_feature (1060)..(1065): n is a, c, g, or t
  misc_feature (1068)..(1068): n is a, c, g, or t
  misc_feature (1070)..(1072): n is a, c, g, or t
  misc_feature (1075)..(1075): n is a, c, g, or t
  misc_feature (1077)..(1077): n is a, c, g, or t
  misc_feature (1079)..(1080): n is a, c, g, or t
  misc_feature (1083)..(1084): n is a, c, g, or t
  misc_feature (1086)..(1086): n is a, c, g, or t
  misc_feature (1089)..(1089): n is a, c, g, or t
  misc_feature (1092)..(1093): n is a, c, g, or t
  misc_feature (1095)..(1096): n is a, c, g, or t
  misc_feature (1100)..(1101): n is a, c, g, or t
  misc_feature (1103)..(1103): n is a, c, g, or t
  misc_feature (1105)..(1107): n is a, c, g, or t
  misc_feature (1112)..(1113): n is a, c, g, or t
  misc_feature (1284)..(1284): n is a, c, g, or t
  misc_feature (1288)..(1290): n is a, c, g, or t
  misc_feature (1300)..(1300): n is a, c, g, or t
  misc_feature (1308)..(1309): n is a, c, g, or t
  misc_feature (1313)..(1315): n is a, c, g, or t
  misc_feature (1983)..(1983): n is a, c, g, or t
  misc_feature (1997)..(1997): n is a, c, g, or t
  misc_feature (2486)..(2486): n is a, c, g, or t
  misc_feature (2501)..(2501): n is a, c, g, or t
  misc_feature (2510)..(2510): n is a, c, g, or t
  misc_feature (2529)..(2529): n is a, c, g, or t
  misc_feature (2532)..(2532): n is a, c, g, or t
  misc_feature (2680)..(2680): n is a, c, g, or t
  misc_feature (2781)..(2781): n is a, c, g, or t
  misc_feature (2976)..(2976): n is a, c, g, or t
  misc_feature (2982)..(2982): n is a, c, g, or t
  misc_feature (3057)..(3060): n is a, c, g, or t
  misc_feature (3062)..(3062): n is a, c, g, or t
  misc_feature (3064)..(3064): n is a, c, g, or t
  misc_feature (3068)..(3068): n is a, c, g, or t
  misc_feature (3070)..(3070): n is a, c, g, or t
  misc_feature (3072)..(3073): n is a, c, g, or t
  misc_feature (3076)..(3077): n is a, c, g, or t
  misc_feature (3079)..(3085): n is a, c, g, or t
  misc_feature (3087)..(3087): n is a, c, g, or t
  misc_feature (3089)..(3089): n is a, c, g, or t
  misc_feature (3092)..(3102): n is a, c, g, or t
  misc_feature (3104)..(3117): n is a, c, g, or t
  misc_feature (3119)..(3127): n is a, c, g, or t
  misc_feature (3129)..(3133): n is a, c, g, or t
  misc_feature (3135)..(3142): n is a, c, g, or t
  misc_feature (3144)..(3147): n is a, c, g, or t
  misc_feature (3149)..(3149): n is a, c, g, or t
  misc_feature (3151)..(3151): n is a, c, g, or t
  misc_feature (3153)..(3153): n is a, c, g, or t
  misc_feature (3155)..(3162): n is a, c, g, or t
  misc_feature (3164)..(3166): n is a, c, g, or t
  misc_feature (3168)..(3171): n is a, c, g, or t
  misc_feature (3173)..(3175): n is a, c, g, or t
  misc_feature (3178)..(3181): n is a, c, g, or t
  misc_feature (3183)..(3184): n is a, c, g, or t
  misc_feature (3186)..(3187): n is a, c, g, or t
  misc_feature (3189)..(3193): n is a, c, g, or t
  misc_feature (3195)..(3195): n is a, c, g, or t
  misc_feature (3197)..(3198): n is a, c, g, or t
  misc_feature (3200)..(3200): n is a, c, g, or t
  misc_feature (3202)..(3213): n is a, c, g, or t
  misc_feature (3215)..(3224): n is a, c, g, or t
  misc_feature (3226)..(3226): n is a, c, g, or t
  misc_feature (3228)..(3228): n is a, c, g, or t
  misc_feature (3230)..(3230): n is a, c, g, or t
  misc_feature (3232)..(3237): n is a, c, g, or t
  misc_feature (3239)..(3244): n is a, c, g, or t
  misc_feature (3246)..(3253): n is a, c, g, or t
  misc_feature (3256)..(3260): n is a, c, g, or t
  misc_feature (3262)..(3262): n is a, c, g, or t
  misc_feature (3264)..(3265): n is a, c, g, or t
  misc_feature (3268)..(3269): n is a, c, g, or t
  misc_feature (3271)..(3271): n is a, c, g, or t
  misc_feature (3273)..(3273): n is a, c, g, or t
  misc_feature (3276)..(3300): n is a, c, g, or t
  misc_feature (3304)..(3304): n is a, c, g, or t
  misc_feature (3306)..(3306): n is a, c, g, or t
  misc_feature (3308)..(3309): n is a, c, g, or t
  misc_feature (3311)..(3313): n is a, c, g, or t
  misc_feature (3315)..(3321): n is a, c, g, or t
  misc_feature (3323)..(3323): n is a, c, g, or t
  misc_feature (3325)..(3326): n is a, c, g, or t
  misc_feature (3328)..(3332): n is a, c, g, or t
  misc_feature (3335)..(3335): n is a, c, g, or t
  misc_feature (3337)..(3340): n is a, c, g, or t
  misc_feature (3342)..(3345): n is a, c, g, or t
  misc_feature (3348)..(3351): n is a, c, g, or t
  misc_feature (3354)..(3372): n is a, c, g, or t
  misc_feature (3375)..(3375): n is a, c, g, or t
  misc_feature (3377)..(3377): n is a, c, g, or t
  misc_feature (3379)..(3380): n is a, c, g, or t
  misc_feature (3384)..(3387): n is a, c, g, or t
  misc_feature (3390)..(3390): n is a, c, g, or t
  misc_feature (3393)..(3399): n is a, c, g, or t
  misc_feature (3401)..(3406): n is a, c, g, or t
  misc_feature (3408)..(3410): n is a, c, g, or t
  misc_feature (3412)..(3412): n is a, c, g, or t
  misc_feature (3414)..(3418): n is a, c, g, or t
  misc_feature (3421)..(3422): n is a, c, g, or t
  misc_feature (3425)..(3426): n is a, c, g, or t
  misc_feature (3428)..(3429): n is a, c, g, or t
  misc_feature (3431)..(3431): n is a, c, g, or t
  misc_feature (3433)..(3433): n is a, c, g, or t
  misc_feature (3435)..(3435): n is a, c, g, or t
  misc_feature (3437)..(3443): n is a, c, g, or t
  misc_feature (3447)..(3450): n is a, c, g, or t
  misc_feature (3452)..(3452): n is a, c, g, or t
  misc_feature (3454)..(3455): n is a, c, g, or t
  misc_feature (3457)..(3457): n is a, c, g, or t
  misc_feature (3459)..(3459): n is a, c, g, or t
  misc_feature (3461)..(3462): n is a, c, g, or t
  misc_feature (3464)..(3467): n is a, c, g, or t
  misc_feature (3469)..(3469): n is a, c, g, or t
  misc_feature (3471)..(3473): n is a, c, g, or t
  misc_feature (3475)..(3475): n is a, c, g, or t
  misc_feature (3477)..(3484): n is a, c, g, or t
  misc_feature (3486)..(3486): n is a, c, g, or t
  misc_feature (3488)..(3488): n is a, c, g, or t
  misc_feature (3491)..(3497): n is a, c, g, or t
  misc_feature (3499)..(3499): n is a, c, g, or t
  misc_feature (3501)..(3503): n is a, c, g, or t
  misc_feature (3505)..(3508): n is a, c, g, or t
  misc_feature (3511)..(3513): n is a, c, g, or t
  misc_feature (3515)..(3523): n is a, c, g, or t
  misc_feature (3526)..(3530): n is a, c, g, or t
  misc_feature (3534)..(3540): n is a, c, g, or t
  misc_feature (3542)..(3549): n is a, c, g, or t
  misc_feature (3551)..(3551): n is a, c, g, or t
  misc_feature (3553)..(3558): n is a, c, g, or t
  misc_feature (3560)..(3564): n is a, c, g, or t
  misc_feature (3567)..(3567): n is a, c, g, or t
  misc_feature (3569)..(3573): n is a, c, g, or t
  misc_feature (3576)..(3577): n is a, c, g, or t
  misc_feature (3579)..(3579): n is a, c, g, or t
  misc_feature (3581)..(3581): n is a, c, g, or t
  misc_feature (3585)..(3585): n is a, c, g, or t
  misc_feature (3589)..(3593): n is a, c, g, or t
  misc_feature (3595)..(3610): n is a, c, g, or t
  misc_feature (3612)..(3614): n is a, c, g, or t
  misc_feature (3616)..(3620): n is a, c, g, or t
  misc_feature (3622)..(3622): n is a, c, g, or t
  misc_feature (3624)..(3624): n is a, c, g, or t
  misc_feature (3626)..(3629): n is a, c, g, or t
  misc_feature (3632)..(3636): n is a, c, g, or t
  misc_feature (3638)..(3644): n is a, c, g, or t
  misc_feature (3646)..(3650): n is a, c, g, or t
  misc_feature (3652)..(3656): n is a, c, g, or t
  misc_feature (3658)..(3668): n is a, c, g, or t
  misc_feature (3671)..(3682): n is a, c, g, or t
  misc_feature (3684)..(3684): n is a, c, g, or t
  misc_feature (3686)..(3690): n is a, c, g, or t
  misc_feature (3692)..(3694): n is a, c, g, or t
  misc_feature (3696)..(3696): n is a, c, g, or t
  misc_feature (3698)..(3713): n is a, c, g, or t
  misc_feature (3716)..(3719): n is a, c, g, or t
  misc_feature (3721)..(3721): n is a, c, g, or t
  misc_feature (3723)..(3724): n is a, c, g, or t
  misc_feature (3726)..(3735): n is a, c, g, or t
  misc_feature (3737)..(3737): n is a, c, g, or t
  misc_feature (3739)..(3741): n is a, c, g, or t
  misc_feature (3743)..(3743): n is a, c, g, or t
  misc_feature (3747)..(3750): n is a, c, g, or t
  misc_feature (3753)..(3756): n is a, c, g, or t
  misc_feature (3758)..(3759): n is a, c, g, or t
  misc_feature (3761)..(3764): n is a, c, g, or t
  misc_feature (3766)..(3783): n is a, c, g, or t
  misc_feature (3785)..(3791): n is a, c, g, or t
  misc_feature (3793)..(3794): n is a, c, g, or t
  misc_feature (3796)..(3804): n is a, c, g, or t
  misc_feature (3807)..(3820): n is a, c, g, or t
  misc_feature (3822)..(3825): n is a, c, g, or t
  misc_feature (3828)..(3828): n is a, c, g, or t
  misc_feature (3830)..(3834): n is a, c, g, or t
  misc_feature (3837)..(3838): n is a, c, g, or t
  misc_feature (3840)..(3841): n is a, c, g, or t
  misc_feature (3843)..(3849): n is a, c, g, or t
  misc_feature (3851)..(3862): n is a, c, g, or t
  misc_feature (3864)..(3867): n is a, c, g, or t
  misc_feature (3869)..(3872): n is a, c, g, or t
  misc_feature (3874)..(3875): n is a, c, g, or t
  misc_feature (3877)..(3878): n is a, c, g, or t
  misc_feature (3880)..(3893): n is a, c, g, or t
  misc_feature (3895)..(3896): n is a, c, g, or t
  misc_feature (3898)..(3900): n is a, c, g, or t
  misc_feature (3902)..(3902): n is a, c, g, or t
  misc_feature (3905)..(3909): n is a, c, g, or t
  misc_feature (3911)..(3916): n is a, c, g, or t
  misc_feature (3918)..(3919): n is a, c, g, or t
  misc_feature (3921)..(3923): n is a, c, g, or t
  misc_feature (3925)..(3926): n is a, c, g, or t
  misc_feature (3928)..(3929): n is a, c, g, or t
  misc_feature (3931)..(3932): n is a, c, g, or t
  misc_feature (3934)..(3945): n is a, c, g, or t
  misc_feature (3947)..(3949): n is a, c, g, or t
  misc_feature (3953)..(3954): n is a, c, g, or t
  misc_feature (3956)..(3960): n is a, c, g, or t
  misc_feature (3962)..(3965): n is a, c, g, or t
  misc_feature (3967)..(3973): n is a, c, g, or t
  misc_feature (3976)..(3980): n is a, c, g, or t
  misc_feature (3984)..(3985): n is a, c, g, or t
  misc_feature (3988)..(3990): n is a, c, g, or t
  misc_feature (3993)..(3998): n is a, c, g, or t
  misc_feature (4000)..(4000): n is a, c, g, or t
nnntnnannnnnnnnnnnnnnnnnannnnnnnnnannnnnnannannnnnnnnnnnnnnnnnnnnnnnnannnnnnnnnnatgnannnnnnnnnnnntnnnnnntnnnnnnnnntnnnntnnnnnannnannnannnnnnnnantttatnannannannnnnannnnnnnnatnannnnnnaaanannnnnnntnnnnnnnnnatannnnnnntnnnnnnannnnnnnntttnttangatannnttnnntntannnnntnnntngnnnnnntnntntnntnntttntnnnntnnttannannnannnnnannantnnannnnnnnnnnttnnntnnnannnnnnnnnnnannnnnnnnnnntnnnnnnanntnntnnnnnnnnnnantnnnnnnnanntnnnnntnnnnanannntnttnnnnnnntnnnnnaatnnnnnntntntnnnannntannnnnntnnnnnnnnnnnnnnnnnntntnnnnnntnnntnnntnnnnannnnannnnnnnnnnnnnnnnnnnannnnnnnnntnnnnnnnananannnnnnnnnnnntnnannnnnannnnnnnnntnnnnnnnnnnnnnnnanannnnnnnnnnnnnnnnnnanntnannnnnnnnnnnnnnnnnnnnannntnntnnnntnnnnnnnnnnnannnnnntnnnnnnnannnnnnnnnnnnnnnnnnnnnnnnnannnnnnnnnannnnnnnnnaannnnannnnnnnannnnannnnnnntnnnnnnnnantnnnnannntnnnnanaaannnnannannnnnnnannnnnnnnnnnnnnntnnnnnnttnnnnnannnnnnannnnnnttnttnnnnntnnnnnnnnnnnnnnnnnnnnnannnnnnnnnnnnnnnnnnnannnnnnnnannnannnnnnnnnnnnnannnnnnnannnnnnnnnnnnnnnnnnnannnnnnnnnnnnnnnnnnnnnnnnnnnnnnnnnnnnnnnnnnnaannanannnnnnnaannnnnnnnnannnnnntnnnnannnaannnnnnnnannnnnnnaaaannnnnnaanannnaananannaannanaanaanntnnaaannanannnatgannaatgcaaatgtcgtataggactgaagcctatcgaatcagcataacatcgagcagaaactcagcggatcgcaatgtggcggttgctctcacgtgtacgttactctgttactgaagaaagtcgtttacaatcgattctagccattagtgttgtttcgactaaaaatgcatcgntgcnnncacaatctcntttcgatnntgannnagcaacaatacggtagcttcattcatatgttcacttgatcaacagtttgaacatatataaatgtgctgacgacaaccaatgtgccaaaaaatcattgagtctagatcggattccaacttagaggcgttcagttgtaagccgtcggatggtagcttcgcatcattgtcctttcgaacaaatacgtaaaccaaatgtccgaacgtacggttcctctcgtactaagtacgattcctatatcaatgacaaaatccaatgtagggtaaaactaacctgtctcacgacggtctaaacccagctcacgttccctattggtgggtgaacaatccaacactttgcgaagtctgcttcgcaatgataggaagagccgacatcgaaggatcaaaaagcgacgtcgctatgaacgcttggccgccacaagccagttatccctgtggtaacttttctgtcacctcttgcaaaaaactcgttaaatcaaaaggatcgataggcccggatttctccgtctgtattcgtactgaaaatctaaatcaagctgacttatgcccttttactcaatgtgtggtttctgtccgcactgagtcaacttttggacacctacgttaacatttgatagatgtaccgccccagccaaactccccacctgtctctttccttgaagcagatcacgntgatacaagtatcnacgtttgtcactcaaacactggatataaaatccaatctctgtataaccaagtaagtaaagaaacaatgaaaataatggtgtttcattgacgtgttgccactcccatctacgctacacttttcaagtctctttacgaagacagattagagtcaagctcaacagggtcttctttccccgcattgaagtccaagcccgttcccttggctgtggtttcgctagatagtagacagggacagtgggaatctcgttaatccattcatgcgcgtcactaattagatgacgaggcatttggctaccagaagagagtcatagttactcccgccgtttacccgcgcttatttgaatttcttcacgttaacattcagagcactgggcagaaatcactttgcgtcaacaccaagttttccggccaatcgcaaagctctgttttaattagacagtcggattcccctagacgcagcgagttctaagtttgctattaaacgatgnccgaagtaatacganccgcaagcnaaccgcataccgtagcaanacnattccacagcaagacaagccactagtccgaacgatcagacacattgctgcatccgaaagctcagctccaatagcaagtctactgctttatcatcaagcccgaacaccctagcacttagagccaatcgttatcccgaagttgccgatcnattttgccgacttcccttgtgctaccttgttctaattgactagaggcttttcaccttggagacctgatgcggtttagagtacagataagtgcgaaattgantatctcgctcaaattttcaaggatcacaaatgatgcaccgaggaagtagcaagaacggctactctttaccttcatttgaaccctatctccagttgaactgattccagggtcgtctgatgaagtaacaaagaagagaaaactctttccaggaccacttgtgatgtatttgagcttgtttgtgttaccacatatgtntgacangaaatcaaacaatctccgacacttagtacaagaatattaacttgtttccctttcgatttgatggaatataaatannnnananaaanantnntcnntnnnnnnncncnttnnnnnnnnnnntnnnnnnnnnnnnnncnnnnnnnnnannnnntnnnnnnnnannnntntncncnnnnnnnntnnnannnntnnnttnnnnanntnntnnnnncncnnanannnnnnnnnnnnannnnnnnnnncncncncnnnnnntnnnnnncnnnnnnnncannnnnancnnccnncntnttnnnnnnnnnnnnnnnnnnnnnnnnngttntntnntnnnannnnnnnanannannnnngcncnnnngnnnnccnnnnttnnnnnnnnnnnnnnnnnnnggngngnngttnnnnacnccnnnnnnnannnnnncnnncntnnnnnccnnccnncnntntntntnnnnnnncacnnnntntnntntntnntnnnngngnnnancnnnnnnnntntnttnnnnnnntntnnntnnnncannncnnnnnnnnnttnnnnnaaannnnnnncnnnnnnnncncnnnnnntnnnnnttntnnnnnaannananaaanaaannnnntnnnnnnnnnnnnnnnntnnntnnnnngngngnnnnttnnnnncnnnnnnncnnnnnannnnntnnnnnnnnnnnaannnnnnnnnnnnantnnnnncnnncntnnnnnnnnnnnnnnnnggnnnnancnncnnnnnnnnnngntnnntntttnnnnccnnnntnnannnntnnnnnnnnnnnnnnnnnncnnnnnnncnncnnnnnnnnnccnnnnnnnnnnnnnncnnnnttntnnnnncannanntnnnnnnncnnnnnnnnnnnntnnnntnnnntnntnntnnnnnnnnnnnnnncnncnnnanaannnnncnnnnnngnntnnntnntnntnntnnnnnnnnnnnnannnaaannannnnnannnnannnnnnnaannnnntttnnttnnnttnnnnnnan

SEQ ID NO: 324 - DNA, 4000 bp, Escherichia coli
  misc_feature (1933)..(1933): n is a, c, g, or t
  misc_feature (1935)..(1936): n is a, c, g, or t
  misc_feature (1941)..(1942): n is a, c, g, or t
  misc_feature (1945)..(1945): n is a, c, g, or t
  misc_feature (1947)..(1947): n is a, c, g, or t
  misc_feature (1962)..(1963): n is a, c, g, or t
  misc_feature (1969)..(1969): n is a, c, g, or t
  misc_feature (1974)..(1974): n is a, c, g, or t
  misc_feature (1989)..(1990): n is a, c, g, or t
  misc_feature (1999)..(1999): n is a, c, g, or t
  misc_feature (2002)..(2002): n is a, c, g, or t
  misc_feature (2007)..(2007): n is a, c, g, or t
ttaatggcggatgagtttgtgaaaaacttaccctccgtaccgttctgcgtgaacttaatgagataccgaccttccccgtgttgtgttttcattccggggataaagtcgataacttctatttcgctgttcagaacgtccgtgatagacacctgttggcagttgaaaatcttgcggtcgtcctgctgcttgataccgagttcgctgaaacgctttgccatattactggatatttagggttgcacaatcgtcgtcgatttgacgtttgatagctgcccgctcggataaaaaggctttgtatgcagcgattttcggctgggcatcggtactcgatttagccccgtatatccccattgtcgcagcgttgtactcgttgataagtttctgctcgtaatccctcggccataaatggttgattacggcctcggtcagtttgtcgctcgttaccgtaccccacacgacaacctcctgacactcccatttcgttgtggtttcctccgtgtcagctccggcgggtatttcgacttctttaatgtcccaacggtaggtgtaagaaccgtccccgtttgcctcgtagatagagggctttttgtcatagattgccatagaaactcggtttaattatggttttcaataaatgtttggaattgctgtgttttgcccagccgagccaactgcacactccctgtttgtagtctttggcagataggttgggctgcttgttaagccgggcaacggcacggcaaaaattcttcttgatgctcttgcggattagcttgtgttcgtggtagaaaacgaacccgacgaaatccagcccccgcccgtgcttatcgctgcgatttttagcgatagggaatacctggtaatttgcctttatcgtcaaatgcaggttgtcacggagataggcatctatctgtgtgagtaaatcatgcaggaacgccttgtccttgtgcagaaaaaccatgtcgtcggcatacctgaaataatatttgacaccgacctcctcttttatccaatggtcaaagtatgcgaggaacaggttggcgaaatattgcgacaggtaattgccgatagggacaccggcggcactatctatgatttggtcgagtagagccagcgtgtccgggcatttgattttacggcgcacgatttgtttcagcacatcatggtcgatactcggatagaatttcttaacgtcgattttcaggcaatatcgggtgttctccacgtctttcaacgctttatctactttcagcatacacccgtttatacccctatttttgatgcaagaaaacgtgtccgtcgtgaacaccgaaacccatattggttcgagaatgttcattatagcgtgatgaacgattctgtcggggaaatacggcagccgatatatctcccgctctttggggtctttgatgataaatgtttcgtactttgatgttttgaacgtcttatttttgagtgcttcgtgcaaagcgagggtattggcttccctgtttttgtcgtggcgacgtaccccgtaagaacgcagttttccccgtctcgctttttggtcggcgagttggaggttttctactgcgataatcctttcgtataaattccctatccgtttcattgctttgcttttcatacttggagccgtcggtttccctaccagcacctttttgtggttcgtgtttttttgccaagaggcacggtcgtcgttctatattttgtttcttattaacctatgaaaatcagaggtgagagccgatgttcgcattcgtattcgagggggtgttattcgaattcgcatagctgaagcctgcattcgcaccgttattcgcattaccgctgaacaggacaccacgaagaacgaccaaccttttctatcttacgtcataactatctattattaaattatttacaaattgggtataaagcaaaggcgagagccgangnncgcanncgnantcgagggggcgttanncgaatncgcanagccgaagcccgcanncgcaccgtnatncgcanaaccgccgaacaggacaccacgaagaactgtacccgatgcaggaatgttggtatagtggtagtccgcccaataggttgttgaaccgccgcccaccaccgctggcatgatgtcgccgaactcaccgaagacaagttctttgacgtatgcttcggttcgggcttcttctcctcgcagagtgtagccgttgtagttgctgtcgttgtagtttgtggggtcgtcagcaacatatacttttgatgtcccgccgtcagcagccgaggcgatttgaatattgatgccgtccgtccatttccaaatgtgtccgaacggattttcaatacctcggtagcgaggaacatataccgttccgtgtgtacctccctcggcgttctgcatgacgtatgcaacctcgcccgaagcgttgccgagttcatcggtataaccgcaagggacaaacggataataaccgttaaatccgttccaatccggggtgttggttactccgttgccgaggccgccttgtgcaaagccgtttgtgtccttttgggcgttgaatgccgtctgacagttacggttggcgtactccacatagtaaagccaaaatacggccttgtatgcgttgtagtcaaggcaattccattcgttcgtcgccgatgcgttacggaggcgggctgcattgcggaaagccgtgcggctcttgactgtaaccggacgcccaagaacagaacgatacgttccgtcccaatccgcctgattgtttccacccctgtaatctgttcccatattgacgacagaacagagtttgcccgtgctgcgttccatagcggcctcatacgccgaaatatacattttgggaacggcgtgatagcccggcaacgggtattccgatagtttgcaccggcgtattgttccctctgtctcgaacttgcgataatgtgctgggatttcgaccatgacctgacctttggagccgtcgagggtatgcgccctccaatttgtcgggttcaggtactcaacgaccgttccgttatcgctcaacaagcaaccccgcatccggttttgaatggggaggcttttatggagagcgatactgccgatacgggtacacgtcggcgtcgatacggtcgtgtcccattggatgccgtaggcgcattgatcttcgaggtatgggagcatggttgcgagtttagcttgtttgctctctccgtccgtgtccataacctctacgatgagttcgagaggatttacctccccgatatgggggagttcattcaaccgcttcccgttatcgaaagctgtgataatttgaagcacttttgcttcctgttcaggtgttaatgccataattgtcttgttattaagttaatctaaaactaccgttgcccatgagccgcaatgagtttgattttactcgtcgaagttccggttccgccaccgtaatttgtatggttcggtaaattgacgtattctcggtcgggataacgtggattttgctgatacctgtccgattgactgtgaggcttccgtcgggttgaaccgaaacggcattatcatcgccgagaaacagcacattgcgtcccgtgttcgtcgggagcagttcgtatgttatacgtctcggcacggtgtttcggaatgttatgcgaggcggatagtcgaggttcatgcctgtcggaatcattttgtactgcccgacgagcgattcttccaattcctccaaccttacgattgtggctcgtgcttcctctgcggtctccccggcgagatttgcggcgttgtcggcggctgtggccttttggtctgcgagggcggctttggaattggcggtgttcgctgctgtcgttgctgccccggcagctttgtccgctgcatcggcttttgtgttcgcatttttggctgccgtgtctgctgctgttgctttatccgtagcatttttagcggctgtattggccgcctccgttgcggtattggcattttttgtggctgtttttgccgcttctgtcgccgtctctgcgg

SEQ ID NO: 325 - DNA, 4000 bp, Escherichia coli
  misc_feature (2)..(2): n is a, c, g, or t
  misc_feature (4)..(5): n is a, c, g, or t
  misc_feature (7)..(8): n is a, c, g, or t
  misc_feature (11)..(13): n is a, c, g, or t
  misc_feature (15)..(16): n is a, c, g, or t
  misc_feature (18)..(22): n is a, c, g, or t
  misc_feature (26)..(26): n is a, c, g, or t
  misc_feature (30)..(31): n is a, c, g, or t
  misc_feature (35)..(35): n is a, c, g, or t
  misc_feature (37)..(37): n is a, c, g, or t
  misc_feature (40)..(40): n is a, c, g, or t
  misc_feature (45)..(46): n is a, c, g, or t
  misc_feature (51)..(51): n is a, c, g, or t
  misc_feature (56)..(60): n is a, c, g, or t
  misc_feature (62)..(62): n is a, c, g, or t
  misc_feature (64)..(64): n is a, c, g, or t
  misc_feature (69)..(69): n is a, c, g, or t
  misc_feature (71)..(71): n is a, c, g, or t
  misc_feature (77)..(78): n is a, c, g, or t
  misc_feature (81)..(83): n is a, c, g, or t
  misc_feature (85)..(86): n is a, c, g, or t
  misc_feature (88)..(88): n is a, c, g, or t
  misc_feature (92)..(93): n is a, c, g, or t
  misc_feature (96)..(99): n is a, c, g, or t
  misc_feature (101)..(103): n is a, c, g, or t
  misc_feature (106)..(107): n is a, c, g, or t
  misc_feature (109)..(112): n is a, c, g, or t
  misc_feature (114)..(116): n is a, c, g, or t
  misc_feature (118)..(124): n is a, c, g, or t
  misc_feature (126)..(126): n is a, c, g, or t
  misc_feature (129)..(134): n is a, c, g, or t
  misc_feature (137)..(138): n is a, c, g, or t
  misc_feature (141)..(142): n is a, c, g, or t
  misc_feature (145)..(145): n is a, c, g, or t
  misc_feature (147)..(148): n is a, c, g, or t
  misc_feature (151)..(153): n is a, c, g, or t
  misc_feature (155)..(155): n is a, c, g, or t
  misc_feature (160)..(161): n is a, c, g, or t
  misc_feature (167)..(167): n is a, c, g, or t
  misc_feature (169)..(172): n is a, c, g, or t
  misc_feature (175)..(176): n is a, c, g, or t
  misc_feature (179)..(179): n is a, c, g, or t
  misc_feature (181)..(184): n is a, c, g, or t
  misc_feature (186)..(188): n is a, c, g, or t
  misc_feature (190)..(190): n is a, c, g, or t
  misc_feature (192)..(193): n is a, c, g, or t
  misc_feature (195)..(195): n is a, c, g, or t
  misc_feature (205)..(207): n is a, c, g, or t
  misc_feature (210)..(210): n is a, c, g, or t
  misc_feature (212)..(212): n is a, c, g, or t
  misc_feature (214)..(215): n is a, c, g, or t
  misc_feature (217)..(220): n is a, c, g, or t
  misc_feature (223)..(224): n is a, c, g, or t
  misc_feature (226)..(226): n is a, c, g, or t
  misc_feature (230)..(231): n is a, c, g, or t
  misc_feature (234)..(234): n is a, c, g, or t
  misc_feature (241)..(241): n is a, c, g, or t
  misc_feature (244)..(247): n is a, c, g, or t
  misc_feature (249)..(249): n is a, c, g, or t
  misc_feature (255)..(258): n is a, c, g, or t
  misc_feature (264)..(264): n is a, c, g, or t
  misc_feature (267)..(267): n is a, c, g, or t
  misc_feature (274)..(275): n is a, c, g, or t
  misc_feature (277)..(285): n is a, c, g, or t
  misc_feature (287)..(290): n is a, c, g, or t
  misc_feature (293)..(295): n is a, c, g, or t
  misc_feature (298)..(298): n is a, c, g, or t
  misc_feature (300)..(300): n is a, c, g, or t
  misc_feature (304)..(304): n is a, c, g, or t
  misc_feature (308)..(308): n is a, c, g, or t
  misc_feature (311)..(312): n is a, c, g, or t
  misc_feature (314)..(314): n is a, c, g, or t
  misc_feature (318)..(318): n is a, c, g, or t
  misc_feature (321)..(321): n is a, c, g, or t
  misc_feature (323)..(324): n is a, c, g, or t
  misc_feature (327)..(328): n is a, c, g, or t
  misc_feature (331)..(331): n is a, c, g, or t
  misc_feature (334)..(339): n is a, c, g, or t
  misc_feature (341)..(341): n is a, c, g, or t
  misc_feature (343)..(343): n is a, c, g, or t
  misc_feature (345)..(347): n is a, c, g, or t
  misc_feature (349)..(349): n is a, c, g, or t
  misc_feature (351)..(351): n is a, c, g, or t
  misc_feature (353)..(353): n is a, c, g, or t
  misc_feature (356)..(356): n is a, c, g, or t
  misc_feature (358)..(363): n is a, c, g, or t
  misc_feature (365)..(367): n is a, c, g, or t
  misc_feature (369)..(373): n is a, c, g, or t
  misc_feature (375)..(376): n is a, c, g, or t
  misc_feature (379)..(379): n is a, c, g, or t
  misc_feature (386)..(388): n is a, c, g, or t
  misc_feature (391)..(391): n is a, c, g, or t
  misc_feature (394)..(394): n is a, c, g, or t
  misc_feature (399)..(399): n is a, c, g, or t
  misc_feature (401)..(401): n is a, c, g, or t
  misc_feature (403)..(406): n is a, c, g, or t
  misc_feature (409)..(410): n is a, c, g, or t
  misc_feature (412)..(419): n is a, c, g, or t
  misc_feature (422)..(422): n is a, c, g, or t
  misc_feature (424)..(424): n is a, c, g, or t
  misc_feature (426)..(429): n is a, c, g, or t
  misc_feature (431)..(437): n is a, c, g, or t
  misc_feature (439)..(441): n is a, c, g, or t
  misc_feature (444)..(444): n is a, c, g, or t
  misc_feature (447)..(448): n is a, c, g, or t
  misc_feature (451)..(452): n is a, c, g, or t
  misc_feature (454)..(454): n is a, c, g, or t
  misc_feature (456)..(456): n is a, c, g, or t
  misc_feature (458)..(458): n is a, c, g, or t
  misc_feature (460)..(460): n is a, c, g, or t
  misc_feature (462)..(462): n is a, c, g, or t
  misc_feature (466)..(466): n is a, c, g, or t
  misc_feature (470)..(471): n is a, c, g, or t
  misc_feature (478)..(478): n is a, c, g, or t
  misc_feature (480)..(482): n is a, c, g, or t
  misc_feature (484)..(488): n is a, c, g, or t
  misc_feature (490)..(491): n is a, c, g, or t
  misc_feature (494)..(494): n is a, c, g, or t
  misc_feature (497)..(499): n is a, c, g, or t
  misc_feature (501)..(502): n is a, c, g, or t
  misc_feature (504)..(505): n is a, c, g, or t
  misc_feature (507)..(507): n is a, c, g, or t
  misc_feature (512)..(513): n is a, c, g, or t
  misc_feature (515)..(515): n is a, c, g, or t
  misc_feature (517)..(521): n is a, c, g, or t
  misc_feature (524)..(526): n is a, c, g, or t
  misc_feature (530)..(530): n is a, c, g, or t
  misc_feature (532)..(532): n is a, c, g, or t
  misc_feature (534)..(534): n is a, c, g, or t
  misc_feature (536)..(536): n is a, c, g, or t
  misc_feature (539)..(539): n is a, c, g, or t
  misc_feature (541)..(541): n is a, c, g, or t
  misc_feature (549)..(560): n is a, c, g, or t
  misc_feature (562)..(564): n is a, c, g, or t
  misc_feature (567)..(567): n is a, c, g, or t
  misc_feature (569)..(574): n is a, c, g, or t
  misc_feature (576)..(577): n is a, c, g, or t
  misc_feature (579)..(581): n is a, c, g, or t
  misc_feature (583)..(583): n is a, c, g, or t
  misc_feature (585)..(586): n is a, c, g, or t
  misc_feature (594)..(597): n is a, c, g, or t
  misc_feature (599)..(599): n is a, c, g, or t
  misc_feature (601)..(604): n is a, c, g, or t
  misc_feature (607)..(608): n is a, c, g, or t
  misc_feature (612)..(614): n is a, c, g, or t
  misc_feature (616)..(616): n is a, c, g, or t
  misc_feature (618)..(624): n is a, c, g, or t
  misc_feature (626)..(628): n is a, c, g, or t
  misc_feature (631)..(638): n is a, c, g, or t
  misc_feature (640)..(642): n is a, c, g, or t
  misc_feature (644)..(645): n is a, c, g, or t
  misc_feature (647)..(648): n is a, c, g, or t
  misc_feature (653)..(653): n is a, c, g, or t
  misc_feature (655)..(660): n is a, c, g, or t
  misc_feature (663)..(664): n is a, c, g, or t
  misc_feature (666)..(667): n is a, c, g, or t
  misc_feature (670)..(670): n is a, c, g, or t
  misc_feature (673)..(673): n is a, c, g, or t
  misc_feature (676)..(676): n is a, c, g, or t
  misc_feature (681)..(682): n is a, c, g, or t
  misc_feature (684)..(684): n is a, c, g, or t
  misc_feature (686)..(688): n is a, c, g, or t
  misc_feature (695)..(698): n is a, c, g, or t
  misc_feature (700)..(702): n is a, c, g, or t
  misc_feature (705)..(706): n is a, c, g, or t
  misc_feature (708)..(709): n is a, c, g, or t
  misc_feature (711)..(712): n is a, c, g, or t
  misc_feature (714)..(714): n is a, c, g, or t
  misc_feature (718)..(723): n is a, c, g, or t
  misc_feature (731)..(731): n is a, c, g, or t
  misc_feature (734)..(734): n is a, c, g, or t
  misc_feature (740)..(740): n is a, c, g, or t
  misc_feature (743)..(748): n is a, c, g, or t
  misc_feature (750)..(751): n is a, c, g, or t
  misc_feature (753)..(754): n is a, c, g, or t
  misc_feature (756)..(758): n is a, c, g, or t
  misc_feature (760)..(760): n is a, c, g, or t
  misc_feature (762)..(763): n is a, c, g, or t
  misc_feature (766)..(766): n is a, c, g, or t
  misc_feature (770)..(771): n is a, c, g, or t
  misc_feature (773)..(773): n is a, c, g, or t
  misc_feature (775)..(780): n is a, c, g, or t
  misc_feature (783)..(783): n is a, c, g, or t
  misc_feature (786)..(789): n is a, c, g, or t
  misc_feature (791)..(792): n is a, c, g, or t
  misc_feature (794)..(794): n is a, c, g, or t
  misc_feature (796)..(796): n is a, c, g, or t
  misc_feature (798)..(799): n is a, c, g, or t
  misc_feature (801)..(801): n is a, c, g, or t
  misc_feature (803)..(804): n is a, c, g, or t
  misc_feature (807)..(807): n is a, c, g, or t
  misc_feature (809)..(809): n is a, c, g, or t
  misc_feature (811)..(811): n is a, c, g, or t
  misc_feature (813)..(813): n is a, c, g, or t
  misc_feature (815)..(815): n is a, c, g, or t
  misc_feature (820)..(821): n is a, c, g, or t
  misc_feature (823)..(827): n is a, c, g, or t
  misc_feature (829)..(829): n is a, c, g, or t
  misc_feature (831)..(833): n is a, c, g, or t
  misc_feature (835)..(836): n is a, c, g, or t
  misc_feature (838)..(838): n is a, c, g, or t
  misc_feature (840)..(841): n is a, c, g, or t
  misc_feature (846)..(856): n is a, c, g, or t
  misc_feature (859)..(860): n is a, c, g, or t
  misc_feature (862)..(864): n is a, c, g, or t
  misc_feature (866)..(866): n is a, c, g, or t
  misc_feature (868)..(868): n is a, c, g, or t
  misc_feature (870)..(872): n is a, c, g, or t
  misc_feature (875)..(875): n is a, c, g, or t
  misc_feature (877)..(878): n is a, c, g, or t
  misc_feature (881)..(882): n is a, c, g, or t
  misc_feature (886)..(891): n is a, c, g, or t
  misc_feature (893)..(906): n is a, c, g, or t
  misc_feature (908)..(909): n is a, c, g, or t
  misc_feature (911)..(912): n is a, c, g, or t
  misc_feature (914)..(914): n is a, c, g, or t
  misc_feature (916)..(916): n is a, c, g, or t
  misc_feature (918)..(920): n is a, c, g, or t
  misc_feature (922)..(924): n is a, c, g, or t
  misc_feature (929)..(929): n is a, c, g, or t
  misc_feature (932)..(932): n is a, c, g, or t
  misc_feature (934)..(935): n is a, c, g, or t
  misc_feature (939)..(939): n is a, c, g, or t
  misc_feature (944)..(946): n is a, c, g, or t
  misc_feature (948)..(948): n is a, c, g, or t
  misc_feature (950)..(951): n is a, c, g, or t
  misc_feature (955)..(956): n is a, c, g, or t
  misc_feature (960)..(960): n is a, c, g, or t
  misc_feature (963)..(963): n is a, c, g, or t
  misc_feature (966)..(972): n is a, c, g, or t
  misc_feature (974)..(974): n is a, c, g, or t
  misc_feature (977)..(980): n is a, c, g, or t
  misc_feature (983)..(985): n is a, c, g, or t
  misc_feature (987)..(988): n is a, c, g, or t
  misc_feature (990)..(991): n is a, c, g, or t
  misc_feature (994)..(997): n is a, c, g, or t
  misc_feature (1000)..(1000): n is a, c, g, or t
  misc_feature (1002)..(1005): n is a, c, g, or t
  misc_feature (1007)..(1007): n is a, c, g, or t
  misc_feature (1009)..(1016): n is a, c, g, or t
  misc_feature (1018)..(1019): n is a, c, g, or t
  misc_feature (1021)..(1021): n is a, c, g, or t
  misc_feature (1023)..(1025): n is a, c, g, or t
  misc_feature (1027)..(1030): n is a, c, g, or t
  misc_feature (1032)..(1032): n is a, c, g, or t
  misc_feature (1034)..(1034): n is a, c, g, or t
  misc_feature (1039)..(1040): n is a, c, g, or t
  misc_feature (1042)..(1043): n is a, c, g, or t
  misc_feature (1045)..(1045): n is a, c, g, or t
  misc_feature (1047)..(1048): n is a, c, g, or t
  misc_feature (1050)..(1052): n is a, c, g, or t
  misc_feature (1054)..(1054): n is a, c, g, or t
  misc_feature (1056)..(1056): n is a, c, g, or t
  misc_feature (1058)..(1058): n is a, c, g, or t
  misc_feature (1060)..(1061): n is a, c, g, or t
  misc_feature (1063)..(1063): n is a, c, g, or t
  misc_feature (1066)..(1067): n is a, c, g, or t
  misc_feature (1069)..(1071): n is a, c, g, or t
  misc_feature (1076)..(1078): n is a, c, g, or t
  misc_feature (1083)..(1083): n is a, c, g, or t
  misc_feature (1087)..(1087): n is a, c, g, or t
  misc_feature (1089)..(1089): n is a, c, g, or t
  misc_feature (1091)..(1094): n is a, c, g, or t
  misc_feature (1098)..(1100): n is a, c, g, or t
  misc_feature (1103)..(1103): n is a, c, g, or t
  misc_feature (1105)..(1105): n is a, c, g, or t
  misc_feature (1107)..(1108): n is a, c, g, or t
  misc_feature (1111)..(1113): n is a, c, g, or t
  misc_feature (1116)..(1116): n is a, c, g, or t
  misc_feature (1118)..(1118): n is a, c, g, or t
  misc_feature (1121)..(1124): n is a, c, g, or t
  misc_feature (1126)..(1127): n is a, c, g, or t
  misc_feature (1131)..(1131): n is a, c, g, or t
  misc_feature (1135)..(1136): n is a, c, g, or t
  misc_feature (1139)..(1140): n is a, c, g, or t
  misc_feature (1142)..(1142): n is a, c, g, or t
  misc_feature (1144)..(1145): n is a, c, g, or t
  misc_feature (1147)..(1152): n is a, c, g, or t
  misc_feature (1155)..(1157): n is a, c, g, or t
  misc_feature (1159)..(1159): n is a, c, g, or t
  misc_feature (1161)..(1166): n is a, c, g, or t
  misc_feature (1168)..(1168): n is a, c, g, or t
  misc_feature (1170)..(1171): n is a, c, g, or t
  misc_feature (1173)..(1175): n is a, c, g, or t
  misc_feature (1178)..(1178): n is a, c, g, or t
  misc_feature (1180)..(1180): n is a, c, g, or t
  misc_feature (1183)..(1184): n is a, c, g, or t
  misc_feature (1186)..(1189): n is a, c, g, or t
  misc_feature (1194)..(1195): n is a, c, g, or t
  misc_feature (1197)..(1198): n is a, c, g, or t
  misc_feature (1200)..(1200): n is a, c, g, or t
  misc_feature (1203)..(1205): n is a, c, g, or t
  misc_feature (1207)..(1207): n is a, c, g, or t
  misc_feature (1210)..(1210): n is a, c, g, or t
  misc_feature (1213)..(1213): n is a, c, g, or t
  misc_feature (1215)..(1216): n is a, c, g, or t
  misc_feature (1219)..(1221): n is a, c, g, or t
  misc_feature (1224)..(1225): n is a, c, g, or t
  misc_feature (1227)..(1227): n is a, c, g, or t
  misc_feature (1229)..(1229): n is a, c, g, or t
  misc_feature (1231)..(1232): n is a, c, g, or t
  misc_feature (1234)..(1234): n is a, c, g, or t
  misc_feature (1237)..(1242): n is a, c, g, or t
  misc_feature (1244)..(1246): n is a, c, g, or t
  misc_feature (1248)..(1248): n is a, c, g, or t
  misc_feature (1258)..(1258): n is a, c, g, or t
  misc_feature (1264)..(1265): n is a, c, g, or t
  misc_feature (1267)..(1267): n is a, c, g, or t
  misc_feature (1269)..(1272): n is a, c, g, or t
  misc_feature (1274)..(1279): n is a, c, g, or t
  misc_feature (1281)..(1282): n is a, c, g, or t
  misc_feature (1286)..(1287): n is a, c, g, or t
  misc_feature (1293)..(1294): n is a, c, g, or t
  misc_feature (1296)..(1296): n is a, c, g, or t
  misc_feature (1300)..(1301): n is a, c, g, or t
  misc_feature (1303)..(1303): n is a, c, g, or t
  misc_feature (1305)..(1306): n is a, c, g, or t
  misc_feature (1310)..(1310): n is a, c, g, or t
  misc_feature (1314)..(1315): n is a, c, g, or t
  misc_feature (1319)..(1319): n is a, c, g, or t
  misc_feature (1321)..(1322): n is a, c, g, or t
  misc_feature (1325)..(1325): n is a, c, g, or t
  misc_feature (1327)..(1329): n is a, c, g, or t
  misc_feature (1331)..(1331): n is a, c, g, or t
  misc_feature (1334)..(1336): n is a, c, g, or t
  misc_feature (1338)..(1338): n is a, c, g, or t
  misc_feature (1341)..(1341): n is a, c, g, or t
  misc_feature (1343)..(1343): n is a, c, g, or t
  misc_feature (1349)..(1355): n is a, c, g, or t
  misc_feature (1357)..(1357): n is a, c, g, or t
  misc_feature (1359)..(1359): n is a, c, g, or t
  misc_feature (1365)..(1367): n is a, c, g, or t
  misc_feature (1371)..(1373): n is a, c, g, or t
  misc_feature (1379)..(1380): n is a, c, g, or t
  misc_feature (1384)..(1384): n is a, c, g, or t
  misc_feature (1388)..(1388): n is a, c, g, or t
  misc_feature (1390)..(1392): n is a, c, g, or t
  misc_feature (1395)..(1395): n is a, c, g, or t
  misc_feature (1399)..(1400): n is a, c, g, or t
  misc_feature (1402)..(1403): n is a, c, g, or t
  misc_feature (1405)..(1405): n is a, c, g, or t
  misc_feature (1407)..(1407): n is a, c, g, or t
  misc_feature (1409)..(1411): n is a, c, g, or t
  misc_feature (1413)..(1413): n is a, c, g, or t
  misc_feature (1418)..(1420): n is a, c, g, or t
  misc_feature (1422)..(1426): n is a, c, g, or t
  misc_feature (1429)..(1429): n is a, c, g, or t
  misc_feature (1431)..(1431): n is a, c, g, or t
  misc_feature (1434)..(1435): n is a, c, g, or t
  misc_feature (1442)..(1442): n is a, c, g, or t
  misc_feature (1445)..(1446): n is a, c, g, or t
  misc_feature (1448)..(1448): n is a, c, g, or t
  misc_feature (1450)..(1450): n is a, c, g, or t
  misc_feature (1452)..(1452): n is a, c, g, or t
  misc_feature (1456)..(1459): n is a, c, g, or t
  misc_feature (1464)..(1464): n is a, c, g, or t
  misc_feature (1466)..(1466): n is a, c, g, or t
  misc_feature (1468)..(1469): n is a, c, g, or t
  misc_feature (1471)..(1471): n is a, c, g, or t
  misc_feature (1473)..(1473): n is a, c, g, or t
  misc_feature (1475)..(1478): n is a, c, g, or t
  misc_feature (1480)..(1480): n is a, c, g, or t
  misc_feature (1482)..(1482): n is a, c, g, or t
  misc_feature (1485)..(1485): n is a, c, g, or t
  misc_feature (1487)..(1487): n is a, c, g, or t
  misc_feature (1489)..(1489): n is a, c, g, or t
  misc_feature (1491)..(1491): n is a, c, g, or t
  misc_feature (1497)..(1499): n is a, c, g, or t
  misc_feature (1504)..(1511): n is a, c, g, or t
  misc_feature (1516)..(1517): n is a, c, g, or t
  misc_feature (2990)..(2990): n is a, c, g, or t
  misc_feature (3140)..(3140): n is a, c, g, or t
  misc_feature (3155)..(3155): n is a, c, g, or t
  misc_feature (3197)..(3197): n is a, c, g, or t
  misc_feature (3425)..(3425): n is a, c, g, or t
  misc_feature (3429)..(3429): n is a, c, g, or t
  misc_feature (3893)..(3893): n is a, c, g, or t
  misc_feature (3923)..(3923): n is a, c, g, or t
tncnncnntannnannannnnngggnattnnaacncnggngagannatttnaaaannnnncngnaggangnaaaaannatnnnanntnaatnnagnnnntnnngtnnannnnannngnnnnnnnanttnnnnnnaannctnnatnannggnnncnggggnntgaaantnnnnggnngangnnnntnnngnanngnaaaaaacagnnnagnangnntnnnntgnnanaaannaanttttttnacnnnngnaaaaannnnagtttngangaaaaanngnnnnnnnnnannnngannntgntnacgnaaantannanaaangancnnaannagntgnnnnnntntntnnngnancnatnannnnnnannntnnnnntnncangggaaannnagnagnaaaantngnnnnacnnannnnnnnngtntnannnnannnnnnncnnnaanttnnaanntntncngnancctnaaannaaaaaantnnngnnnnngnnacngannntnntnnanttaannantnnnnnaannntttncntnanttnanaaaaaaannnnnnnnnnnnannnttnannnnnntnnannngnannaaaaaacnnnncngnnnncanncaannncntnnnnnnnannnaannnnnnnngnnnannannaaaangnnnnnnaannannttnaanggnaaaanncnannnggctttnnnncnnngannanntnntncacnnnnnnaaaagttnaangaattnatnnnnnntnntnntnnnantnntgncagnngngnnnnnnacnctnnnnanntnananntngnnttnangntngntacanntnnnnnangnnngnnantnnttttnnnnnnnnnnntgnngnnntntncnnnttntnnaannatgnnnnnnannnnnnnnnnnnnnanntnngngnannnannngcaantangnnaatnctttnnntnannaagnnaaanttnaannnnnnnantannnngannncnntnnatnnnnccngnnnnangnnnnnnnnannangnnntnnnnantnaaatnngnngngnnannntnanangnntncanngnnngaacnnnaaaantatnancnnnnaaannnggntntnnaannnttnantgnnnnannggtncggnnatnnancnngnnnnnnttnnntnannnnnngntnngnnncangnagnnannnnccctnntnnanccnnngnaantgntnnagnnnaannangncnngntcnnnnnnannnanaaattaaggnatcggnngnannnnannnnnnannaaannaaaaannanaggnngnanncatnaaanntttntnnaangnnngnaannntnaancnacaaannnnnnngntnatcaannnaatnnnccggtnnatgnaaangnnntangttnntnncngntnnntnaggtnnncnnnnntantnttnnatttgantanntngngntatnnnnagaantntnngnanannnngnanaantncngnaggggnnnattgnnnnnnnnatttnnttcatgctaatagaatgcaaaatgttgtttgtgacaacaagccggcttgcagaacatgcagtctatttgccacatcccagatcaaattccgggttgcacatataaaagtttttgctgtcaagttcttcctgaaccaggcggaggccttcaccgaaacgctggaaatgcacgatttcgcgctggcgcagaaaacggatcggttcacagacttccggatctttgacaagacgtaaaatattatcgtaggtggtgcgggctttctgctccgcagccatatcttcaaaaagatccgtgatcgcatcgcctttgctctggaattcacaggcattaaacggaataccgccggctgcctgcggccagatcccggccgtgtgatcgacatagtaaggagcgaaaccggcggcctcaagttcttcagcacttaagcctttggtgagctggcggacgatggcggcaatcatttcgaggtgggctaattcctccgtcccaatatccgtcaacagtcccgctactttattatatggcatactatacctctgtgacagataacggaacgatgcggccgcctctccatctggtcctccatactgactgatgatgatctgtgcgattttggcattgggtcttgtaatgttgactgggaattgtaaacgtttttcataattccacattaacagtcacctccttcccatggccatggatccgatgcccaacgccagtaattatcaggatttgcggtgtcgatggtaagcggagtataattttgcgcatatgcacgcagtgcagtgcgtcttaagtcagcatagtgattgaaatattttaaagcttcttcatcgtcaggatgcgtgtcgagatattctgtgatttctacgacagcaaagctgaccatatcgatccagtggaggagttgggactgattcatctgactgatcatcatcggcatctacctccgtttgcggctaaaaatggtttatccagttctggaaaaatagtcccggcactgagtgaacgatccggttcataaacagtagaaaaatgctgccaggggacgtatgccatggcgagtacataatcagaaatggttcttatattttctgaacaggaaacagaatctgcacaggatgcagattctgtgcaaaagtccagacctgcacggtgtgcaggatgtgaaacagataaacggtcgcaggaacgattgctgttcccggacataggataaggtctcataataagttattcctttcaatatcaggtttacaataagatatgtaaaaatgatgattttggttcatttagcagacatcatataaaaaggtaaaaaatgcgtattatcaaatcgaaaaagagcgtaaaaaatgttgaaaaatatcaaaatgagtataaaataaaagatattggtattaaaacagcagaagacagagaaggggaataagaatgaataaaagaattgttgcaggtatgctgtttacgacngttgtgtgtatgacgttaggaggctgcggcttcacagctgataaagaaaatgtaaagaatagtggtgctgtggaatcggtaatgccgggagcagaagtatctacggagatgacagaaagagatgctgaggcggataatggtgtggtacancttaaagtatggtcngaagaagacaattttgacatgttaaaccagatgatagacagntttgaacagaaatatgcaggacaggcaaagtttgagattacattggaacaaaatgctgattctgatacaaaggatattcttttgggagatattcataacggggcggatgttttcccgtttgcggatgatcagctttctgcaatggttgccgctggtgcattatatccggtgccaaatgcagaagaagtaaagagtgcgaatttagaagagtcggtttctgctgcatcnattnatgatatcttatatgcttatccaatgacggcagataacggatacttcctctattatgataaaaatgttctttccgatgaagatgtccagacgatggatggcatgttagaggcactgaatgctgcaggcagatcattttccatggagcttaattcgggctggtatctgtatacattttttggtaatacgggtctggagtttggtattaatgatgatggcgtgacaaattactgtaactggaacgccacagatggagcaattaaaggcgttgatgtggcacaggccattttaaatatcacaaccaatccggcatttatcagccagccggatggagatttcattacaggagtacagaatggtacggttagtgcgggaatcagtggcgtatggaatgcagtttcagtcagggaagcatggggcgataattacggagccgtaaaacttccaacttacacggtggcaggncagcaggtacagatgtcttcttttaccggntataaaatgatgggcgtgaatgcatattccaaatatccggaatgggcagcaaaacttgcagactggcttacaaatga

SEQ ID NO: 326 - DNA, 4000 bp, Escherichia coli
  misc_feature (1937)..(1938): n is a, c, g, or t
  misc_feature (1941)..(1941): n is a, c, g, or t
  misc_feature (1943)..(1944): n is a, c, g, or t
  misc_feature (1949)..(1950): n is a, c, g, or t
  misc_feature (1958)..(1959): n is a, c, g, or t
  misc_feature (1965)..(1965): n is a, c, g, or t
  misc_feature (1971)..(1971): n is a, c, g, or t
  misc_feature (1991)..(1992): n is a, c, g, or t
  misc_feature (2001)..(2001): n is a, c, g, or t
  misc_feature (2003)..(2003): n is a, c, g, or t
  misc_feature (2010)..(2010): n is a, c, g, or t
  misc_feature (2012)..(2013): n is a, c, g, or t
caagtgcacatgtggggatgctttcttgattttgtctttttcggctttcgtgaaactaaaaacctcatccactgtgtttactataacagcaggctgaagaggcagcttcacgccgtcaggcacagaaacaaatgtctcaccgtttatggtgcatagttcagtgatccgggcctcgccctcctgaacatccggttccttgagtgagtgcgttgtaaatttgtctataacctttcggtatttgtagatctttggcattttgggcctccttaatgattctcagtaaatatggtaacgagttagttttctttgcatggccaagcaacgaaacgattgattcctgttttcctcttttgagagagcgtttgaatttataaagactatatttccggataaaacgtttatcctgccacgttctgtatcctacaaaattgacaccttttttaattttttggattgtcgatttggaaagacctaagcacagattccgtttcagaaattccacaataattcctttgtattttaaacacccttccctggttaatccgatcaaaataaaatcatccacatatctgacatagtgctttattttaagcacccgcttcacgaagtgatcaagcggattcagatagatcagcgcatatatctggctcaatagatttccgatcgggatccctaccggacctgctttttctgcgaaaatcatcataacatcaacgagttgtttatccttaattttgcgctcaatcaacatccgtaatatcatacgatcgatagagtagaaaaacttcctgatatccagtttcaacgtatagagatctgcgtcaaaagcccggagggtcttctgcgtatagtcactcgccccatgggtcccatatccaaccctgcacgcaaaactcgttgaaataaaactcctgtcaaaaatgtcatagatcactctgtaaattgcatgttgaaccactatatccctgaacgctggggcgtgaatcaatctctctttcggttcgtaaacggtaaactgaaaatatggatccggcttatatgaaccattgtgtatcctatcgtaaagatccatcaaattagccccaaggtttatctcaaattcaaagcaggctcgtttctttctcttccctttccgtgcatcgagataggcagaatataaattttccttactgaaggctttttcaaacaagttcccgtatcttttcaatttattgataccccctggtcttcggtttccctaccaaaaagaaggtttctgttgatttcgcttaaagctggataatgcatccctgtaattccactattccgtttccggatttgaggtgaaattgtagtcgcaacgcaacctgacattgttgttcgaattcgtccgattgttgttaagattcgaataccaaaccccggcattcgacgtgttgttccaattgttgcacgataggacgcatattgaggcattacccatttaccaattcttttgttctttaacttttttaatccaaccgcctatcatttttcctaattcatcattcaacctgctaattgcagcaaagcgatgcttttctaattcttcgggcttttcattactttgctttccatctttaaagcaaaaatatcccaattcgtaagctaaaaacaattgcatcctcagcttttcatgcgtgacatccaagttagtcaaggtggtttttttgaaataccgcttttggccttcggaaacataatcataaacttcataagccgtgctccttattctgtttgccaaagcgtacttctcgtgtttcggaaaatggttcaaatatatatttaacaattttgcaaattctataaactttctatttaatccggcttcactatgtatccccattttagcgaccttcttaaaaccgccgggttatcacccggctactcagggtaacaggcgcaacgcaacccgacanngtngnncgaanncgtccganngttgtnaagatncgaagaccaaaccccggcanncgacgtgtngntccaatngnngcacgatcggacgcatagctcatttcgaatatattgatagaaataatctttcccgaattgattagttccggttacgtcaatcccgtccgcatcctgtggaaagcctaaagcggtgagaatccagccatccccgcttacggcttcgcccaaaacttgattggcccctgatccgtatcgttgcgcaaatgccccggcggggtcaaacggcagcgaagccatggtaattgcgtccatcatggcggctacaccggtagcgccccagtggtcagtcgcgcccgcactgccgctatcaaagtccttcatggccgtggcttccttggcgacataaaaatccccataggtcacagtgcctgcactggaataggtggtgtatccggtagagtcaatcccgtccaaactgaaggtcgtgccattaatgacggtaaccttatacagtttatcgttaagttgggtcataccaaccacagcggttatcatgatccagtccccagtggtaagcgccgctgtgctcgccaccgtaatcacgcatggatctgcctccgatgccccggtaatggacatcgtggacgcaatacaggtgatcccgatagagacctcatacatcaaaccattcagatcagccacgccgcatgcctggccgttatgcgttgacttggcaaacggaacccctgatcctgttttcccgcaattactgtagccatcggtcacatagagcaaatcgtctcccgacccggcaccattgctcacctcatcatagtcctttagggcgttgttattgcaacccttggggtagttgtaagtggcgtcataccacgcgcagtacgtggtagcgctcaccgcttgagcatgggccagcgagagcagtgccagtgcggcatattgaaatttgctggcgcaatgaaaaatactactggcgttcaccgccccatctacaccgtcacgggcatgggctgcgtcaatggcctcgaaataggcatttgaaccacaggccgtcagatcagcaataggattgtgcgcagccgctgtactcaatggcagaccgcttttaatgctgctcgcgatatacccggttccccaggcagtttttgagcacatatacttatcagcaaaaaatccctgctgatttattccgccgtcgataaatgccctatgcatagcataactgtccgcattggcctcagcctcagttgaataggtgtccatcccctcgatggtcaccgtgttggtcgcgattagataataaaagcgggggatccagcacataatagacccatccgcatactgatagttaccgtagttgtccgatgcagggtcactgtatccggacattggggtcatatccgccggtaatatatcagccggacatatccctacgccgaacccggcgcgtcccgcagtcccgatacaattgacctcggcgccggcttgcatgtatcgcggatctgtaaaatatttccccgcccgggcgacccatcgcgtgtcaccgccgttctctgtgctgaggatttccaggtgatccaccgtatacgccgagcccgccgccacatactcataaagcgtctcggtttccgcgcagtagcacacctcccccggccggcctgcagcttccgccgcggtcaccgtatcaaacactaaatcctttatttgtcgctgattgagcatatccctcctccttttccgaccaggcccttttcaggtccatagctcgttacgatttcattttcccctgtctacgaggccggcacctcgatctccaccacatcgtttatgtccataatataattgatgtgaaacgtggtcgcgctgtcccagtggacttcatcgtcgcggatcaactgtactccattcaaccggatccggttctggtcgttggcgttaaacaaggcctcgctggcatccagcgttaccgtgtccccggtgtcatccgatgtcccggtcccggcgcctgctcccccggcgatcgtgattacctcattggccgcaaact

SEQ ID NO: 327 - DNA, 4000 bp, Escherichia coli
  misc_feature (810)..(811): n is a, c, g, or t
  misc_feature (814)..(814): n is a, c, g, or t
  misc_feature (829)..(829): n is a, c, g, or t
  misc_feature (836)..(836): n is a, c, g, or t
  misc_feature (843)..(843): n is a, c, g, or t
  misc_feature (1985)..(1985): n is a, c, g, or t
  misc_feature (1992)..(1992): n is a, c, g, or t
  misc_feature (1999)..(1999): n is a, c, g, or t
  misc_feature (2279)..(2279): n is a, c, g, or t
  misc_feature (2315)..(2317): n is a, c, g, or t
  misc_feature (2319)..(2319): n is a, c, g, or t
  misc_feature (2323)..(2323): n is a, c, g, or t
  misc_feature (2325)..(2326): n is a, c, g, or t
  misc_feature (2328)..(2329): n is a, c, g, or t
  misc_feature (2332)..(2336): n is a, c, g, or t
  misc_feature (2340)..(2340): n is a, c, g, or t
  misc_feature (2342)..(2345): n is a, c, g, or t
  misc_feature (2348)..(2348): n is a, c, g, or t
  misc_feature (2351)..(2356): n is a, c, g, or t
  misc_feature (2358)..(2361): n is a, c, g, or t
  misc_feature (2363)..(2373): n is a, c, g, or t
  misc_feature (2375)..(2375): n is a, c, g, or t
  misc_feature (2378)..(2378): n is a, c, g, or t
  misc_feature (2380)..(2381): n is a, c, g, or t
  misc_feature (2384)..(2385): n is a, c, g, or t
  misc_feature (2388)..(2388): n is a, c, g, or t
  misc_feature (2392)..(2392): n is a, c, g, or t
  misc_feature (2394)..(2394): n is a, c, g, or t
  misc_feature (2396)..(2401): n is a, c, g, or t
  misc_feature (2403)..(2404): n is a, c, g, or t
  misc_feature (2406)..(2407): n is a, c, g, or t
  misc_feature (2409)..(2418): n is a, c, g, or t
  misc_feature (2420)..(2422): n is a, c, g, or t
  misc_feature (2424)..(2425): n is a, c, g, or t
  misc_feature (2427)..(2429): n is a, c, g, or t
  misc_feature (2431)..(2432): n is a, c, g, or t
  misc_feature (2434)..(2436): n is a, c, g, or t
  misc_feature (2438)..(2438): n is a, c, g, or t
  misc_feature (2441)..(2443): n is a, c, g, or t
  misc_feature (2445)..(2446): n is a, c, g, or t
  misc_feature (2451)..(2454): n is a, c, g, or t
  misc_feature (2457)..(2457): n is a, c, g, or t
  misc_feature (2460)..(2460): n is a, c, g, or t
  misc_feature (2462)..(2465): n is a, c, g, or t
  misc_feature (2467)..(2469): n is a, c, g, or t
  misc_feature (2471)..(2472): n is a, c, g, or t
  misc_feature (2474)..(2477): n is a, c, g, or t
  misc_feature (2479)..(2481): n is a, c, g, or t
  misc_feature (2483)..(2491): n is a, c, g, or t
  misc_feature (2494)..(2494): n is a, c, g, or t
  misc_feature (2496)..(2496): n is a, c, g, or t
  misc_feature (2498)..(2498): n is a, c, g, or t
  misc_feature (2501)..(2502): n is a, c, g, or t
  misc_feature (2504)..(2514): n is a, c, g, or t
  misc_feature (2516)..(2518): n is a, c, g, or t
  misc_feature (2520)..(2520): n is a, c, g, or t
  misc_feature (2523)..(2524): n is a, c, g, or t
  misc_feature (2526)..(2526): n is a, c, g, or t
  misc_feature (2529)..(2529): n is a, c, g, or t
  misc_feature (2531)..(2535): n is a, c, g, or t
  misc_feature (2539)..(2541): n is a, c, g, or t
  misc_feature (2546)..(2546): n is a, c, g, or t
  misc_feature (2550)..(2552): n is a, c, g, or t
  misc_feature (2555)..(2556): n is a, c, g, or t
  misc_feature (2558)..(2558): n is a, c, g, or t
  misc_feature (2565)..(2565): n is a, c, g, or t
  misc_feature (2567)..(2567): n is a, c, g, or t
  misc_feature (2569)..(2571): n is a, c, g, or t
  misc_feature (2573)..(2575): n is a, c, g, or t
  misc_feature (2577)..(2577): n is a, c, g, or t
  misc_feature (2579)..(2579): n is a, c, g, or t
  misc_feature (2581)..(2581): n is a, c, g, or t
  misc_feature (2583)..(2584): n is a, c, g, or t
  misc_feature (2587)..(2592): n is a, c, g, or t
  misc_feature (2594)..(2594): n is a, c, g, or t
  misc_feature (2596)..(2600): n is a, c, g, or t
  misc_feature (2602)..(2604): n is a, c, g, or t
  misc_feature (2606)..(2606): n is a, c, g, or t
  misc_feature (2608)..(2611): n is a, c, g, or t
  misc_feature (2614)..(2614): n is a, c, g, or t
  misc_feature (2617)..(2619): n is a, c, g, or t
  misc_feature (2622)..(2622): n is a, c, g, or t
  misc_feature (2624)..(2625): n is a, c, g, or t
  misc_feature (2628)..(2628): n is a, c, g, or t
  misc_feature (2634)..(2634): n is a, c, g, or t
  misc_feature (2637)..(2641): n is a, c, g, or t
  misc_feature (2643)..(2645): n is a, c, g, or t
  misc_feature (2647)..(2648): n is a, c, g, or t
  misc_feature (2650)..(2650): n is a, c, g, or t
  misc_feature (2653)..(2655): n is a, c, g, or t
  misc_feature (2657)..(2657): n is a, c, g, or t
  misc_feature (2660)..(2662): n is a, c, g, or t
  misc_feature (2664)..(2664): n is a, c, g, or t
  misc_feature (2667)..(2674): n is a, c, g, or t
  misc_feature (2677)..(2677): n is a, c, g, or t
  misc_feature (2680)..(2680): n is a, c, g, or t
  misc_feature (2685)..(2688): n is a, c, g, or t
  misc_feature (2690)..(2695): n is a, c, g, or t
  misc_feature (2697)..(2702): n is a, c, g, or t
  misc_feature (2704)..(2707): n is a, c, g, or t
  misc_feature (2709)..(2714): n is a, c, g, or t
  misc_feature (2716)..(2719): n is a, c, g, or t
  misc_feature (2721)..(2721): n is a, c, g, or t
  misc_feature (2724)..(2729): n is a, c, g, or t
  misc_feature (2732)..(2734): n is a, c, g, or t
  misc_feature (2736)..(2740): n is a, c, g, or t
  misc_feature (2742)..(2745): n is a, c, g, or t
  misc_feature (2747)..(2749): n is a, c, g, or t
  misc_feature (2751)..(2755): n is a, c, g, or t
  misc_feature (2758)..(2758): n is a, c, g, or t
  misc_feature (2761)..(2764): n is a, c, g, or t
  misc_feature (2769)..(2779): n is a, c, g, or t
  misc_feature (2781)..(2781): n is a, c, g, or t
  misc_feature (2783)..(2788): n is a, c, g, or t
  misc_feature (2791)..(2794): n is a, c, g, or t
  misc_feature (2796)..(2798): n is a, c, g, or t
  misc_feature (2800)..(2803): n is a, c, g, or t
  misc_feature (2806)..(2806): n is a, c, g, or t
  misc_feature (2808)..(2819): n is a, c, g, or t
  misc_feature (2821)..(2821): n is a, c, g, or t
  misc_feature (2824)..(2826): n is a, c, g, or t
  misc_feature (2828)..(2837): n is a, c, g, or t
  misc_feature (2839)..(2840): n is a, c, g, or t
  misc_feature (2842)..(2861): n is a, c, g, or t
  misc_feature (2864)..(2864): n is a, c, g, or t
  misc_feature (2867)..(2869): n is a, c, g, or t
  misc_feature (2871)..(2876): n is a, c, g, or t
  misc_feature (2878)..(2880): n is a, c, g, or t
  misc_feature (2882)..(2887): n is a, c, g, or t
  misc_feature (2889)..(2891): n is a, c, g, or t
  misc_feature (2893)..(2893): n is a, c, g, or t
  misc_feature (2895)..(2897): n is a, c, g, or t
  misc_feature (2899)..(2901): n is a, c, g, or t
  misc_feature (2903)..(2903): n is a, c, g, or t
  misc_feature (2905)..(2905): n is a, c, g, or t
  misc_feature (2908)..(2916): n is a, c, g, or t
  misc_feature (2918)..(2922): n is a, c, g, or t
  misc_feature (2925)..(2928): n is a, c, g, or t
  misc_feature (2931)..(2931): n is a, c, g, or t
  misc_feature (2933)..(2934): n is a, c, g, or t
  misc_feature (2936)..(2937): n is a, c, g, or t
  misc_feature (2939)..(2939): n is a, c, g, or t
  misc_feature (2941)..(2941): n is a, c, g, or t
  misc_feature (2944)..(2951): n is a, c, g, or t
  misc_feature (2955)..(2959): n is a, c, g, or t
  misc_feature (2961)..(2961): n is a, c, g, or t
  misc_feature (2963)..(2963): n is a, c, g, or t
  misc_feature (2965)..(2965): n is a, c, g, or t
  misc_feature (2967)..(2973): n is a, c, g, or t
  misc_feature (2975)..(2979): n is a, c, g, or t
  misc_feature (2981)..(2981): n is a, c, g, or t
  misc_feature (2983)..(2984): n is a, c, g, or t
  misc_feature (2988)..(2988): n is a, c, g, or t
  misc_feature (2990)..(2992): n is a, c, g, or t
  misc_feature (2994)..(2995): n is a, c, g, or t
  misc_feature (2997)..(2999): n is a, c, g, or t
  misc_feature (3002)..(3002): n is a, c, g, or t
  misc_feature (3004)..(3009): n is a, c, g, or t
  misc_feature (3011)..(3017): n is a, c, g, or t
  misc_feature (3019)..(3022): n is a, c, g, or t
  misc_feature (3024)..(3027): n is a, c, g, or t
  misc_feature (3029)..(3029): n is a, c, g, or t
  misc_feature (3032)..(3033): n is a, c, g, or t
  misc_feature (3036)..(3038): n is a, c, g, or t
  misc_feature (3041)..(3044): n is a, c, g, or t
  misc_feature (3046)..(3047): n is a, c, g, or t
  misc_feature (3049)..(3049): n is a, c, g, or t
  misc_feature (3051)..(3055): n is a, c, g, or t
  misc_feature (3057)..(3059): n is a, c, g, or t
  misc_feature (3061)..(3062): n is a, c, g, or t
  misc_feature (3064)..(3066): n is a, c, g, or t
  misc_feature (3068)..(3073): n is a, c, g, or t
  misc_feature (3075)..(3076): n is a, c, g, or t
  misc_feature (3079)..(3082): n is a, c, g, or t
  misc_feature (3085)..(3085): n is a, c, g, or t
  misc_feature (3087)..(3092): n is a, c, g, or t
  misc_feature (3094)..(3095): n is a, c, g, or t
  misc_feature (3098)..(3101): n is a, c, g, or t
  misc_feature (3104)..(3110): n is a, c, g, or t
  misc_feature (3112)..(3115): n is a, c, g, or t
  misc_feature (3118)..(3118): n is a, c, g, or t
  misc_feature (3122)..(3122): n is a, c, g, or t
  misc_feature (3126)..(3126): n is a, c, g, or t
  misc_feature (3129)..(3130): n is a, c, g, or t
  misc_feature (3132)..(3134): n is a, c, g, or t
  misc_feature (3137)..(3138): n is a, c, g, or t
  misc_feature (3140)..(3141): n is a, c, g, or t
  misc_feature (3144)..(3145): n is a, c, g, or t
  misc_feature (3148)..(3148): n is a, c, g, or t
  misc_feature (3150)..(3150): n is a, c, g, or t
  misc_feature (3152)..(3155): n is a, c, g, or t
  misc_feature (3157)..(3158): n is a, c, g, or t
  misc_feature (3160)..(3160): n is a, c, g, or t
  misc_feature (3167)..(3167): n is a, c, g, or t
  misc_feature (3169)..(3173): n is a, c, g, or t
  misc_feature (3176)..(3176): n is a, c, g, or t
  misc_feature (3178)..(3183): n is a, c, g, or t
  misc_feature (3185)..(3191): n is a, c, g, or t
  misc_feature (3193)..(3193): n is a, c, g, or t
  misc_feature (3195)..(3196): n is a, c, g, or t
  misc_feature (3198)..(3201): n is a, c, g, or t
  misc_feature (3204)..(3205): n is a, c, g, or t
  misc_feature (3208)..(3214): n is a, c, g, or t
  misc_feature (3218)..(3224): n is a, c, g, or t
  misc_feature (3226)..(3228): n is a, c, g, or t
  misc_feature (3230)..(3231): n is a, c, g, or t
  misc_feature (3234)..(3234): n is a, c, g, or t
  misc_feature (3237)..(3237): n is a, c, g, or t
  misc_feature (3239)..(3242): n is a, c, g, or t
  misc_feature (3246)..(3248): n is a, c, g, or t
  misc_feature (3250)..(3254): n is a, c, g, or t
  misc_feature (3256)..(3256): n is a, c, g, or t
  misc_feature (3259)..(3260): n is a, c, g, or t
  misc_feature (3262)..(3262): n is a, c, g, or t
  misc_feature (3265)..(3266): n is a, c, g, or t
  misc_feature (3269)..(3270): n is a, c, g, or t
  misc_feature (3272)..(3273): n is a, c, g, or t
  misc_feature (3275)..(3275): n is a, c, g, or t
  misc_feature (3279)..(3280): n is a, c, g, or t
  misc_feature (3283)..(3285): n is a, c, g, or t
  misc_feature (3287)..(3288): n is a, c, g, or t
  misc_feature (3290)..(3290): n is a, c, g, or t
  misc_feature (3294)..(3297): n is a, c, g, or t
  misc_feature (3300)..(3300): n is a, c, g, or t
  misc_feature (3302)..(3304): n is a, c, g, or t
  misc_feature (3307)..(3308): n is a, c, g, or t
  misc_feature (3310)..(3310): n is a, c, g, or t
  misc_feature (3312)..(3312): n is a, c, g, or t
  misc_feature (3314)..(3316): n is a, c, g, or t
  misc_feature (3318)..(3318): n is a, c, g, or t
  misc_feature (3320)..(3324): n is a, c, g, or t
  misc_feature (3326)..(3326): n is a, c, g, or t
  misc_feature (3328)..(3330): n is a, c, g, or t
  misc_feature (3332)..(3338): n is a, c, g, or t
  misc_feature (3340)..(3343): n is a, c, g, or t
  misc_feature (3345)..(3345): n is a, c, g, or t
  misc_feature (3349)..(3360): n is a, c, g, or t
  misc_feature (3362)..(3364): n is a, c, g, or t
  misc_feature (3367)..(3367): n is a, c, g, or t
  misc_feature (3370)..(3371): n is a, c, g, or t
  misc_feature (3373)..(3374): n is a, c, g, or t
  misc_feature (3376)..(3377): n is a, c, g, or t
  misc_feature (3379)..(3380): n is a, c, g, or t
  misc_feature (3383)..(3392): n is a, c, g, or t
  misc_feature (3396)..(3399): n is a, c, g, or t
  misc_feature (3401)..(3401): n is a, c, g, or t
  misc_feature (3403)..(3403): n is a, c, g, or t
  misc_feature (3405)..(3406): n is a, c, g, or t
  misc_feature (3408)..(3410): n is a, c, g, or t
  misc_feature (3413)..(3415): n is a, c, g, or t
  misc_feature (3418)..(3423): n is a, c, g, or t
  misc_feature (3425)..(3427): n is a, c, g, or t
  misc_feature (3432)..(3435): n is a, c, g, or t
  misc_feature (3437)..(3447): n is a, c, g, or t
  misc_feature (3449)..(3451): n is a, c, g, or t
  misc_feature (3453)..(3456): n is a, c, g, or t
  misc_feature (3461)..(3465): n is a, c, g, or t
  misc_feature (3467)..(3469): n is a, c, g, or t
  misc_feature (3471)..(3471): n is a, c, g, or t
  misc_feature (3473)..(3475): n is a, c, g, or t
  misc_feature (3480)..(3484): n is a, c, g, or t
  misc_feature (3486)..(3490): n is a, c, g, or t
  misc_feature (3492)..(3495): n is a, c, g, or t
  misc_feature (3497)..(3498): n is a, c, g, or t
  misc_feature (3500)..(3503): n is a, c, g, or t
  misc_feature (3505)..(3505): n is a, c, g, or t
  misc_feature (3508)..(3508): n is a, c, g, or t
  misc_feature (3510)..(3510): n is a, c, g, or t
  misc_feature (3513)..(3514): n is a, c, g, or t
  misc_feature (3522)..(3522): n is a, c, g, or t
  misc_feature (3525)..(3527): n is a, c, g, or t
  misc_feature (3530)..(3531): n is a, c, g, or t
  misc_feature (3534)..(3534): n is a, c, g, or t
  misc_feature (3536)..(3536): n is a, c, g, or t
  misc_feature (3539)..(3539): n is a, c, g, or t
  misc_feature (3542)..(3543): n is a, c, g, or t
  misc_feature (3545)..(3545): n is a, c, g, or t
  misc_feature (3547)..(3547): n is a, c, g, or t
  misc_feature (3549)..(3549): n is a, c, g, or t
  misc_feature (3551)..(3557): n is a, c, g, or t
  misc_feature (3559)..(3559): n is a, c, g, or t
  misc_feature (3561)..(3563): n is a, c, g, or t
  misc_feature (3565)..(3567): n is a, c, g, or t
  misc_feature (3569)..(3572): n is a, c, g, or t
  misc_feature (3574)..(3581): n is a, c, g, or t
  misc_feature (3583)..(3585): n is a, c, g, or t
  misc_feature (3587)..(3591): n is a, c, g, or t
  misc_feature (3594)..(3594): n is a, c, g, or t
  misc_feature (3596)..(3596): n is a, c, g, or t
  misc_feature (3598)..(3598): n is a, c, g, or t
  misc_feature (3601)..(3603): n is a, c, g, or t
  misc_feature (3605)..(3607): n is a, c, g, or t
  misc_feature (3609)..(3612): n is a, c, g, or t
  misc_feature (3614)..(3621): n is a, c, g, or t
  misc_feature (3623)..(3624): n is a, c, g, or t
  misc_feature (3626)..(3628): n is a, c, g, or t
  misc_feature (3631)..(3636): n is a, c, g, or t
  misc_feature (3639)..(3640): n is a, c, g, or t
  misc_feature (3642)..(3642): n is a, c, g, or t
  misc_feature (3646)..(3646): n is a, c, g, or t
  misc_feature (3648)..(3649): n is a, c, g, or t
  misc_feature (3651)..(3651): n is a, c, g, or t
  misc_feature (3654)..(3656): n is a, c, g, or t
  misc_feature (3658)..(3658): n is a, c, g, or t
  misc_feature (3660)..(3661): n is a, c, g, or t
  misc_feature (3663)..(3669): n is a, c, g, or t
  misc_feature (3671)..(3671): n is a, c, g, or t
  misc_feature (3673)..(3679): n is a, c, g, or t
  misc_feature (3681)..(3683): n is a, c, g, or t
  misc_feature (3686)..(3689): n is a, c, g, or t
  misc_feature (3691)..(3691): n is a, c, g, or t
  misc_feature (3693)..(3693): n is a, c, g, or t
  misc_feature (3695)..(3695): n is a, c, g, or t
  misc_feature (3697)..(3701): n is a, c, g, or t
  misc_feature (3703)..(3703): n is a, c, g, or t
  misc_feature (3706)..(3706): n is a, c, g, or t
  misc_feature (3708)..(3714): n is a, c, g, or t
  misc_feature (3716)..(3722): n is a, c, g, or t
  misc_feature (3724)..(3728): n is a, c, g, or t
  misc_feature (3730)..(3730): n is a, c, g, or t
  misc_feature (3732)..(3735): n is a, c, g, or t
  misc_feature (3738)..(3744): n is a, c, g, or t
  misc_feature (3748)..(3752): n is a, c, g, or t
  misc_feature (3754)..(3754): n is a, c, g, or t
  misc_feature (3756)..(3759): n is a, c, g, or t
  misc_feature (3761)..(3763): n is a, c, g, or t
  misc_feature (3765)..(3765): n is a, c, g, or t
  misc_feature (3767)..(3771): n is a, c, g, or t
  misc_feature (3773)..(3775): n is a, c, g, or t
  misc_feature (3777)..(3778): n is a, c, g, or t
  misc_feature (3780)..(3785): n is a, c, g, or t
  misc_feature (3787)..(3787): n is a, c, g, or t
  misc_feature (3789)..(3790): n is a, c, g, or t
  misc_feature (3792)..(3792): n is a, c, g, or t
  misc_feature (3794)..(3795): n is a, c, g, or t
  misc_feature (3797)..(3798): n is a, c, g, or t
  misc_feature (3801)..(3801): n is a, c, g, or t
  misc_feature (3803)..(3803): n is a, c, g, or t
  misc_feature (3806)..(3807): n is a, c, g, or t
  misc_feature (3810)..(3815): n is a, c, g, or t
  misc_feature (3817)..(3817): n is a, c, g, or t
  misc_feature (3819)..(3824): n is a, c, g, or t
  misc_feature (3827)..(3827): n is a, c, g, or t
  misc_feature (3829)..(3829): n is a, c, g, or t
  misc_feature (3831)..(3831): n is a, c, g, or t
  misc_feature (3833)..(3840): n is a, c, g, or t
  misc_feature (3842)..(3845): n is a, c, g, or t
  misc_feature (3847)..(3847): n is a, c, g, or t
  misc_feature (3849)..(3851): n is a, c, g, or t
  misc_feature (3854)..(3854): n is a, c, g, or t
  misc_feature (3856)..(3859): n is a, c, g, or t
  misc_feature (3861)..(3863): n is a, c, g, or t
  misc_feature (3865)..(3869): n is a, c, g, or t
  misc_feature (3872)..(3880): n is a, c, g, or t
  misc_feature (3883)..(3883): n is a, c, g, or t
  misc_feature (3885)..(3886): n is a, c, g, or t
  misc_feature (3888)..(3895): n is a, c, g, or t
  misc_feature (3897)..(3899): n is a, c, g, or t
  misc_feature (3901)..(3903): n is a, c, g, or t
  misc_feature (3905)..(3908): n is a, c, g, or t
  misc_feature (3910)..(3914): n is a, c, g, or t
  misc_feature (3916)..(3917): n is a, c, g, or t
  misc_feature (3919)..(3919): n is a, c, g, or t
  misc_feature (3921)..(3925): n is a, c, g, or t
  misc_feature (3927)..(3932): n is a, c, g, or t
  misc_feature (3934)..(3934): n is a, c, g, or t
  misc_feature (3936)..(3947): n is a, c, g, or t
  misc_feature (3949)..(3950): n is a, c, g, or t
  misc_feature (3952)..(3957): n is a, c, g, or t
  misc_feature (3959)..(3962): n is a, c, g, or t
  misc_feature (3964)..(3964): n is a, c, g, or t
  misc_feature (3966)..(3968): n is a, c, g, or t
  misc_feature (3971)..(3972): n is a, c, g, or t
  misc_feature (3974)..(3974): n is a, c, g, or t
  misc_feature (3978)..(3985): n is a, c, g, or t
  misc_feature (3989)..(3995): n is a, c, g, or t
  misc_feature (3998)..(4000): n is a, c, g, or t
atgtgtaatatatgtaataattaatatttattaaatatatcaaagatatttttttatattaataattctgttattttaataatttataattgttaaataggttttaattatataaatattgttaaatataatcaattattaattattataatattttgaaatatatgtatatttaatttattattttgttttattaatgtgaaaaaaataattattttaaaactaaaagtttggaataaattttataatattaatgataagagtagtttaattttctatattaattgttgaacatattcatacttttttttattagtattaaattataattattttttttattccatgttttattccataatacaaatctaacatataaaagaaaagaaatataccattcttcttataaaatgaagatttgttggccttgaatcaatttcagtcatttttactttttactaatgttctgtattaatttaatgggttgttattttttatagtcgaaaattaatattaaattatattcctcgataaaattttatttttaaatgtaatagataaattaatattatgtatttctcaaaattgttttatctttttttttatattgaaaaaattttcaaaaatttatatattgatattgatattgttataaataatagctgtaaaaaattaaattaaaagtgttaataaaatgtgattaggatgaagatatattaatataattttctttttaataattaaattttatatatacatctcttttttcataattggtatatatatataatatttctttttttttaaaannaanaaaaaaaaaaaaaanaaaaaanaaaaaanaattaaaattttgaaagaatgtaatattattaatattaactataaaaaaatatggttttctaaattgtatttaaattaattaattaattattgctcttaaataacaggttaaatcataatttaaattcaaatttaaaaattcaaaaacgtttttaattatgaaatattattttactctattatttaaaattataataataatttaaatttctttttacttatcgagtattaaaaccatgattttaaaattgattaataagaattaaaattttgattgaaaaataaaataaaaaattaaaaaaattttatatccattacagtatgaaagataatgattattggtagtcattaataatgatttttggttttataataattaaatatttatgaaattgaattattatattcattatactttattatttatataaaagtatggataattattagaataattattaaactttttataataatttttttttaaaaaattaagataaatttttctaaatgaaattagtattatcagtatataattaacaattatatatatatatgcatttatatattacatatttgaaattgcatattaacatttatacattgttaacggttatacaatttcttttattatttctttgcagagtttatagatgtaattagttaatctcaataaataatcataaactattattacaatattcatatttattaataaatttttaaatatatatataattatataaataatatttttatgataaaaagtaaaatgtatcattaatattttttttttaaaaaactttattctattaaattataattatatatatataattatatttattaatatttatataatgataattagtataattactatcctattattgaaataatattaattttattattactattatataataaaaatttatagcattattttgtaaaccaaaggtaaacataatttctaattattaatttcattttaaaaattatttattaattaaaagatttattttatgttattaggtatcattgtaattgattttattattataatatttattataattgttataattatttaattattattacttttttataatatttttttataaaaaaaaaaaaaaaanaatattnaaaatanataagtttattattttattaaaacatatatttatttaaactttaatgaaattaacaaactataatttactattatattatatataaaatatataatatatattattatgtaaaaaaacctatattgcaaagtattgtaaaagataaacataattaaaaaattaaataagtatttatttaaatattttaaatgtttattttttttttcttttttttttttttttttttttttttttttttttttttttttttttttttttttttttttttttttttttttntttttttttttttttttttttttttttttttttttnnnantttntnntnnaannnnntttntnnnntantgnnnnnnannnnannnnnnnnnnntnttntnnttnnttntttntntnnnnnnannanntnnnnnnnnnnannntnntnnntnnannntntannnannttaannnntantanannnnannntnnannnntnnnannnnnnnnntanangnaannannnnnnnnnnnannnanaanntntanannnnntaannnttatnatannnaannanaaaaatntntnnntnnntntntnanngtnnnnnntntnnnnntnnntnannnnttntannntangnnaantttatnatnnnnnannnannanatnnntnttnnntnttnnnnnnnntgntgntgttnnnntnnnnnntnnnnnntnnnntnnnnnnannnnancannnnnnaannntnnnnnannnntnnnannnnnatnaannnnatgannnnnnnnnnnantnnnnnnatnnnnannnannnntanannnnnnnnnnnnanttnnntnnnnnnnnnnannannnnnnnnnnnnnnnnnnnnacnatnnntnnnnnnannntnnnnnnannntntnnntnnnananttnnnnnnnnntnnnnntcnnnnatngnntnntntngannnnnnnnaatnnnnntntnanannnnnnnannnnntntnnattnannnanntnnnatncnnnnnntnnnnnnntnnnntnnnntnganntgnnnaannnnanntntnnnnntnnntnntnnnannnnnntnnatnnnnatntnnnnnncnntannnnaannnnnnntnnnntgnattnggtnaanngnnnttnntnnttnntantntnnnnannanttatatnannnnnttnannnnnntnnnnnnnananntnnnnatnnaannnnnnnaaannnnnnnannnannatnaanannnntatnnntnnnnnantanntntannttnntnntnattnntannntnnantaannnnatnannnatnnananannnanannnnnanannntnnnnnnntnnnntnaatnnnnnnnnnnnnannnttnttnnannanntnnatnnnnnnnnnnattnnnntnantnnannnttnnntannnnnntnnntaatnnnntnnnnnnnnnnnannntnnnnttcannnnntnnntnannnatgcnnnnntnnnnngnnnnanntnnnntncantnttnnctaatatnttnnnagnnttntnttntannantnantnnnnnnntnannnannngnnnntnnnnnnnntnnntnnnnnttnantnttnnntnnnannnntnnnnnnnngnntnnnatnnnnnnttnnanatangnntnacnnnananngnnnnnnntntnnnnnnntnnnatnnnnantntnannnnnantantnnnnnnnannnnnnntnnnnnanannnntannnnnnnagannnnntnannnntnnncntnnnnnannnanncnnnnnnantnntnanntnnttnanatnncannnnnnancnnnnnnagntntnannnnnnnntnnnncntnnncantnnnnannnannnnnaannnnnnnnnaantnntnnnnnnnncnnnannnannnntnnnnntnntnannnnngnnnnnnanannnnnnnnnnnnanntnnnnnnannnntnannnaannantagnnnnnnnngtannnnnnnatnnn

SEQ ID NO: 328 - DNA, 4000 bp, Escherichia coli
  misc_feature (1)..(3): n is a, c, g, or t
  misc_feature (5)..(10): n is a, c, g, or t
  misc_feature (14)..(15): n is a, c, g, or t
  misc_feature (17)..(17): n is a, c, g, or t
  misc_feature (19)..(19): n is a, c, g, or t
  misc_feature (23)..(28): n is a, c, g, or t
  misc_feature (30)..(32): n is a, c, g, or t
  misc_feature (34)..(34): n is a, c, g, or t
  misc_feature (36)..(36): n is a, c, g, or t
  misc_feature (39)..(48): n is a, c, g, or t
  misc_feature (50)..(55): n is a, c, g, or t
  misc_feature (57)..(59): n is a, c, g, or t
  misc_feature (63)..(64): n is a, c, g, or t
  misc_feature (66)..(67): n is a, c, g, or t
  misc_feature (70)..(73): n is a, c, g, or t
  misc_feature (75)..(77): n is a, c, g, or t
  misc_feature (79)..(79): n is a, c, g, or t
  misc_feature (83)..(87): n is a, c, g, or t
  misc_feature (89)..(89): n is a, c, g, or t
  misc_feature (91)..(98): n is a, c, g, or t
  misc_feature (100)..(103): n is a, c, g, or t
  misc_feature (105)..(110): n is a, c, g, or t
  misc_feature (112)..(120): n is a, c, g, or t
  misc_feature (124)..(127): n is a, c, g, or t
  misc_feature (129)..(134): n is a, c, g, or t
  misc_feature (137)..(139): n is a, c, g, or t
  misc_feature (141)..(143): n is a, c, g, or t
  misc_feature (149)..(149): n is a, c, g, or t
  misc_feature (151)..(158): n is a, c, g, or t
  misc_feature (160)..(162): n is a, c, g, or t
  misc_feature (165)..(166): n is a, c, g, or t
  misc_feature (168)..(173): n is a, c, g, or t
  misc_feature (178)..(181): n is a, c, g, or t
  misc_feature (185)..(195): n is a, c, g, or t
  misc_feature (198)..(200): n is a, c, g, or t
  misc_feature (202)..(203): n is a, c, g, or t
  misc_feature (208)..(210): n is a, c, g, or t
  misc_feature (212)..(220): n is a, c, g, or t
  misc_feature (223)..(225): n is a, c, g, or t
  misc_feature (228)..(231): n is a, c, g, or t
  misc_feature (234)..(243): n is a, c, g, or t
  misc_feature (245)..(251): n is a, c, g, or t
  misc_feature (253)..(253): n is a, c, g, or t
  misc_feature (255)..(255): n is a, c, g, or t
  misc_feature (261)..(262): n is a, c, g, or t
  misc_feature (264)..(269): n is a, c, g, or t
  misc_feature (271)..(272): n is a, c, g, or t
  misc_feature (274)..(274): n is a, c, g, or t
  misc_feature (277)..(280): n is a, c, g, or t
  misc_feature (282)..(282): n is a, c, g, or t
  misc_feature (285)..(286): n is a, c, g, or t
  misc_feature (288)..(288): n is a, c, g, or t
  misc_feature (290)..(290): n is a, c, g, or t
  misc_feature (292)..(293): n is a, c, g, or t
  misc_feature (295)..(298): n is a, c, g, or t
  misc_feature (300)..(301): n is a, c, g, or t
  misc_feature (304)..(307): n is a, c, g, or t
  misc_feature (309)..(309): n is a, c, g, or t
  misc_feature (311)..(311): n is a, c, g, or t
  misc_feature (313)..(315): n is a, c, g, or t
  misc_feature (317)..(323): n is a, c, g, or t
  misc_feature (326)..(332): n is a, c, g, or t
  misc_feature (336)..(341): n is a, c, g, or t
  misc_feature (343)..(344): n is a, c, g, or t
  misc_feature (346)..(351): n is a, c, g, or t
  misc_feature (353)..(357): n is a, c, g, or t
  misc_feature (359)..(360): n is a, c, g, or t
  misc_feature (364)..(366): n is a, c, g, or t
  misc_feature (368)..(369): n is a, c, g, or t
  misc_feature (371)..(371): n is a, c, g, or t
  misc_feature (373)..(373): n is a, c, g, or t
  misc_feature (375)..(375): n is a, c, g, or t
  misc_feature (379)..(382): n is a, c, g, or t
  misc_feature (384)..(386): n is a, c, g, or t
  misc_feature (388)..(388): n is a, c, g, or t
  misc_feature (392)..(392): n is a, c, g, or t
  misc_feature (395)..(398): n is a, c, g, or t
  misc_feature (400)..(400): n is a, c, g, or t
  misc_feature (402)..(407): n is a, c, g, or t
  misc_feature (409)..(409): n is a, c, g, or t
  misc_feature (411)..(411): n is a, c, g, or t
  misc_feature (413)..(413): n is a, c, g, or t
  misc_feature (419)..(420): n is a, c, g, or t
  misc_feature (422)..(427): n is a, c, g, or t
  misc_feature (430)..(431): n is a, c, g, or t
  misc_feature (433)..(434): n is a, c, g, or t
  misc_feature (437)..(439): n is a, c, g, or t
  misc_feature (441)..(445): n is a, c, g, or t
  misc_feature (448)..(448): n is a, c, g, or t
  misc_feature (451)..(451): n is a, c, g, or t
  misc_feature (590)..(590): n is a, c, g, or t
  misc_feature (593)..(593): n is a, c, g, or t
  misc_feature (677)..(677): n is a, c, g, or t
  misc_feature (692)..(692): n is a, c, g, or t
  misc_feature (701)..(701): n is a, c, g, or t
  misc_feature (725)..(725): n is a, c, g, or t
  misc_feature (813)..(813): n is a, c, g, or t
  misc_feature (898)..(898): n is a, c, g, or t
  misc_feature (1295)..(1295): n is a, c, g, or t
  misc_feature (1451)..(1451): n is a, c, g, or t
  misc_feature (1991)..(1991): n is a, c, g, or t
  misc_feature (2051)..(2051): n is a, c, g, or t
  misc_feature (2057)..(2057): n is a, c, g, or t
  misc_feature (2234)..(2234): n is a, c, g, or t
  misc_feature (2366)..(2366): n is a, c, g, or t
  misc_feature (2494)..(2494): n is a, c, g, or t
  misc_feature (2496)..(2496): n is a, c, g, or t
  misc_feature (2540)..(2540): n is a, c, g, or t
  misc_feature (2566)..(2567): n is a, c, g, or t
  misc_feature (2572)..(2572): n is a, c, g, or t
  misc_feature (2576)..(2576): n is a, c, g, or t
  misc_feature (2597)..(2597): n is a, c, g, or t
  misc_feature (3040)..(3041): n is a, c, g, or t
  misc_feature (3131)..(3131): n is a, c, g, or t
  misc_feature (3184)..(3184): n is a, c, g, or t
  misc_feature (3268)..(3268): n is a, c, g, or t
  misc_feature (3272)..(3272): n is a, c, g, or t
  misc_feature (3352)..(3354): n is a, c, g, or t
  misc_feature (3356)..(3357): n is a, c, g, or t
  misc_feature (3360)..(3360): n is a, c, g, or t
  misc_feature (3362)..(3364): n is a, c, g, or t
  misc_feature (3366)..(3380): n is a, c, g, or t
  misc_feature (3383)..(3383): n is a, c, g, or t
  misc_feature (3385)..(3385): n is a, c, g, or t
  misc_feature (3388)..(3397): n is a, c, g, or t
  misc_feature (3399)..(3401): n is a, c, g, or t
  misc_feature (3403)..(3405): n is a, c, g, or t
  misc_feature (3407)..(3407): n is a, c, g, or t
  misc_feature (3413)..(3414): n is a, c, g, or t
  misc_feature (3417)..(3418): n is a, c, g, or t
  misc_feature (3421)..(3421): n is a, c, g, or t
  misc_feature (3428)..(3428): n is a, c, g, or t
  misc_feature (3432)..(3434): n is a, c, g, or t
  misc_feature (3439)..(3439): n is a, c, g, or t
  misc_feature (3444)..(3445): n is a, c, g, or t
  misc_feature (3447)..(3447): n is a, c, g, or t
  misc_feature (3451)..(3452): n is a, c, g, or t
  misc_feature (3455)..(3455): n is a, c, g, or t
  misc_feature (3458)..(3462): n is a, c, g, or t
  misc_feature (3467)..(3468): n is a, c, g, or t
  misc_feature (3473)..(3473): n is a, c, g, or t
  misc_feature (3481)..(3483): n is a, c, g, or t
  misc_feature (3488)..(3488): n is a, c, g, or t
  misc_feature (3490)..(3493): n is a, c, g, or t
  misc_feature (3497)..(3498): n is a, c, g, or t
  misc_feature (3502)..(3502): n is a, c, g, or t
  misc_feature (3505)..(3505): n is a, c, g, or t
  misc_feature (3507)..(3507): n is a, c, g, or t
  misc_feature (3509)..(3510): n is a, c, g, or t
  misc_feature (3512)..(3514): n is a, c, g, or t
  misc_feature (3516)..(3516): n is a, c, g, or t
  misc_feature (3520)..(3520): n is a, c, g, or t
  misc_feature (3522)..(3522): n is a, c, g, or t
  misc_feature (3524)..(3524): n is a, c, g, or t
  misc_feature (3526)..(3526): n is a, c, g, or t
  misc_feature (3534)..(3534): n is a, c, g, or t
  misc_feature (3536)..(3536): n is a, c, g, or t
  misc_feature (3539)..(3539): n is a, c, g, or t
  misc_feature (3542)..(3543): n is a, c, g, or t
  misc_feature (3549)..(3549): n is a, c, g, or t
  misc_feature (3551)..(3568): n is a, c, g, or t
  misc_feature (3570)..(3570): n is a, c, g, or t
  misc_feature (3572)..(3575): n is a, c, g, or t
  misc_feature (3577)..(3580): n is a, c, g, or t
  misc_feature (3583)..(3586): n is a, c, g, or t
  misc_feature (3588)..(3592): n is a, c, g, or t
  misc_feature (3594)..(3608): n is a, c, g, or t
  misc_feature (3610)..(3617): n is a, c, g, or t
  misc_feature (3619)..(3626): n is a, c, g, or t
  misc_feature (3628)..(3634): n is a, c, g, or t
  misc_feature (3641)..(3641): n is a, c, g, or t
  misc_feature (3643)..(3646): n is a, c, g, or t
  misc_feature (3648)..(3650): n is a, c, g, or t
  misc_feature (3652)..(3655): n is a, c, g, or t
  misc_feature (3657)..(3659): n is a, c, g, or t
  misc_feature (3661)..(3662): n is a, c, g, or t
  misc_feature (3664)..(3673): n is a, c, g, or t
  misc_feature (3675)..(3680): n is a, c, g, or t
  misc_feature (3682)..(3684): n is a, c, g, or t
  misc_feature (3686)..(3686): n is a, c, g, or t
  misc_feature (3688)..(3693): n is a, c, g, or t
  misc_feature (3695)..(3695): n is a, c, g, or t
  misc_feature (3697)..(3698): n is a, c, g, or t
  misc_feature (3700)..(3706): n is a, c, g, or t
  misc_feature (3708)..(3709): n is a, c, g, or t
  misc_feature (3711)..(3713): n is a, c, g, or t
  misc_feature (3715)..(3734): n is a, c, g, or t
  misc_feature (3736)..(3737): n is a, c, g, or t
  misc_feature (3739)..(3743): n is a, c, g, or t
  misc_feature (3745)..(3747): n is a, c, g, or t
  misc_feature (3749)..(3767): n is a, c, g, or t
  misc_feature (3769)..(3769): n is a, c, g, or t
  misc_feature (3772)..(3781): n is a, c, g, or t
  misc_feature (3783)..(3789): n is a, c, g, or t
  misc_feature (3791)..(3803): n is a, c, g, or t
  misc_feature (3806)..(3806): n is a, c, g, or t
  misc_feature (3808)..(3809): n is a, c, g, or t
  misc_feature (3811)..(3815): n is a, c, g, or t
  misc_feature (3817)..(3823): n is a, c, g, or t
  misc_feature (3827)..(3839): n is a, c, g, or t
  misc_feature (3841)..(3843): n is a, c, g, or t
  misc_feature (3846)..(3846): n is a, c, g, or t
  misc_feature (3849)..(3853): n is a, c, g, or t
  misc_feature (3856)..(3860): n is a, c, g, or t
  misc_feature (3862)..(3874): n is a, c, g, or t
  misc_feature (3876)..(3880): n is a, c, g, or t
  misc_feature (3883)..(3890): n is a, c, g, or t
  misc_feature (3892)..(3894): n is a, c, g, or t
  misc_feature (3896)..(3896): n is a, c, g, or t
  misc_feature (3898)..(3898): n is a, c, g, or t
  misc_feature (3902)..(3919): n is a, c, g, or t
  misc_feature (3921)..(3923): n is a, c, g, or t
  misc_feature (3925)..(3926): n is a, c, g, or t
  misc_feature (3929)..(3929): n is a, c, g, or t
  misc_feature (3931)..(3931): n is a, c, g, or t
  misc_feature (3933)..(3938): n is a, c, g, or t
  misc_feature (3940)..(3940): n is a, c, g, or t
  misc_feature (3942)..(3950): n is a, c, g, or t
  misc_feature (3952)..(3952): n is a, c, g, or t
  misc_feature (3954)..(3956): n is a, c, g, or t
  misc_feature (3960)..(3962): n is a, c, g, or t
  misc_feature (3964)..(3978): n is a, c, g, or t
  misc_feature (3980)..(3986): n is a, c, g, or t
  misc_feature (3989)..(3989): n is a, c, g, or t
  misc_feature (3991)..(3994): n is a, c, g, or t
  misc_feature (3998)..(4000): n is a, c, g, or t
nnncnnnnnncccnncncncacnnnnnncnnncncncgnnnnnnnnnncnnnnnncnnnctanntnngtnnnngnnngngggnnnnngnannnnnnnngnnnngnnnnnncnnnnnnnnnagcnnnncnnnnnngtnnntnnntttttntnnnnnnnntnnncgnncnnnnnnttgtnnnnactnnnnnnnnnnnttnnntnnacacnnncnnnnnnnnncgnnnatnnnntgnnnnnnnnnngnnnnnnngngngggcgnngnnnnnntnncncgnnnngngcnncncncnngnnnncnncgnnnngngngnnnannnnnnnggnnnnnnncccnnnnnngnngnnnnnnannnnngnngcgnnnanngngngngggnnnncnnngngggnggnnnngncnnnnnngngngnttcttnncnnnnnntcnnanntcnnntnnnnnccncgngtgaagaggcaattagactgaaccgacgccgcgtttcgtttacgtttacaggaaattcatcgtgggctccgccgagctgtcggtgcccctcgcgcccgaccagttcgacgggtacgtgttcttcgacatcggcagtganctnaagagcgggtcgcaggtgctcggggacccggcgctggcgaggggtaagcccggccagggctacgggtacggcgccggcatcgcnatgcacacgccggtnggaccgatncggttcgaatacgcgttttcgganaagggcgccggtcgcatgcactgcgggcttgcgaggtcgttctaactgaaccttttaataacttaagagtactcgtaagtggttccgntcgtcgacagacagactcgctcgcgatgatcatatcatattgcgtcaatttgcaattaaaaatactggtacacgacggcggggtncgatatcccatccacgagcgctattcgcccgagacgtgaatcaccaccccaccgtctctccacctctcctctaggttattactcttacttgcgcccgcgcgtcggggcatccgggttcttcaagtcgaacatatcctcgagcgcgtgcatgttgacgagcgtttgggacacctgcgccggatccgtcccgtcggatcgaagcgcctgcatgggcccgtgcaggagcttgttcacgatcccgcggctcagctcctccaccgccttcatctgcttcttggtgagcccgtcgccgagcttgcccatcgccttctcgagctccgtcgcgcggatggtctcagccttaccgcgcagccgcttaatcgtgggcaccgtctccaacgagtccctccacgcctcnaagccagcctgctcctgcgcgagcagctcccgggcctcgtcagccgcgcgctcacgcgcctccttgttcgcctccaccagctccttcaggtcgtcgacgttgtacgcgatcgtgttggcgtcgtcgccgcaatccgcgtcgacgttgcgtggcacngcgatgtccaccagcctgcgcttcccgtcgacgcacgccgacgccacgggcatggacgcgaggtcatctttggtgacgatgacgccggtggacgccgcggtgaagatgacgtcgtgctcggcggcgaggggcaggaactcatccatcagcgccagcttgatgttcgcctcggggaaatccgccgcgagttcctcgacccgtccggcgcttctgttcacgatggtcatctcggtgcaccgcttggacacgaggtgcttgacgaggaggcgggacatcgtacccgcgcccacgatcatcacccggcacccgtcgaaggagttggacgggagcttcatctgcaccagctcggcggcggcggaggacacggaaacggcgcccgacgcgatggaagtctccgatcgcacgcgcttaccagcggtgatcgcagccttgaagaggccggagaggtgccgcccgaacccttccacgttctcgcccagcgcgaagacgttcttaacctgcgccaggatctggccctcgcccatgaccaccgagtctagncctccggaaaccttgagaaggtgcgaggtggcgtcttggtcccggagcagaaagaggtgntcgcgnagttcgtcgagcgggatgccgctgtactggctcatccactcctccacctcgcgcacgccgcggtgccagctcagggccaccacgtagatctccatgcggttgcacgtggagaggataccagcctcctcgacgtgcgggaaggacgtcagctgtttgatggcatcctcccacttgtcntcgggcaccgccatcttctcgcgcacctcgacggggcacgtgtggatggacagaccgatggacacgatcgaggacttggcctcggatgcgtagcctgcggattggggtaatgaagggtggatgtcggtgagngtgaagtggatagatatgggcggcgagtgccgggtgagggggaaaaaatatacggagtttgccacggtggcaccgggcgatacgcatgccgaaagtggcgtcgcacggcgcgttctcgcgggttccgngncgtcgcgacggtggaaaccacccgtggacgttcgcgacgtgctnaaacccggttcgaaacggtcgcgcgnncttcntgangcgcgtcaccgggtggtattnggggcggtcaggaaatgaaacttacgggaagcgccgcccatgctgcggaactgctcgagcgccttgctgctgtcgaccgcagccgcggagacgggccggagggtggtgtccggacgagcgttgtcgtgcgtcgtcggcggggtcaccacggccctggtcaccgtgttgcgcgcggtgcggaaggtcgcgcgcctcgcgccggcgcactttccgccggtggcgaaggcgctggatttcgccgaggatcgcttaggttccatcgcgcggacgcgaccggaaagcgccatcgcgggcgcggcgacggagtgagcgcccatcgctgagtcgttgaactaagccgcggtgttgttgcggaaacgcgccggactgttagaaccggtgcggtgcgtcgggacgcgtcacgggacgtgcgcgagctcgacggcgtgaacgggaatggttgnngattaccgatagcgaggacgtaaacgagcatgtaaagcgagatcctcggccaatcaggaggcgtgaaattggagatccacgatcgagcanttcaagaatctactcgaccaaatcttgctaaatcacatttttcaagactggtnttcatacgttccgaggtattttttgaccccgaaatcggatgcgtgtccacccgggaaaggagaataaacgccagtgtcatctgnttcngagcttcccgcatcaccagtttgacgcaccgaatcgcgggaagatatttttgagagagttcccaaaaagcagattcattnnnannggnannngnnnnnnnnnnnnnnnccngnccnnnnnnnnnngnnncnnnanaaaccnnacnnggnggaaccnattnnnggttnggccnngngggnnccnggnnnnnggggnnggttnggggtttnnnatttnannnnaaannaaanggncncnnannntnaaanantntntgtttttntnttnttnnaaaccncnnnnnnnnnnnnnnnnnncncnnnncnnnncannnnannnnnannnnnnnnnnnnnnngnnnnnnnncnnnnnnnncnnnnnnnccccccngnnnnannncnnnnannncnngnnnnnnnnnnannnnnncnnncncnnnnnncncnncnnnnnnncnncnnncnnnnnnnnnnnnnnnnnnnncnngnnnnngnnngnnnnnnnnnnnnnnnnnnncnccnnnnnnnnnnannnnnnnannnnnnnnnnnnngananngnnnnngnnnnnnncccnnnnnnnnnnnnncnnnagnccnnnnnccnnnnncnnnnnnnnnnnnncnnnnnccnnnnnnnngnnncncngggnnnnnnnnnnnnnnnnnngnnncnnggncncnnnnnngnannnnnnnnngngnnngggnnngnnnnnnnnnnnnnnngnnnnnnnttngnnnntttnnn

SEQ ID NO: 329 - DNA, 4000 bp, Escherichia coli
  misc_feature (1990)..(1990): n is a, c, g, or t
gaaaccaccacaccgcccacagtcacgggtgtcagacgtgcaacgggcgataatgcgcctgtgcgccccacctgaatgtcgatgccggccaatgtggtccatgccagttctgcggggaatttatgcgcaatcgcccaacgtggcgtggtagcgcggaaccccaaacgcgattgcagcgccaagtcattgactttgtagaccacaccatcaatgtcatagcccaacgtggcacgctgttcctcgatcatgcgatagtggtctaacagatcctcaaccctgtcacacagtcgggtcaacggattggttttgaaccccatttccgccaaccgttcaatcgcgcccatttgcgtatccgccaagggctgtgacaattccccccaagaataggcgaaaaaacacaaggggcgatccgccgttatcgcagcatccaactggcgcaacgatcctgctgccgcatttcgggggttggcaaacaccttgcctccgcggctggtgtggcgtgcatttagatcggcgaaatcacgatgcgacatgtacacttcgccgcgcacctctaggacatcgggggcgttttcgatggtatggggaatatcggcaatcgtgcgtgcgttggcggtgacgttttcgcccacctgaccatcgccacgcgttgcggcagagactagctgaccctgttcatagcgcaggctaagtgaaagcccgtcaattttcggctcagccgtaaaggcgatgggatcgccatcctcttgacccaaataccgtttgatccggtcgcgaaaatcgaacaattcatcatcgtcaaacgcattggccagcgacatcatgcgcacagtatgggttattttactaaacccatccgcagccggcgcgcccacctgcaaactggggctgtcgtcacggaccaaatcgggaaacgcggcctcaatcgcggcattgcgttgctttagccggtcatattctgcatcgctgatatctggcgcgtcattttggtggtatgctaggtttgccccccccaaaatcgcggccaagcgcgccaattcctgccgcgcctgttctggtgtcaaatctttcggttcggttgcctctgtcacgcgtagatgtcctatcactatcgtttatcccagtgatagttcccgcaccccgttgcgtccagtgacaaatcgcaatttaacgcgatatccgcgccctaggccgataccgcgaatgtatcaacgcctgtgccaattggcattggatcctttaacacatagccccggccccaaacggtttggatataggagtcgtcccctgtcgccacagccaattttttgcgcaatttgcagataaacacatcaataattttcaactcgggttcgtccattccaccgtaaaggtgattcaaaaacatttccttggtcaatgtcgttcccttgcgcagggacagcaattccaacatctgatattctttgcccgtcaaatgcacaggtgcgccgtcaacttcgaccgtcttggcatccaaattcaccgcaattcggcccgttttaataattgactgcgaatgccctttgctgcggcggatgatggcgtgaatgcgggcgaccaattcttcgcggtggaatggtttggtcaaataatcatcggccccaaatccaaagccacgtattttcgcctcggtatcgtcgttgcctgacaatatcaagatgggcgttgaaatgcgcgccaaacgcagctggcgcaacacgtcatagcccgtcatatcgggcagattcaaatccaataaaatcagatcgtaatcatatagtttcgctaaatcgataccctcttcgcccagatcggtggaatagacattcagattcgcatgggtcagcatcatttcaatgcttttcgctgtgtttggatcgtcctctaccaataatacacgcattcaagcctcctgctttacactcttgctgtaatttgcaccgaattggttaacgcaaggttaccgcttgataacttttaccaccacaanctatggttgtcgatacgctttgagcttggtgcatttcaatccatcgtgaccatgatccaaaaaatgcttgatccaactggtaaattcttcttcactcaggccatagcgctccaacgcttcgcgttgggtcaacaggccatagacaacggatcgcacgacgaccaatttccgcgacgcagtccagcgtgataaattcgcgtgtggtaaatcggcgaccgacagaatttgcccatcgggcaactttgcaaccctaggcctgcttgataactccttcattgtgaccctcatacttgtgaacggggtaaaaatgccgcgcttgggttaacagccgcttaaatcgtggggttgtgaatatttcaaattttcctatatttcagccaaacttgtaaccaaaggccaacgacatggatcaccccgtcaattcactgggatttgcaaaaccccccgccgatacgcgcgtcgttgtcgcgatgtccggcggcgtggacagttctgtcgtcgcagcccaactgaaatctcaaggctatgatgtcattggcgtgacattgcagctgtatgatcatggggcagccctggccaagaaaggcgcgtgttgcgcaggcatcgacattcacgatgcgcgccgcgtggccgaggatatggggtttccccattatgttctggattatgaaaacatttttcgcgatgccgttatcgaagaattcgccgacagctatctggcgggtgcaacgcctgtcccctgcatccgttgcaatgaacgggtaaaattcaaggatctgttggaaacggccaaagatctggatgccgattgcatggcaacggggcattatattcaacgcaaatccggcccgcatgggtccgaattacacagcgccacggatgccaaccgcgatcaaagctattttttgttttccacaacccaagatcaactggatttcctgcgctttcctttggggcatttggcgtccaaagctgaaacgcgtgaactggcggcgcaatatgggttggtcgtcgccgataaacccgatagccaagacatttgtttcgtacccgatggaaattacgccggtgttatcgaaaaattgcgccctggtgcggttgaacccggtgatattgtggatatggacggcactgttttgggccagcacaatggcgtgatccattacacaatcggccagcggcgcggtttagggatcggtggactggcaacaccgctgtatgttgttgggctggacgtggacaaaaaacacgtgatcgtgggcgaaaaagaacatctaaaaacccgccatgtcccgattaagcaggtcaactggttgggtgatacccccctgacatcgaaaagcgaatggcacatttccgtcaaagtccggtccacccgccccccgcgcgaagcgattttgcgccccatcaacgacaccgaagctgtggttgaattgctaaacccggaagagggcgtggcccccggtcaggcctgtgtattttatgaaacgggtggcagccgcatttttggaggcggttggatcaccaaacgcgcctagggtttttccgctaaaaacgcgtcaaaggcggccaaggttgccttggacacatgatgttcgatcccttcggcatccaattcggcggtttctggcggaacgccaactgcgatcaacaattgcaccacggtccgatggcgcgcgcgcacccgatcggccaatgcagccccttggtcggttaagaacaccccgcgataggggcgcgatgttgccaaaccttcgcgttttaggcgcgcaatcgctttggtcgcggtgggctgggccacgcccatgcgttcggcaatatcggcaacacgcgcttcgcccatctcagcgatcagatcgccaatcagctcgacataatcctcaagcaaagcgaccgcctgtttttcgcgggcacgggcaaatcgatcggcttgatcgtggggctgttcggggtggtctgtcattgatctgtaattatgcctttgtttgcatggcttgcccgccaactgcg

SEQ ID NO: 330 - DNA, 4000 bp, Escherichia coli
  misc_feature (1926)..(1926): n is a, c, g, or t
  misc_feature (1944)..(1944): n is a, c, g, or t
  misc_feature (1960)..(1960): n is a, c, g, or t
  misc_feature (1965)..(1965): n is a, c, g, or t
  misc_feature (1972)..(1972): n is a, c, g, or t
  misc_feature (1977)..(1977): n is a, c, g, or t
  misc_feature (1989)..(1989): n is a, c, g, or t
gacaactcgactacgctatggcatttaccggcaagctcacaatcgctgatttggcgatagaggagggggatgaaggcaatcaagaggccaatttagttgtccgtctcgacttcagtgattcactgggttcgaccaacgagaccacggtcacagtggactatgcaaccgaagatggtaccggagaggcggacgtggactacctaagtagcagtggaaccctcaccttctctccgggagagaccacaaagaccattccgctcaccattatcggtgatcttatcgatgaggcagatgaagcctttacccttaccctctctgatgcaagtcaggcccggttacccgtaggccatacagccatcaccattgaagatcaggatccggaacctgtcgtgatattcagtttcaccacagggcagtatctctatgaggaccagcagccactgtcactaaacttcaacctctcacagccctcaggtaaggagattgtcatcccctataccttgagcggaaccgccagtagccagcttgactataccctggccccgtcagcggagattcgcttgttgccgggggaaaccgctgcggcgctaaccctcacaccactggaagagagtcaatcggagaccaacgagacactctctatatcgataggatccccaactcatgccagctttgagggagaacagacccacaccgtgcgactggtggatgcgctggcaaccgtgattgagggagttgatgagatcacagcaggagtggactatgtgcctggtagactctacgccttaagttcggagtggaatccactcgtctgtggtgatgagagtgtcagtgaccaagctaactttgtattggccaaagccaatggcgcgggtcgtatagcggttgctgcacatgaggggatcttattgcgtgatgaactcgataacatgcgcttcaacacccagttgctggattggctcgcaacgcaagaggggggggtgggctataccaccggccaccgagagtgggtcaacacaaccaatgttaacccgctaatcaccgtacttgaggcggaaggtggctctctgcaagaggtaagtggaatagtcacagagcaacaacttgaagagctctcggtgttgattgtgggaaatagctgggagcagtttacgtccgatgagaagagtttgattgatttatggaaccaacagggaggagggttgctgcttgtaggattaggttggtcatggcccatgtataacagttcaacactgcctgaatacccgattaatcaacttgcagaaccgtttgagataatgtggttaggtggtacggtcaccgataccgatgcggccaatgaagtgcgctactccgagtttacctctagctgtgcgttgagcagagttccacttaatgatactggcatcacttggggagggagctatccaagtggaaataacgaatcctgtactggtgagaccattgaggcacaagactgctcccatggcagagatgtcacccataacgatgatagtgatggccatgcgggtttcagcttcaccaagctggactccagtggccatgagttggcagcaagtgccacggagtggggctgtgtcaaagacaatgtcaccgacttgatctgggaggtgaagacggatgatggtggtgttcacgataaggacaacgcctatcgctgggggggtatcagtgcaattggaagagctcatgctgatgtgaaaggaacctactacgatgattggaatgagttggtcaatggaaccaatagtgaaagcctctgtggctatagtgactggcgagtgccaactttggaagagttacgctcgatttccaataaatacagctacagacccgcaattgatacaaactacttccctaacacccctgcggcgtggttttggtcgtcttcgccctatgcctatnatagttactacgcatggntattgagtttcgatgncgggnacgatancaacnataaccggaacnatagctatcatgttcggttagtgcgtagtggacagtgattttgacttttttcttttcctttatgagaaagtgagatgagtgccaaatttccaatctatcgggatgccaataccctactactgcagatcgaacaggcggtgcggacctttcctcgctaccataaatataccattggtagtgaacttcgcagagccacaatggagctggtccgccagctctcgcgctctattaagtacgctgatcagcgtttgcgttgggttacagaggctcatgatacgctggatgacctcaaggtacagattcagttagccaaagagctcaaggccttccacagttttcggcagtatgagtccatcgcagcactggcgttcggggtctctaaacaggcctggggctggaaaaagaaattgcaacgcacgtcctctgaaaaggggatgcggggcctgaatggagttcagtcgtgaacttcagcgtgcctacttcactgtgcaccctgcacacctgtcaaagtccccctctcccgatgtcgtttatccgttggggggcactctacatcacaggtatttcagagcaatcggggtaccgtttacggatccccgtgcgtggaccaagggcagggaaactggcgtggttttggtcgtcttcgcccaatgccaataatagtaacaacgcatggaaattgagtttcgataacggaaacgataacaacaataaccggaacaataacaatcatgttcggttagtgcgtagtggaaagtgaagatggagtgtgtcaattaccaggacctctatcaggcagccatgcgctgcaaacaggggaagtccggtagtggtcaggcgcaggcgtatcatagccagctgattgaccgtctttttaccacactcgctgcgttgcaatcctatcaatggcgtccgggtccgatgcgctgctttatcgccaacaacggggtcaagccgcgtgagatccatgccccctactatgcggaccgtgtggtgcaccactggctggtccccagactggccgtactgattgagcccaaatttatccatcacagctgtgccaaccaggtgggtaaggggacccactttgccgtgaatgcattgcagaaaatgatgcggcaatatgatcgcccgtcacagagctactatctgcagctcgatatctacaacttcttctacacgatagatcgtgccacgctctaccagctactgcagcgtcatctgcaacaggcagttgtacgaggcaggctggagccagaccttggaaaagcatatctttggttggttcacaggcttctcttctcaccaatccaggtgatggtgcgcactcaaggttacaccattccgcctcataaacagtggctcaatacaccacctgagaaggggttgcccatcggcaatctcaccagccagttctttgctaacgtctatctcaatgaactggaccagtttgttaaacaccagcttaactgtcgccactatatccgttatgtggatgatatggtgttgctctcggagagtcgcgatcagctcgtcggctatcagcagaagattgcccaattcctccaccagcatctacagttgcggcttaaaccgggtgagaaactgcaaagggtgagccatggtgtcgactttctcggttatatcactcgaccccactaccgtttagtacgccgtagagtggtccacaaccttaagaacaagctgacagccatggagcgaaatatcattcagtataaagggagggggaagcagattaacggcaaggcggtggagccgctacgcgccctgctggcgagctattgggggcacctcagtcatgccagaagtacccacctgctgcagaaaattcttcgtcaattcccttggcttgagtggctgtttgaatttggaggtgaagggcttcgatgtcgctatcgtgcacccaggctcatctcaatgcaggagcagtggaactactacagtcagcgctatccgggttttgtactactgatgcagaaagggcattgct

SEQ ID NO: 331 - DNA, 4000 bp, Escherichia coli
  misc_feature (214)..(214): n is a, c, g, or t
  misc_feature (244)..(244): n is a, c, g, or t
  misc_feature (284)..(284): n is a, c, g, or t
  misc_feature (376)..(376): n is a, c, g, or t
  misc_feature (559)..(559): n is a, c, g, or t
  misc_feature (891)..(891): n is a, c, g, or t
  misc_feature (1276)..(1276): n is a, c, g, or t
  misc_feature (1990)..(1990): n is a, c, g, or t
  misc_feature (1992)..(1992): n is a, c, g, or t
  misc_feature (2005)..(2005): n is a, c, g, or t
  misc_feature (2168)..(2168): n is a, c, g, or t
  misc_feature (3120)..(3120): n is a, c, g, or t
  misc_feature (3149)..(3149): n is a, c, g, or t
  misc_feature (3719)..(3719): n is a, c, g, or t
  misc_feature (3981)..(3981): n is a, c, g, or t
cggcctgggccaaggcgttaatactagggaagcgggctataaatcgattgaagtaggggatgaccgtttgcacttgggtctgttgcagcatgatttcagaaatccagaccgggtaaggcgtcagcgacttttgccagggcaagtcatggcggccaaaaacgtcaaaccaagccagaaccttatccgcgaacccgtgtttcatgatcccaagagnccttttaaaagatctttcaacgcctctggngccttgttctcgatcgtttggtcgaggcgctgcttgactntatcctgcaatgccttgcgcgcaatctcagtgagcaggctttgcgctttatctcgatcgataccgcaatcgcttggtgacagcgctgctagngcgccttggcaacgagcgggccaggcgacgctggttaatgggccctttaccggtagcggtccatcggtcgcggcggccaagcgcagtgtcacctcgtagtcgaaatcggattcaaataggtcaaagccgccggtcgcgccaacggtcatgttctcgtaatttaaggtcgcaagttgcgcgctngacaggccggcgtgaaaggcatgggcgccgtttaacgtgtcaatcacgagatcatccggccaatcggcagcacccgatgactgctgagtcatctgatccagccttagtaggccctgtttgagtgtccggatatcgaccagggcctcctggatggaaaattggctggctccttttattgtctttgacagcgaagcgaggctcgcccccgcaaaggagagcgaggaagacacgctcagtttgcctaaggtttgttctgggacgagttgattgagatcgatttgcgtgaggttggcggcaagcgtcgtaaaggcctgttgttcataatcagagancatttcaagctggataccgccagaggccagttgaccggttaggcgggttgttagttttgattgcgcattgtttagatgcaggtgtgcatccgtcagagtccactgctttgctttgagtgatttaatccgcagatcgatcatcgcctgcgcactgcccagtgtctcaacgggtaatacgactgtgtcgggatcaagcggggtcgagggggatggctgtgcggcatcgcctccggcaagggggccgcctgggtttaattctaaacgactcagcctgagcgtcaggtcaattgacggggtcgtcaggtcgatcattgcctcgccattaaagtcgccgccgttgattcggcctgaaatgctcgatagctcgggtgccacatcggtgccntgcgccatggcggcaatcgtaagctcggtaatcggtgcaaggggcgacagttgaccggcaaaagcggtgttaaaaacattggtgttggtcaaggtgctactgatttcgagcgccagtctgatttttggctgcgtgatcgcggacacctcgccggttaatgtggttgtgagcccgagatggtcaatgcgcatttgctcgaaaacgaagacgtccgtttcaacctgataaacaccggagaggtcgctagcaaatgcgctcgcgtcttgaatagccgttgataaatcaccctgaagggaaaagccctcgagcacaacttgctgggtttcgaaatcataaagggcggtgccatcggactggccctcaaagacaatgcctaggtcggtatccgaataggcgagttcgtttttgagcaacaggctgagccgctcattggcataagtgcccgttactggacccaaagaggccgtaatctcaccagaaattgacgcgtcgacgtactcaatttcgatcgattcaactgtaaaagatgataacgccaggctgcggatcggggttgttgcggggtcagttgtttgcgttgtttcggggctctcgccggtatcgcctgcagcataattcgtttggccattggcatcgacaaagagatagagctttacagcgcccaatgtcacagcatcgatggttaatgcgcctgagcgcaagaggggcatgagntntacgtcaatggcnagggtatcgatgacggccgcgggctggttgcccagtccggctgaaacggcaacgccatccacacgaatcgcaagatccggccaaagttgccattcaaggttttcaaatcggatcgcgtagcccgtattagcggctaatcgctcggtgagtgcttcacgatatnggtctgggtctgccagtagcatgcgaacgccggcataggccgccccggccagtagggtaaggacgatgaggatgctgagggcaaattttgaaatgtgactcaagaggtgcattcctttgttcaggcaacgaagagtttaagcgctgttgcgcgtacggccaatgtttacgccgcggcttactgtgcgacggggctttattctgctatcttttgcctcgaatcaataggcaattggatacttctatgtcagctgttggaacagagtcgaacccattacgcgtggccgttatcggatccggcccatctgggttttatacggtcagtaatttactcaagcaaaccgatctcgtcgttgaagtggatgtgtttgatcgtttgccgacgccttacgggttggttcgagccggggtggcgccggatcatcaaaaggataagtccgtaacccgtgcctacgagaaaagcgccgccgcgccggggttccggtttttcggtaatgtggagtatggcacccacctgcatttggacgacttaaaagaacactaccatcaagtgatgttcacaacaggcagcccttttgaccgaaatttgggggtggctggcgaggaccttcttgggagtcactctgccaccgagtttgttgcctggtacaacgggcaccccgactttgccgaccgacagtttgatttgtcccaagagaacgtggttgtggtggggattggcaatgttgcgatggatgtcgcgcgaattctgtgtaaaaccgttgatgaactcaaagtcactgatattgccgatcacgcccttgcagcattaagcgaaagtaaggtgaagaatgtttatattttaggaagaaggggtccagctcaagccgccttcacaccgcctgaaataaaagagatgggcgagtttgcggaagccgatgtcaatattttagcaagcgaggcagtggtggatnccaattctcaaaagctgctcgatgacagncaggacaagaatgcgattaagaatgtagagacgataacggcctatgcctcgcgtgaaaatgccggcaagcccaggcagttgcatattcggttttgcgtctcaccgaccgagctggttgaagccgatggccgagtgggtgcggttaaactgatacaaaacgatttggtattggatgatcgagggcaattgaaagccgttgcaacggagcgcgaagaagtgattccggcgggccttgtgtttcgctcagtgggatatcgcgggcagccgttgccggatgtacccttcaacgacagttggggcaccattttaaacgaaggcggccgcgcagttgatgctgcgggcgatcaagtggttggcctctacaccgcgggttggatcaagcgcggtcccagtggggtgattggcaccaataaaacctgcgcgcaagaaaccgttgggttgatgatgcaagatcttcaggcgaaccgtttgtttgagccgagcgcgccgtctgccgaggccgcattgaaattgatccagagccgccaaccggactttgtcagctttgcggactggaaaaaaatagatgangcggaagtcgcgaagggcctcgcaagcgaccggccgagagtgaagtttacccgggttactgacatgctcgaggttgctcgcgcctaaccgactgccgctctgaccgctggcatcacttcattgatatagcgctcgagggcatcttcccgccagggtgcacgcagcgcgatgttgattagactcgcgccttgctgatggtaggccaagattttgtcaatggcttggcttggggtgcagaccaaagagcccgcgcgaatgcgtnctgcttgcggtccccagtc

SEQ ID NO: 332 - DNA, 4000 bp, Escherichia coli
  misc_feature (1)..(3): n is a, c, g, or t
  misc_feature (8)..(13): n is a, c, g, or t
  misc_feature (15)..(15): n is a, c, g, or t
  misc_feature (17)..(20): n is a, c, g, or t
  misc_feature (22)..(23): n is a, c, g, or t
  misc_feature (25)..(27): n is a, c, g, or t
  misc_feature (29)..(30): n is a, c, g, or t
  misc_feature (32)..(42): n is a, c, g, or t
  misc_feature (44)..(45): n is a, c, g, or t
  misc_feature (47)..(48): n is a, c, g, or t
  misc_feature (53)..(55): n is a, c, g, or t
  misc_feature (57)..(62): n is a, c, g, or t
  misc_feature (64)..(74): n is a, c, g, or t
  misc_feature (76)..(90): n is a, c, g, or t
  misc_feature (92)..(92): n is a, c, g, or t
  misc_feature (94)..(94): n is a, c, g, or t
  misc_feature (96)..(99): n is a, c, g, or t
  misc_feature (101)..(101): n is a, c, g, or t
  misc_feature (103)..(121): n is a, c, g, or t
  misc_feature (123)..(123): n is a, c, g, or t
  misc_feature (125)..(125): n is a, c, g, or t
  misc_feature (127)..(128): n is a, c, g, or t
  misc_feature (130)..(131): n is a, c, g, or t
  misc_feature (133)..(147): n is a, c, g, or t
  misc_feature (149)..(150): n is a, c, g, or t
  misc_feature (152)..(162): n is a, c, g, or t
  misc_feature (165)..(168): n is a, c, g, or t
  misc_feature (170)..(171): n is a, c, g, or t
  misc_feature (174)..(175): n is a, c, g, or t
  misc_feature (177)..(180): n is a, c, g, or t
  misc_feature (182)..(183): n is a, c, g, or t
  misc_feature (185)..(187): n is a, c, g, or t
  misc_feature (190)..(192): n is a, c, g, or t
  misc_feature (194)..(194): n is a, c, g, or t
  misc_feature (196)..(197): n is a, c, g, or t
  misc_feature (199)..(200): n is a, c, g, or t
  misc_feature (202)..(203): n is a, c, g, or t
  misc_feature (205)..(207): n is a, c, g, or t
  misc_feature (209)..(212): n is a, c, g, or t
  misc_feature (214)..(219): n is a, c, g, or t
  misc_feature (221)..(230): n is a, c, g, or t
  misc_feature (232)..(232): n is a, c, g, or t
  misc_feature (234)..(235): n is a, c, g, or t
  misc_feature (240)..(241): n is a, c, g, or t
  misc_feature (244)..(249): n is a, c, g, or t
  misc_feature (251)..(255): n is a, c, g, or t
  misc_feature (257)..(257): n is a, c, g, or t
  misc_feature (259)..(260): n is a, c, g, or t
  misc_feature (265)..(267): n is a, c, g, or t
  misc_feature (269)..(269): n is a, c, g, or t
  misc_feature (271)..(278): n is a, c, g, or t
  misc_feature (280)..(280): n is a, c, g, or t
  misc_feature (283)..(287): n is a, c, g, or t
  misc_feature (289)..(289): n is a, c, g, or t
  misc_feature (292)..(309): n is a, c, g, or t
  misc_feature (311)..(311): n is a, c, g, or t
  misc_feature (313)..(314): n is a, c, g, or t
  misc_feature (317)..(317): n is a, c, g, or t
  misc_feature (319)..(320): n is a, c, g, or t
  misc_feature (323)..(323): n is a, c, g, or t
  misc_feature (325)..(326): n is a, c, g, or t
  misc_feature (328)..(329): n is a, c, g, or t
  misc_feature (331)..(334): n is a, c, g, or t
  misc_feature (336)..(341): n is a, c, g, or t
  misc_feature (344)..(344): n is a, c, g, or t
  misc_feature (346)..(362): n is a, c, g, or t
  misc_feature (364)..(367): n is a, c, g, or t
  misc_feature (374)..(376): n is a, c, g, or t
  misc_feature (380)..(380): n is a, c, g, or t
  misc_feature (382)..(386): n is a, c, g, or t
  misc_feature (388)..(391): n is a, c, g, or t
  misc_feature (395)..(401): n is a, c, g, or t
  misc_feature (403)..(404): n is a, c, g, or t
  misc_feature (409)..(410): n is a, c, g, or t
  misc_feature (412)..(414): n is a, c, g, or t
  misc_feature (416)..(429): n is a, c, g, or t
  misc_feature (431)..(431): n is a, c, g, or t
  misc_feature (433)..(434): n is a, c, g, or t
  misc_feature (436)..(442): n is a, c, g, or t
  misc_feature (447)..(450): n is a, c, g, or t
  misc_feature (452)..(453): n is a, c, g, or t
  misc_feature (458)..(476): n is a, c, g, or t
  misc_feature (478)..(479): n is a, c, g, or t
  misc_feature (481)..(484): n is a, c, g, or t
  misc_feature (486)..(493): n is a, c, g, or t
  misc_feature (495)..(503): n is a, c, g, or t
  misc_feature (507)..(509): n is a, c, g, or t
  misc_feature (512)..(514): n is a, c, g, or t
  misc_feature (517)..(522): n is a, c, g, or t
  misc_feature (527)..(527): n is a, c, g, or t
  misc_feature (530)..(531): n is a, c, g, or t
  misc_feature (533)..(534): n is a, c, g, or t
  misc_feature (536)..(538): n is a, c, g, or t
  misc_feature (541)..(541): n is a, c, g, or t
  misc_feature (544)..(550): n is a, c, g, or t
  misc_feature (552)..(556): n is a, c, g, or t
  misc_feature (559)..(567): n is a, c, g, or t
  misc_feature (569)..(571): n is a, c, g, or t
  misc_feature (573)..(574): n is a, c, g, or t
  misc_feature (576)..(603): n is a, c, g, or t
  misc_feature (605)..(606): n is a, c, g, or t
  misc_feature (608)..(608): n is a, c, g, or t
  misc_feature (610)..(612): n is a, c, g, or t
  misc_feature (614)..(614): n is a, c, g, or t
  misc_feature (618)..(621): n is a, c, g, or t
  misc_feature (628)..(643): n is a, c, g, or t
  misc_feature (645)..(646): n is a, c, g, or t
  misc_feature (648)..(665): n is a, c, g, or t
  misc_feature (667)..(669): n is a, c, g, or t
  misc_feature (671)..(673): n is a, c, g, or t
  misc_feature (675)..(681): n is a, c, g, or t
  misc_feature (683)..(683): n is a, c, g, or t
  misc_feature (685)..(693): n is a, c, g, or t
  misc_feature (695)..(708): n is a, c, g, or t
  misc_feature (712)..(717): n is a, c, g, or t
  misc_feature (719)..(720): n is a, c, g, or t
  misc_feature (723)..(735): n is a, c, g, or t
  misc_feature (737)..(737): n is a, c, g, or t
  misc_feature (739)..(747): n is a, c, g, or t
  misc_feature (750)..(752): n is a, c, g, or t
  misc_feature (760)..(761): n is a, c, g, or t
  misc_feature (765)..(767): n is a, c, g, or t
  misc_feature (774)..(775): n is a, c, g, or t
  misc_feature (778)..(779): n is a, c, g, or t
  misc_feature (784)..(800): n is a, c, g, or t
  misc_feature (803)..(803): n is a, c, g, or t
  misc_feature (805)..(814): n is a, c, g, or t
  misc_feature (817)..(821): n is a, c, g, or t
  misc_feature (823)..(833): n is a, c, g, or t
  misc_feature (835)..(837): n is a, c, g, or t
  misc_feature (839)..(848): n is a, c, g, or t
  misc_feature (851)..(854): n is a, c, g, or t
  misc_feature (857)..(859): n is a, c, g, or t
  misc_feature (861)..(863): n is a, c, g, or t
  misc_feature (865)..(865): n is a, c, g, or t
  misc_feature (868)..(868): n is a, c, g, or t
  misc_feature (871)..(871): n is a, c, g, or t
  misc_feature (873)..(880): n is a, c, g, or t
  misc_feature (885)..(887): n is a, c, g, or t
  misc_feature (889)..(889): n is a, c, g, or t
  misc_feature (892)..(914): n is a, c, g, or t
  misc_feature (916)..(931): n is a, c, g, or t
  misc_feature (933)..(943): n is a, c, g, or t
  misc_feature (945)..(946): n is a, c, g, or t
  misc_feature (948)..(962): n is a, c, g, or t
  misc_feature (964)..(964): n is a, c, g, or t
  misc_feature (966)..(966): n is a, c, g, or t
  misc_feature (968)..(969): n is a, c, g, or t
  misc_feature (971)..(976): n is a, c, g, or t
  misc_feature (979)..(980): n is a, c, g, or t
  misc_feature (982)..(985): n is a, c, g, or t
  misc_feature (987)..(992): n is a, c, g, or t
  misc_feature (994)..(994): n is a, c, g, or t
  misc_feature (997)..(997): n is a, c, g, or t
  misc_feature (1000)..(1002): n is a, c, g, or t
  misc_feature (1004)..(1011): n is a, c, g, or t
  misc_feature (1013)..(1017): n is a, c, g, or t
  misc_feature (1019)..(1019): n is a, c, g, or t
  misc_feature (1023)..(1024): n is a, c, g, or t
  misc_feature (1026)..(1030): n is a, c, g, or t
  misc_feature (1032)..(1033): n is a, c, g, or t
  misc_feature (1038)..(1042): n is a, c, g, or t
  misc_feature (1045)..(1048): n is a, c, g, or t
  misc_feature (1050)..(1051): n is a, c, g, or t
  misc_feature (1053)..(1054): n is a, c, g, or t
  misc_feature (1057)..(1057): n is a, c, g, or t
  misc_feature (1061)..(1061): n is a, c, g, or t
  misc_feature (1064)..(1067): n is a, c, g, or t
  misc_feature (1069)..(1070): n is a, c, g, or t
  misc_feature (1072)..(1072): n is a, c, g, or t
  misc_feature (1074)..(1075): n is a, c, g, or t
  misc_feature (1078)..(1081): n is a, c, g, or t
  misc_feature (1085)..(1089): n is a, c, g, or t
  misc_feature (1091)..(1096): n is a, c, g, or t
  misc_feature (1098)..(1099): n is a, c, g, or t
  misc_feature (1101)..(1111): n is a, c, g, or t
  misc_feature (1115)..(1122): n is a, c, g, or t
  misc_feature (1124)..(1125): n is a, c, g, or t
  misc_feature (1128)..(1132): n is a, c, g, or t
  misc_feature (1135)..(1135): n is a, c, g, or t
  misc_feature (1137)..(1137): n is a, c, g, or t
  misc_feature (1140)..(1144): n is a, c, g, or t
  misc_feature (1146)..(1146): n is a, c, g, or t
  misc_feature (1149)..(1150): n is a, c, g, or t
  misc_feature (1153)..(1155): n is a, c, g, or t
  misc_feature (1159)..(1165): n is a, c, g, or t
  misc_feature (1167)..(1171): n is a, c, g, or t
  misc_feature (1173)..(1176): n is a, c, g, or t
  misc_feature (1178)..(1179): n is a, c, g, or t
  misc_feature (1182)..(1183): n is a, c, g, or t
  misc_feature (1186)..(1189): n is a, c, g, or t
  misc_feature (1191)..(1199): n is a, c, g, or t
  misc_feature (1203)..(1204): n is a, c, g, or t
  misc_feature (1206)..(1207): n is a, c, g, or t
  misc_feature (1209)..(1210): n is a, c, g, or t
  misc_feature (1212)..(1213): n is a, c, g, or t
  misc_feature (1215)..(1223): n is a, c, g, or t
  misc_feature (1226)..(1227): n is a, c, g, or t
  misc_feature (1230)..(1230): n is a, c, g, or t
  misc_feature (1235)..(1235): n is a, c, g, or t
  misc_feature (1237)..(1242): n is a, c, g, or t
  misc_feature (1244)..(1244): n is a, c, g, or t
  misc_feature (1247)..(1247): n is a, c, g, or t
  misc_feature (1250)..(1250): n is a, c, g, or t
  misc_feature (1252)..(1252): n is a, c, g, or t
  misc_feature (1254)..(1263): n is a, c, g, or t
  misc_feature (1265)..(1271): n is a, c, g, or t
  misc_feature (1276)..(1288): n is a, c, g, or t
  misc_feature (1290)..(1295): n is a, c, g, or t
  misc_feature (1298)..(1298): n is a, c, g, or t
  misc_feature (1300)..(1302): n is a, c, g, or t
  misc_feature (1305)..(1312): n is a, c, g, or t
  misc_feature (1314)..(1319): n is a, c, g, or t
  misc_feature (1321)..(1321): n is a, c, g, or t
  misc_feature (1324)..(1335): n is a, c, g, or t
  misc_feature (1337)..(1337): n is a, c, g, or t
  misc_feature (1339)..(1340): n is a, c, g, or t
  misc_feature (1342)..(1342): n is a, c, g, or t
  misc_feature (1348)..(1353): n is a, c, g, or t
  misc_feature (1357)..(1360): n is a, c, g, or t
  misc_feature (1362)..(1369): n is a, c, g, or t
  misc_feature (1372)..(1377): n is a, c, g, or t
  misc_feature (1379)..(1379): n is a, c, g, or t
  misc_feature (1383)..(1383): n is a, c, g, or t
  misc_feature (1385)..(1385): n is a, c, g, or t
  misc_feature (1387)..(1389): n is a, c, g, or t
  misc_feature (1395)..(1396): n is a, c, g, or t
  misc_feature (1398)..(1400): n is a, c, g, or t
  misc_feature (1402)..(1405): n is a, c, g, or t
  misc_feature (1410)..(1410): n is a, c, g, or t
  misc_feature (1414)..(1415): n is a, c, g, or t
  misc_feature (1419)..(1419): n is a, c, g, or t
  misc_feature (1421)..(1423): n is a, c, g, or t
  misc_feature (1425)..(1425): n is a, c, g, or t
  misc_feature (1427)..(1428): n is a, c, g, or t
  misc_feature (1431)..(1431): n is a, c, g, or t
  misc_feature (1438)..(1440): n is a, c, g, or t
  misc_feature (1442)..(1442): n is a, c, g, or t
  misc_feature (1445)..(1445): n is a, c, g, or t
  misc_feature (1447)..(1448): n is a, c, g, or t
  misc_feature (1450)..(1452): n is a, c, g, or t
  misc_feature (1454)..(1454): n is a, c, g, or t
  misc_feature (1456)..(1457): n is a, c, g, or t
  misc_feature (1464)..(1465): n is a, c, g, or t
  misc_feature (1467)..(1467): n is a, c, g, or t
  misc_feature (1471)..(1473): n is a, c, g, or t
  misc_feature (1476)..(1479): n is a, c, g, or t
  misc_feature (1490)..(1490): n is a, c, g, or t
  misc_feature (1499)..(1499): n is a, c, g, or t
  misc_feature (1508)..(1508): n is a, c, g, or t
  misc_feature (1732)..(1732): n is a, c, g, or t
  misc_feature (1749)..(1749): n is a, c, g, or t
  misc_feature (2371)..(2371): n is a, c, g, or t
  misc_feature (3761)..(3761): n is a, c, g, or t
nnnggggnnnnnngncnnnngnntnnnanncnnnnnnnnnnngnnannaaaannngnnnnnnannnnnnnnnnntnnnnnnnnnnnnnnngngnannnngngnnnnnnnnnnnnnnnnnnncngngnnannannnnnnnnnnnnnnntnntnnnnnnnnnnnggnnnnannggnngnnnngnngnnngtnnntntnngnngnnannncnnnngnnnnnncnnnnnnnnnncncnnaaaannacnnnnnnannnnntngnnggggnnngngnnnnnnnngntgnnnnngnaannnnnnnnnnnnnnnnnngnannacnannggngnngnngnnnncnnnnnnaanannnnnnnnnnnnnnnnnannnnggggggnnnaaangnnnnnannnncccnnnnnnncnnccccnnannngnnnnnnnnnnnnnntngnngnnnnnnnccccnnnngnnccccnnnnnnnnnnnnnnnnnnncnncnnnngnnnnnnnncnnnnnnnnnaaannnaannnaannnnnnggggnccnncnnannnggnggnnnnnnngnnnnnttnnnnnnnnncnnnannannnnnnnnnnnnnnnnnnnnnnnnnnnncnncncnnnangggnnnnttttttnnnnnnnnnnnnnnnngnngnnnnnnnnnnnnnnnnnncnnntnnngnnnnnnntngnnnnnnnnngnnnnnnnnnnnnnncccnnnnnntnnttnnnnnnnnnnnnntngnnnnnnnnnggnnnaaaacccnncttnnnggggggnnggnnggggnnnnnnnnnnnnnnnnnggncnnnnnnnnnnggnnnnncnnnnnnnnnnnannncnnnnnnnnnnggnnnnaannncnnngnggnggngnnnnnnnnaaaannngnccnnnnnnnnnnnnnnnnnnnnnnncnnnnnnnnnnnnnnnngnnnnnnnnnnnanngnnnnnnnnnnnnnnncncngnnannnnnnccnngnnnntnnnnnncnccnccnnncnnnnnnnnannnnngntttnncnnnnngnnttttnnnnnccnnnnanngnnggnggcnccnnnngnngngnnggnnnntggnnnnnannnnnnannannnnnnnnnnngggnnnnnnnngnnggnnnnnccncnttnnnnngnagnnggnnntttnnnnnnncnnnnngnnnnannaannaannnntnnnnnnnnntttnngnntnntnntnnnnnnnnnaannaanttttnannnnnntnttnttnanannnnnnnnnncnnnnnnnggggnnnnnnnnnnnnngnnnnnngcncnnnttnnnnnnnngnnnnnncncgnnnnnnnnnnnncngnncnccccannnnnncccnnnnannnnnnnnaannnnnncntttncnannntgggcnnannncnnnngttgntagnncacncnnntnannagnggggggnnngntgntnnannncntnngggcccnncntttnnnaannnnttgcaaatctnaaggttggncgcagagangagcagttcttaaaataacgatttttgttctttgaaagtctagggtaaatataatgtaagcaggtaaaataaacgcctagaatagtagcgtttgcataaaccagttacagcaattgatggatgccttggcttcatcaggcgatgaaggacgcagcaagctgcgataagcttcggatagcggcacacacgctttgacccggagatttccgaatggggaaacccgncaccgataatacggtgncacttcaggatgaatacatagtcctgatagagcaatacgcggcgaagtgaaacatctcagtaaccgcaggaaaagaaagagaatcgattccgtaagtagtggcgagcgaaagcggaacagcccaaaccagagggatttatccctttggggttgtaggaccacaacgtgaaatgcaacggttagacgaacactctggaaagagtgaccaaagagggtgacagtcccttagtcgaaaacccgagcaaatctagtggtatcctgagtagcaccggacacgtgaaacccggtgtgaatccatgccgaccacggcataaggctaaatactcgatgaagaccgatagtgaactagtaccgcgagggaaaggtgaaaagcacccctgttaggggagtgaaatagtaactgaaatcaattgctaacaagtcagtgggagctcccatgtggagtcaccgcttgccttttgtataatgagtctgcgagttattgtctgtagcaagcttaagccggtacccggtgcaagcgcagcgaaagcgagtccgaatagggcgtctagttgctggcaatagacccgaagcggaggtgatctaaccatgaccaggatgaagctgcggtaaaacgcagtgnaggtccgaaccggttactcttgagaaagtatcggatgagttgtggttaggagcgaaagactaatcaaaccccgtgatagctggttctttccgaaatatatttaggtatagcgtctggtgctgatctatggaggtagagcactaaataagctagggcccctaccggggtactgaacttaattaaactccgaatgccatagagtgaagccaggcagtcagacggcgggtgataaggtccgtcgtcgagaggagaatagtccagaccaccagttaaggtcccaaaatatggctcagtggaaaaggatgtgattttgcttagacaatggggatgttggcttagaggcagccatcatttaaacagtgcgtaacagctgacccatcgagcgaaattgcgccgaaaatgatcgggacttaagccatataccgaagctgtggattcaccgcaaggtgagtagtaggaaagcgtcctaagtgctgcgaagcggaaggggtaaccgaccgtggagtgcttaggagtgagaatgcagacataagtaacgataaagatggttgaattccatctcgccgaaatcccaaggattcctggggaaggttcgtccgcccagggttagtcgggtgctaagacgaggccgtaaggagtagtcgatgccaagctggtttaatattccagcaccaccggatttgcgtttgacccaaggagtgacggagaaagttagaacagcgacgtgttgaatcgtcgtcgaagctcgtaggctgtctggggataaaagaccagataaggctgaaaagcgataggaccctgaagctacggccgaaggggattgttcgatactacgcttccaagaaaagcttcgtggttagcaagtcaggtgcccgtaccgtaaaccgacacaggtgggatagatgagtattctaaggcgcgcaggttaactctctctaaggaactcggcaaattgaccccgtatcttcggtataaggggtgccccgcaaggggccgcagtgaaccgcttcaaccgactgtttagcaaaaacacagctctctgctaagtcgcaagacgacgtatagggagtgacacgtgaccaatgcggaaaggtgaaaacgtgaggtgcaagcttcgcgtctaagcccccgtgaatgtcggccgtaactataacggtcctaaggtagcgaaattccttgtcgggtaagttccgacccgcacgaatcgtgtaacgagttgaaggctgtctcggagagatgcctggtgaaattgtagtggcggtgaagatgccgcctacccgcagcaggacggaaagaccctatgcacctttactgtaagctgttattgtcgcttgatttttaatacgtagaataggtgggagactttgaagcccggttccaggatcgggcngagtcgaaatgtgaaataccactttttaattgttaggcgtctaaccccgacccattatctgggcgtgggacagtgatagcaggtcagttttactggggcggtatcctccaaaagagtaacggaggatttcgaaggttccctcagcccggtcggtaatcgggctatagagcgcatgagtataagggagctttactgtgagacctacaagtcgagcagttgcgaaagcaggatcaagtgat

SEQ ID NO: 333 - DNA, 4000 bp, Escherichia coli
  misc_feature (11)..(11): n is a, c, g, or t
  misc_feature (36)..(36): n is a, c, g, or t
  misc_feature (51)..(51): n is a, c, g, or t
  misc_feature (57)..(57): n is a, c, g, or t
  misc_feature (60)..(60): n is a, c, g, or t
  misc_feature (105)..(105): n is a, c, g, or t
  misc_feature (129)..(129): n is a, c, g, or t
  misc_feature (135)..(135): n is a, c, g, or t
  misc_feature (168)..(168): n is a, c, g, or t
  misc_feature (180)..(180): n is a, c, g, or t
  misc_feature (189)..(189): n is a, c, g, or t
  misc_feature (204)..(204): n is a, c, g, or t
  misc_feature (216)..(216): n is a, c, g, or t
  misc_feature (255)..(255): n is a, c, g, or t
  misc_feature (270)..(270): n is a, c, g, or t
  misc_feature (288)..(288): n is a, c, g, or t
  misc_feature (303)..(303): n is a, c, g, or t
  misc_feature (325)..(325): n is a, c, g, or t
  misc_feature (327)..(327): n is a, c, g, or t
  misc_feature (330)..(330): n is a, c, g, or t
  misc_feature (333)..(333): n is a, c, g, or t
  misc_feature (339)..(339): n is a, c, g, or t
  misc_feature (344)..(345): n is a, c, g, or t
  misc_feature (354)..(354): n is a, c, g, or t
  misc_feature (360)..(360): n is a, c, g, or t
  misc_feature (369)..(369): n is a, c, g, or t
  misc_feature (375)..(375): n is a, c, g, or t
  misc_feature (384)..(384): n is a, c, g, or t
  misc_feature (396)..(396): n is a, c, g, or t
  misc_feature (414)..(414): n is a, c, g, or t
  misc_feature (417)..(417): n is a, c, g, or t
  misc_feature (420)..(420): n is a, c, g, or t
  misc_feature (432)..(432): n is a, c, g, or t
  misc_feature (441)..(441): n is a, c, g, or t
  misc_feature (444)..(444): n is a, c, g, or t
  misc_feature (468)..(468): n is a, c, g, or t
  misc_feature (498)..(498): n is a, c, g, or t
  misc_feature (510)..(510): n is a, c, g, or t
  misc_feature (519)..(519): n is a, c, g, or t
  misc_feature (522)..(522): n is a, c, g, or t
  misc_feature (537)..(537): n is a, c, g, or t
  misc_feature (555)..(555): n is a, c, g, or t
  misc_feature (579)..(579): n is a, c, g, or t
  misc_feature (588)..(588): n is a, c, g, or t
  misc_feature (597)..(597): n is a, c, g, or t
  misc_feature (621)..(621): n is a, c, g, or t
  misc_feature (645)..(645): n is a, c, g, or t
  misc_feature (663)..(663): n is a, c, g, or t
  misc_feature (669)..(669): n is a, c, g, or t
  misc_feature (681)..(681): n is a, c, g, or t
  misc_feature (684)..(684): n is a, c, g, or t
  misc_feature (693)..(693): n is a, c, g, or t
  misc_feature (729)..(729): n is a, c, g, or t
  misc_feature (744)..(744): n is a, c, g, or t
  misc_feature (774)..(774): n is a, c, g, or t
  misc_feature (804)..(804): n is a, c, g, or t
  misc_feature (837)..(837): n is a, c, g, or t
  misc_feature (840)..(840): n is a, c, g, or t
  misc_feature (843)..(843): n is a, c, g, or t
  misc_feature (855)..(855): n is a, c, g, or t
  misc_feature (870)..(870): n is a, c, g, or t
  misc_feature (882)..(882): n is a, c, g, or t
  misc_feature (891)..(891): n is a, c, g, or t
  misc_feature (903)..(903): n is a, c, g, or t
  misc_feature (926)..(926): n is a, c, g, or t
  misc_feature (941)..(941): n is a, c, g, or t
  misc_feature (948)..(948): n is a, c, g, or t
  misc_feature (975)..(975): n is a, c, g, or t
  misc_feature (999)..(999): n is a, c, g, or t
  misc_feature (1002)..(1002): n is a, c, g, or t
  misc_feature (1005)..(1005): n is a, c, g, or t
  misc_feature (1017)..(1018): n is a, c, g, or t
  misc_feature (1035)..(1035): n is a, c, g, or t
  misc_feature (1047)..(1047): n is a, c, g, or t
  misc_feature (1059)..(1059): n is a, c, g, or t
  misc_feature (1066)..(1066): n is a, c, g, or t
  misc_feature (1072)..(1072): n is a, c, g, or t
  misc_feature (1076)..(1077): n is a, c, g, or t
  misc_feature (1083)..(1083): n is a, c, g, or t
  misc_feature (1097)..(1097): n is a, c, g, or t
  misc_feature (2387)..(2387): n is a, c, g, or t
  misc_feature (2396)..(2397): n is a, c, g, or t
  misc_feature (2412)..(2412): n is a, c, g, or t
  misc_feature (2586)..(2586): n is a, c, g, or t
  misc_feature (2652)..(2652): n is a, c, g, or t
  misc_feature (2691)..(2691): n is a, c, g, or t
  misc_feature (2697)..(2697): n is a, c, g, or t
  misc_feature (2706)..(2706): n is a, c, g, or t
  misc_feature (2728)..(2728): n is a, c, g, or t
  misc_feature (2739)..(2740): n is a, c, g, or t
  misc_feature (2744)..(2744): n is a, c, g, or t
  misc_feature (2746)..(2748): n is a, c, g, or t
  misc_feature (2750)..(2752): n is a, c, g, or t
  misc_feature (2756)..(2767): n is a, c, g, or t
  misc_feature (2772)..(2772): n is a, c, g, or t
  misc_feature (2774)..(2775): n is a, c, g, or t
  misc_feature (2777)..(2779): n is a, c, g, or t
  misc_feature (2781)..(2781): n is a, c, g, or t
  misc_feature (2783)..(2786): n is a, c, g, or t
  misc_feature (2788)..(2793): n is a, c, g, or t
  misc_feature (2796)..(2800): n is a, c, g, or t
  misc_feature (2802)..(2802): n is a, c, g, or t
  misc_feature (2804)..(2804): n is a, c, g, or t
  misc_feature (2807)..(2807): n is a, c, g, or t
  misc_feature (2809)..(2810): n is a, c, g, or t
  misc_feature (2812)..(2813): n is a, c, g, or t
  misc_feature (2816)..(2816): n is a, c, g, or t
  misc_feature (2818)..(2818): n is a, c, g, or t
  misc_feature (2820)..(2820): n is a, c, g, or t
  misc_feature (2822)..(2823): n is a, c, g, or t
  misc_feature (2825)..(2825): n is a, c, g, or t
  misc_feature (2827)..(2827): n is a, c, g, or t
  misc_feature (2830)..(2830): n is a, c, g, or t
  misc_feature (2832)..(2841): n is a, c, g, or t
  misc_feature (2843)..(2844): n is a, c, g, or t
  misc_feature (2846)..(2846): n is a, c, g, or t
  misc_feature (2848)..(2851): n is a, c, g, or t
  misc_feature (2854)..(2857): n is a, c, g, or t
  misc_feature (2859)..(2859): n is a, c, g, or t
  misc_feature (2862)..(2863): n is a, c, g, or t
  misc_feature (2865)..(2866): n is a, c, g, or t
  misc_feature (2868)..(2870): n is a, c, g, or t
  misc_feature (2873)..(2873): n is a, c, g, or t
  misc_feature (2876)..(2876): n is a, c, g, or t
  misc_feature (2878)..(2881): n is a, c, g, or t
  misc_feature (2883)..(2883): n is a, c, g, or t
  misc_feature (2885)..(2885): n is a, c, g, or t
  misc_feature (2887)..(2888): n is a, c, g, or t
  misc_feature (2891)..(2891): n is a, c, g, or t
  misc_feature (2893)..(2893): n is a, c, g, or t
  misc_feature (2895)..(2898): n is a, c, g, or t
  misc_feature (2900)..(2904): n is a, c, g, or t
  misc_feature (2907)..(2910): n is a, c, g, or t
  misc_feature (2912)..(2912): n is a, c, g, or t
  misc_feature (2914)..(2916): n is a, c, g, or t
  misc_feature (2919)..(2919): n is a, c, g, or t
  misc_feature (2924)..(2924): n is a, c, g, or t
  misc_feature (2926)..(2929): n is a, c, g, or t
  misc_feature (2931)..(2931): n is a, c, g, or t
  misc_feature (2934)..(2935): n is a, c, g, or t
  misc_feature (2938)..(2940): n is a, c, g, or t
  misc_feature (2942)..(2943): n is a, c, g, or t
  misc_feature (2946)..(2946): n is a, c, g, or t
  misc_feature (2948)..(2959): n is a, c, g, or t
  misc_feature (2962)..(2963): n is a, c, g, or t
  misc_feature (2965)..(2973): n is a, c, g, or t
  misc_feature (2975)..(2977): n is a, c, g, or t
  misc_feature (2979)..(2982): n is a, c, g, or t
  misc_feature (2985)..(2986): n is a, c, g, or t
  misc_feature (2988)..(2997): n is a, c, g, or t
  misc_feature (2999)..(3001): n is a, c, g, or t
  misc_feature (3003)..(3005): n is a, c, g, or t
  misc_feature (3007)..(3010): n is a, c, g, or t
  misc_feature (3012)..(3013): n is a, c, g, or t
  misc_feature (3016)..(3028): n is a, c, g, or t
  misc_feature (3030)..(3033): n is a, c, g, or t
  misc_feature (3036)..(3049): n is a, c, g, or t
  misc_feature (3051)..(3054): n is a, c, g, or t
  misc_feature (3056)..(3061): n is a, c, g, or t
  misc_feature (3063)..(3064): n is a, c, g, or t
  misc_feature (3066)..(3071): n is a, c, g, or t
  misc_feature (3073)..(3073): n is a, c, g, or t
  misc_feature (3076)..(3079): n is a, c, g, or t
  misc_feature (3082)..(3082): n is a, c, g, or t
  misc_feature (3084)..(3086): n is a, c, g, or t
  misc_feature (3088)..(3091): n is a, c, g, or t
  misc_feature (3093)..(3094): n is a, c, g, or t
  misc_feature (3096)..(3098): n is a, c, g, or t
  misc_feature (3102)..(3106): n is a, c, g, or t
  misc_feature (3109)..(3110): n is a, c, g, or t
  misc_feature (3113)..(3113): n is a, c, g, or t
  misc_feature (3115)..(3117): n is a, c, g, or t
  misc_feature (3119)..(3120): n is a, c, g, or t
  misc_feature (3122)..(3123): n is a, c, g, or t
  misc_feature (3127)..(3127): n is a, c, g, or t
  misc_feature (3129)..(3129): n is a, c, g, or t
  misc_feature (3131)..(3134): n is a, c, g, or t
  misc_feature (3136)..(3139): n is a, c, g, or t
  misc_feature (3142)..(3143): n is a, c, g, or t
  misc_feature (3145)..(3147): n is a, c, g, or t
  misc_feature (3149)..(3152): n is a, c, g, or t
  misc_feature (3154)..(3155): n is a, c, g, or t
  misc_feature (3159)..(3162): n is a, c, g, or t
  misc_feature (3165)..(3166): n is a, c, g, or t
  misc_feature (3169)..(3170): n is a, c, g, or t
  misc_feature (3175)..(3178): n is a, c, g, or t
  misc_feature (3181)..(3182): n is a, c, g, or t
  misc_feature (3184)..(3203): n is a, c, g, or t
  misc_feature (3205)..(3211): n is a, c, g, or t
  misc_feature (3213)..(3213): n is a, c, g, or t
  misc_feature (3215)..(3224): n is a, c, g, or t
  misc_feature (3226)..(3227): n is a, c, g, or t
  misc_feature (3231)..(3234): n is a, c, g, or t
  misc_feature (3237)..(3237): n is a, c, g, or t
  misc_feature (3239)..(3239): n is a, c, g, or t
  misc_feature (3241)..(3244): n is a, c, g, or t
  misc_feature (3246)..(3247): n is a, c, g, or t
  misc_feature (3252)..(3254): n is a, c, g, or t
  misc_feature (3257)..(3257): n is a, c, g, or t
  misc_feature (3259)..(3259): n is a, c, g, or t
  misc_feature (3262)..(3262): n is a, c, g, or t
  misc_feature (3264)..(3266): n is a, c, g, or t
  misc_feature (3268)..(3269): n is a, c, g, or t
  misc_feature (3271)..(3274): n is a, c, g, or t
  misc_feature (3277)..(3279): n is a, c, g, or t
  misc_feature (3282)..(3283): n is a, c, g, or t
  misc_feature (3287)..(3291): n is a, c, g, or t
  misc_feature (3295)..(3299): n is a, c, g, or t
  misc_feature (3301)..(3307): n is a, c, g, or t
  misc_feature (3309)..(3310): n is a, c, g, or t
  misc_feature (3312)..(3313): n is a, c, g, or t
  misc_feature (3315)..(3317): n is a, c, g, or t
  misc_feature (3320)..(3320): n is a, c, g, or t
  misc_feature (3323)..(3323): n is a, c, g, or t
  misc_feature (3325)..(3328): n is a, c, g, or t
  misc_feature (3331)..(3331): n is a, c, g, or t
  misc_feature (3334)..(3335): n is a, c, g, or t
  misc_feature (3337)..(3344): n is a, c, g, or t
  misc_feature (3346)..(3346): n is a, c, g, or t
  misc_feature (3348)..(3349): n is a, c, g, or t
  misc_feature (3351)..(3351): n is a, c, g, or t
  misc_feature (3353)..(3354): n is a, c, g, or t
  misc_feature (3356)..(3357): n is a, c, g, or t
  misc_feature (3359)..(3360): n is a, c, g, or t
  misc_feature (3363)..(3364): n is a, c, g, or t
  misc_feature (3366)..(3374): n is a, c, g, or t
  misc_feature (3377)..(3380): n is a, c, g, or t
  misc_feature (3382)..(3385): n is a, c, g, or t
  misc_feature (3387)..(3388): n is a, c, g, or t
  misc_feature (3390)..(3394): n is a, c, g, or t
  misc_feature (3396)..(3396): n is a, c, g, or t
  misc_feature (3398)..(3402): n is a, c, g, or t
  misc_feature (3404)..(3406): n is a, c, g, or t
  misc_feature (3408)..(3409): n is a, c, g, or t
  misc_feature (3411)..(3415): n is a, c, g, or t
  misc_feature (3417)..(3417): n is a, c, g, or t
  misc_feature (3419)..(3420): n is a, c, g, or t
  misc_feature (3425)..(3431): n is a, c, g, or t
  misc_feature (3434)..(3436): n is a, c, g, or t
  misc_feature (3438)..(3445): n is a, c, g, or t
  misc_feature (3450)..(3450): n is a, c, g, or t
  misc_feature (3452)..(3457): n is a, c, g, or t
  misc_feature (3459)..(3460): n is a, c, g, or t
  misc_feature (3463)..(3463): n is a, c, g, or t
  misc_feature (3465)..(3469): n is a, c, g, or t
  misc_feature (3471)..(3472): n is a, c, g, or t
  misc_feature (3474)..(3477): n is a, c, g, or t
  misc_feature (3479)..(3490): n is a, c, g, or t
  misc_feature (3493)..(3493): n is a, c, g, or t
  misc_feature (3495)..(3495): n is a, c, g, or t
  misc_feature (3497)..(3497): n is a, c, g, or t
  misc_feature (3499)..(3506): n is a, c, g, or t
  misc_feature (3508)..(3509): n is a, c, g, or t
  misc_feature (3512)..(3518): n is a, c, g, or t
  misc_feature (3520)..(3528): n is a, c, g, or t
  misc_feature (3530)..(3538): n is a, c, g, or t
  misc_feature (3540)..(3542): n is a, c, g, or t
  misc_feature (3545)..(3545): n is a, c, g, or t
  misc_feature (3547)..(3556): n is a, c, g, or t
  misc_feature (3559)..(3559): n is a, c, g, or t
  misc_feature (3561)..(3562): n is a, c, g, or t
  misc_feature (3564)..(3572): n is a, c, g, or t
  misc_feature (3574)..(3576): n is a, c, g, or t
  misc_feature (3578)..(3580): n is a, c, g, or t
  misc_feature (3582)..(3585): n is a, c, g, or t
  misc_feature (3589)..(3592): n is a, c, g, or t
  misc_feature (3594)..(3595): n is a, c, g, or t
  misc_feature (3597)..(3600): n is a, c, g, or t
  misc_feature (3603)..(3605): n is a, c, g, or t
  misc_feature (3607)..(3609): n is a, c, g, or t
  misc_feature (3612)..(3616): n is a, c, g, or t
  misc_feature (3618)..(3618): n is a, c, g, or t
  misc_feature (3620)..(3620): n is a, c, g, or t
  misc_feature (3622)..(3624): n is a, c, g, or t
  misc_feature (3627)..(3637): n is a, c, g, or t
  misc_feature (3639)..(3639): n is a, c, g, or t
  misc_feature (3641)..(3644): n is a, c, g, or t
  misc_feature (3646)..(3647): n is a, c, g, or t
  misc_feature (3649)..(3649): n is a, c, g, or t
  misc_feature (3651)..(3659): n is a, c, g, or t
  misc_feature (3661)..(3663): n is a, c, g, or t
  misc_feature (3667)..(3667): n is a, c, g, or t
  misc_feature (3669)..(3670): n is a, c, g, or t
  misc_feature (3672)..(3675): n is a, c, g, or t
  misc_feature (3677)..(3677): n is a, c, g, or t
  misc_feature (3681)..(3693): n is a, c, g, or t
  misc_feature (3695)..(3698): n is a, c, g, or t
  misc_feature (3700)..(3701): n is a, c, g, or t
  misc_feature (3703)..(3713): n is a, c, g, or t
  misc_feature (3715)..(3718): n is a, c, g, or t
  misc_feature (3720)..(3723): n is a, c, g, or t
  misc_feature (3725)..(3725): n is a, c, g, or t
  misc_feature (3727)..(3732): n is a, c, g, or t
  misc_feature (3735)..(3748): n is a, c, g, or t
  misc_feature (3751)..(3752): n is a, c, g, or t
  misc_feature (3754)..(3760): n is a, c, g, or t
  misc_feature (3762)..(3764): n is a, c, g, or t
  misc_feature (3768)..(3775): n is a, c, g, or t
  misc_feature (3777)..(3779): n is a, c, g, or t
  misc_feature (3781)..(3781): n is a, c, g, or t
  misc_feature (3783)..(3783): n is a, c, g, or t
  misc_feature (3785)..(3797): n is a, c, g, or t
  misc_feature (3799)..(3799): n is a, c, g, or t
  misc_feature (3801)..(3808): n is a, c, g, or t
  misc_feature (3810)..(3811): n is a, c, g, or t
  misc_feature (3813)..(3817): n is a, c, g, or t
  misc_feature (3819)..(3821): n is a, c, g, or t
  misc_feature (3824)..(3824): n is a, c, g, or t
  misc_feature (3826)..(3827): n is a, c, g, or t
  misc_feature (3829)..(3832): n is a, c, g, or t
  misc_feature (3834)..(3835): n is a, c, g, or t
  misc_feature (3837)..(3842): n is a, c, g, or t
  misc_feature (3844)..(3847): n is a, c, g, or t
  misc_feature (3849)..(3853): n is a, c, g, or t
  misc_feature (3857)..(3859): n is a, c, g, or t
  misc_feature (3861)..(3861): n is a, c, g, or t
  misc_feature (3863)..(3863): n is a, c, g, or t
  misc_feature (3865)..(3868): n is a, c, g, or t
  misc_feature (3875)..(3875): n is a, c, g, or t
  misc_feature (3877)..(3879): n is a, c, g, or t
  misc_feature (3881)..(3885): n is a, c, g, or t
  misc_feature (3887)..(3890): n is a, c, g, or t
  misc_feature (3892)..(3893): n is a, c, g, or t
  misc_feature (3895)..(3897): n is a, c, g, or t
  misc_feature (3899)..(3899): n is a, c, g, or t
  misc_feature (3901)..(3901): n is a, c, g, or t
  misc_feature (3905)..(3908): n is a, c, g, or t
  misc_feature (3910)..(3910): n is a, c, g, or t
  misc_feature (3912)..(3913): n is a, c, g, or t
  misc_feature (3915)..(3917): n is a, c, g, or t
  misc_feature (3919)..(3920): n is a, c, g, or t
  misc_feature (3922)..(3922): n is a, c, g, or t
  misc_feature (3924)..(3930): n is a, c, g, or t
  misc_feature (3932)..(3935): n is a, c, g, or t
  misc_feature (3939)..(3943): n is a, c, g, or t
  misc_feature (3945)..(3947): n is a, c, g, or t
  misc_feature (3949)..(3949): n is a, c, g, or t
  misc_feature (3951)..(3952): n is a, c, g, or t
  misc_feature (3954)..(3961): n is a, c, g, or t
  misc_feature (3963)..(3964): n is a, c, g, or t
  misc_feature (3966)..(3976): n is a, c, g, or t
  misc_feature (3978)..(3979): n is a, c, g, or t
  misc_feature (3983)..(3983): n is a, c, g, or t
  misc_feature (3985)..(3986): n is a, c, g, or t
  misc_feature (3988)..(3988): n is a, c, g, or t
  misc_feature (3990)..(3992): n is a, c, g, or t
  misc_feature (3994)..(3994): n is a, c, g, or t
  misc_feature (3996)..(3999): n is a, c, g, or t
accctggaagngaacaccgcctacacctacctggtnaacgaccactggtcngcggangcngtatccggctacagcttcctgaaccttgccgatgagaccgtcgcnatcgactggcccatcgacctggcnaaggcngaactctccgagaaggaccgtaaccacccgcgnctgaacgagatnaagcccctngaagccgacccgatnctgattattggngcgggcggtcagctcggcaccgagctggttcgccagctnaccgagcagaacgtncccttcctggctgtggancgcgaccgcctcganctgggcaagcccgagcagtggngngangcnttccgntggcnntccttccgngcggtnatcaacgcngcagcntacaccgcngtggatcaggcngaaacccccgaggggcgncgngangcctgggcagcnaacgccctnggngtgagcgctcttgcctccatctgngaagaagctaacctgccgctggttcacgtntccaccgactangtctttganggntccctgcccctgggngaggaatacccggaggantaccccctggcaccgctgagcgtntacggcgcntccaaggcngccggtgaggttgccgccgccgcntggcgtaagcactacaccctgcgnaccagctgggttgttggngccggnaagaactttgtnggnaccatggcntccctggctgagcgcggtatcgacccgtccgtggtngccgaccagtggggncgcccgaccttcacccaggacctggcagcngctgccctgcacctgctcttctccggcgcngaatacggcacctacaacgtgtcgaacaccggngangtnatcaactgggcncagttcgctcgtgcngtgtacgagggnaccggccangacccggcacgngtcagcgacaccaccaccgaggnatacttcgccaacgntgagctnttcgctcaccgtccgacgaactcggcnatggacctgtccaagctgattgcngcnggnttcaccccgcgnnatcaccgcgaggcgctngccgcctacctngcagaaatgggntcctaancctctnaggnnttggcnctatatctgctganaacagcataaaaggcgtgaaaagcgccatatcacaggttcccggcccttgaagaagagccgggaacctgtacaatattgtcttggccaaggcggtggaatacacgaaacgtgtaggtccgtaactgacggtggctggttggaaagagatttctggcgccagtccctattccacttggcgcataacttctaaccaagaaagggtggacaactcatgtcagataccatcaaaatttcagctaccgtacgtagcgacttcggcaagggctacgcgcgccgcatccgcatggcaggcgacatccccgccgtcatctacggccacggcgaagagcccaagcacgtagtactccccggccacgcaaccaccctggctgcccgcgtccccaacgctatcctcgacctcgacatcgaaggtgaatcacacctcgcaatgatcaaggacatccagcgtcacgcaatccgccctgaactgcagcacatcgacctgctgaccgttaagcgcggcgagcgcgttgagattgaggttcctgtacacgttgaaggcgagcctgctgttggcgccgttgctaaccaggaagaaaccgttcttctggttgaagctgacgcactgaaggcacccgaagctttgaccgtgagcatcgaaggccgcgaagctggcgctcacgttctggcatcagacgttgaactgccctcaggcgtaaccctggttgcagacgctgaactgctgatcgttaacgtttctgagcccgaggaactcgacgttcccgagcccggtgaagaaggcgaaaacgcacccgagggtgacatcgttgaagcttccgaggaatcagatcaggctggcgaagctcacgactcagataactcaaagcactagaccgcgccctgcgcctagcgcaacaatgatttgtggatggcccgccgctacctctcttctgaggtggtagcgggccatactcatagaatggtgtagtccatgaattttctaaaaaccttttacagcgccgtggaaagggcgaagatatgtctgatgcgtggctcattgttggtctggggaacccgggcccggagtacgagaaaacccgccataacatcggccagatggtggttgatgaactggcgcgtgaagtaggcggtggcttcaagaagcacggacgcgcgcgcgcccaggtgctggaaggacgtttgggtataggcggacccaaggtagtgctggccaagcccctgacctatatgaacacctcgggcggcccggtatcggctctagcccagttctacgatattaaccccgaccntatcatcgnngtgcacgatgaactngatatccccttcgacaccattaagctcaagattggtgggggagagggcggccataacggtctgcgcgatatcaccaaggcgctgggcaccaaggactactaccgtgtgcgcaccggcatcggtcgtcctcccggacgcatggacaccgcagacttcgtgctcaagcccttcagnagcaccgaagcgaaggacctgcccttcctcatctcaaacgcagcggatgcaaccatgatgctcgtnaaggaaggcctgctggcaacccagcagcgctaccacggngcaggntcctagccntatgacccgtgccgggtaaacnctgaactgggnnaacncnnnannngggnnnnnnnnnnnncgggncnntnnntnannnngnnnnnnccnnnnnangnaananncnnganangnannangntanannnnnnnnnngnnanannnnccnnnncnggnnannannngancgngnnnngnangnnccngngnnnnannnnnccnnnncngnnnacnccccncnnnncnacnnccnnntnngcnannnnnnnnnnnnccnncnnnnnnnnnannntnnnntcnncnnnnnnnnnntnnncnnncnnnntnnggnnnnnnnnnnnnngnnnnccnnnnnnnnnnnnnncnnnnannnnnncnncnnnnnncncgnnnnctncnnngnnnncnncnnngccnnnnnccnnggngnnnanncnnccgncntnnnngnnnncgnncnnntnnnngnngcgnnnntcnncgnngccannnncgnngnnnnnnnnnnnnnnnnnnnngnnnnnnncncnnnnnnnnnngnngccnnnnacntngnnnncnnctccnnnggnancgncnnncnngnnnncgnnngtnncgcnnnnnagcnnnnngnnnnnnncnncnncnnnganatngnnnnccncgnnannnnnnnncncnngnanntnntnnccnngnnnnnnnnngcnnnncnnnncnncnnnnncncnnnnnannncnncnnnnncnannacggnnnnnnngannncnnnnnnnncgagnannnnnncnncgngnnnnncnncnnnntnnnnnnnnnnnncgncncnannnnnnnngnnccnnnnnnngnnnnnnnnncnnnnnnnnncnnngcncnnnnnnnnnnggncnncnnnnnnnnngnnncnnncnnnnccgnnnncnncnnnnccnnngnnntcnnnnncncngnnntcnnnnnnnnnnngntnnnngnncncnnnnnnnnngnnncccncnncnnnngngccnnnnnnnnnnnnncnnnncnncnnnnnnnnnnngnnnncnnnntnannnnnngcnnnnnnnnnnnnnncgnngnnnnnnngnnngccnnnnnnnngnnngncncnnnnnnnnnnnnngncnnnnnnnngnncnnnnncnnngcngnngnnnncnncnnnnnncnnnngnnnnnggannncntngnnnngggggancnnnannnnngnnnncnncnnntngngggnnnncngnntnnngnngntnnnnnnntnnnnggcnnnnncnnncncnncnnnnnnnncnncnnnnnnnnnnncnncctngnngncnnncncnnnna

SEQ ID NO: 334 - DNA, 4000 bp, Escherichia coli
  misc_feature (1967)..(1967): n is a, c, g, or t
  misc_feature (1970)..(1971): n is a, c, g, or t
  misc_feature (1980)..(1980): n is a, c, g, or t
  misc_feature (1985)..(1985): n is a, c, g, or t
  misc_feature (1988)..(1989): n is a, c, g, or t
  misc_feature (1997)..(1997): n is a, c, g, or t
  misc_feature (2003)..(2003): n is a, c, g, or t
  misc_feature (2009)..(2009): n is a, c, g, or t
  misc_feature (2012)..(2013): n is a, c, g, or t
  misc_feature (2019)..(2019): n is a, c, g, or t
  misc_feature (2021)..(2022): n is a, c, g, or t
  misc_feature (2027)..(2027): n is a, c, g, or t
cggccggagacggccggcgaacactgtgcaccatcatccaaggaaggcgtatccctcccgcacccggcgccgtatgaccggcccggccatgggtaaacacaggactgccgatgctcccggcggcgcacgcaaagcgtggccggagctgccgacggcagggattttttcacatggagaacatcgtcaacagcttcaactcgctatacaaagcataccgcaagacccgctgcgggaagcgggacaaccccacggccatgcgctaccgcatggaggccatcgagcgcacggccgacctctctgaccgcctccagcggcgcgagtacaccttcgggccctactaccccttcaaggtgtatgagccaaaggagcggctcgtccttgccatagacttcgagggcaaagtcgtccagcactcgctctgcgacaacgtcctcgagccagtattctcccggcgcttcatccgggacaactatgcggggcagatcggcaaaggcacccacgacggcctcgaccgtctggccggcgccatgcgccactactttttcagccggaaggcagcagacgaggaggcccggcgggccgccggcctgccataccggccgatggaggagtgggactacgccgagggctgggtgctgaaaggtgacttttccaagttcttttacaccctgctgcacgccgtctgcttcgagaaggcccgcaaggctctggccttcctgtctgacgaggagctgatcgacttcgtcgagtggctgctctggatcgtcatcgacagcacgccagaccccgggatccccatcggcaaccagtcgagccaactgctcgccctgctctatctggacgacttcgaccactggctgcgggatggcctcggcctcgtctatggccgttacatggacgacttctacatcatcagcagcgacaagctgctgctccgggagatcctcaagaagatcgaggcgtacatcaagccgctgggcctgcgcctgaacggcaagacgcagatcttcccgctcaagaatggcatcgacttcctcggcttccatacctacctcacgagcaccggcaaggtggtcaggaaggtgagggccaagagcatcgacaacatgaagcggaagatccgcaagttccgcggcctcgtggacaggggcaagatgacgctcgagagcgtgagccaatcctacgcaagctggacgggccacatctcgcacggcaacacctaccacctgcggcagaacatggacgcctatttctacgcatacttcccggagctaaaacctaccgaaaggagacaagactcatgcctcaaaccctcggaagccttgccaacaaggcaaaaatcaagttcggcagcctctacggcgcgccgatcatctggatcaaggccgacaaaaaccacgccggctaccctgccaacagcgtcaccctcgtgaccaaccagatcatcaagctgctgtgcttcgacgcgaaggagagcgccaacggcaacagcgaccgccgaaactacggcaacaaccgctacatctactccaacctgcgccagtggctcaacagtgacgccgccgcgggccagtggtacaccgcgcagcatagcgcagatgcgcctccgagcacggccaacgtgtgggacggcgtcaaccagtaccagaccctcgccggtttcctcaatggcttcacggccaacgagcgggccgccctgctcgccaccaccatcaccgtcggtaagagctccacggacggcggcgggacggagacctgcgtggacaaggttttccccctgtcctgcaccgaggtcaacctctcgggcgaccatgtgtgcggcagcaagctggcgatcttcagcgacaactccagccgcatcgctaccgtgacggcatcctgcgtcgccaattccaactacggcagcaacccgtcggcaaatcaggcgtggtactactggctgcgggacgcctatgccgggtcggccngcnncgcccgctncgtcnggnncgatggcncgctgnactggnacnncgcctncnncggcnacggcggcctgcgccccgcttgtaatctgtcatccgatctcttggtctccgataacaccgactcggacggctgctacacaatcgtctacaaccagccgcccacggcccccggcaccatcactgtcccgagcgaggtcatcggcggcgaaaacctgagcatctcgtggggacagtcgaccgatcccgacggcaacctcgccggctacaagctggagcgcaaggtggacgacggcacatgggcgcagatttacagcggcagctcccggagctacacggactccatcacctacggatggacgagcgtgcagtaccgcgtcaaggcatacgacaccgccggggccgagagcgcctacaccaccagcgccgtgcgcaccgtcaccaacaaccggccgcccgtcatcagcggcagcgacaccgacctcggcagcttcaccaccacgccgccctcctatgagtacaccgtcaccgacgccgacggccatcaggtcacggtcgtggagaagctggacaccaccacgctgcgcacctacaccgctaccctcggcgacaccaacgagctcgagatcacggccgaccagtggctcaagctgctgaacggcgaccacaccctgaccatcaccgccaccgacgccaagaacgagagcaccgtgcgcaccctttccttcgacaaggccatgcactcggtcgagttcgagcagaccgtggcgatggcggccgacgatatgccgaccaaggccctcgtcaatattcagggcagcttcccgaccggcagcacccttcaggtctggatctgcaacaacggcaacgacgccgagcccacatgggaggacatcaccaccaaggccctgaccagccagaagcactttttcaccaaccagaccaagaccgccgcaagctggggcgtgaagatcaaggtcaagctcctgcgcggctcggccgagggcgactgctacatccagtcggtcggcggcaacttcgcataaaccaacaccccaagaccagaaaggaggagcagcatggtctacttcatggaacacagtatcaaagccatccacgagaaggagcaggccgccgccggcggcgggggcggcacctctcccgaggacaaggagcggatcaccaagctcgaggacgagctcgaggatctgtctggcgccattgaaagggggctgaccacatgagcgacaagtacagcggcctcgaggccgccctgcgcagcgcccgcatgaccttcgtgagcgaggccgaggccggcgaccgtaccggcaccgagatcatcgcctgcgaggatctgctgccagcgtggacgaaggccggccccaagggggatggcagccacgaggtcggcgaagcctgcacccacgacgggcagagctggcgctgctgccaagcccacaacaccaacaacaacccggacatcgagccgggcaagagccccgcacagtgggtgccctaccacaccaccgacccgaagaaggcgaagcccttcattcagccgaccatggccgaggacagctaccagaagggcgaggtctgcatctggactgatggcaaggtctaccgctccatcatggagggggccaacgcatacagcccggaagcctacccgcagggctgggaggtcgtcgaggtcgaggatggaggtgcagcatgatccagcttgacatcgggcagctcgtggccctcatggggatcccgtcggccatcacgggcctgtgcttctggatgatccagaggcagctctccaagagggacgcagagctcgaccggcgcgacgccgcccgggagagaaacgaggtgctgctcgtgcgcagcgtgggggccgccatcgcgctcggcgaggccacggccaccgccctgaagaacggccacgccaacggagagaccgaggcggccctccagtatgcgcagaagatcaaacacgagcagaaggacttcctcaccgagcagggcatccacgcgatctactgagg

SEQ ID NO: 335 - DNA, 4000 bp, Escherichia coli
  misc_feature (1986)..(1987): n is a, c, g, or t
tcaatgatgtggccggcaattgcacccgcttcctgctgctgcgccgcggggagcgcgctgccgaggggccgatggccagccttgccttctcgctccactccaaccagcccggggccctgctcaaggcactgggctgttttgcccagcgcgggctgaacatgagccgcatcgagtcgcggccgtcgaaacgggagatgggggaatacatcttttttgtcgatctggagctgcccgagggctccacgcccctggaggcggccctggccgagttgggccccctctgcgagcacctggccctgttcggggcttacccgctcaccaaccaggcttgacgccacggaacacgccgaactgcatcaggccggtggcaaaggcccagtgcatcagcaggatcgtgggagtttcccgcaggccctgcaggacggctcccggtccgagcccaaggatggcccccggccgccgcaccccttcggcgatcgagtcgatccaggaggggagggtggcccgggtccagtcatcggtgtccacagccatcccgccggcgtagcgactctgctcaaggtgctggcggaggccgcggatgctggcgaattcgggatgggcccactgctccagcaactggcgcatcacccagcgctctcggcgggtcatgacgccatcggcgggatcgcgccggttccaatcggccacggccaggaggccgccgggtttcaccacccgcagcagctcatcggcgtagcgttgcttgtcgggcatgtgggggcaggcctccacgctccacaccgcatcgacgctggcgtcggccacctccagggcgagggcatccatcaccgcgaagcggcagctgaggtcggctggcgtgagcgcctgggcccgggcgatctgggctgggctgatgctgatgcccaacacgttgaggccgtaatcgcgggccaggatgcgggcgctgccgccgatgccgcagcccacatcgagcaccgtcgacccggcgggaagccggtcgaggccgctccagcgcaccaattcatgcacgaaggtctccttcgccgcccggaagtcctggcgcccacttggggtccgcccggagtcgcggtagtagcccaggtggatgtggtcaccccagaggcgttccagcagctggtcattggtccagcggtcgtaggcgtcggccacgctggcgctggattcgtagcggcgccgacgctgcagccagatgcgggtggccacggcgatggccgcggcaaggagggctccagccccgatggtggcggccaggggccagctgaggagggtcatgaagccgcttgctggggctgggattattggggctggaacgtgtccttgagcacggtgcgggccgccaattgacggcgggtctggtcgagaagctcgtactcctggcgcaaccgctcgccggtgtcggtgatttccagcagcgcctgctggtggtcggccacgggcccacccaggtgggcgccgatccagaacgacagttcccggggcagctcgggcagatcgttgggcaggctggcgggcttgccgatcagcttgcccgtgagctccaccacatcccgcagggcctgaccgaccgtgccggccagttcgtccagctcggcagggccggcttcggggtcatcttcaatccagctcaccaggcccacccgaaagggtgcctcgcgcacaatgtcgagcacgcgaaagcgctgctgacccatggtcacgatgttgctgcggtcgtcatcctgggtttggcagtgcaggatctcagcacagcagcccacgtccgccatggtttgggtctggggatcccagcgcaccaccccaaaacgctggtcaccggccatcaccgtgcgcagcagcatccggtaacggggctcaaaaatgtgcagtggcagcacttcctgggggaagagcaccacatccggcaggggaaacagtggcagctcccgtacggccagttcacccatggcttgatcaggaggtgcnnaatcatcctagaaaaaatgcccccgccacgcgccggcgtgacaggggcaaagaacctggaggagcgaaccctgatccggtgatcagagcttgacttcgatgtcgacgccgctgggcagatccagcttcatcagcgcgtcgatcgttttcgccgaagggctgtagatgtcgatgatgcgccggtgggtgcgggtttcgaagtgctcgcgggagtctttgtcgacgtggggcgagcgcagcacgcagtaaatcttgcgcttggtgggcagggggatggggccgatggccgtggcagcggtgtgatcggcggtttcgataattttttcgcaggagagatccagcatgcggcgatcaaacgccttcaggcggatgcggatcttctgctgagcgatggcggtggacatgggagatcagactcggaacggtcgtcaaggggctcaagcctggccagccgggtggctgatggagctggattgtcgaggtgctgggaaggggtgagcccggtggacccaccccatgaaacttacctcaggctcaggcgatgatcttggagaccacaccggcaccgatggtgcggccgccttcgcggatggcgaagcgcatgccctgctcgatggccaccgggcagatcagctcgccggtcatcttgatgcggtcaccgggcatcaccatttccacgttcgcaccgtcgtcggaggtgaaggccgtgatctggccggtcacgtcggtcgtacggatgtagaactgcgggcgatagccagcgaagaagggggtatggcggccgccttcttccttcttgagcacatacacctcaccctcaaacttggtgtggggggtgatggagccgggcttgaccagcaccatgccgcgctcgatgtcttccttctgcacaccgcgcagcagcagacccacgttgtcgccggccatgccctcgtcgagcagcttgcggaacatttccacgccggtgacggtggtttcgcgggtgtccctgatccccacgatctgcacggtctcgccgaccttcaccttgccgcgctcgatccgaccggtggccacggtgccacgaccggtgatcgagaagacgtcttcgatggccatcaggaacggcttgtcgatttcgcgctcgggctcggggatcgactcgtcgacggcatccatcaggtcgaggattttgtcgacccactcgtcggcgccacgctcagccttgttgccagcttggatgtactccagagccttcagagctgaaccagccaccacggggatgtcgtcgccggggaagtcgtagctgctgagcagttcacgcatctccagttcgacgagctcgaggatctcctcgtcgtcgaccatgtccttcttgttgaggaacaccaccagcgcgggcacgcccacctgcttggccagcaggatgtgctccttggtctgggccatcgggccgtcggtggcggccaccaccaggattgcgccgtccatctgggcggcaccagtgatcatgttcttgacgtagtccgcgtggccggggcagtccacgtgggcatagtgacgcttgccggtttcgtattcgacgtgcgcggtgttgatggtgatcccccgctctttctcttcaggggcaccatcgatttcgtcgtaggcctgggccttggccatgccttgggatgccagcacgttggtgatggcagccgtcagggtggttttgccgtggtcaacgtggccaatggtgccgatgttgacgtggggcttgttcctttcgaacttctcgcgtgccatgagtggaaagaatcgggggattaaagggtagaggagagatcaggaattgccctgattcttggagatgatggcctcagccacgttgcgaggaacttcctcgtaatggctgaactccatcgagaaaataccccgaccctgggtcatggatcggagctgggtggcatagccgaacatctcggccaggggcactttcgactggaccttggactgcccattgtcaatggactgcccttcgacctggccgcgacgg

SEQ ID NO: 336 - DNA, 4000 bp, Escherichia coli
  misc_feature (678)..(678): n is a, c, g, or t
  misc_feature (807)..(807): n is a, c, g, or t
  misc_feature (2018)..(2018): n is a, c, g, or t
  misc_feature (2965)..(2965): n is a, c, g, or t
  misc_feature (3844)..(3844): n is a, c, g, or t
gcactctctgaaagtccaataactcttggacaaagcattgattccatctcactatcttttagaattgtttcacaccaaagatgcccctgaatacccataatattagattcaagttctggctcatcttcaggaataatttgccaatcaacagaactctcaaaaggtatcacagctgcccaatttgcccctcgatcagcatagtttctactttgagccatatcaaaataaatgttctcagctggacacaagaccactttatagccttgtcttgctagatcaaaaccagactcaagattctgccatgaaaataataatttctctgacttatcgtcatgatgattgccatcttcagcctcctgccaagaggcagtttttttgttatttaactctactctttttgaaagcttattgataaaccatgaagcaacatctttagcactgttaagatcatgctctttcattaagtcttgtactttaggagatttttcccaagcgcccggcgctacttcatccccacccagatggatatattccccaggaaatagattacacatatcgtctattaaagactcgacaacctttatggtttcaggcatggctggattcaacgtgttctctctatagccttgaactgaaacttcattacttttgtcttcagggtctctcatctcagggtanaagttaattagcgccatattatggcccggcaaatcaaactcgggtatgacttcaatatagttagctgaggccctactaataattctatcaatatcttctttgtcataataaccaccagttgcatctganccagatccgaaaacaggtggtactaataaattatttcccctttttgaagtttcagtagcagcttcaggataactatctaatttaaatcgaaaggcttcatcatcgactccatgccaatgaaacttattcagcttgaaaagactcattaaatctagtaatttaaataaactgtctaccgagaaaaaatgcctcacagtatctaaatgctgtcctctccaactaaaacgaggcttatcaaagatagaaccacacgggactagctgatgataattttgggaaagctgcatcaaagagacaagagcataataaaagcctgattcatcacctgatacaatctcaacatcatcactcgttatggtaattttataggcagagtcatcagaaagatcctgaaaagttagctttagtgatgtggttgctttcttatttatctcgtttgttgagttagataaaagattgagattaagtcgattaccaagttctaaagctgattgataggcacttgttattatttccagattttcaaacgctacattaatcggcgaacacaggttacaaacacctgcacttggattccatgagtaagggtgtggcaccaatctaaaagattcataatttaatttatctcccgaaaaattgggaattggcgccacggaggagattctttctagatctaaatctatcatttcaagattgatcagatctccattatctttttttaaaaaacagccttggggtgaccatcgatgattcataggcttgtgcctagactcttcataggcatatttaaaactccactgttcaccaggctttaaaatcaactcttcagaatgacataactctgtataaccacctgaacttttgacgacactacaattttcaatcgcttttgaaggtgcaagtaagctaaaacaaaacctaaaattctctatcgagttatcagaattattgctcaagcttgaacaaaagtaattgtctgaattgattgatgtagtcatcacaaaaccagttgtattcatcgttatttatctttctcaaaatagactcattgcagcgtctaattagcacttagtctagtaaaaattggtaatataatggtattatataacaggtactaaataaaaagcaaataagatttattgattagtatttaattaatctcataaagatcatttaatccaatatatatgattattatatgggtaataaangcttttaaatattttatattcttgttattgactttctttagactattagaatataataataccaattaaataccaatttaactaaaaatgctgttaatttatttaacagcttaattcaatcatatggtgagtgctgacaatttaattaacttcttaagaccatctggtgatagttctgaatctctatacaaacaattatctcgctcactaaatagtgccattcaagagggaattttaaagcctggtgatgcgcttatgccagagagggatttggcttctaatttaaaaatgtctcgcatcactgtccgtaaggcgatagatcagcttgtagaaattggaatgcttattaagagacaaggtgctggaacagttgtatctgaaaatgttgaccttgttcttcacaaaaacctctcctctttaaatagttttaccgctgatatgaagaaaagaggccttgagtcctactcaagaattactcttagagaggaaggcaaagctaccgcgaaggaagcgttgataatgaacttaaatgaagatgactttgtgcatagactcaatcgagttcgatacctagttaatgagccacttctttatgaaatagctgtcatacctgcgtcaatcatttcaataacctctgccattgacaattctttatatgaacttcttgaatccaaaaaaatgaacccagtcactgcaaaacaaaatattcacgcgattattgcagatgataatttagctgataagcttgaagtcaatcctggaagtgctattttatttgttgaaagaaagggtaaagatgccaatggtcgagtggtcgaatatacccaatcctactatcgtggtgatcgctatgattatgtggtcgaattaggatgaaacaagcaatcacaggctcgaagcttttcaacggtatagattttattgagcataaagcactcctcattgangatcaacatattgctggaattgtaaatgaagatgctatacccactgacttccaagtcaaaaaactagaggggggcatcttgtctccaggctttattgatcttcaagttaatggaggtggtggaaagttatttaataactctccagacaaggaaagccttaatacaataatatctgcacatcaatattttggcactacaagtattatgccaacagtcatcagtgactcgttaaatattttgcaaaaatgcactgacactatctctaacgagattgataataatcactcactacttggcattcacattgaggggccatttttcaatgtaaagtatagaggggtccaccaaaaacaatatattaataccattaatgcttcatatttaaatctatttgagacactcgataagtttccagtcatgcttacgcttgctcccgaatgtatatcgatcaagcagcttaaacatcttaagtctttaggttttaaaattctggcaggtcacaccgacgcaaactacgatcagctcgaagaagcggttaaatatggcttagatggcttcactcatctctttaatgcaatgggccaaatctcagcacgggagccaggtgttgtcggatctgcatttgattttgatgaaacatccgcaagtattattgttgatttacaccatgttcatccttctttaattaatctctcgttcaaacaaaaaccaaaaggaaaactcttttttgtctcagattctatggcaaccattaatcatggggagccctcatttgagctttatgatgaagtggttagtgagtcaaatggacgcattattaattcagaaggtaaacttgcaggctcatccattactcaaattgatgccattaaaaatgcntatcaaaaatgcagcattcccctcgaaagtgcaatctctatggcaacactttatccagcagaatatttaggtgtgtctgactatattggccagttaaaaaaagggtaccgagcagatcttgctcattttgactcaaactttcatgtacaaaatgtt

SEQ ID NO: 337 - DNA, 4000 bp, Escherichia coli
  misc_feature (1969)..(1969): n is a, c, g, or t
  misc_feature (1974)..(1974): n is a, c, g, or t
  misc_feature (1980)..(1981): n is a, c, g, or t
  misc_feature (1989)..(1990): n is a, c, g, or t
  misc_feature (1996)..(1996): n is a, c, g, or t
  misc_feature (2001)..(2002): n is a, c, g, or t
  misc_feature (2022)..(2022): n is a, c, g, or t
  misc_feature (2035)..(2035): n is a, c, g, or t
  misc_feature (2041)..(2041): n is a, c, g, or t
ggcgatcaactggcacggacggctgacagccttgatctgttccttctcggcatccgtcagcgtcaccgcctgccatccgatgtcggcatgctgctctagcatggccgcgccatccggcacgaacacgtaatgccagccgttcagttcggccagttcgatggcctcattggtttcggtgttgcggaagtacagcgtggtgccgtcaggcccaggcgtggtaactcgctggtatttatggattggcatgtcggttcctcgcagaagggatttgagagataagctcgggccgttcgtcgcggatacggcggcacatgtgagcatgactcgacgtgcgcaatgcgttgccgagaatgctgttcaggctgggtacatcgcacgctttcaggctgcggctgaatcgaaacaggctgtgcttgcgcacgaaccgtcgcttgcgccacgtcctgaaccccacgaaattgacgccacgactgacaggtgcaatcgtccagcgagagagcgtcaaggcaagattggccgtcagaaagccgatgatcgtgtcgcgccgttctatggcttgctcacgggtatcgcaccacagaatgaagtcatcgacgtagcgcacgtacttcttgatcttcatctcgcgcttgacgaagtgatccagcggatcgaggtagatcagcgcgtacaactgcgacagcagattgccaatgggcacgcccagcgctcccttgccgtcgtcggcaaactgcatcatcagatccaccaggcgctcgtccttgatcttgcgttcgatcagcttgcgcaagatgtcgcggttgatgttgtagtaaaagcgccggatgtccagttgcagcgtgaagctgtcggccttggcctcgcgcagatactgctgcgcccggtcgcttgccatgtgcgtgcctttggccacacggcagccgtagctgtcgtggatgaacacgcggtcaaagatcgggttcagcagcccatagatagcgtgctgcaccaccacgtcacgaaaagccggtgcgctgatctggcgcggcttgggttccatgaccatgaaatgccggtacggctgcggcttgtaggtgcctgcatgcagttccttgtgcagcgcctgcaagttcgcgcccaagtcgcgctcgaagcgcatcaccgagaacgtcttgcgcttgccgcgccggcctcgctcataggcggcatacagcgcctccatcgaaaagcactggtcaaacagattgccgtggcgtttaggcatggctgacattccccgtgggtactagaaagccattcccggcagatttcgccaaaaggctggacggaaagctccctatgtctccagttttcccatagcgggatgtcagggatggaaacgtagtcgccggcacggaagccaacgttgttgttgtcattcgaccggttgttgttccaattgcggtagaacacgcccgcattcgctgcgttgttccagttggccgcagatagagcgaacaggcacacattttcaagcctccgcccaattcgcaggtttcaagctgcgaatccatcctccgatcatcgcgccaagctcattgacgagcacggaaatggcggtgtatcggcgttgcgcttccgtgcagccacggtcgcgcttgtgattgtggaagtcgtaataccccaactcgaatgaaaggttaatcagcatccgaagctgctcatgccgcacgtccaacttggtcaggctcgtcttgttgtgataccgcttctggcactcggccagcagggcatacacgtcataggcagcctgacggatggattggcaaaggccgtatttctcgtgctttggaaagtgattcagatgcacgttgagcaacagaatcatctccctgcacttgcagagaatggcggcttcgggatgggtgtgtgtcgtcattggtattgaggcggggctgtcgccccgccaacatgcttacgatccataggcgccggcacggaagccaacgcngccgntgccanncgaccggnngccgcnccaanngcggcagaacacgcccgcanccgctgcgccgcnccagtnggccgcagagcgagcgaacaggttggcgcggttgtactggtagcagccgtcattgccgaactggctggttcccgttgcgtcggcgccgctggtggcgttctgaatgccgcaggccgtgcgcttccagctaataccactggtcgctccgctgaacacctgattgctgccgctgccgaagtacgtccatccggtagtgctgccccacgggaacagcccggtttccaagttgtacttggtggccagatttgtcgtgtcgccccatgcgtcgtttgttccgttccagccgtaggtcaggctggacagggccacgctggtattgaggacgtaggcgttgccgtctgtcttttgcgtcgtgtcggtggcgctggtgccagcattggtgatgccaagcatgacctgatacaaggcgccattgaggtcggccacaccgcatgactgtccgttgtgcgtggtcttggcaaacgggctgccactgccggtctttggcttggcgctcgaaccactgtcgcctgccgtggtgaaggtgacgccggcatcgttggtgtctgccagactgccgttgttgcagcccttcgggaaattgttggtggcgtcgtaccaggcacaataggtcgtattgctgctggcctgggcgtgtgccagtgccagcagagaaagcgccgagtacatgaacaccgaagccacgttgaacgtgcccactccccgcgaacgggccagcaacacagcatcggcatagatgccagtgcatgagccttcgccggtcgtcataccgttggagttggtgtaggtggccgtggtcgtcagcgagatcggcacgccattggcgactgacttgcagctcgtcgtgccgttcttgctggccagatacttgtcgataaagaagccagatttgtcggcgccgccgtccttgaacgcccggtgcatggcatatcctgccgtgttggccgctgcttctgtcgcgtaggtgtcgatgcccacgatgtcgatagcgttggcgccataggtggcatagcgcgggctggccgcgttgccgatgcggtagtagaaacgcggcacgaacaccatgatcgagccgtcgctgtactggtagttgccgtaattggcgctggccttgtccgatgtgccggtcatggccgagaacccagacggcaatgtcccgctgtactcgccaaccccgaagccctgcccgccctgtgtgccgatcagccctccgaacgtcgccttggtgacgaacgtcgttcccgtcgaccagcttgagacgccgttgttggtgccacggtggcgcacgcgccaatagtaggtctggctggtggagaggccggaaaccgtccaggtggtcttgttggtggcgtccgcgctcgtgctctgcacgatgttggtgaagccggaatcggtcgccagttgccagtcagagttcaggtgagtgtccgacaggccgaaccaggcgaaagccgaactggtgagcgtcaccgaactgttctggtcggtggcgccattggtcggcgtgctgttggtgggggttgagacgccagccggttgaatggcaagactgaatgcggtggccacatcatccatggtcacggtcagcgtgaccgtttgcgctgtgcttggcgcggtgaagctgatcgtgtcgcccgtgatgctcacgctgccggcgcttacctgcaccacgtagctggaaaacacgttgtagttggtgatggtgtatgacttggactggctgacgtagatcgtcgcatcacccgacagcgccactccgacaccgccttgaatggcgatattgccagcgccaaggatgctctgcccgttgatggtcttgatgttggtgcccgacaccagatccacctgatattgcgggtgcgggtcgcctgctgcttcgtgggctgcaacagcggcggcagccgtgccggtgttttccttgccgttcagcgccgtttgcgtggccgtgctgacgggctt

SEQ ID NO: 338 - DNA, 4000 bp, Escherichia coli
  misc_feature (61)..(61): n is a, c, g, or t
  misc_feature (70)..(70): n is a, c, g, or t
  misc_feature (72)..(72): n is a, c, g, or t
  misc_feature (88)..(88): n is a, c, g, or t
  misc_feature (100)..(104): n is a, c, g, or t
  misc_feature (110)..(110): n is a, c, g, or t
  misc_feature (115)..(115): n is a, c, g, or t
  misc_feature (118)..(118): n is a, c, g, or t
  misc_feature (120)..(121): n is a, c, g, or t
  misc_feature (126)..(127): n is a, c, g, or t
  misc_feature (155)..(156): n is a, c, g, or t
  misc_feature (159)..(159): n is a, c, g, or t
  misc_feature (162)..(162): n is a, c, g, or t
  misc_feature (169)..(170): n is a, c, g, or t
  misc_feature (175)..(175): n is a, c, g, or t
  misc_feature (178)..(178): n is a, c, g, or t
  misc_feature (181)..(181): n is a, c, g, or t
  misc_feature (199)..(199): n is a, c, g, or t
  misc_feature (204)..(204): n is a, c, g, or t
  misc_feature (233)..(235): n is a, c, g, or t
  misc_feature (241)..(241): n is a, c, g, or t
  misc_feature (246)..(247): n is a, c, g, or t
  misc_feature (255)..(256): n is a, c, g, or t
  misc_feature (285)..(285): n is a, c, g, or t
  misc_feature (287)..(287): n is a, c, g, or t
  misc_feature (309)..(309): n is a, c, g, or t
  misc_feature (317)..(317): n is a, c, g, or t
  misc_feature (322)..(322): n is a, c, g, or t
  misc_feature (353)..(353): n is a, c, g, or t
  misc_feature (378)..(378): n is a, c, g, or t
  misc_feature (410)..(410): n is a, c, g, or t
  misc_feature (457)..(457): n is a, c, g, or t
  misc_feature (473)..(473): n is a, c, g, or t
  misc_feature (485)..(485): n is a, c, g, or t
  misc_feature (489)..(489): n is a, c, g, or t
  misc_feature (510)..(510): n is a, c, g, or t
  misc_feature (519)..(519): n is a, c, g, or t
  misc_feature (688)..(688): n is a, c, g, or t
  misc_feature (712)..(712): n is a, c, g, or t
  misc_feature (717)..(717): n is a, c, g, or t
  misc_feature (1178)..(1178): n is a, c, g, or t
  misc_feature (1281)..(1281): n is a, c, g, or t
  misc_feature (1352)..(1352): n is a, c, g, or t
  misc_feature (1368)..(1368): n is a, c, g, or t
  misc_feature (1985)..(1985): n is a, c, g, or t
gaagggcgtgaattttgccacagcacccagtaatcagcaactaattgtgactgaaataatnagtttatancncatctttttctggatntaccgctgctannnnnaagacntcacncgncnnccctnnaagtctagtttgatattagactagaatnntcntcntaattannatggntantcnaaaatcggcgtaaaactnactanttaaaaagcctttaaaaccaaacaacaannnctaatncattnnaaggacgnntgcagatggccaatgaatacccaattggnanagaaggtaagccttggggtacnaaagaganaaccntatggctaaatcaacagtcgattaaacgacngtatgctgatgaagttttggtcacnattgactctttgcgagatgatttcgagctagnccaatatggtactttgccttacgaccaaaatcgctacccgctatacntagcgaagaccaaaanctggcaagccanttcnccaaccgtgttggttactggnggcgtgcanggatatgaaactagcggtgtccagggagccctagggtttttaactggcaaggccaaagactatgaatcatcttttaatttagttgtcgcaccgtgcatcagtccttggggttatgaaaccattaatcgttggaatccagatgcaattgaccctaatcgttcatttatgnccaacagtttgtcagcagaagctnctcanataatggcctatgttaatgctcagcaatttaatctgcttgctcattttgacttacacgaaacaaccgatacagataattctgaattccgtcccgcattagccgcccgagacgcggtatttcaggcagtttgggatatccctgatggattttatactgttgatgactcatcccgtccgaagccagcattccaaaaagcgataattgactctgttgaatcagtgacccacattgctcaacctgatgaacagaataaaatcattggcgctgatgtcgctcaaaaaggcgttatcaactataacaaacgcaaactatttttatgtggaggttttaccactgccgactatgttaccaccaccgaggtttatcctgacagctcatcagcgacgccaagacaatgtattgatgcccaaattgccgctatttgtggtggtttaaattatttaatgacccgcgctagcgnggttaaagtttgacaaatatttgcttgcggtagagaacccaagcaacagcataaaatacgagggtgaaacataaggcatacaccaacgagacggctttatctngcaccagtgattgcaaataactaattaaaatgccataaattgaccaaaaatctatcggagcacgtaaaagntcttgcatcacacacncaataaaacgatgattccgcccctaaaatacaactaatcgattgtcaaagtttatgtcagctgaaaaaaagcaggttaatgcgtctcccgactcccaatccgttgctctaagaaacgcattgggaagcttcgctacaggaataacagtagttacagccttaggggtaaacgagcaaaagatcggcatgaccgtgaatagcttcaattcagtctctctaaatcctgcgcttgtgctgtggagcatagataagaaatcaaactgttttagcgattttattaaagccaaatcttatgccattcatgtgctaagccatgaacagcaggctatttctgatcagttcgctcttagcggagaggataagttttcaaatttgcaatgcactagcggactcaataatgtcccaatacttccagatttcagcgcatgttttgagtgtagcatcgagcaccaatttgagggtggcgatcatataatattagtaggaaaggtattaaaatttgaggacagaggtagtcagcctctagttttttatcggggaaattatacttcattttagtatttaaatcagtaacttaaatgtttaacttcttagtttaaattaagtttaaaccatggnttctggattatcaggtttacgttgacgtaaacgtaatattcatttaagataagccctttcttagagcgaaaggaaagacttagcgatgcacccctcaaccgttacagtcgaatatagtattagcgacctatgcaaagaattcgacatcacaacccgtactattcggcattatgaggatttaggtcttttgagcccttctcgtcgcggccaatcaagagtctataccccctcagatagaacccgattacgcttgattcttagaggtaaaagacttggattatctctagaggactctcgtcaaattatagatatgtacgagcctggtaagactaatattaatcaactaaacactttgatcgacgcaattcgcgttcaacgcactaaactcaatcagcagcttgatgatatcagcaagctattgaaagacctcaatgatgcagaagccaactgtgttattgctctcaaaactaatggacagaactaacctatgaataccccctacccgacactgaactttaacctaggtgaagacatagacatgttgcgtgatagcgtgttccagttctgcactcaagaaattagccctcgtgctgacgatatagatagcagtaacgaatttcccatggacctgtggcgaaaacttggcgacatgggactcttggggttaacagtggatgagcaatatggcggcacgggcatgggataccttgcccacagtgttgccatggaagaaatatctcgtgcatcagcctctgttggcctgtcttacggtgctcattctaacctctgcgttaatcaacttcacaagaacggcacagaacagcagaagcaaaaatacctgcctaaactctgctcaggtgagcatataggggctctagcgatgagcgaaccaggtgctgggtccgacgttgttagcatgaaacttacggctcaaaagcagagtgatcattatattcttaacggcaataagatgtggattactaacggtccagatgcaaacacttatgtcatatacgccaaaaccgatacctctgcaggatctcggggaattacagcatttattgttgaacgtgactatcccggcttttcccgccatcaaaagctcgataaattgggaatgaggggttcaaacacctgtgagttggtttttaatgactgtcaggtgcccgtagagaacgttctcggtggcgaaggtcgcggtgtagctgttcttatgtcaggcttggattatgaacgcaccgtactctccggcggccctgtaggcatcatgcaggcctgtctagatgtcgttctaccctacattcacgatcgtaagcaatttggtcaacccattggggagttccaactcatgcaaggtaagatcgctgacatgtatgcggacttgaatgcgtctcgtgcttatctttatgcagtcgctaaggcttgtgatctcggtcaagactctcgtaaagacgcagcagcagtaattatgtttaccgctgagaaagccacgcagatggccctgcaagcaattcaagctctgggcggcaatggctacactaatgaatactccaccgggagattgcttagagatgccaaactctatgagattggagctggcacctctgaagtgcgcagaatgctcatcggtcgcgaattatttaacgagagcgcctaagaggtaaccaatggccattattaaaagtaaaataaatatcaatagtgccgagttttctgcaaatacagagaaaatgaagagtcaggtagacgatctatgcctgactcttgagaaaatttacttaggcggcggtaaaaaagccagtgaacgtcacttaaaccgcggcaaattattgcccagagaacgggttcaggggctccttgatcccggctcgcccttcctagagctatcaccattagctgctcacaacgtgtatgacgatgacgtaccggctgcgggaatcattactggtataggtcgagttagcggccaagaatgcgtgatagtagctaatgacgccactgtaaaagggggaagc

SEQ ID NO: 339 - DNA, 4000 bp, Escherichia coli
  misc_feature (1)..(83): n is a, c, g, or t
  misc_feature (85)..(145): n is a, c, g, or t
  misc_feature (147)..(149): n is a, c, g, or t
  misc_feature (152)..(185): n is a, c, g, or t
  misc_feature (187)..(215): n is a, c, g, or t
  misc_feature (217)..(217): n is a, c, g, or t
  misc_feature (219)..(221): n is a, c, g, or t
  misc_feature (223)..(235): n is a, c, g, or t
  misc_feature (237)..(244): n is a, c, g, or t
  misc_feature (246)..(350): n is a, c, g, or t
  misc_feature (352)..(387): n is a, c, g, or t
  misc_feature (393)..(435): n is a, c, g, or t
  misc_feature (437)..(438): n is a, c, g, or t
  misc_feature (441)..(451): n is a, c, g, or t
  misc_feature (454)..(494): n is a, c, g, or t
  misc_feature (496)..(530): n is a, c, g, or t
  misc_feature (532)..(537): n is a, c, g, or t
  misc_feature (539)..(587): n is a, c, g, or t
  misc_feature (589)..(610): n is a, c, g, or t
  misc_feature (613)..(622): n is a, c, g, or t
  misc_feature (624)..(635): n is a, c, g, or t
  misc_feature (639)..(642): n is a, c, g, or t
  misc_feature (645)..(645): n is a, c, g, or t
  misc_feature (648)..(656): n is a, c, g, or t
  misc_feature (659)..(660): n is a, c, g, or t
  misc_feature (662)..(664): n is a, c, g, or t
  misc_feature (666)..(674): n is a, c, g, or t
  misc_feature (681)..(683): n is a, c, g, or t
  misc_feature (686)..(686): n is a, c, g, or t
  misc_feature (688)..(701): n is a, c, g, or t
  misc_feature (705)..(705): n is a, c, g, or t
  misc_feature (708)..(713): n is a, c, g, or t
  misc_feature (716)..(716): n is a, c, g, or t
  misc_feature (718)..(718): n is a, c, g, or t
  misc_feature (720)..(723): n is a, c, g, or t
  misc_feature (725)..(732): n is a, c, g, or t
  misc_feature (735)..(735): n is a, c, g, or t
  misc_feature (737)..(739): n is a, c, g, or t
  misc_feature (741)..(743): n is a, c, g, or t
  misc_feature (746)..(746): n is a, c, g, or t
  misc_feature (748)..(749): n is a, c, g, or t
  misc_feature (751)..(752): n is a, c, g, or t
  misc_feature (754)..(754): n is a, c, g, or t
  misc_feature (757)..(759): n is a, c, g, or t
  misc_feature (761)..(764): n is a, c, g, or t
  misc_feature (766)..(766): n is a, c, g, or t
  misc_feature (771)..(771): n is a, c, g, or t
  misc_feature (942)..(942): n is a, c, g, or t
  misc_feature (945)..(945): n is a, c, g, or t
  misc_feature (1182)..(1183): n is a, c, g, or t
  misc_feature (1223)..(1223): n is a, c, g, or t
  misc_feature (1357)..(1357): n is a, c, g, or t
  misc_feature (1364)..(1364): n is a, c, g, or t
  misc_feature (1366)..(1366): n is a, c, g, or t
  misc_feature (1986)..(1986): n is a, c, g, or t
  misc_feature (2020)..(2020): n is a, c, g, or t
  misc_feature (2172)..(2172): n is a, c, g, or t
  misc_feature (2175)..(2175): n is a, c, g, or t
  misc_feature (2228)..(2228): n is a, c, g, or t
  misc_feature (2242)..(2242): n is a, c, g, or t
  misc_feature (2252)..(2252): n is a, c, g, or t
  misc_feature (2276)..(2276): n is a, c, g, or t
  misc_feature (2288)..(2288): n is a, c, g, or t
  misc_feature (2303)..(2303): n is a, c, g, or t
  misc_feature (2305)..(2305): n is a, c, g, or t
  misc_feature (2342)..(2342): n is a, c, g, or t
  misc_feature (2841)..(2841): n is a, c, g, or t
  misc_feature (2847)..(2847): n is a, c, g, or t
  misc_feature (2850)..(2850): n is a, c, g, or t
  misc_feature (2852)..(2852): n is a, c, g, or t
  misc_feature (2861)..(2862): n is a, c, g, or t
  misc_feature (2917)..(2917): n is a, c, g, or t
  misc_feature (2920)..(2920): n is a, c, g, or t
  misc_feature (2927)..(2927): n is a, c, g, or t
  misc_feature (2930)..(2930): n is a, c, g, or t
  misc_feature (3420)..(3420): n is a, c, g, or t
  misc_feature (3440)..(3440): n is a, c, g, or t
  misc_feature (3505)..(3505): n is a, c, g, or t
  misc_feature (3508)..(3508): n is a, c, g, or t
  misc_feature (3514)..(3514): n is a, c, g, or t
  misc_feature (3517)..(3517): n is a, c, g, or t
  misc_feature (3569)..(3569): n is a, c, g, or t
  misc_feature (3598)..(3598): n is a, c, g, or t
  misc_feature (3628)..(3628): n is a, c, g, or t
  misc_feature (3630)..(3630): n is a, c, g, or t
  misc_feature (3632)..(3632): n is a, c, g, or t
  misc_feature (3635)..(3637): n is a, c, g, or t
  misc_feature (3639)..(3642): n is a, c, g, or t
  misc_feature (3648)..(3648): n is a, c, g, or t
  misc_feature (3650)..(3650): n is a, c, g, or t
  misc_feature (3652)..(3656): n is a, c, g, or t
  misc_feature (3658)..(3660): n is a, c, g, or t
  misc_feature (3663)..(3668): n is a, c, g, or t
  misc_feature (3672)..(3677): n is a, c, g, or t
  misc_feature (3679)..(3685): n is a, c, g, or t
  misc_feature (3687)..(3688): n is a, c, g, or t
  misc_feature (3691)..(3691): n is a, c, g, or t
  misc_feature (3694)..(3700): n is a, c, g, or t
  misc_feature (3702)..(3702): n is a, c, g, or t
  misc_feature (3704)..(3707): n is a, c, g, or t
  misc_feature (3709)..(3710): n is a, c, g, or t
  misc_feature (3712)..(3712): n is a, c, g, or t
  misc_feature (3714)..(3714): n is a, c, g, or t
  misc_feature (3716)..(3717): n is a, c, g, or t
  misc_feature (3719)..(3719): n is a, c, g, or t
  misc_feature (3721)..(3759): n is a, c, g, or t
  misc_feature (3761)..(3766): n is a, c, g, or t
  misc_feature (3768)..(3770): n is a, c, g, or t
  misc_feature (3772)..(3784): n is a, c, g, or t
  misc_feature (3786)..(3788): n is a, c, g, or t
  misc_feature (3790)..(3802): n is a, c, g, or t
  misc_feature (3804)..(3812): n is a, c, g, or t
  misc_feature (3814)..(3815): n is a, c, g, or t
  misc_feature (3817)..(3826): n is a, c, g, or t
  misc_feature (3828)..(3838): n is a, c, g, or t
  misc_feature (3843)..(3850): n is a, c, g, or t
  misc_feature (3852)..(3877): n is a, c, g, or t
  misc_feature (3879)..(4000): n is a, c, g, or t
nnnnnnnnnnnnnnnnnnnnnnnnnnnnnnnnnnnnnnnnnnnnnnnnnnnnnnnnnnnnnnnnnnnnnnnnnnnnnnnnnnncnnnnnnnnnnnnnnnnnnnnnnnnnnnnnnnnnnnnnnnnnnnnnnnnnnnnnnnnnnnnngnnnggnnnnnnnnnnnnnnnnnnnnnnnnnnnnnnnnnngnnnnnnnnnnnnnnnnnnnnnnnnnnnnnanannnannnnnnnnnnnnngnnnnnnnnannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngnnnnnnnnnnnnnnnnnnnnnnnnnnnnnnnnnnnngggggnnnnnnnnnnnnnnnnnnnnnnnnnnnnnnnnnnnnnnnnnnngnnaannnnnnnnnnnggnnnnnnnnnnnnnnnnnnnnnnnnnnnnnnnnnnnnnnnnngnnnnnnnnnnnnnnnnnnnnnnnnnnnnnnnnnnnannnnnnannnnnnnnnnnnnnnnnnnnnnnnnnnnnnnnnnnnnnnnnnnnnnnnntnnnnnnnnnnnnnnnnnnnnnnaannnnnnnnnnannnnnnnnnnnnaaannnnaanaannnnnnnnnaannannntnnnnnnnnnttttttnnnaanannnnnnnnnnnnnnaaanggnnnnnnaanantnnnntnnnnnnnnaanannnannnaanannanncnaannntnnnnanagaangtttgaaaggtcaagcgaacaagggcgcagggcgaatgccttggcactgggagccgatgaaagacgtgataagctgcgataagcttcggggagctgcaaataagcattgatccggagatttctgaatgaggaaactcacctgggttcatactcaggtacgttatactgaanttnaaaataggtatatcgagggaaccgcctgaactgaaacatctaagtagggcgaggaagagacatcaaacgagattccgtaagtagtggcgagcgaacgcggaagagggcaaaccgagagtagaaatactttcggggtacggactgcttttaggacttaatctgttaaccgaacggcatgggaaggccggtcagagagtgtgagaaccacgtaggtgaaaacggagagagctgcgcagnntccagagtacggccagacacgtgaaacctggtcggaatanggggggaccaccctccaaccctaaatactacccagtgaccgatagcgtatagtactgtgaaggaaaggtgaaaagcaccccgggaggggagtgaaaaagaacctgaaaccctgtgcctacaagcacctagagcncgtcaangngtgatagggtactttttgtagaacggtccggcgagcgattgtatgcagcaaggttaaggacttaaggtctggagccgaagcgaaagcgagtttgaaaagggcgttaagttgcatataatgggcccgaaaccgggtgacctacccatggtcaggttgaagtggaagtaaaattccatggaggaccgaaccgacctccgttgaaaaggcggcggatgaactgtgggtagcggagaaattccaatcgaacccggagatagctggttctccccgaaatagttttaggactagcctcaagttagatacctggaggtaaagcactgaatagcctagcggccgagaggttagcgaagcttatcaaactcagaatgccagagtattgatgcttgggagtcagacagtgtcagataaatgtcattgtcaaaagggaaacagcccagatctacagctaaggtcccaaagtcaggttaagtggaaaacgatgtgaagatacgcagacaaccaggatgttggctcagaagcagccactcattcaaagagtgcgtaatagctcactggtcgagcgtctttgcgcggagaatttaacggggctaaacctgacaccgaagcttaggcaatacagnaatgtattgggtaggggagcgttgtatacgcggngaaacagtagcgcaagcggctgtggagtgtatagaagtgagaatgccggaatgagtagcgcgaatgcagtgagaatctgcatggccgaaagcctcaggtttctggaggaaggttcgtccgctccaggttagtcgggagctaaggtgaggccnaanggcgtagccgatgcacagacggtagagattccgtcaccaccaaaagagttaancacagggacacatntgaagtctcngagccgggtgttggttccggtagngatcgagggaanttagtaccgaagtcngngatggaagatggcgagaaaagctgtgtgtatttctgnggtgcccgtaccgcaaaccgacacaggtaggtaggaagaagattctaaggccaacgggagaagggttgttaaggaactcggcaaattgaccccgtaacttcgggagaaggggtgctccagagatggagccgcagagaatcggcccaagcaactgtttaccaaaaacacaggtttgtgctaaatcgaaagatgacgtatacgagctgacgcctgcccggtgctggaaggttaagaggagatgtgcaagcattgaatcgaagccccagtgaacggcggccgtaactataacggtcctaaggtagcgaaattccttgtcaggtaagttctgacccgcatgaaaggcgtaatgatttgggcactgtctcaacagcccgcccggcgaaattgtagtaccggtgaagatgccggttacccgcgacaagacggaaagaccccatggagctttactgtagcctaatattgggtttcgatgttgcatgcacaggatagatgggacacngggaancangngctttggcnnttgtggagtggccgttgggataccatccttgcgatattggaattctaacctgcgnctntgaatcnagncgggggacattgttaggtgggcagtttgactggggcggtcgcctcctaaagagtaacggaggcgttcaaaggttcgctcagcttgaacggaaatcaagcaaaagagtgcaaacgcagaagcgagcctaactgcgagactgacgggtcgagcagtaacgaaagttggagttagtgatccggtggtatgtgagtggaaatgccatcgctcaacggataaaagttaccctggggataacaggctgatctcccccaagagtccacatcgacggggaggtttggcacctcgatgtcggctcatcgcatcctggggctgtattcggtcccaagggtttggctgttcgccaattaaagcggtacgcgagctgggttcagaacgtcgtgagacagttcggtccctatctgtcgtgggcgcaggatatttgatgggagctgtccctagtacgagaggaccgggacggacgtacctctggcgcaccagttgttccgccangagcatagctgggcaactangtacggatcggataaacgctgaaagcatctaagcgtgaagccgacccaaagataagatatcccantgnttcaancangtaagaccccttgaagactacaaggttgataggcacgatgtgtaagtggagngatccattcagcaagcgtgtactaatagntcgagggcttgaccacaattcgcttgagantntnagnnncnnnnaaaaantntnnnnngnnnttnnnnnntttnnnnnncnnnnnnntnnaanaannnnnnnanannnnannanananntntnnnnnnnnnnnnnnnnnnnnnnnnnnnnnnnnnnnnnnngnnnnnncnnntnnnnnnnnnnnnnannnannnnnnnnnnnnncnnnnnnnnnanntnnnnnnnnnnannnnnnnnnnnaaaannnnnnnncnnnnnnnnnnnnnnnnnnnnnnnnnnannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 340 - DNA, 4000 bp, Escherichia coli
  misc_feature (134)..(134): n is a, c, g, or t
  misc_feature (781)..(781): n is a, c, g, or t
  misc_feature (1262)..(1262): n is a, c, g, or t
  misc_feature (1989)..(1990): n is a, c, g, or t
  misc_feature (2012)..(2012): n is a, c, g, or t
  misc_feature (2021)..(2021): n is a, c, g, or t
  misc_feature (2047)..(2047): n is a, c, g, or t
  misc_feature (2548)..(2548): n is a, c, g, or t
  misc_feature (3529)..(3529): n is a, c, g, or t
tgaatgcgttcaatttcgttttggcttagttccctgacaagagtaagatgaccaaatctgtttttatcattcttgccaaaaacaaggatgtctccaatcgggggttttgagacagagccattcatatattgcgnaagatttctatcctcattgtggtgaccattggacaatgagctatcgaaaagcatataggcatgcccataagaatcaggcatgcgatgattctttatctggtaataataccttttaactaattcaacacactgatacttaaggcctagattgtaaccttctctgctgaggtttcttccgaaaaaatttgacattctgccattatcatatacagtcattgaattataggaatcgatgatatcagcggaggaccagtctttcttaaccggaaaacagacagcgggcccactgaagtgtattccaagggtcagaataccgattaacaagcatgtatgagagcttagcattgtttgcacactataaaagggtcactgcaaatatacatatgcggattacacgaaaaaatgaagttccaatattaaagcgaagtctatcttattaatataaaataaaagagctatacattttataaatttgtaatcctgaaataaaacttgaaatgtttgatactttaagtgataagctggactcggcctttaagaatttaactggtgagggaaaactcacagaaattaatattgcacagtcaattaaagaaatccgtcgagctctcgtagccgccgatgtcaactataaaatagccaagganttcaccgatagggttaaagaacaggctatgggcacacgaaatgtgctcaaagcggttaagcctggagagcttatggtcaagatcgttatggatgaaatggttgagctgatgggtggtcagtccgttggaatcaacctctcgggaagtccggccgtgattcttatagcaggtctgcaaggttccggaaagactacatttacaggcaaactggctaagcacctcaaggaaaaaaagcgattgaaggtacttgtagcggcctgtgacgtgtacaggccagcagcaatcgatcagctgaccgttctggcaaagcaggttgatgttgaaatttataaagagacagaaaataagaatcctatatccattgcaggaaacgcgttggtttatgccaagcaaaacaactttggagccgtcataattgatactgcaggacgcctttctgtagatgaggaaatgatggacgagattgcagccatcaaagatnagataacaccttcagaaactctttttgttgtcgattcaatgacaggtcaggatgcagtcaatactgcagcagttttcaatgagcgcattgattataatggcgttgttttaacaaaacttgatggcgatacgcgaggtggagctgctttatcgatcaaatatacagtcggcaagccaataaaatttgtctccacaggtgagaagatggatgccctggatgtgtttcatccagacaggatggcccagcgaattttgggtatgggagatatagtctccttcgttgagaaagcacaggatcaatttgatgaaaaggaagcacagcggcttgagaagaaaatcaagaagaacaaatttgacttcaatgacttcctgggacagatggcgcagatacgaaagatgggagacctaaggtcactgataggaatgattcccggtatgagcaagctcaaaaacctggacatagatgacaatgcctttgcgaaagtcgaatccatcattcattccatgacaccggaagagcgaaccaatccagatctattgaatatgagtagaaaaagacgaattgcgaaaggatgtggccgaaatatccatgagataaatatgtttatcaagcaattcaatcagatgcgtaagatgatgcatatgatgtcaaaaggaaagggaatgcagcaactaatgggtaattttcccaatatgcctgggatgaattaatatttcttactattttnntagtgaaatttaccatttgaantgttataantctgagacatgaaaaaactttacctnttattaacccttcttttaggggctaattttctatttgcacaacttccggactggtcaactgctcctgatttttcacttccagatcttaatgacgattatcatgaactttatgactacctagatgaagggtattctgcagttctggacttttcagctacctggtgcggtccatgctggaactatcatcaaacaggcatattggaagatatttatgatgagtatggacctggaggggaagacaaggtcatggtgtttatgattgaagctgaccccggcacaacgcctccatgcatttatggaccttccgggtgttctggtggttcaataggagactggactgcaggtgttacatatcctattctaaacccagaagcatcagaggcggcaacagttaacacagattttcaaattaattattaccccaccttatatggcgtatcaccaattggagaaattattgaaattggtcaagccagcttttctgtttgggaaagttgggtngcggaatcttttcaaatgcataatacaagctggactaccaatgaagaagattgtacggaatccttcatagacctgcatcctgttggtggtcatgatggcattgactaccagtggtcaaatggtgcaacgactgaagacttgtatgacatagcacctggagaatataccgtcactatgaccgatggtcatgactatgaagttgtgaaaggtcctatagaaattaaatacaacaatggtgcaaatattgtccttgatgaaatagaacacattgaatgctttggtgaagaaacgggtattatagacatccacatggaaggtggatccgatgattttgaattctactggtcaaatggttctaacgatgaagaccttgaggatgctcctggtggaacatacgaattgcttgtgatagaccttgactctggttgtgaatttgaaatggaatttgagattgaggaacccgagactttggaatatgaattggaaatagagaatgccccatgtggatcagctgaattaggtgcagtggagttttttgtggatgggggtacctggccagtgacattcttctttgaagatttcgatacaagagatgattatgttgaattacctgcaggagattataccgttaccatcatggattttaacggctgtgaattggaaaccgaaagctttactatcgaatccgttgatgcaccacttgcctatgcgggttttagcggtttgctgaattgtgtcaatgacagtatatcaatttcaatagacagttcatcctcaggacctatgatctcttatgaatggtattcaccagacagtatcctgatcggacaggatagtcaattgtatgtaatgactgaaggtatgtatacactcaatgtgataaacctttcatctggatgtactagtgtggattcggtgtttgttatgtccgattacagcagtcctgaattggaagcagatgttattcagtcatggcattgntcggatcacatagccatattgggtggttttgtaaatgttgcagacagcttagtgacatacagttggtctaccttgggaggtgaaatatcatctgaccctcatgcggcagaaattgaagtaagtgcttttggtttgtatcagctggaagttacccatatagcaagtggctgtgtagaaacaggagaactcatgattcaagagcctgagttgccagagattacatatgagggagagctggaattttgtgaagaaagtactactgaaatttgctttgacttcgatagcaatttcagggttgactatgaatttaatggtgaacctatttccactattggaaaccagacatgcatcatattttccgaggctggcgatttaattgtcactgttgtagatcaattaactgattgcagctcatcagaatcctttgtgctggaacaattcgaagttcctgagttgcaggtattgggagaa

SEQ ID NO: 341 - DNA, 4000 bp, Escherichia coli
  misc_feature (1926)..(1926): n is a, c, g, or t
  misc_feature (3355)..(3355): n is a, c, g, or t
agcgcagtccgaaggcctctcccgcaatgatggtcagatcgatgccgtcgcctgcgcggcgcggcagggtcgacgcggcgtagtgcacgaaggtcggctctccatcctcgtgaccgtcaggcaatgccacccagctctgaatgccgtggacttcatggccgcccgatgcgcgggcggcctgcggcgttcgctcggaatgggcaatgccgcgcccggccgacatccagttcacgtcgccggggcggatttcctgcaccgtgccgaggctgtcgcgatgctccagggagccctcgaagagataagtcaccgtcgccagtgcaatatgggggtgcggccgcacgtcgatcccatagcccggtgcgaatcgcgttgggcccatatgatcgaaaaaaatgaacggccccaccatctgccggaccccggccggcagcacgcggcgcacgacgaagccgccaaggtcgcgttggcgcgaatcaatcacttgcagaatcgtcatgggcggccccgcgtcaacgcctcgagaaaccgatagtagaactcgacgcctgtgtagtaagaatcgactttgaccctctcgtccttgccgtgcatgcgcacatcgtcgcgatcgatcgcgatgccgttgatcccatagctcggcatgcccgcatacatcgtgtaaatactatccgacgatcccgttaccatcgtcggtatcacgggcgcgccgggccatagcttcgccgcgaccttgcgcagcgagtccatgacgtcggcgcgcagcggcggcggcgccattgccttgcgatccgagccatgatccgacaattcgcccgcatcgctccggtaccggacggtgagcttcggatcgttgaacaggcggatcaattccaagcgaatttcctcctgagaatggccgggaaagatacggcagttgacgttggcctccgcgcgctgcggcagggcattgggcgcatgacccccgctcagcatggtcgccacgcacgtggtgcgcatggtggaattatagcgcgcgtcctgcgacagccgccgaaccgccgcggaatcgggcggctcgcccaggattgcacgcatatcggccgctgtctggcctgtttcgatcttggccatctggccgaaatactcccgtgtcacggcattcaactcgaagggaaacggtgatttctccaataccgccagcgcattcgcgacgtgatagatcgcattgtccggtttcggcagcgaactgtgtcccccgggattggtggcgagcacctggtagtcggcatagagcttttctgtggcttcgaattccacgctcaacggtttgccatgatccgtggtgacgccgcccgagtccgggttgagcacgaactcggcatcgatcaggtcgcggtgattctgcagcagccaatccacgccgttcgactttccgccctcttcgtcggcggtgagcgccaggatgatgtcgcggttcgggacgtagccttcctgcttcaaacgaatgaaatcggtgacggcgatggcgtcggcttccttcatgtcttgggtgccgcgcccgtagaagtagccgtcttgctcgacgaatttgaacggatcggtggtccagtcctcacgccgcgcttccacgacatccaggtgcccgatgatcaagatcggccgcagcgtcgaacccggcttgccgcggtagcgcgcaaccatgtttcccttgcggtcattgggcccgatgaccacgacgtcggtcttgggaaaccccgcatcgagcaatcgcttcgccatggcctgcgcggccaccgtggtacttccgatggaatcggtggtgttgatctcgatcaattgcttgaagatgtcgtgcgccatctcgcgggtggcggcatccttctgggaggccgcgggccacgccgcttgcgcgcacaggccgcagacgaggacaatgatgggcttcangcgagcgcgatatatcaaatttgcatctccccataaaaatacaaaatcaggattcagattatgccggttcaagtcaatcgaggcgctcgtctgcggagcgtaagttgtctaataaacgatgctattctgcgcgagttgcggcaaatgcccggagcgatgtgacatggtgaagaaaaagacacccggggtgacccgcgccgccgcggaagccgccgtgcgcactctcctcacctgggccggcgacgatccgacgcgcgagggtctgcgcgacacgccgaagcgcgtcgtcaacgcctacaccgattggttctcgggatacgccatcgaccccggagcgtatctacggcgcaccttcgaagaagtcgagggctacgacgagatggtggtgctgcgcgatatcagcttcgaatcgttttgcgagcatcacatggcgcccatcatcggccacgcgcatgtcggttacctccccaccgaccgcgtcgtcggcatcagcaagctcgcgcgagtcgtcgacggctatgcgcgccgcttccaggtgcaggaaaagctcacctcgcaaattgccgcgtgcatcaacgatattctcaagccgcgcggcgtcggcgtcgtgatcgacgccgtgcatcagtgcatgaccactcgcggcgttcacaaacgcggggtctcgatgatcacgagcaagatgatgggcacctttcgcgcggatgccagcacacgcgcggagtttttgcgcttcatcgacatcgagggccgctctctgcgctgatcagtttcgcttgcgctcggcggcggagcgtaccggcatcaagtcgaccgagaagctgtatttgtgtttctcgccgggctgcagcgcaccgacgccgaccacttggcgcgcaattttctcgccgcgctcgttggtgatcgagatcaccacgacgtactcgcagctctcatcgcgcacggtgtggcgaatcgttccttcgattcgcatcgccggcttcgactccgcctgcggttccgcattcccggaattgaagcgtagatggtgctggcaccccggacaaatattggcgctctgcaggaccaccgccttgcagtgcggacatattcgagtcgcgcctaaggtgccggctcgagcggcgctcacggctagctgccgccgcccaccaagccgggtttgatcttcaccttctcgtcctcccagccgaattcgacgtgcccgcgcatgcgggagcctgcggcgacggtgatcgacccggccttcacgtcgccgacgatgatgccgccttccgttacatcgacccgcttggcggattcgatgttgccctgaagctcgccgccgaccacgacgatgccggccaggacctggccggtcaaatgggcccccggctcgatgctgaaattgccgtcgatacgaacatcacccttgaagcggcccgccatacgnacatttcccgacccctcgatcttgccctcgatcgtcagattcgcggcaatgaccgattcgcccccctccgatgacgtcttgggggtggggcggcgcggcgaaacggccagagccggttcgcttatattgcgctccggcaaatttcgttccggcggaggcgccgacggggggacaacagaacccgcagtggcgggcgtgggtttttcgttccaaagcgccatgacttaactctccattgagatggtggctaaagcgtacacgctaacgcttaaaaatgtcatcggacactgtcttttattagagacggtgacccggagcggcggcccctacgggggtcccctacagacggttgatcgcgggccgcgtcgagcaagccgcacacctcgcgcacgccctgcaggatgcgcggcgccattcggccgaccagcgagggatccaccgtgaacacgtgatgattgcgcaccgcttcgaggttcgaaaatcgactccattcgagagcctgccgcgcaccctcggcgccggcggcggcgacgagtatcacgtcggggttgcgcgcgagcactgcttccttgtcgattgccggcgccagcgcggagagatcggcaaaaacattgtcgccgccgcacagcgataaaacctcgctga

SEQ ID NO: 342 - DNA, 4000 bp, Escherichia coli
  misc_feature (1682)..(1682): n is a, c, g, or t
  misc_feature (1685)..(1685): n is a, c, g, or t
  misc_feature (1691)..(1691): n is a, c, g, or t
  misc_feature (1697)..(1697): n is a, c, g, or t
  misc_feature (1973)..(1973): n is a, c, g, or t
  misc_feature (1980)..(1981): n is a, c, g, or t
  misc_feature (1983)..(1984): n is a, c, g, or t
  misc_feature (1986)..(1987): n is a, c, g, or t
  misc_feature (1990)..(1990): n is a, c, g, or t
  misc_feature (1996)..(1996): n is a, c, g, or t
  misc_feature (1999)..(1999): n is a, c, g, or t
  misc_feature (2004)..(2004): n is a, c, g, or t
  misc_feature (2007)..(2008): n is a, c, g, or t
  misc_feature (2011)..(2011): n is a, c, g, or t
  misc_feature (2013)..(2014): n is a, c, g, or t
  misc_feature (2019)..(2020): n is a, c, g, or t
  misc_feature (2034)..(2034): n is a, c, g, or t
  misc_feature (2037)..(2037): n is a, c, g, or t
  misc_feature (2041)..(2041): n is a, c, g, or t
  misc_feature (2043)..(2044): n is a, c, g, or t
  misc_feature (2046)..(2046): n is a, c, g, or t
  misc_feature (2049)..(2050): n is a, c, g, or t
  misc_feature (2052)..(2053): n is a, c, g, or t
  misc_feature (2123)..(2123): n is a, c, g, or t
  misc_feature (2138)..(2138): n is a, c, g, or t
  misc_feature (2141)..(2141): n is a, c, g, or t
  misc_feature (2147)..(2147): n is a, c, g, or t
  misc_feature (2210)..(2210): n is a, c, g, or t
  misc_feature (2222)..(2222): n is a, c, g, or t
  misc_feature (2225)..(2225): n is a, c, g, or t
  misc_feature (2227)..(2227): n is a, c, g, or t
  misc_feature (2315)..(2315): n is a, c, g, or t
  misc_feature (2330)..(2330): n is a, c, g, or t
  misc_feature (2477)..(2477): n is a, c, g, or t
  misc_feature (2503)..(2503): n is a, c, g, or t
  misc_feature (2510)..(2510): n is a, c, g, or t
  misc_feature (2533)..(2533): n is a, c, g, or t
  misc_feature (2536)..(2536): n is a, c, g, or t
  misc_feature (2553)..(2554): n is a, c, g, or t
  misc_feature (2569)..(2569): n is a, c, g, or t
  misc_feature (2573)..(2574): n is a, c, g, or t
  misc_feature (2576)..(2578): n is a, c, g, or t
  misc_feature (2580)..(2581): n is a, c, g, or t
  misc_feature (2583)..(2583): n is a, c, g, or t
  misc_feature (2585)..(2585): n is a, c, g, or t
  misc_feature (2587)..(2587): n is a, c, g, or t
  misc_feature (2593)..(2599): n is a, c, g, or t
  misc_feature (2601)..(2606): n is a, c, g, or t
  misc_feature (2609)..(2609): n is a, c, g, or t
  misc_feature (2612)..(2614): n is a, c, g, or t
  misc_feature (2616)..(2616): n is a, c, g, or t
  misc_feature (2619)..(2626): n is a, c, g, or t
  misc_feature (2629)..(2630): n is a, c, g, or t
  misc_feature (2632)..(2636): n is a, c, g, or t
  misc_feature (2639)..(2639): n is a, c, g, or t
  misc_feature (2641)..(2641): n is a, c, g, or t
  misc_feature (2643)..(2648): n is a, c, g, or t
  misc_feature (2650)..(2654): n is a, c, g, or t
  misc_feature (2657)..(2658): n is a, c, g, or t
  misc_feature (2769)..(4000): n is a, c, g, or t
gcagcagcggcaccccccagtcgcctgccaatgcccgcgccgacaggctcttcccgcagccgggcacgccgacaagcagcacgcccttggggacgggcaggccggcgtagcgggcggtgttggcaaaggcgggctgccgagagcggaaccacttgagcagattgcccaggccgcccacatcctgaaacgagtcggccgcgtgatagtactccagaatgcccgacttgcggatgacctgcgccttctcctcggcaatggcccgctcggcgccggggcgcagccccttctcctgcacggccactttgcgcagcgtccgctcggcttcgttgagcgtcatgcccagggcggcgcgcaccagcagggcgcggtcgaggtcggtcagttccaccggcaggcccgcagcctgcacttcgtcgcagatccgctccaacaacggcgccaagtgctgctgatcgggcaactggaagccggccaaggtcacttccttttccaactcctccggcacgctgaagttgggcgacaggaacaacaccgccttgcgcgtcattcgcacggcacgggcggtgtcgcggatcaggcgggtggtcaccggcgagaagtgccggtgcagatcgaggaagacgtagacagcgtcctcggggttctcgatgacgtgcaccagcgcggccgtcgggtcttccaggctgtcgttgttgaccagcttgtcctgctcgtcccgcagaccgcgggaggcgctccacacgtagagcttccgtgcctgcttggtctcttcagacagccgcgcgcagatgccccgcacggccgtcagcacgcgatcctcttcgaccgagagcacgcagaccagcgggaagctggcgcggatcaggacttccagacggctctcgtcgtcgtccaccatccgcgtccgtcgcgccacggcttccaggtcgcgcgccaactcgtcggccgtctggtagcggcggtccgcttccttgtgtagggctttgcgcaggacgcggatgacgcggacgtcgacgcccttctcgtgcagcggcttctcgtcatacttggccgccatgatcttctgcatgacctcggcaaactcaccggtgaagggcttctcgcccgtcagcagctcatacagcgtcacgcccaacgcccacagatcggcattggtgccggcggcgccttggaactgctccggcgccatgtactgcaccgtgcccacgcgcgtgctggccttggcgctggtgcgcgccaacagccgcgccacgccgaagtcgagcaacttgggcacgttgtcgccggtgaccagcacattgtcgggcttcacgtcgcggtggaagatgcgagcggaatgggcgtacgccaacgcctcgccaatgagcccggcgtagcggatcgcctccggcggcgtgaagctcccatgctcccgcagcttcgctcgcaagctttggccctctacgtgctccataaccaggaacgacacgccctcgcggcgctccacggcatggacccgcagaatgccggggtgctccaagcggctggtgacggcgaactccttctccaactcctcgatcccctccgggtcctgctggtgcgggaagccaagcgccaccaccggctcccccggcccgccgcgattgcgcgccttgtacacgctcttgaacgcccccgcgccgaggtacgcctccagcgtgtanggnccgaancgttgnccgagcttgtagggaccgccttcagtcatcgttcactccgttctccgtagggtaaagctccagctttgccgcccttgacctttgccttcaggtctgcgagactgcacggcagagcgacagttgaggtcaagttcaaggtcaagggcggcaaagctggagctttaccctacggaacaaaggccgaccagggggctatcgccccctggacccccgtcccttgctctcgcaaggggtaaaggcgtaaagggtcaaggcgtgagagtccgggcaagacgnaaaccgnngnngnngcngcgatncgncgggncgnngtngnngcggnnggcacaacggaagncgncggnanngncgnngnnccaggagccgccgcgcaacacacggaagtttcctgacttcggcgccgccaagtctcctttcttgtagcgntcataggcgttgctntcntaccantcctcgcaccactcccacacgttcccggacatctggtacaaaccccacgggctgcagccctcngggtactgccanacncngcacgtggtctcgctgcctttgttgttgctgttccggcacttgctctggtcccactcgttcccccacgggtactcccgaccatccacnccccgagcgcccttntcccactccagctcggttggcaaacgcaagccagcccattccgcgtacgcttgcgcgtcgtgccagttcacgtacaccaccggatggtcttccttcccggccccggcctgctgcttccagtcgtcgctctcccgatacccgctcgcntccacgaagcgggcgtactgggcgtnggtcacngggtgaatgcccaagtagtacgncgncagcgtcaccgggaacnngtcggcaccggccangaanncnnngnncngnancagcannnnnnngnnnnnntcnttnnngntcnnnnnnnngtnntnnnnnttnangnnnnnncnnnnngannaccaagggcgaaacactaagaacacgaggaaaccgggagggcgaggctcctgccgagccgcagacgcgatcacctccggcaccggctcggcgggagcctcgccctcccctnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 343 - DNA, 4000 bp, Escherichia coli
  misc_feature (126)..(126): n is a, c, g, or t
  misc_feature (896)..(896): n is a, c, g, or t
  misc_feature (2685)..(2685): n is a, c, g, or t
  misc_feature (2742)..(2742): n is a, c, g, or t
gcatcttgaatctttgagagcccgcgttgactaaggatatcaaatttatgaagtccaatatcttctgctacaaccatatcaaattgcgttgttgcaaagcctttaggcggtaaaaaagtcccagtntggtaatggatactcttttcagcaatcaaaatccctccagcgtgaatgcttaaatggcttggaaacccttgaatataagtgctatagcgcaatactagatggcccaattggtccaattcgttactgctaaacttccccctactcaatttatcaatctcatgtttaggcagaccaaacaccttccctagttcgcggaccaccgcacggtattgaaacgtattgtacgttgccaacaacgccgtgtgcgggaagcgtttaaagatgtattgggtaatgtcgtctcgatcacgccaggaaaaatcaagatcaaaatctggaggagatgtccggtacaggttaatgaagcgctcaaaatacaagtccaactcaatggggtctacatctgtgattttcaacaaataagcaacaatgctatttgctccactcccacgcccaacatagaaatagccgcgtttttgggcataattgacaatgtcccagttgatcaagaagtaggatacaaaattcttctttgcaatgagttccaactccttctcaatacgctcctttactttgaagtctaccgttggataacgataaggtataccgtcgtaagccaattttttgagcagtcgtaaatccttctgttttgaaccggtataggtctgtaagttcagtgaggcttcatcgggcaatagaaccttacaatcttctaatacctgctgcgcctgacgtagcaaatacggcacttcaacataagcgctcagcagttcatcgttagctaagtagcngtcttcttctttcgcttgtttatcctttgaaagtttactcagcaaggtattttcgtctatagcacgcaataggcggtgagcattgtggtcccgttttcccctgaaagttgccgtaggcattgcaatgagtttgtgctgacggtgaacatgcggcgaaagatgtaagaagcgtaactgatctgcccctactcctataagttcgttaggtgccaacagtgcatcgggtggaagagcttctaaaggataaatgatccaagcatctttaagtgctgcgaccggagcgcgcgatgaaaagcgctgctttcgatgaaggtgttctgataggtgatcattgatttggcggaagccttcccaatttttcgctagtgctacatagcagggcactattccatttctaaaatctaccccaatgaccggacgctttctagcgtgattgcgcaaaaggtaaaggaccgtcatgcatgccgaagtgttattaatatcggtgatggccatcgcattccatggctggctttcaaagaaagccagccactctttgggcgaaagtaccccgtaacgcaagctgtaataactgtgcgagttcactaacatctcttctgcattttatctagaaacctaaatccaacttgcgttgacgtgcctgagtcatgcccattccttgtaggccaaggtgagtatgaatttcatagtcgtattccgtaactaaacgttggcctacaggcttgagtagttccggcccattgcttctgggattctttattgcagctgatataggataggcattgagctcctctgcagggtatggataaagtaagtcggttacttctgctaacggcgtcgtaggatctagccaaatggattcatcttcttcattgagaattacaggtgatcggtggtgatcgatagcagctgtgattttattgctcaccgttgtaataatcgcaaaactatcgaccatctcgccggtatctggattgacccaggtatcgtacaatcccgcgaaagcgaaaggagctccgtctcttttgtaaatgacgtaaggctttgacaaacgttccttttgtggtccttctataaatccatctgccagcactagacagcgtttagagcgaatgctctgacggaaggctggctttaccgtaatgccctttgcgccacgataggtaggattgttttctttgttgtgatccccttctgaacgagcgttaaagaggtaaaagggtttctttgcccaatacggggtgaatccaaactgataatgctttatacggtcggaatgctcctgtgtaatcacaggtgccaatgttcctataccaatattagtatttggtgtaaagagctctggacgctctataagcgcactaaaacgcttctctattgcctttactttgctaatagctacatatctaccacacatacttctctgtttatctacgtttactgatgtctgtttgctaaaagtggtggtggctcaccgttaaatggatttgtccttcctatggttttagcgcctagagaaacggcgcgcaatactgaacggtcgccaaagcgttgtcgtatatggtccatggcactatagagtttactgagttcctcgctctcttcaaacaaattcatctggtacccaccgccaactaaatgggagaaacgaacacccaccaaacgaacgagtaatctacgttcaaagagtttttgaaaaagctccttgactttaggaatgagaaggtgatctgccgctgtatatggtatacgcgcctgaagcgtatgggtattaaagtctgaatacctnattttaacagtaatacaagaagtaagcttatccccacgacgcagctgataagcaagnttctctgtcatagcgacaataattccttcaagtttaaccacatctatggtatccttagcaaaagtgcgttctgttgaaatactctttcgctcttggtaaggaacaacagggctttgatcaacaccctgagccttatgccaaatcacagcaccgtgcttgcccatgacactctgcatcatttccaatggcatttcttgtagcgtatgaatacgtcgcacccctagatttcgcaaggtctggtaggtcttctctcccaccatgggaatcttgcgaaccgataaaggtgctagaaacggacgctccagccctttttgaacgaaaatcttgttattaggcttagcttcccctgtggcgaccttgctaacagtcttgtttaaggacaagccaaaactaataggcaatcctgtttcactaatgacacggtcccttagttcactggaaaatttgaagtttccaaaaaaacgatccataccggtaaggtccacataaaactcatctaccgacgtcttctcatagacaggtacctcctctttaataacatccgtaactaagtttgagtatttactgtagttcgctgaattcccccgaatgataatggcctcagggcagagagaacgagccatgcgcataggcatggccgaatgcacgccgaacttccttgtctcataactacaagctgcaactactccacgatcgccggtaccgccaatgagaataggcttaccgtttaatcgactatccatcaaacgttcaacagagacgaagaacgtatcaaggtccatatgtaggatagagcggtccatgaattaaaatgtagttagttaagtaaggacacaccaccggcacttcgaacggctctaagaccgctcaaaaacacactaggctaaactccttttacgtgttaattagttgtctttcaggtgattcatctcttttttgagatcggccatcatgtgcatgatctgagacatttcctgacctgtacctgctgcagggagttcaaagctggtataaccaaccgctttccaaacctctaccagcctatcgacaggtacagtataaggagcaaactgtggattatccgattttagcattaattcaccgatatggaggttattaatgacgcgcttgtacacgacaccttcgtcttttgtgatcaaaacatgacactcgtcattgcgaatagacttccaatcttgaatatattctgtgataacataagccccaggtttgatcggaagcatgctctctcctctga

SEQ ID NO: 344 - DNA, 4000 bp, Escherichia coli
  misc_feature (1931)..(1932): n is a, c, g, or t
  misc_feature (1934)..(1935): n is a, c, g, or t
  misc_feature (1937)..(1938): n is a, c, g, or t
  misc_feature (1943)..(1943): n is a, c, g, or t
  misc_feature (1968)..(1968): n is a, c, g, or t
  misc_feature (1970)..(1971): n is a, c, g, or t
  misc_feature (1973)..(1973): n is a, c, g, or t
  misc_feature (1976)..(1976): n is a, c, g, or t
  misc_feature (1983)..(1983): n is a, c, g, or t
  misc_feature (1986)..(1986): n is a, c, g, or t
  misc_feature (1991)..(1992): n is a, c, g, or t
  misc_feature (1994)..(1994): n is a, c, g, or t
  misc_feature (1997)..(1998): n is a, c, g, or t
  misc_feature (2000)..(2000): n is a, c, g, or t
atttccgcagcgccctatcgtgacagggtggtgcatcacgcgctgtgcaacgtcattgtgccgctgatcgatcgcaccttcatcgcagacacctacgctaatcggttgggctatggcacccaccgtgccctgaagcgcttcacctactttgcccgtaagagtcgttacatcttgcaaggcgatgtccgcaaatactttcccaatctggatcatgaccttttgaaagccgccctgaggcagaaaatcaaatgtccagagaccctctggttgatcgatcgcatcattgacggcagcaatccccagggcgaagacgcagagtactttccgggcgatgacttgctgacaccgcttgagcgtcgcaagggcttacccatcggcaacctgaccagccagttctttgccaatgtttatctgaatggctttgaccactttgtgaaagaacagctccaagccaagcagtatttgcgctacgtggatgacttttcgctcttctcggacgatcgctcttttctcgaggacgcatggagcgcgatcgcagactatttgacgactctgcgcctgaagctgcatcccatcaaaagtcaactgtttgaaacacgctacggcgcaaactttgtggggtttcgcatcctgccagaccgcattcgtgtccgcagcgacaacctgagacgggcacggcagcggctccggcaactccagcaagactacacaaccggacaaatttccctggaacacctcattcagcgtctccaaagctgggaagcccatctgctgcacggtgatacccatcgactgcgccgtcaaatcagcgatcgctggcgctttaccccacccgcagcaccactctccgtaaagattccagcaccactagagcctgattgggaagtctagcggtatcctacaaacgggattagtcggcaaacgcggcggtgcctggaacaacaatccgaggtcttgccgttctgcctctcgcaacaacaatacgcccgacaaccgcaacaacaatatcggttttcgagtggtttgtgctgccccgagtactcttcagtgccagaactggcagatgagatatctgctgggagtgtgagaagagtccagactagttccagtgatgctcttcttttggcttttagctctaatagtggcatccgaaaatcaaaccgagtcaggtagcttggtaagccttgctgaagtgttgcctgactcacccaatgtagggcagtcttgcatggcagaactcatccttcgtaaagaacgcaaacaagcccgctactttaccgaaaagctgggagacgggattgggttagatatgattctggttccgtctggcacctttgtgatgggttcgccagacgatgaaccagaacgcaacgaaagcgagggaccgcagcatgaagtgagtgtctccagcttttttatgggacgctatcccgtcactcaggcacagtggcggtttgtggcagcattggctccagagaagcgggacttagaactcgacccatccaactttaagggcgataatcgccccgttgagcaggtgccctggtacgacgcagtggagttttgcgatcggctggcgaagcacactggtagaccgtatcgcttaccatccgaagctgagtgggaatatgcctgtcgagctgataccaccacacccttctactttggcaaaaccctgacgaccgaactggcaaactacgacggcaactatacctacgatatcgggactcaaggtgaggatcgagaagagactacgaccgtagaccagtttgaaattgcgaatgcctttgggttatgtgatatgcacggcaatgtgtgggagtggtgtcaggattattggcatgatcactataagggtgcgcccaccgacggcagtgcctggttaagtgaagacgagaatgcaaaccgagtgttacgcggcggtgcctggnncnncnntccgnggtcttgccgttctgcctctcgctncnncnatncgcccgnctnccgcnncnacnntntcggttttcgagtggtttgtgctgccccgaggactctgtagccctttactcttttgccctcttgctctttgcgcgcgaagcgcgtcgcattgcaccgctcttttgaagccttgcacaacgtttgcgccgcatggaataagttgattctcaaccagcttttgccacagagatggcgggtgagtttttaggagtggcaagtaaaaaaatacaaacgtttgcagaaaaatgagagagccagagagctgagacaagaagccacaaacactttcccacaggcagagcttcctctatcctttttcagtcccacacgcctcgttttttcagtcccgtgcgccgtccctgctcttgacgttggggtctggagagtaacggaacagtcaaccgacttaaggctgtgcgtctgcctttgatgccgatgctacgctccattgcctcccccctgttgagcgatcgccaaactgtaaacgcctgcatggtgggcagccccgcttgcccgtactcagtggagtgatgatatttagctaatatcttcactcgccctacagtcgcactacattcgggagtcgggggttaaatgagtaggcgagcagaaagtagcgttaagcggttatgaaatgacagtgacattggcgggtaatgacagctacgcgccctcatcaacccaccagcgaaacagcatcttagtacacttgttctatgcgtcagaacgcgatacagtaaagccggctaatgggttacacccccgcttcctcgccttcaccacgttctggtggaggcttcttgctttagagtacgactcagattgctctttcgcttcgccagtccagtctgaccaaccctacaagccatcattctttgcttgcctgaccgctagtgcaacatcaagggcatgtgttgacaggttaacgggtcactgggtagaaagttattgccgacacttgcttgagcgctgccattaatcgtggttgattgctgtcaggcttatggggtatgggttagagggcttgggctggtaggtgtaaagggttggttagctggcattgttgcaagctccgtaatttagtgtggtcaaatgaagccttgatgggattcagttgtcggcaattgaagtggggctaaagtgcaatggtcggcaattgtttctagagggatgccccccctttgtggtgaagatgatgcctgctcagtatggctttcacgcttatgctccccacggggatgtggctagaggttttaagggggtgtgtgcttcagtccaaggggtactgacagtagagacggcaggtttagggtaaagtggatgctgtttgagcgggggttacagctgctagtcgtaccctaaaagggattcatccagccgttggtcacacttgagggtaatttaggggtggcaggctaacgagtcaggcagctttgaacagaccaccggtcggacatcatagacccaacccatctaaacccatcccctttacagaggagcagatcagagccagggcgtatcaactctggcagatcgggggagaccagcagtcagcagacgggtattggcaggcagcgcttgaggcactgaggcaagagcgttcacttgtgtgtgcgaagcacgtatcgctggtgtggcgagtgaatcagacctggcagatggctactaataaggagaacagggtcttcacgcttgatgtggtgaaggtggtgatctctgggtttggtgtgttggcgacagtctttgcaggggtagggttatatctcacttatcagaactcacaagcagagcggcagctgaatactgagaggctggtcaccgatcgctttagcaaagcggtggagcaattgggcagtcaggatgttgatgtgcggttgggtggcatctactcgctggagcgcgttgccaaggattcacccaaagaccatgggacagtgatggaagtgttgacagcgtatgtgcggaacaaatcaccagtgccgaaggggtggaaaagcacaccgtcagagaagcgtaagcc

SEQ ID NO: 345 - DNA, 4000 bp, Escherichia coli
  misc_feature (1)..(4): n is a, c, g, or t
  misc_feature (7)..(12): n is a, c, g, or t
  misc_feature (16)..(16): n is a, c, g, or t
  misc_feature (18)..(19): n is a, c, g, or t
  misc_feature (22)..(22): n is a, c, g, or t
  misc_feature (24)..(24): n is a, c, g, or t
  misc_feature (27)..(27): n is a, c, g, or t
  misc_feature (29)..(29): n is a, c, g, or t
  misc_feature (32)..(33): n is a, c, g, or t
  misc_feature (35)..(35): n is a, c, g, or t
  misc_feature (40)..(40): n is a, c, g, or t
  misc_feature (43)..(45): n is a, c, g, or t
  misc_feature (48)..(48): n is a, c, g, or t
  misc_feature (50)..(51): n is a, c, g, or t
  misc_feature (55)..(55): n is a, c, g, or t
  misc_feature (60)..(61): n is a, c, g, or t
  misc_feature (64)..(67): n is a, c, g, or t
  misc_feature (71)..(71): n is a, c, g, or t
  misc_feature (73)..(75): n is a, c, g, or t
  misc_feature (78)..(81): n is a, c, g, or t
  misc_feature (83)..(83): n is a, c, g, or t
  misc_feature (85)..(89): n is a, c, g, or t
  misc_feature (93)..(94): n is a, c, g, or t
  misc_feature (100)..(100): n is a, c, g, or t
  misc_feature (102)..(102): n is a, c, g, or t
  misc_feature (104)..(104): n is a, c, g, or t
  misc_feature (106)..(106): n is a, c, g, or t
  misc_feature (111)..(113): n is a, c, g, or t
  misc_feature (115)..(119): n is a, c, g, or t
  misc_feature (121)..(121): n is a, c, g, or t
  misc_feature (123)..(124): n is a, c, g, or t
  misc_feature (129)..(130): n is a, c, g, or t
  misc_feature (132)..(132): n is a, c, g, or t
  misc_feature (135)..(135): n is a, c, g, or t
  misc_feature (137)..(137): n is a, c, g, or t
  misc_feature (143)..(144): n is a, c, g, or t
  misc_feature (146)..(152): n is a, c, g, or t
  misc_feature (154)..(155): n is a, c, g, or t
  misc_feature (157)..(159): n is a, c, g, or t
  misc_feature (162)..(163): n is a, c, g, or t
  misc_feature (165)..(166): n is a, c, g, or t
  misc_feature (170)..(170): n is a, c, g, or t
  misc_feature (172)..(173): n is a, c, g, or t
  misc_feature (175)..(179): n is a, c, g, or t
  misc_feature (181)..(185): n is a, c, g, or t
  misc_feature (187)..(188): n is a, c, g, or t
  misc_feature (193)..(194): n is a, c, g, or t
  misc_feature (197)..(197): n is a, c, g, or t
  misc_feature (200)..(202): n is a, c, g, or t
  misc_feature (205)..(205): n is a, c, g, or t
  misc_feature (207)..(207): n is a, c, g, or t
  misc_feature (210)..(210): n is a, c, g, or t
  misc_feature (212)..(212): n is a, c, g, or t
  misc_feature (214)..(230): n is a, c, g, or t
  misc_feature (232)..(233): n is a, c, g, or t
  misc_feature (235)..(238): n is a, c, g, or t
  misc_feature (240)..(250): n is a, c, g, or t
  misc_feature (252)..(254): n is a, c, g, or t
  misc_feature (256)..(260): n is a, c, g, or t
  misc_feature (262)..(272): n is a, c, g, or t
  misc_feature (274)..(274): n is a, c, g, or t
  misc_feature (276)..(279): n is a, c, g, or t
  misc_feature (281)..(302): n is a, c, g, or t
  misc_feature (304)..(326): n is a, c, g, or t
  misc_feature (328)..(329): n is a, c, g, or t
  misc_feature (331)..(336): n is a, c, g, or t
  misc_feature (338)..(350): n is a, c, g, or t
  misc_feature (352)..(365): n is a, c, g, or t
  misc_feature (368)..(369): n is a, c, g, or t
  misc_feature (371)..(373): n is a, c, g, or t
  misc_feature (376)..(386): n is a, c, g, or t
  misc_feature (389)..(390): n is a, c, g, or t
  misc_feature (392)..(392): n is a, c, g, or t
  misc_feature (394)..(399): n is a, c, g, or t
  misc_feature (401)..(404): n is a, c, g, or t
  misc_feature (406)..(411): n is a, c, g, or t
  misc_feature (413)..(414): n is a, c, g, or t
  misc_feature (416)..(417): n is a, c, g, or t
  misc_feature (419)..(425): n is a, c, g, or t
  misc_feature (427)..(427): n is a, c, g, or t
  misc_feature (429)..(432): n is a, c, g, or t
  misc_feature (434)..(438): n is a, c, g, or t
  misc_feature (440)..(440): n is a, c, g, or t
  misc_feature (443)..(448): n is a, c, g, or t
  misc_feature (450)..(454): n is a, c, g, or t
  misc_feature (457)..(457): n is a, c, g, or t
  misc_feature (459)..(465): n is a, c, g, or t
  misc_feature (467)..(468): n is a, c, g, or t
  misc_feature (470)..(478): n is a, c, g, or t
  misc_feature (480)..(486): n is a, c, g, or t
  misc_feature (488)..(488): n is a, c, g, or t
  misc_feature (490)..(492): n is a, c, g, or t
  misc_feature (494)..(497): n is a, c, g, or t
  misc_feature (499)..(500): n is a, c, g, or t
  misc_feature (502)..(505): n is a, c, g, or t
  misc_feature (507)..(507): n is a, c, g, or t
  misc_feature (511)..(511): n is a, c, g, or t
  misc_feature (513)..(517): n is a, c, g, or t
  misc_feature (519)..(519): n is a, c, g, or t
  misc_feature (521)..(521): n is a, c, g, or t
  misc_feature (524)..(524): n is a, c, g, or t
  misc_feature (526)..(526): n is a, c, g, or t
  misc_feature (530)..(530): n is a, c, g, or t
  misc_feature (535)..(537): n is a, c, g, or t
  misc_feature (539)..(540): n is a, c, g, or t
  misc_feature (542)..(542): n is a, c, g, or t
  misc_feature (544)..(544): n is a, c, g, or t
  misc_feature (546)..(546): n is a, c, g, or t
  misc_feature (548)..(551): n is a, c, g, or t
  misc_feature (555)..(557): n is a, c, g, or t
  misc_feature (560)..(564): n is a, c, g, or t
  misc_feature (566)..(566): n is a, c, g, or t
  misc_feature (569)..(570): n is a, c, g, or t
  misc_feature (572)..(573): n is a, c, g, or t
  misc_feature (575)..(576): n is a, c, g, or t
  misc_feature (580)..(580): n is a, c, g, or t
  misc_feature (585)..(585): n is a, c, g, or t
  misc_feature (587)..(587): n is a, c, g, or t
  misc_feature (592)..(592): n is a, c, g, or t
  misc_feature (595)..(597): n is a, c, g, or t
  misc_feature (601)..(601): n is a, c, g, or t
  misc_feature (604)..(607): n is a, c, g, or t
  misc_feature (609)..(609): n is a, c, g, or t
  misc_feature (620)..(620): n is a, c, g, or t
  misc_feature (623)..(626): n is a, c, g, or t
  misc_feature (628)..(628): n is a, c, g, or t
  misc_feature (631)..(632): n is a, c, g, or t
  misc_feature (634)..(635): n is a, c, g, or t
  misc_feature (637)..(637): n is a, c, g, or t
  misc_feature (639)..(639): n is a, c, g, or t
  misc_feature (641)..(645): n is a, c, g, or t
  misc_feature (647)..(647): n is a, c, g, or t
  misc_feature (649)..(650): n is a, c, g, or t
  misc_feature (652)..(654): n is a, c, g, or t
  misc_feature (656)..(657): n is a, c, g, or t
  misc_feature (660)..(661): n is a, c, g, or t
  misc_feature (664)..(665): n is a, c, g, or t
  misc_feature (670)..(671): n is a, c, g, or t
  misc_feature (674)..(675): n is a, c, g, or t
  misc_feature (677)..(677): n is a, c, g, or t
  misc_feature (679)..(680): n is a, c, g, or t
  misc_feature (683)..(685): n is a, c, g, or t
  misc_feature (690)..(695): n is a, c, g, or t
  misc_feature (699)..(703): n is a, c, g, or t
  misc_feature (705)..(708): n is a, c, g, or t
  misc_feature (712)..(712): n is a, c, g, or t
  misc_feature (717)..(717): n is a, c, g, or t
  misc_feature (721)..(722): n is a, c, g, or t
  misc_feature (724)..(724): n is a, c, g, or t
  misc_feature (726)..(726): n is a, c, g, or t
  misc_feature (729)..(733): n is a, c, g, or t
  misc_feature (736)..(737): n is a, c, g, or t
  misc_feature (739)..(743): n is a, c, g, or t
  misc_feature (746)..(746): n is a, c, g, or t
  misc_feature (748)..(748): n is a, c, g, or t
  misc_feature (752)..(753): n is a, c, g, or t
  misc_feature (756)..(756): n is a, c, g, or t
  misc_feature (759)..(759): n is a, c, g, or t
  misc_feature (761)..(761): n is a, c, g, or t
  misc_feature (763)..(763): n is a, c, g, or t
  misc_feature (765)..(765): n is a, c, g, or t
  misc_feature (767)..(767): n is a, c, g, or t
  misc_feature (769)..(769): n is a, c, g, or t
  misc_feature (775)..(777): n is a, c, g, or t
  misc_feature (802)..(802): n is a, c, g, or t
  misc_feature (816)..(816): n is a, c, g, or t
  misc_feature (819)..(819): n is a, c, g, or t
  misc_feature (828)..(828): n is a, c, g, or t
  misc_feature (831)..(831): n is a, c, g, or t
  misc_feature (849)..(849): n is a, c, g, or t
  misc_feature (852)..(852): n is a, c, g, or t
  misc_feature (861)..(861): n is a, c, g, or t
  misc_feature (864)..(864): n is a, c, g, or t
  misc_feature (867)..(867): n is a, c, g, or t
  misc_feature (882)..(882): n is a, c, g, or t
  misc_feature (915)..(915): n is a, c, g, or t
  misc_feature (930)..(930): n is a, c, g, or t
  misc_feature (984)..(984): n is a, c, g, or t
  misc_feature (1008)..(1008): n is a, c, g, or t
  misc_feature (1011)..(1011): n is a, c, g, or t
  misc_feature (1023)..(1023): n is a, c, g, or t
  misc_feature (1026)..(1026): n is a, c, g, or t
  misc_feature (1053)..(1053): n is a, c, g, or t
  misc_feature (1062)..(1062): n is a, c, g, or t
  misc_feature (1101)..(1101): n is a, c, g, or t
  misc_feature (1107)..(1107): n is a, c, g, or t
  misc_feature (1116)..(1116): n is a, c, g, or t
  misc_feature (1119)..(1119): n is a, c, g, or t
  misc_feature (1143)..(1143): n is a, c, g, or t
  misc_feature (1149)..(1149): n is a, c, g, or t
  misc_feature (1152)..(1152): n is a, c, g, or t
  misc_feature (1158)..(1158): n is a, c, g, or t
  misc_feature (1248)..(1248): n is a, c, g, or t
  misc_feature (1269)..(1269): n is a, c, g, or t
  misc_feature (1286)..(1286): n is a, c, g, or t
  misc_feature (1305)..(1305): n is a, c, g, or t
  misc_feature (1335)..(1335): n is a, c, g, or t
  misc_feature (1341)..(1341): n is a, c, g, or t
  misc_feature (1380)..(1380): n is a, c, g, or t
  misc_feature (1386)..(1386): n is a, c, g, or t
  misc_feature (1398)..(1398): n is a, c, g, or t
  misc_feature (1424)..(1424): n is a, c, g, or t
  misc_feature (1467)..(1467): n is a, c, g, or t
  misc_feature (1479)..(1479): n is a, c, g, or t
  misc_feature (1491)..(1491): n is a, c, g, or t
  misc_feature (1509)..(1509): n is a, c, g, or t
  misc_feature (1533)..(1533): n is a, c, g, or t
  misc_feature (1548)..(1548): n is a, c, g, or t
  misc_feature (1554)..(1554): n is a, c, g, or t
  misc_feature (1557)..(1557): n is a, c, g, or t
  misc_feature (1560)..(1560): n is a, c, g, or t
  misc_feature (1572)..(1572): n is a, c, g, or t
  misc_feature (1575)..(1575): n is a, c, g, or t
  misc_feature (1587)..(1587): n is a, c, g, or t
  misc_feature (1590)..(1590): n is a, c, g, or t
  misc_feature (1596)..(1596): n is a, c, g, or t
  misc_feature (1601)..(1601): n is a, c, g, or t
  misc_feature (1637)..(1637): n is a, c, g, or t
  misc_feature (1689)..(1689): n is a, c, g, or t
  misc_feature (1718)..(1718): n is a, c, g, or t
  misc_feature (1725)..(1725): n is a, c, g, or t
  misc_feature (1761)..(1761): n is a, c, g, or t
  misc_feature (1812)..(1812): n is a, c, g, or t
  misc_feature (1963)..(1963): n is a, c, g, or t
  misc_feature (1974)..(1974): n is a, c, g, or t
  misc_feature (1976)..(1976): n is a, c, g, or t
  misc_feature (1980)..(1982): n is a, c, g, or t
  misc_feature (1985)..(1986): n is a, c, g, or t
  misc_feature (1988)..(1988): n is a, c, g, or t
  misc_feature (1990)..(1991): n is a, c, g, or t
nnnnttnnnnnnatantnnaanantangngtnnanaatanagnnnaantnngaanacaannggnnnntatntnnnatnnnnanannnnnagtnnaaaatntngntntattnnnannnnnananngtatnntngtngntttttnnannnnnnnannannntcnngnncttntnntnnnnntnnnnntnntacannagnacnnnttnancananannnnnnnnnnnnnnnnnannannnnannnnnnnnnnnannnannnnnannnnnnnnnnnanannnnannnnnnnnnnnnnnnnnnnnnnannnnnnnnnnnnnnnnnnnnnnntnncnnnnnnannnnnnnnnnnnnannnnnnnnnnnnnnttnnannnatnnnnnnnnnnnttnntntnnnnnntnnnntnnnnnnannannannnnnnnanannnnannnnntntgnnnnnntnnnnnatnannnnnnntnntnnnnnnnnnannnnnnnanannntnnnnannannnngngatnannnnncntnttnangaantgatnnnanngngngngnnnntacnnnatnnnnngntgnnanntnntttntaacnanagagngtnnngagnagnnnnanggtgaaaaaanacnnnncnccnntnnanantnnnnntntnnannntnnttnnggnnaaaannagnnantnntgnnncacannnnnnttannnnntnnnntttntatanaaannananaannnnngtnnannnnnaananatcnntcnctntntntnanantaatannntacataatttacgttatgtaatttnataaactatccaangcntttttctgntcntcattaacgatatgcgtntanaagtctgtnacntgngtgctagcatgtccnagctggtggctgaccaaaacctgtgatttggtngcatcatagagacgngttgctaatgtatggcgaagcttgtggggtgtcacgcggactttgaagtcttcngaatacttggcgaccatcttttcnacnctagaagcatcnatncggtttggaacacctcgatacaaggtnagaaagagngctgtatcagtcttttctgtcttgtaacgtttgtctcgnatagcnagatattgntcnagataaggcttagcaaaggcagcnacattnacngagtcncgttttccaccttttcgagtgacgtcaatgaccatcatcttaagattgaggtcacgaaggtctaggttaacggcttcagagagacggacnccagaggcaagaaggagtgcnataatggctaaatctcnctctttattcttattaaangaggataaggcgcgatttgagagtgtttgngggtantcctggtcgatatagttaagaaaaccttctgtttcatcncctaanaagagcttttgnttgatattttcagctcgagcagccanggtttctttctttttcttggtagcaaccttcttcatgacattncggtagaaatanggttccccttgntcgttttcaacttcctcngtcaaatacttatagagactaganagtgcagaaagggtncggttnatngtngtttgggaaacnccnttttttgtcgtnttngcattnagcanaggacgttcacgtaagtaaagaataaaggattccangtctttcttggtcatgtgctccagaacgtctaaagggatctcggccatggtntcagcatccgatataccagattccaaaanccaggtnaaaaatcgatcgtattcctttaagtattcgtacaangttgtaaaactgtatggaacggccagtttcgattggtaatattccaatacntaccagggcatgacttgtttgagtttatcaatccgttctaataagatctcgcgtttcatgtttttctccaaatctttctatactagtagtatagcatagccagatatatttttcaagaaaattatagtttttcggaaagatgttatagggnttatataggantntttnnnttnnanannataaccaaaaaaattttttaagccaattatactcaattatgtactttatttaagtgaacactggaaattttttactactctcaattcagttgaaaatgtactttatttaagtgaaaactaaaaaattttcaaatgtacattttgacaataaaaaaacactctaatatcaatttaatgaaatttagagtgtttttatttatctatattttttcaaactgtacaaagtgttcttgctttcttctgtggcctttgcaaatggaacacgaccttttattgcgttttttgtatgccattctttcttttacttgaattttgtaacggtgattaagattttcttgacatatccaccatacaggcagaatactcaactctgtaatttcagttggacttactatcaaggagttatttagataatcccactcattcattagactttgttgcgttgttgctaaatcgttaaatccttttaatactttttgatttctacagtatggacaagaattttctctgtaaaatttttctttaataactttctgatattctccagtacatacagggcatttccaccatgcattatatgttgaatttgcccttactgaagacatttcttgtttatttaatgatgaccattctttaattaaccaaggatgtgttgtttcaagatcattataaccttttgcagtcttcttaaaagaacaatatggacaacattggtcgtttttgtggcgatcagaaatttttgctttaaaacttctgtgacattttcgacaaatccaattggttaaagcatttgaatcataaaagaaggtatcaatatcaccattcagttcttttacccattcattgtttaagtacggtttaacatagcttagtgtttcatttggtttaggaatttttttattacagtaaggacatatagaattgagactattagaattattgtttgtaaacacacctagaacaatccctaatctctcctgaaattctaaatcacaacaatcacaaatccaattaaatattttattctcggtttctgacgatttcgtcacctcatcaggtttttctacattcttgctactccaaaggtcacacaactcaggataagtatctgcaattgtattataaccttttaatgcttgttcatcattacaatatggacagctatctattacttcttttcttattggaattgaacaaaggtattcaccttgacaaacagaacacttccaccaatatttttttgtttcaatgtggctcaatgctaaatgaacaggcaatccatttttatcgctccattcttcctgtaattttgggaaattatagagtatatcattgttaaaaacaagtgtatcccaatcacaacgattaggacaagtttgaaaattactattctctaagtcggttcttaaaatcatttcaattggactacaataaaaactgactttgcagcaagggcatttccaatttatgcatttagaagacttataccagtattcagaaataggtttatcattacttttatcccaaaatttctctaaataaggatgagtttcttgtaaagtattatatccttttaacatcaatttattatcacaataagggcagccttcaagatgccttttgacaacactacattcatattgaccatgacatttaaaacactgccatcttactaagatgttggataaactatcaatcatattactttttacatgagttggaataaattgcttaaaaagatttctatctgtatgtaatagggggttcgctttcactttaattgaggtatcgaatgtagctttacagttagtacaatagaaactatatcttttgattcttgaaattagctgatcaatagacaacttaaagatatggtcacatttgtcgcatttccaatttctagggattgtaacattgtcacttaacttcagatcattaaactctacatcgttttgctcccctggaagataaattttccgaagattagggtatgctttagtgtaaggtac

SEQ ID NO: 346 - DNA, 4000 bp, Escherichia coli
  misc_feature (486)..(486): n is a, c, g, or t
  misc_feature (611)..(611): n is a, c, g, or t
  misc_feature (1604)..(1604): n is a, c, g, or t
  misc_feature (1667)..(1667): n is a, c, g, or t
gggtgcgccaatccctatcgatttattcggcaaaagatattgccagcatgaccagagaagacggtctggtaaccgcagattgtcaattttgcggcgcacattatcagttagacccaaccagcgtagggtttcaggcggagcccgatgacagtgcccccgcatgagctgcgcgcgcgcttactgacagcaacagagcgttcgctggccgcctcttcggattttgatctgaaccccgtatcaaaggaaaagcgcaccgcatccctgcgcgacgcggccgtgttgattggtgtgtatagcagcgttgatggaccctgtgtcttgctgacccgccgcgccgcgcatttaaagcatcacccgaatcaagttgctttccccggtggtaaagtcgaagcaaaagatgcccatattcacgccgccgcgctgcgcgaagcgcaagaagaggttgggctcaatcctcaaaatatcgaggtattgggcagcttggcnccacatgaaacggtcaccggcttttccgtcacgcccgtaatcgggcttatttccagcccgtttacgccgcagatcgatccctgcgaagtggccgaggccttttgggtcccgctggcgcatctgangcaggtggaaaacttttcgatccatcagcggcgctggcaatcgcaaacgcgaaaatactatgctattccgttcggtccgtattatatatggggtgcaacggcgcgtattcttcgggggttggcagaccggttggtatgaatatcattcaggcagactggctcaaaaagcctggtgtggaaaaaattacacggctgttaagcgacgctgggttcgagatttattttgtcggtggctgcgtgcgcaacagcctgctcaacaggcccgtcgacgatattgatctggccagcaacgcccggcccgatcaaattcaaaatttggcgcgcgccgccaagctaaaaaccattccaaccggcatcgaacatggcaccatcacggtgatcagcgagggtacgccctatgaaatcaccacgtttcgccaagatattgaaaccgacggccgccgcgccacaattcaatatgccgatagccttaaaagcgatgcaacgcggcgtgattttacgatgaatgcgctttacgccgatgcaagcggcaagatctacgatccgctgaatgggcttgctgatctgaaagcggggcatctgcgctttatcgagaatgccgagcggcggattaccgaagattacctgcgtattttacggttctttaggttctcggcctggtatgccgatccagatttgggcttcgatcctgatgctctggccgcgattgcaacccagggcgatggcttattggggctttctaaagaacgcataaccaaagaactgttaaaattgctggctgccccaagccccgcccccgcggtggccgcgatgcgcatcaccggagtgctgcagcatgttttgcccggatctgatgataaagcccttgcaccattggtttactttgaaagcctctatgaggctccgattgacccgcttcggcggcttgctgcgctgggcggggggcaggttgaagcgcatctgcgcctaagcaaagcccaaagcaaaaccctnaaactgttgaaaacccatatagaggcgatgacaaaagcgggcgaattggcctatcggtgcaangcgccgattgctttggatgttttactgctgcgcgccgcgctttttgaaacgccggtctcagagcctgacttgagcgcggtacaaaccggtgccagcgcgcaatttccaataaccgccgaagatctgatgcccctttacactggctcagcgcttggcaaaaaactacgcgccttggaacagatctggatcacctctgggttccagctggataagacggcgttgctgcgcacattggatgttaaatagtgggcctgatactttagggctattttcaccgataaaattatattgacgcccctgataaacagcttagctcaggacaacggggcgcttttaacaattttgaagcttggttcgagcgaaataggcgcatattctaaaaggctttgatatctgcaaagggggggtcatgtttcggttttttgaagatttgatcgatcctttcgccgattaccgcgaaattgatcgcccaccgcaacggctttggccttttctacagacctattgtcaaccgtttaaatgggtcttcctgctggctttcaccgcctcggttttggtggctggcagcgaaatcggattgatctatgcgctgggatggctggtggaccagttgcagggcgatcgcgcagaaacgctgcagcgccttggaccggttttaatcgccttggcggtgtttatattgctgatcaggccaatacttacctttttcgataccgcattggtgaataatacgatcctcaccaatatggccacattggtgcgctggcgcgggcatcgccacgtaatgcgccaatctgtgggctggtttgaaggcgattttgccggccgcatcgccaaccgcgtgatgcaaacgccccctgctgcgggcgaagtggcctttcacgtgtttgacgcaatgagctatgcgctggcctatgtgatcggcgctttcttcttactgatgcaggcagatattcgccttaccctgcccttggtgctttggttcgggctctatttgttactgctgcgcttcacggtaaaacgcgttggccccgcctcaaaagcttcatcagatgcgcgttccgagttgaacgggcgggtcgtggatgcgtataccaacattcattcggtaaaattatttgcccatgagggcgaagaaatcgcctttgccaaagcgggcatcacgcaaacccgcgacaccttcatcaaggaaatgcggatttatacccgcatggatattttattaagtctgataaatggctttttgatcgtggcggtgatcgggtgggggattgcgctttgggcgcagggcagcgccagtgctggggttgtggcggcagcgtcagcgttggttttaaggctgaacagcatgagcaattggatcatctgggccgtcgcctcattttttcgcgaattgggcgtggtggccgaaggcatgcaaaccttatcacaacccgtcaccttaattgaccacccgaacgcgcagaccttacaaccacaagaggccaggattgaaataaccgagctgtcgcatcattacggccgggctcttggtggattggaaggtatcaatctaagcattccagcgggtcagaagctgggccttgtggggcgctctggcgcaggaaaatcaactttgttcaagcttttgctccggttttatgacgctgagtccggccagatttatattgatgggcaacgcatagacctggtgaagcaagacagtttgcgccgccatatcggcatggtccagcaagagagcagcctgatgcaccgctcagtgcgcgataatatccgctatgggaataacgccgccagcgaggcgcaagtgatcgcggcggccaagcaggccgaagcgcatgactttattttggacctcgaagatccagaagggcgttgcggttatgaggcgcatgtcggagagcgcggcgtaaagctttccggcgggcagcgccaacgtattgccttggcccgggtgattctgaaagacgcccccatattattgctcgatgaagccaccagcgcgctggacagcgaagtcgaggcggccattcagacaacgctttacagcatgatggacggcaaaacggtgattgcgatcgcgcatcgattgtctacgattgcgcatatggatcgaattcttgtaatggatcaggggcggatcgttgaagagggcagccatgaacagctgctggcaaaaggcgggctttatgccgggttttgggcccatcaatcgggtgggttccttgatgtggatgcagcgcagtgacacctttggcaaattggatctcgcatcacgccaaaagtgatcaggcgccgccgaaaacattgctcgccttcctgcgctgggcgtt

SEQ ID NO: 347 - DNA, 4000 bp, Escherichia coli
  misc_feature (1973)..(1973): n is a, c, g, or t
  misc_feature (1979)..(1980): n is a, c, g, or t
  misc_feature (1985)..(1986): n is a, c, g, or t
  misc_feature (2012)..(2012): n is a, c, g, or t
  misc_feature (2021)..(2021): n is a, c, g, or t
  misc_feature (2028)..(2028): n is a, c, g, or t
  misc_feature (2031)..(2031): n is a, c, g, or t
  misc_feature (2040)..(2040): n is a, c, g, or t
  misc_feature (2045)..(2045): n is a, c, g, or t
  misc_feature (2909)..(2913): n is a, c, g, or t
  misc_feature (2915)..(2917): n is a, c, g, or t
  misc_feature (2919)..(2921): n is a, c, g, or t
  misc_feature (2923)..(2924): n is a, c, g, or t
  misc_feature (2926)..(2926): n is a, c, g, or t
  misc_feature (2928)..(2929): n is a, c, g, or t
  misc_feature (2931)..(2934): n is a, c, g, or t
  misc_feature (2936)..(2936): n is a, c, g, or t
  misc_feature (2938)..(2942): n is a, c, g, or t
  misc_feature (2946)..(2949): n is a, c, g, or t
  misc_feature (2952)..(2954): n is a, c, g, or t
  misc_feature (2958)..(2958): n is a, c, g, or t
  misc_feature (2966)..(2966): n is a, c, g, or t
  misc_feature (2968)..(2968): n is a, c, g, or t
  misc_feature (2970)..(2971): n is a, c, g, or t
  misc_feature (2973)..(2975): n is a, c, g, or t
  misc_feature (2977)..(2977): n is a, c, g, or t
  misc_feature (2979)..(2979): n is a, c, g, or t
  misc_feature (2982)..(2983): n is a, c, g, or t
  misc_feature (2990)..(2990): n is a, c, g, or t
  misc_feature (2993)..(2994): n is a, c, g, or t
  misc_feature (2996)..(2996): n is a, c, g, or t
  misc_feature (3000)..(3001): n is a, c, g, or t
  misc_feature (3005)..(3005): n is a, c, g, or t
  misc_feature (3012)..(3013): n is a, c, g, or t
  misc_feature (3016)..(3019): n is a, c, g, or t
  misc_feature (3021)..(3022): n is a, c, g, or t
  misc_feature (3027)..(3029): n is a, c, g, or t
  misc_feature (3032)..(3033): n is a, c, g, or t
  misc_feature (3035)..(3035): n is a, c, g, or t
  misc_feature (3037)..(3038): n is a, c, g, or t
  misc_feature (3040)..(3041): n is a, c, g, or t
  misc_feature (3044)..(3045): n is a, c, g, or t
  misc_feature (3047)..(3050): n is a, c, g, or t
  misc_feature (3052)..(3052): n is a, c, g, or t
  misc_feature (3054)..(3054): n is a, c, g, or t
  misc_feature (3056)..(3056): n is a, c, g, or t
  misc_feature (3058)..(3059): n is a, c, g, or t
  misc_feature (3061)..(3063): n is a, c, g, or t
  misc_feature (3065)..(3069): n is a, c, g, or t
  misc_feature (3072)..(3072): n is a, c, g, or t
  misc_feature (3074)..(3078): n is a, c, g, or t
  misc_feature (3082)..(3082): n is a, c, g, or t
  misc_feature (3084)..(3088): n is a, c, g, or t
  misc_feature (3090)..(3093): n is a, c, g, or t
  misc_feature (3095)..(3097): n is a, c, g, or t
  misc_feature (3100)..(3103): n is a, c, g, or t
  misc_feature (3105)..(3108): n is a, c, g, or t
  misc_feature (3110)..(3111): n is a, c, g, or t
  misc_feature (3113)..(3114): n is a, c, g, or t
  misc_feature (3117)..(3118): n is a, c, g, or t
  misc_feature (3120)..(3121): n is a, c, g, or t
  misc_feature (3129)..(3129): n is a, c, g, or t
  misc_feature (3133)..(3135): n is a, c, g, or t
  misc_feature (3138)..(3139): n is a, c, g, or t
  misc_feature (3141)..(3141): n is a, c, g, or t
  misc_feature (3143)..(3143): n is a, c, g, or t
  misc_feature (3147)..(3148): n is a, c, g, or t
  misc_feature (3150)..(3150): n is a, c, g, or t
  misc_feature (3152)..(3156): n is a, c, g, or t
  misc_feature (3158)..(3159): n is a, c, g, or t
  misc_feature (3161)..(3161): n is a, c, g, or t
  misc_feature (3163)..(3165): n is a, c, g, or t
  misc_feature (3167)..(3167): n is a, c, g, or t
  misc_feature (3169)..(3170): n is a, c, g, or t
  misc_feature (3172)..(3173): n is a, c, g, or t
  misc_feature (3175)..(3175): n is a, c, g, or t
  misc_feature (3178)..(3179): n is a, c, g, or t
  misc_feature (3183)..(3185): n is a, c, g, or t
  misc_feature (3187)..(3187): n is a, c, g, or t
  misc_feature (3191)..(3192): n is a, c, g, or t
  misc_feature (3196)..(3197): n is a, c, g, or t
  misc_feature (3199)..(3199): n is a, c, g, or t
  misc_feature (3202)..(3202): n is a, c, g, or t
  misc_feature (3207)..(3207): n is a, c, g, or t
  misc_feature (3209)..(3210): n is a, c, g, or t
  misc_feature (3212)..(3212): n is a, c, g, or t
  misc_feature (3220)..(3223): n is a, c, g, or t
  misc_feature (3225)..(3227): n is a, c, g, or t
  misc_feature (3229)..(3232): n is a, c, g, or t
  misc_feature (3235)..(3236): n is a, c, g, or t
  misc_feature (3238)..(3239): n is a, c, g, or t
  misc_feature (3242)..(3244): n is a, c, g, or t
  misc_feature (3255)..(3255): n is a, c, g, or t
  misc_feature (3257)..(3258): n is a, c, g, or t
  misc_feature (3260)..(3261): n is a, c, g, or t
  misc_feature (3263)..(3263): n is a, c, g, or t
  misc_feature (3265)..(3267): n is a, c, g, or t
  misc_feature (3269)..(3270): n is a, c, g, or t
  misc_feature (3272)..(3272): n is a, c, g, or t
  misc_feature (3274)..(3274): n is a, c, g, or t
  misc_feature (3279)..(3281): n is a, c, g, or t
  misc_feature (3283)..(3284): n is a, c, g, or t
  misc_feature (3286)..(3289): n is a, c, g, or t
  misc_feature (3291)..(3293): n is a, c, g, or t
  misc_feature (3295)..(3295): n is a, c, g, or t
  misc_feature (3297)..(3297): n is a, c, g, or t
  misc_feature (3299)..(3301): n is a, c, g, or t
  misc_feature (3308)..(3308): n is a, c, g, or t
  misc_feature (3311)..(3312): n is a, c, g, or t
  misc_feature (3315)..(3316): n is a, c, g, or t
  misc_feature (3318)..(3320): n is a, c, g, or t
  misc_feature (3322)..(3323): n is a, c, g, or t
  misc_feature (3329)..(3330): n is a, c, g, or t
  misc_feature (3338)..(3339): n is a, c, g, or t
  misc_feature (3342)..(3343): n is a, c, g, or t
  misc_feature (3346)..(3346): n is a, c, g, or t
  misc_feature (3350)..(3350): n is a, c, g, or t
  misc_feature (3357)..(3359): n is a, c, g, or t
  misc_feature (3361)..(3364): n is a, c, g, or t
  misc_feature (3366)..(3368): n is a, c, g, or t
  misc_feature (3370)..(3370): n is a, c, g, or t
  misc_feature (3372)..(3372): n is a, c, g, or t
  misc_feature (3376)..(3384): n is a, c, g, or t
  misc_feature (3387)..(3388): n is a, c, g, or t
  misc_feature (3390)..(3390): n is a, c, g, or t
  misc_feature (3395)..(3397): n is a, c, g, or t
  misc_feature (3399)..(3399): n is a, c, g, or t
  misc_feature (3402)..(3403): n is a, c, g, or t
  misc_feature (3408)..(3409): n is a, c, g, or t
  misc_feature (3412)..(3414): n is a, c, g, or t
  misc_feature (3417)..(3418): n is a, c, g, or t
  misc_feature (3420)..(3423): n is a, c, g, or t
  misc_feature (3425)..(3427): n is a, c, g, or t
  misc_feature (3429)..(3432): n is a, c, g, or t
  misc_feature (3434)..(3435): n is a, c, g, or t
  misc_feature (3437)..(3437): n is a, c, g, or t
  misc_feature (3439)..(3439): n is a, c, g, or t
  misc_feature (3441)..(3442): n is a, c, g, or t
  misc_feature (3444)..(3448): n is a, c, g, or t
  misc_feature (3453)..(3453): n is a, c, g, or t
  misc_feature (3457)..(3457): n is a, c, g, or t
  misc_feature (3461)..(3463): n is a, c, g, or t
  misc_feature (3466)..(3466): n is a, c, g, or t
  misc_feature (3470)..(3470): n is a, c, g, or t
  misc_feature (3474)..(3474): n is a, c, g, or t
  misc_feature (3476)..(3477): n is a, c, g, or t
  misc_feature (3479)..(3480): n is a, c, g, or t
  misc_feature (3482)..(3484): n is a, c, g, or t
  misc_feature (3486)..(3486): n is a, c, g, or t
  misc_feature (3492)..(3494): n is a, c, g, or t
  misc_feature (3496)..(3497): n is a, c, g, or t
  misc_feature (3500)..(3502): n is a, c, g, or t
  misc_feature (3505)..(3506): n is a, c, g, or t
  misc_feature (3508)..(3509): n is a, c, g, or t
  misc_feature (3511)..(3513): n is a, c, g, or t
  misc_feature (3519)..(3519): n is a, c, g, or t
  misc_feature (3521)..(3525): n is a, c, g, or t
  misc_feature (3527)..(3529): n is a, c, g, or t
  misc_feature (3534)..(3536): n is a, c, g, or t
  misc_feature (3538)..(3538): n is a, c, g, or t
  misc_feature (3543)..(3544): n is a, c, g, or t
  misc_feature (3548)..(3549): n is a, c, g, or t
  misc_feature (3551)..(3551): n is a, c, g, or t
  misc_feature (3554)..(3554): n is a, c, g, or t
  misc_feature (3556)..(3557): n is a, c, g, or t
  misc_feature (3562)..(3562): n is a, c, g, or t
  misc_feature (3564)..(3564): n is a, c, g, or t
  misc_feature (3568)..(3570): n is a, c, g, or t
  misc_feature (3572)..(3575): n is a, c, g, or t
  misc_feature (3577)..(3580): n is a, c, g, or t
  misc_feature (3582)..(3589): n is a, c, g, or t
  misc_feature (3594)..(3594): n is a, c, g, or t
  misc_feature (3596)..(3596): n is a, c, g, or t
  misc_feature (3602)..(3602): n is a, c, g, or t
  misc_feature (3605)..(3607): n is a, c, g, or t
  misc_feature (3609)..(3609): n is a, c, g, or t
  misc_feature (3611)..(3611): n is a, c, g, or t
  misc_feature (3613)..(3613): n is a, c, g, or t
  misc_feature (3615)..(3616): n is a, c, g, or t
  misc_feature (3618)..(3619): n is a, c, g, or t
  misc_feature (3621)..(3622): n is a, c, g, or t
  misc_feature (3626)..(3629): n is a, c, g, or t
  misc_feature (3631)..(3634): n is a, c, g, or t
  misc_feature (3638)..(3640): n is a, c, g, or t
  misc_feature (3642)..(3643): n is a, c, g, or t
  misc_feature (3645)..(3650): n is a, c, g, or t
  misc_feature (3655)..(3658): n is a, c, g, or t
  misc_feature (3661)..(3664): n is a, c, g, or t
  misc_feature (3666)..(3666): n is a, c, g, or t
  misc_feature (3668)..(3668): n is a, c, g, or t
  misc_feature (3671)..(3672): n is a, c, g, or t
  misc_feature (3677)..(3679): n is a, c, g, or t
  misc_feature (3681)..(3684): n is a, c, g, or t
  misc_feature (3689)..(3689): n is a, c, g, or t
  misc_feature (3693)..(3693): n is a, c, g, or t
  misc_feature (3696)..(3696): n is a, c, g, or t
  misc_feature (3700)..(3700): n is a, c, g, or t
  misc_feature (3706)..(3707): n is a, c, g, or t
  misc_feature (3709)..(3710): n is a, c, g, or t
  misc_feature (3712)..(3713): n is a, c, g, or t
  misc_feature (3715)..(3717): n is a, c, g, or t
  misc_feature (3720)..(3721): n is a, c, g, or t
  misc_feature (3723)..(3725): n is a, c, g, or t
  misc_feature (3729)..(3730): n is a, c, g, or t
  misc_feature (3732)..(3732): n is a, c, g, or t
  misc_feature (3734)..(3734): n is a, c, g, or t
  misc_feature (3739)..(3739): n is a, c, g, or t
  misc_feature (3741)..(3742): n is a, c, g, or t
  misc_feature (3748)..(3755): n is a, c, g, or t
  misc_feature (3758)..(3761): n is a, c, g, or t
  misc_feature (3763)..(3766): n is a, c, g, or t
  misc_feature (3768)..(3772): n is a, c, g, or t
  misc_feature (3774)..(3777): n is a, c, g, or t
  misc_feature (3780)..(3781): n is a, c, g, or t
  misc_feature (3783)..(3783): n is a, c, g, or t
  misc_feature (3785)..(3786): n is a, c, g, or t
  misc_feature (3788)..(3789): n is a, c, g, or t
  misc_feature (3791)..(3793): n is a, c, g, or t
  misc_feature (3795)..(3797): n is a, c, g, or t
  misc_feature (3799)..(3802): n is a, c, g, or t
  misc_feature (3806)..(3806): n is a, c, g, or t
  misc_feature (3812)..(3813): n is a, c, g, or t
  misc_feature (3815)..(3815): n is a, c, g, or t
  misc_feature (3819)..(3820): n is a, c, g, or t
  misc_feature (3822)..(3822): n is a, c, g, or t
  misc_feature (3826)..(3829): n is a, c, g, or t
  misc_feature (3831)..(3832): n is a, c, g, or t
  misc_feature (3834)..(3836): n is a, c, g, or t
  misc_feature (3838)..(3838): n is a, c, g, or t
  misc_feature (3840)..(3841): n is a, c, g, or t
  misc_feature (3846)..(3846): n is a, c, g, or t
  misc_feature (3848)..(3848): n is a, c, g, or t
  misc_feature (3852)..(3852): n is a, c, g, or t
  misc_feature (3855)..(3857): n is a, c, g, or t
  misc_feature (3861)..(3861): n is a, c, g, or t
  misc_feature (3863)..(3865): n is a, c, g, or t
  misc_feature (3871)..(3874): n is a, c, g, or t
  misc_feature (3876)..(3876): n is a, c, g, or t
  misc_feature (3878)..(3881): n is a, c, g, or t
  misc_feature (3885)..(3886): n is a, c, g, or t
  misc_feature (3889)..(3890): n is a, c, g, or t
  misc_feature (3893)..(3896): n is a, c, g, or t
  misc_feature (3898)..(3900): n is a, c, g, or t
  misc_feature (3907)..(3910): n is a, c, g, or t
  misc_feature (3912)..(3912): n is a, c, g, or t
  misc_feature (3914)..(3915): n is a, c, g, or t
  misc_feature (3917)..(3918): n is a, c, g, or t
  misc_feature (3922)..(3922): n is a, c, g, or t
  misc_feature (3926)..(3927): n is a, c, g, or t
  misc_feature (3929)..(3931): n is a, c, g, or t
  misc_feature (3933)..(3938): n is a, c, g, or t
  misc_feature (3940)..(3940): n is a, c, g, or t
  misc_feature (3942)..(3944): n is a, c, g, or t
  misc_feature (3946)..(3951): n is a, c, g, or t
  misc_feature (3955)..(3956): n is a, c, g, or t
  misc_feature (3959)..(3963): n is a, c, g, or t
  misc_feature (3965)..(3966): n is a, c, g, or t
  misc_feature (3968)..(3968): n is a, c, g, or t
  misc_feature (3970)..(3972): n is a, c, g, or t
  misc_feature (3974)..(3974): n is a, c, g, or t
  misc_feature (3976)..(3977): n is a, c, g, or t
  misc_feature (3980)..(3980): n is a, c, g, or t
  misc_feature (3982)..(3982): n is a, c, g, or t
  misc_feature (3984)..(3985): n is a, c, g, or t
  misc_feature (3987)..(3987): n is a, c, g, or t
  misc_feature (3989)..(3989): n is a, c, g, or t
  misc_feature (3991)..(3991): n is a, c, g, or t
  misc_feature (3993)..(3993): n is a, c, g, or t
  misc_feature (3995)..(3996): n is a, c, g, or t
  misc_feature (4000)..(4000): n is a, c, g, or t
aatttgtcgcacagcgacagcgtttcttgtcgcaatcttcttctcccgcgcctacggcgcggtcgggtttttctttaacttccaaggaagtcagtttctgcggtgaactattaacctttgctcgaacccactttgaaaacaaagaatgattgcaacgcgcggagcgcgtggtggctttgtacttcaacgtacgcattcgggttcgtggtgatgcacctcggacgcgagctaacactcgcgtgcaaaaccaaaaactttccttcctttatttctttaagcggagaggggtctggggagagccgccaaaaagatgaaaggaagtttttgttttgcttcgctatgttgcaattcttagtttaacactttatctaaagtttggatattgatattttggatagacactgtagtatatggttaagtcaatccacacaaaagagtatgcgtacgtcgttgagcaactttgcaaagcacgaaatgaaaagggtcttacccagtccgaagttgccaagaagttaaagcgcccacaatcacacgtttccaacattgaaactggtcaacaaaggattgatgttgttgaactccaaaggtttgcgaaaatctatggaaaagagattactcactttgtaaaatagcattatctatgtatataccaacttggattttaatactcattatcgcaggagttttttattatctttacacaaagaaaaagtcggatgaagtgaagagtattaattcacctaaagtggagaatgctgacaacaacactgatacccaaaatgaggactggttagactcagagaactggcaagatattgctttagaacacatggcaaaatttcctaaacgaacaggaaaaagtcgtccaacttatgaagaaatgcttgaactagacgaaaacgaatttaaggcgtggttgtttgttaaaggcgaaggagataatcaagaacaaactctcaaagaaatgattgagcacgagtcaagaactggcagttttacaaaaactgccagagctgatattcccccacacgagcaactaatcctcaatgtatttgataaagacaaaagtgcagaaactataaaagccattaggaatttagacaaagtagccaacgaacttaaagacgacaaaaaagatgaggatattgttaaacagtctatttgggcaaaagcaacttctgattacttcaagctgtccgaaaaataaacgttagtacccctgagaacagatcaagataatttgacataccaaaaatagtgtgatagtatgtatttcgctttgcactttaaaaaaacttgcgtttgccgtagcagaaagtgtctgaaacattggactttttctgctacggcacactgtattccacattgtgttttgctagcctcttatctagcaggtaagagagaacgccgactagtagtcggagaggaaaaaccaatgtccaagtacaattacgatctgagcgtcgacggcgtgagcgtggaagcaattctcaacaaactcggtggcgtggcgggagcaaagcgcttcctgcgtgatgaactcaacctggtcgaggtcaaaccgcaattcgaacgcaacgaacatggccacatcatcatctcgattaccggcctcgccctgactggcgagcaggaaatcgagcggctgaacagcgccggattccgcatcagccgctggacgaagtcgtgtttcacgtccacgaagaaggacggctacgacaagtgccatcggttggaggacgggcatgaatatcagctcgtcatcattcccggcaaggaggttgcgcagaatcgcacgaccaccgcgctgcgggaatacgccgcaggcttcggctaccaacaagcgctggctggtgtcgtccctcgcattcgcgaagctgtctcggatgagatgatggagaaaatggggttctggtacatcgccgcgctccatgaccccatcaccgattctgtcgcctacccgcgcgtgctcnacgcgnnccggnncggcgacggtcagtgggtcgatgcgngcttcggcnaccctgnccnccagtggcntgacnacggtgcgttcgcgttcctcgtctctgcaagttgaacttgatattggattctatgtgcttgcacttgaatcctttgtccttggtttcgcgctctgcgcgaagccaattttttttgctaaaatatagacggtactaagtgaatacgcgggcgattacggtttctcgctaccgaatccagtttttatatataccagagtgttctcggctacggcttaatgcagtgtgttatatacagactcaaaagtaaaaatacttggtgcgatctgctaatgcatttaagatgccgaattcgatacagctcggagaatattcaatgagcagtggcatggacggcatttcgtacaattctgacggcaacccgaacgtgctcaacgcgaaccggaacgacgacggtcagtgggtcaatgcgaacttcgacaaccctgacaaccagtggaatgacaacggtgcgttcgcgttcctcgtctctgcaactctttttatttctcaccccgctttgtcggggttgagtttttattaagttgtccattccaaccacccaacattttaccaacctcatccagcacttcagataatgcgatatacttctttgtatcaagtgatttcgtttcccataaaaccatgagtaataacttcaatgtgtccacttttctcgtcgccagctgtacatacggtagttttttctctcgcgaaagaaacgcagcagctgatattgcttctatactttcgataaacaactcgtctattcttgcaccgagtgagtatcggtgcagttttggtaatttagcgtggtacgtatgccagagcaagtaagcttgtttgattcgctccaaaatggggagcagctttttgcggggggggggnnnnntnnntnnntnntncnntnnnngntnnnnngatnnnntcnnngcanaaaatttncncnncnnntngngannatttttncgnngnaaannaaanaaaaaanntgnnnnannatttnnntannancnnanngannannnncntncncnncnnngnnnnntgngnnnnnaaanannnnntnnnngnnnatnnnnannnntnnanntcnncnncccaaaancgcnnnatnntnanaaanncngnnnnngnnanannntncnncnncncgnnatannncnaaanntatnntnatnttttnannanaaatttannnnannntnnnnctnntnncgnnntgggaaagggncnnannangnnntnngntnttttnnntnntnnnnannncnantnnnaaaaaancanncgnngnnntnntgggtnntaaaatgnnatnntanaaanttttttnnntnnnntnnncnanatannnnnnnnnatnntntttcnnngnatnntagannctnnnacnntnnnnannntnnnngnngnantnntnnnnnttttnatgngggnnntgngggnaaangnntnncnnntngaaatnnnanntcnnnacnncnngnnnatatanannnnnannnatttnnncnatttnnaaannanacncnnaaaancnagcnnnannnncnnnncnnnnnnnnttttntntttttntcnnnananananngnngnntgtnnnngnnnncccnnngnntnnnnnntttcnnnnatnnnnantngcnntttcnnntnnnncaaanaaantanaaantaaaanngnngnntnnngtnntnnntttnntngntgggnanntttttnnnnnnnncgnnnncnnnngnnnnntnnnnagnngnanntnntnnngnnnannnnaganaaaaanngnaaannanaaannnnannannntntnntgggntnctcncannngggnannnagagannnnanannnnaaanntgnngannnngnnnttttttnnnnananntnnaaantttnnannnannnnnngngnnnannnnnncacnncgnnnnngnnangnnnananntgngngnngncngngngnngtgn

SEQ ID NO: 348 - DNA, 4000 bp, Escherichia coli
  misc_feature (7)..(7): n is a, c, g, or t
  misc_feature (284)..(284): n is a, c, g, or t
  misc_feature (573)..(573): n is a, c, g, or t
  misc_feature (579)..(579): n is a, c, g, or t
  misc_feature (1112)..(1112): n is a, c, g, or t
  misc_feature (1576)..(1576): n is a, c, g, or t
  misc_feature (1658)..(1658): n is a, c, g, or t
  misc_feature (1924)..(1924): n is a, c, g, or t
  misc_feature (1985)..(1985): n is a, c, g, or t
  misc_feature (1991)..(1991): n is a, c, g, or t
  misc_feature (2028)..(2028): n is a, c, g, or t
  misc_feature (2550)..(2558): n is a, c, g, or t
  misc_feature (2560)..(2561): n is a, c, g, or t
  misc_feature (2563)..(2563): n is a, c, g, or t
  misc_feature (2565)..(2565): n is a, c, g, or t
  misc_feature (2567)..(2568): n is a, c, g, or t
  misc_feature (2570)..(2570): n is a, c, g, or t
  misc_feature (2572)..(2572): n is a, c, g, or t
  misc_feature (2574)..(2574): n is a, c, g, or t
  misc_feature (2576)..(2576): n is a, c, g, or t
  misc_feature (2579)..(2583): n is a, c, g, or t
  misc_feature (2585)..(2587): n is a, c, g, or t
  misc_feature (2589)..(2589): n is a, c, g, or t
  misc_feature (2591)..(2595): n is a, c, g, or t
  misc_feature (2597)..(2604): n is a, c, g, or t
  misc_feature (2607)..(2610): n is a, c, g, or t
  misc_feature (2613)..(2613): n is a, c, g, or t
  misc_feature (2615)..(2615): n is a, c, g, or t
  misc_feature (2618)..(2629): n is a, c, g, or t
  misc_feature (2631)..(2632): n is a, c, g, or t
  misc_feature (2634)..(2641): n is a, c, g, or t
  misc_feature (2643)..(2644): n is a, c, g, or t
  misc_feature (2646)..(2651): n is a, c, g, or t
  misc_feature (2653)..(2657): n is a, c, g, or t
  misc_feature (2660)..(2660): n is a, c, g, or t
  misc_feature (2662)..(2662): n is a, c, g, or t
  misc_feature (2665)..(2667): n is a, c, g, or t
  misc_feature (2669)..(2669): n is a, c, g, or t
  misc_feature (2674)..(2676): n is a, c, g, or t
  misc_feature (2678)..(2678): n is a, c, g, or t
  misc_feature (2680)..(2686): n is a, c, g, or t
  misc_feature (2688)..(2688): n is a, c, g, or t
  misc_feature (2690)..(2696): n is a, c, g, or t
  misc_feature (2698)..(2702): n is a, c, g, or t
  misc_feature (2704)..(2709): n is a, c, g, or t
  misc_feature (2711)..(2711): n is a, c, g, or t
  misc_feature (2713)..(2716): n is a, c, g, or t
  misc_feature (2718)..(2719): n is a, c, g, or t
  misc_feature (2721)..(2721): n is a, c, g, or t
  misc_feature (2723)..(2723): n is a, c, g, or t
  misc_feature (2727)..(2729): n is a, c, g, or t
  misc_feature (2731)..(2737): n is a, c, g, or t
  misc_feature (2739)..(2739): n is a, c, g, or t
  misc_feature (2743)..(2744): n is a, c, g, or t
  misc_feature (2746)..(2748): n is a, c, g, or t
  misc_feature (2751)..(2752): n is a, c, g, or t
  misc_feature (2754)..(2755): n is a, c, g, or t
  misc_feature (2757)..(2758): n is a, c, g, or t
  misc_feature (2760)..(2763): n is a, c, g, or t
  misc_feature (2765)..(2769): n is a, c, g, or t
  misc_feature (2772)..(2783): n is a, c, g, or t
  misc_feature (2785)..(2786): n is a, c, g, or t
  misc_feature (2791)..(2793): n is a, c, g, or t
  misc_feature (2799)..(2801): n is a, c, g, or t
  misc_feature (2803)..(2809): n is a, c, g, or t
  misc_feature (2811)..(2812): n is a, c, g, or t
  misc_feature (2814)..(2814): n is a, c, g, or t
  misc_feature (2816)..(2819): n is a, c, g, or t
  misc_feature (2821)..(2831): n is a, c, g, or t
  misc_feature (2835)..(2835): n is a, c, g, or t
  misc_feature (2839)..(2848): n is a, c, g, or t
  misc_feature (2850)..(2852): n is a, c, g, or t
  misc_feature (2855)..(2856): n is a, c, g, or t
  misc_feature (2858)..(2858): n is a, c, g, or t
  misc_feature (2860)..(2861): n is a, c, g, or t
  misc_feature (2863)..(2865): n is a, c, g, or t
  misc_feature (2867)..(2870): n is a, c, g, or t
  misc_feature (2872)..(2873): n is a, c, g, or t
  misc_feature (2875)..(2880): n is a, c, g, or t
  misc_feature (2882)..(2895): n is a, c, g, or t
  misc_feature (2897)..(2898): n is a, c, g, or t
  misc_feature (2901)..(2902): n is a, c, g, or t
  misc_feature (2904)..(2907): n is a, c, g, or t
  misc_feature (2909)..(2911): n is a, c, g, or t
  misc_feature (2913)..(2917): n is a, c, g, or t
  misc_feature (2919)..(2923): n is a, c, g, or t
  misc_feature (2926)..(2928): n is a, c, g, or t
  misc_feature (2930)..(2941): n is a, c, g, or t
  misc_feature (2943)..(2943): n is a, c, g, or t
  misc_feature (2946)..(2949): n is a, c, g, or t
  misc_feature (2952)..(2956): n is a, c, g, or t
  misc_feature (2958)..(2965): n is a, c, g, or t
  misc_feature (2967)..(2971): n is a, c, g, or t
  misc_feature (2973)..(2976): n is a, c, g, or t
  misc_feature (2978)..(2978): n is a, c, g, or t
  misc_feature (2980)..(2981): n is a, c, g, or t
  misc_feature (2984)..(2985): n is a, c, g, or t
  misc_feature (2987)..(2988): n is a, c, g, or t
  misc_feature (2990)..(2991): n is a, c, g, or t
  misc_feature (2993)..(2993): n is a, c, g, or t
  misc_feature (2996)..(2996): n is a, c, g, or t
  misc_feature (2998)..(2998): n is a, c, g, or t
  misc_feature (3000)..(3003): n is a, c, g, or t
  misc_feature (3005)..(3007): n is a, c, g, or t
  misc_feature (3010)..(3022): n is a, c, g, or t
  misc_feature (3024)..(3024): n is a, c, g, or t
  misc_feature (3027)..(3028): n is a, c, g, or t
  misc_feature (3030)..(3032): n is a, c, g, or t
  misc_feature (3034)..(3034): n is a, c, g, or t
  misc_feature (3036)..(3043): n is a, c, g, or t
  misc_feature (3045)..(3046): n is a, c, g, or t
  misc_feature (3048)..(3049): n is a, c, g, or t
  misc_feature (3052)..(3053): n is a, c, g, or t
  misc_feature (3055)..(3056): n is a, c, g, or t
  misc_feature (3058)..(3059): n is a, c, g, or t
  misc_feature (3061)..(3061): n is a, c, g, or t
  misc_feature (3064)..(3070): n is a, c, g, or t
  misc_feature (3072)..(3076): n is a, c, g, or t
  misc_feature (3080)..(3086): n is a, c, g, or t
  misc_feature (3088)..(3089): n is a, c, g, or t
  misc_feature (3091)..(3091): n is a, c, g, or t
  misc_feature (3094)..(3096): n is a, c, g, or t
  misc_feature (3098)..(3103): n is a, c, g, or t
  misc_feature (3105)..(3105): n is a, c, g, or t
  misc_feature (3111)..(3119): n is a, c, g, or t
  misc_feature (3121)..(3124): n is a, c, g, or t
  misc_feature (3127)..(3138): n is a, c, g, or t
  misc_feature (3142)..(3143): n is a, c, g, or t
  misc_feature (3147)..(3148): n is a, c, g, or t
  misc_feature (3151)..(3151): n is a, c, g, or t
  misc_feature (3153)..(3157): n is a, c, g, or t
  misc_feature (3159)..(3162): n is a, c, g, or t
  misc_feature (3164)..(3165): n is a, c, g, or t
  misc_feature (3167)..(3167): n is a, c, g, or t
  misc_feature (3169)..(3180): n is a, c, g, or t
  misc_feature (3183)..(3187): n is a, c, g, or t
  misc_feature (3192)..(3194): n is a, c, g, or t
  misc_feature (3196)..(3200): n is a, c, g, or t
  misc_feature (3202)..(3202): n is a, c, g, or t
  misc_feature (3205)..(3208): n is a, c, g, or t
  misc_feature (3210)..(3210): n is a, c, g, or t
  misc_feature (3212)..(3214): n is a, c, g, or t
  misc_feature (3216)..(3217): n is a, c, g, or t
  misc_feature (3219)..(3220): n is a, c, g, or t
  misc_feature (3222)..(3222): n is a, c, g, or t
  misc_feature (3224)..(3224): n is a, c, g, or t
  misc_feature (3228)..(3233): n is a, c, g, or t
  misc_feature (3237)..(3237): n is a, c, g, or t
  misc_feature (3239)..(3241): n is a, c, g, or t
  misc_feature (3243)..(3244): n is a, c, g, or t
  misc_feature (3246)..(3246): n is a, c, g, or t
  misc_feature (3248)..(3248): n is a, c, g, or t
  misc_feature (3251)..(3253): n is a, c, g, or t
  misc_feature (3255)..(3256): n is a, c, g, or t
  misc_feature (3258)..(3258): n is a, c, g, or t
  misc_feature (3260)..(3265): n is a, c, g, or t
  misc_feature (3269)..(3275): n is a, c, g, or t
  misc_feature (3277)..(3279): n is a, c, g, or t
  misc_feature (3282)..(3282): n is a, c, g, or t
  misc_feature (3284)..(3296): n is a, c, g, or t
  misc_feature (3298)..(3304): n is a, c, g, or t
  misc_feature (3306)..(3307): n is a, c, g, or t
  misc_feature (3309)..(3319): n is a, c, g, or t
  misc_feature (3321)..(3323): n is a, c, g, or t
  misc_feature (3325)..(3325): n is a, c, g, or t
  misc_feature (3328)..(3328): n is a, c, g, or t
  misc_feature (3330)..(3332): n is a, c, g, or t
  misc_feature (3334)..(3334): n is a, c, g, or t
  misc_feature (3336)..(3337): n is a, c, g, or t
  misc_feature (3339)..(3351): n is a, c, g, or t
  misc_feature (3354)..(3356): n is a, c, g, or t
  misc_feature (3358)..(3359): n is a, c, g, or t
  misc_feature (3361)..(3361): n is a, c, g, or t
  misc_feature (3364)..(3368): n is a, c, g, or t
  misc_feature (3370)..(3371): n is a, c, g, or t
  misc_feature (3373)..(3378): n is a, c, g, or t
  misc_feature (3380)..(3382): n is a, c, g, or t
  misc_feature (3384)..(3385): n is a, c, g, or t
  misc_feature (3387)..(3389): n is a, c, g, or t
  misc_feature (3391)..(3391): n is a, c, g, or t
  misc_feature (3393)..(3394): n is a, c, g, or t
  misc_feature (3396)..(3404): n is a, c, g, or t
  misc_feature (3406)..(3423): n is a, c, g, or t
  misc_feature (3425)..(3428): n is a, c, g, or t
  misc_feature (3430)..(3432): n is a, c, g, or t
  misc_feature (3434)..(3434): n is a, c, g, or t
  misc_feature (3436)..(3440): n is a, c, g, or t
  misc_feature (3442)..(3442): n is a, c, g, or t
  misc_feature (3444)..(3466): n is a, c, g, or t
  misc_feature (3468)..(3468): n is a, c, g, or t
  misc_feature (3470)..(3471): n is a, c, g, or t
  misc_feature (3474)..(3476): n is a, c, g, or t
  misc_feature (3478)..(3478): n is a, c, g, or t
  misc_feature (3480)..(3481): n is a, c, g, or t
  misc_feature (3483)..(3484): n is a, c, g, or t
  misc_feature (3486)..(3499): n is a, c, g, or t
  misc_feature (3502)..(3502): n is a, c, g, or t
  misc_feature (3504)..(3506): n is a, c, g, or t
  misc_feature (3508)..(3508): n is a, c, g, or t
  misc_feature (3510)..(3518): n is a, c, g, or t
  misc_feature (3521)..(3522): n is a, c, g, or t
  misc_feature (3524)..(3524): n is a, c, g, or t
  misc_feature (3526)..(3529): n is a, c, g, or t
  misc_feature (3531)..(3535): n is a, c, g, or t
  misc_feature (3539)..(3542): n is a, c, g, or t
  misc_feature (3544)..(3555): n is a, c, g, or t
  misc_feature (3559)..(3562): n is a, c, g, or t
  misc_feature (3566)..(3574): n is a, c, g, or t
  misc_feature (3576)..(3576): n is a, c, g, or t
  misc_feature (3578)..(3581): n is a, c, g, or t
  misc_feature (3583)..(3583): n is a, c, g, or t
  misc_feature (3586)..(3593): n is a, c, g, or t
  misc_feature (3596)..(3596): n is a, c, g, or t
  misc_feature (3598)..(3600): n is a, c, g, or t
  misc_feature (3602)..(3609): n is a, c, g, or t
  misc_feature (3611)..(3618): n is a, c, g, or t
  misc_feature (3620)..(3620): n is a, c, g, or t
  misc_feature (3622)..(3623): n is a, c, g, or t
  misc_feature (3625)..(3626): n is a, c, g, or t
  misc_feature (3629)..(3629): n is a, c, g, or t
  misc_feature (3632)..(3632): n is a, c, g, or t
  misc_feature (3634)..(3647): n is a, c, g, or t
  misc_feature (3650)..(3650): n is a, c, g, or t
  misc_feature (3652)..(3654): n is a, c, g, or t
  misc_feature (3656)..(3656): n is a, c, g, or t
  misc_feature (3659)..(3663): n is a, c, g, or t
  misc_feature (3665)..(3667): n is a, c, g, or t
  misc_feature (3669)..(3673): n is a, c, g, or t
  misc_feature (3675)..(3676): n is a, c, g, or t
  misc_feature (3678)..(3678): n is a, c, g, or t
  misc_feature (3680)..(3680): n is a, c, g, or t
  misc_feature (3683)..(3683): n is a, c, g, or t
  misc_feature (3685)..(3689): n is a, c, g, or t
  misc_feature (3691)..(3691): n is a, c, g, or t
  misc_feature (3694)..(3696): n is a, c, g, or t
  misc_feature (3698)..(3700): n is a, c, g, or t
  misc_feature (3702)..(3704): n is a, c, g, or t
  misc_feature (3707)..(3709): n is a, c, g, or t
  misc_feature (3711)..(3715): n is a, c, g, or t
  misc_feature (3717)..(3718): n is a, c, g, or t
  misc_feature (3720)..(3729): n is a, c, g, or t
  misc_feature (3731)..(3741): n is a, c, g, or t
  misc_feature (3744)..(3746): n is a, c, g, or t
  misc_feature (3748)..(3755): n is a, c, g, or t
  misc_feature (3759)..(3763): n is a, c, g, or t
  misc_feature (3768)..(3768): n is a, c, g, or t
  misc_feature (3770)..(3771): n is a, c, g, or t
  misc_feature (3773)..(3786): n is a, c, g, or t
  misc_feature (3789)..(3793): n is a, c, g, or t
  misc_feature (3795)..(3796): n is a, c, g, or t
  misc_feature (3798)..(3800): n is a, c, g, or t
  misc_feature (3803)..(3807): n is a, c, g, or t
  misc_feature (3809)..(3809): n is a, c, g, or t
  misc_feature (3811)..(3811): n is a, c, g, or t
  misc_feature (3813)..(3813): n is a, c, g, or t
  misc_feature (3816)..(3817): n is a, c, g, or t
  misc_feature (3819)..(3821): n is a, c, g, or t
  misc_feature (3824)..(3826): n is a, c, g, or t
  misc_feature (3829)..(3829): n is a, c, g, or t
  misc_feature (3832)..(3833): n is a, c, g, or t
  misc_feature (3835)..(3836): n is a, c, g, or t
  misc_feature (3840)..(3841): n is a, c, g, or t
  misc_feature (3845)..(3846): n is a, c, g, or t
  misc_feature (3849)..(3851): n is a, c, g, or t
  misc_feature (3853)..(3854): n is a, c, g, or t
  misc_feature (3922)..(3922): n is a, c, g, or t
  misc_feature (3984)..(3984): n is a, c, g, or t
gtctgtnatcttcaactgtgcagggtgaacagttctatggcgacatgtggcgcacccttgaaacggagggaagttgggaaggggaggtttgggatacccgtaaaaatggtgatgtgttccccctgttagttaccgtaaagactattcatgatgccaagagtcgaattacccattacgtattttcgttttccgacattactacgactaaaagagatgcggatgcgatccataagctggctttttttgatccattgacacatttacctaatcgtcgcgctcttatngacactgtctctcaagcattgaactcgagccaacggcatatcaaaagtctggctttattgtctatcgacttggacaactttaaaaacatcaatgacactctagggcatcagctgggcgataaaattttgattgaaacggcacagcgattgcgtcgatgcgttcgaagtgatgatgccgttgcccgcattggtggtgatgagtttgtcgtagtgctggagaacttagactcgaatattgaaagtgccaaggttgaagtcgaggtggtgacgacgaagattttggctgttntcaacnagtcttatcgcgtcgatgagcaagatatacacagcggtgccagcattggagtggccctcacagataatggtcagatacttatagaagagttgttcaagcaggccgatatagctctgtatcagagcaaacggtcgggccgtaatcaaatgtgtttctttgacctggccatggaagaaacggtaactctgcaggctcagctagccaacgcactgcacagcgcggttcaattgcagcagtttgagctctattatcaggttcaggtcgatagccagcagaggcctgtgggagctgaagcgttaattcgctgggagcatcctcaacttggaatcgtgtcgcccagtgattttattcctctggccgaggcgtcagacctgattctttccattggccagtgggttttagaaactgcctgtgctcagttaaagcgttggcaaagtcaattgcacaccagcgggcttagcgtcgcggtcaatattagcccacgtcagtttcaccagtgtaattttgttgaaacggttttacaggcgattgcnagctgtaatatttccccgagtttgctaaagctagaacttaccgaaacagtgatcctcgacaataccagtgaaaccatcgagaaaatgcaccaactgcagcgggcaggagtggagtttgcattggacgattttggcactggctactcatcgctatcgtatttgactcaattgccgttatcgcaattgaagatggatcaatcgtttgtacgcaatataggtatcaaggagggtgacgatattatcgtccagacgattatcgctatggccaaaagcttagcgatcaaggtcatcgcggagggcgttgaaactgaggcccagcatgagtttcttgacgcgttgggttgcccgttatttcaaggctatctgtttggtaaaccagtacccattgccgagtttgaaaagttactggcataactatctcggcagggctgtcatgttgctgtctcttctatatttggcccttnactatttaataatatcctcattgagaagggcgctggcatcagcaactccgccagcgttgattacattgctatatcccatggnttcaactaacgtttttgcctggccagagcgattgccgctgcgacagtagagatacagctgctgactcttgttgggtaccagctgctcaatctgtgcggcaaccaactgcagctcaatatgctgtgctgaggcaagatggcctgagttccactcttctgtggttctaacgtcgataatcatgtggctgtctccttggattgcgccggcccaaaagctcagcgcgcaaatagcggttattagtaatggcttcattggcatagaatccnaaatttttggcgctactttacgggtagggccgtggcgctgcaactttgtatcggtgtattntggagncgcttcagctcggtgagtgtaagctatcaggcgaccnttctaagacgtcgataataacatccagagttaagtgtatgaatactatctcagaagaggagctacttgctcttcaagcacatgtcgaagttgagaattgtcagtggcgtaagctcaaaaaacggattcttattcgtaccggtgtgattatcgtcttgcttctgtctagggtaataatgtttaaagtgtatcctcaaacattagtccccattgtttttgaaagcgcaggtttagatgccgaaggactatcgtcactgatttctgcaaggctggtggcaggcatcgtgctcgcgggtgtgtatttttatgcagtgatgactaatagttacctgagatcggtcactgttattgccttaatggtgcctattgccttgatttgggccgacctacaaatgtatttggcatcgtcttttccagactttacgctggtagcgtcgatttctttttgcttgcggttaattaccatctccctccttacgctaaattatatggatgttagacgttaattgtcgatgccattttnnnnnnnnnanngntnannantnangnccnnnnnannnantnnnnntnnnnnnnnttnnnnttncnttnnnnnnnnnnnncnnannnnnnnngnngnnnnnncnnnnnttnanggnnnanttttnnngntnnnnnnntncnnnnnnnannnnntnnnnnngncnnnngnngncnaaannnannnnnnngnaaanngnnnggnngnnannannnnannnnnttnnnnnnnnnnnnannccccnnnaaaaannnannnnnnngnnancnnnncnnnnnnnnnnncccnaaannnnnnnnnnannnggnntngnntnnngnnnncnncnnnnnncnnnnnnnnnnnnnncnnggnngnnnnannngnnnnngnnnnnaannnannnnnnnnnnnnanggnnnnaannnnngnnnnnnnnannnnnannnncntnnccnntnncnntnaantnannnntnnnaannnnnnnnnnnnngnttnngnnntnannnnnnnnannannccnncnntnncnaannnnnnnannnnnaaannnnnnntnncnaannncnnnnnncnaaaaannnnnnnnnannnnggnnnnnnnnnnnncccnnaaannaantnnnnnannnntnntncnnnnnnnnnnnnggnnnnnaaaannncnnnnnanggnnnncnannnanncnncnancccnnnnnnaaantnnncnncnanccnnncnntngnnnnnngggnnnnnnntnnnccnannnnnnnnnnnnngnnnnnnnannannnnnnnnnnnannntnccngnnnangnngnnnnnnnnnnnnnggnnngnncnaannnnnannannnnnncnnnannannncngnnannnnnnnnntnnnnnnnnnnnnnnnnnngnnnncnnngntnnnnncngnnnnnnnnnnnnnnnnnnnnnnnantnnaannncnannannannnnnnnnnnnnnnccngnnntnannnnnnnnnccnntnannnngnnnnncccnnnntnnnnnnnnnnnncccnnnncccnnnnnnnnngncnnnncnaannnnnnnnccnannncnnnnnnnngnnnnnnnncntnncnnaanggncnnnnnnnnnnnnnnccnannntnggnnnnngnnngnnnnnanngntnaangnnnnncnttnnngnnngnnnaannngnnnnnannannnnnnnnnnannnnnnnnnnnccnnncnnnnnnnncccnnnnnaaaantnntnnnnnnnnnnnnnnttnnnnngnntnnnggnnnnntngntnggnntnnnccnnnaanggnntnncttnnaaannggnnnanngttcggcgatgctccagaacaaaatgccaatacctatgccggcaccaaagagcattgagagccatganaaattgctaaattccggcctttcatcgtcgccgcccaagcgaatattaccgaatttgctcantgctagaccgagcaca

SEQ ID NO: 349 - DNA, 4000 bp, Escherichia coli
  misc_feature (1545)..(1545): n is a, c, g, or t
  misc_feature (1979)..(1979): n is a, c, g, or t
  misc_feature (1983)..(1985): n is a, c, g, or t
acatgatgatgttcatgaagacgtcctttgtgatgaaggtgtcgcgcttcgtgatcaagcggcaacccaacaaggtgtcttgcacgatagccatcacgggcttgttggcctggggcgatacgatcattttcggtaccatcatcaactccttcacctccgcgcgtgtctcgtaagactgcggaaggtgcatgttcatttcatccccatcaaaatcagcgttgtatggcggcgtgacagacaagttcaatctgaacgtcgagtaaggcatgattcggacgcgatgacccatgatggacatcttgtgcaaagaaggttgacgattgaacaggacgacgtctccgttcaccatgtgacgttcaactttgtaaccgtactcgagacgcttctcgctcgacttcttcaagaagcgaagatcgagtcgctgaccatcctcacgaatgatgtaacgcgcaccggtctcaccaggaggtggatgcgggccgttctcgaccaatcgttgaaggcgatcgatgttgtacggcgtcacggtttccggatacgtcatgttcaacgcgatggaccacggaactccgagctcgtcgagcatcaagtttggatcgggcgtaatgacggtacgcgcagagaaatccacgcgcttacccatcaagttgcctcgaattctacccgccttgcccttcaaacgctctgaaatggatttaatgcttcggccgctgcgcgtgagcgctcgcggcatgccagccaccgtgttgtccatgaaggtcatgatgtgatactgaagcagctctgtaaattctaaaatgacgtgctgcggcgctccattttgttcttgtctctctaaatttttattcgttctcacgatttccatgagcttgaccgtcaaatcgtcctccgagcgcgtggaagcgtcgaacgacaccgacggacgaaccggcggcggcggcacgggcatcacttgcaagatgaaccaatccggacgcgcgtgctcggggtcgagacccagcgcacggcaatcctcgtcagaaatcgccttcaagatctgtaacgcgcgctccgcggtgacgatcaccttgcgttcgccaccttccggcaacagctcctcgtcgcggtgcttgaactcggcggtgatcttcattccctccaaacgatactgcggttgcgccgtcccggtgtacggacacacgctcttggttttacacgcgtcggtgagtttcttcaatcggtttttcgggttcttgattcgcatcaactgcgcaaactttgggtcctcgtccttgtgcagcaacaattgcgaagacgagtatccgacgcatctcagaattctcaacacgacgttgatgaacccatgatggtacaccggtttcgccaactcaagatgcccaaagtaacccggcgtctgcacgctgtcgcacccgtccgtctcgcacaccgcgccgcgatccatcgtccccatgcgcggatcggacaaaccccctcgcttgggtctacccttctcgtacgtctcgctcgtctcgatcgcgcacacggacattttacgctatcgcgcgnaagtttcacgttcggtcagtgcgcgctcgctcgccttcgtcgcccgcgtcgcgcgttcgccctcgccgcctcgccctctcgaagatctcccgcgccggcgctctttcgcgccttcgcttcgcgcgcgcgcgcgttcgatgcacgtacgatctcatcgggcgacaacaccccaaactgcaccgcgtttacgcggcacagctccgcggtcgagtgcgggaaccgatcgtgaacgctcatttcgtgagaaaatgcgcgcgcaagatttcgtgcttcggcgcgatcgttcgagaagacgacactttccgcgcgcggtgcgcgcgctcggggcgagcgcgcgcgcggagacgcggcgggaggaagtgttgcgtcgctcgatcgccgaagacgcgagttggaaagcgcgaggcgtcgcgctctgacgatctcagcgccgncccnnncttcagggtttagaagaaagaaattacagacgcggcgcgcgagagcgcgagagacgtcggctagagagctaaggctacttgttcgccgcccagtggcggtaccgcggcaccccggccgcgcgcacggtgtccttgaataaatacagcttgggcaacgcctcgtcccacggaccggcgatttgacgcttaccgctcgcggcgagccgaacgagcgacgccggcgcgacgacggcgagaagaaagacgccgacgacgtacgcccacgccaaagtctcgtcgcgcgcccgcgcgacggtgaacgcgatgatgtgtagtgcgaacaccacgacgagatgaagcgtcgtggagaaggcgcgaatggcgcgccagacgtacggcgataacacgtaacactcgagcgcgagcaagacgtcggcgaagacgctcgcgggatcgtccaaacgactcgccatgagcaacgacgcgaacatggacgctccgagcgaaaacgaactcgcgagctgtttcgtctcgagattcacgaacgcgtaatcgtacgtgatggcgtagagcgcgagcgcgagcgtcgcgcacgtcgccgccgtatcgtcgctcaccgccgccgtcatcgtctgacacagcggcgtcagcgccacgagccccccgagcgtgagcgcgcccaatcgaatcgaccgccacgcccttcccgcgcgcccgagcttcaccgatccctccgcgctcgatccgtcgccgcccagcgcccacgccgccagcccgacgcccagcgcccgcgtctcccaccgcaccagcgtccgcgcgcgcaccgcgccgtccgcgatcgcgccgtgcgcgccgctgtgtatcaccaccaccgcgcactgctgcgagatcgtccacgccgcgcgcgcgctcgtcgcgaacgaccgcgtcttgacgcttttgttcaatcgcatgcgcgcgagaaacgtccgcggatcggtgtgattatcgcgcagcgcgcgcgcgtcgcggtcgtagagcacgcgatagtctctcgcgcgcgcgtcgtcgcgcggcatgccgcgcgccgcgcgccgccgactgaagtcacttcgcgacgactcgatgcgagtcaccgacgacgacgacgacgcgcgcgcgcgcggcggcggccgcggccgcggctacggcggcgcgaaatcgagacgcgcgcgcgccgcgcgcgcgtcgcgcgaaccgcgcgcgaaccgcggcgcgttgccgctgaagacgcccgtcgtcgcgtccgaggacaccaatcgacgattgttcgacgacgcgtcgccgagcgacgcgcgcgatctcagcgcgtggttcgcgctcgcggacgacgcgatcgcggacgacgcgatcgacgacgcgtactggcgcgacgaggcgatgcggcgcgacgcgacggaggcgtgggggcgggcgaacgcgctcgattggtccgagacgaccgaggcggcgcgagcgcgcggatacggcggcgaccgggatcgatcgttcacgcgcggcgcggcgcgcgtgaatcacgacgtcgtgacgtacgagagaaagaaaaggactcgatgcgaggggttcgacgcgcagatgtggcgaggggtggcgagcgaggggaagcacatgtcggcgtgggagcgcgagacggcgcggagcgagcgacggcgaccggcgcgcgagacgggcgggattgaaaatttagggaattcgtgctacatcgccgcgtctttgcagttgttgcgaagcatgcgtggattcgtggagtcggttcacgaggtgtctggagacgaggacggtaaaccgttactcgccgcgctcggcgagtttttcagatcagacgcgagcgagttgagcgcgtcgggcgtgaagcgcgaaatgggtcgcgtgcgggacgagtacggagagttcgatcaacacgacgcaatggaattcatgacgcaaatgttggacacgatcgagcgcgaaatgggtgacgacgcggcgcactgtccgagtcgacaaaacttcgcgtggcgcatcgagcacgcgctatc

SEQ ID NO: 350 - DNA, 4000 bp, Escherichia coli
  misc_feature (699)..(699): n is a, c, g, or t
cgcttgcgctgcagggtttagcgttcagcggaatggtttgcgcgcaatcgtccgccgagcagcaggcgcagcaaccgattccagcatcacgcaattttattgggcttggcattggcgccttccccaaaacaccgggcagcagcgatctacgcgtaatggcattgccggtgctgcagtacaccttcggtgatgtcggctacatcacggggctaaaggccggcgtgtggggttttacttcggaagatcagtcgattcgaatcggcctgtacgccgagccacgctttggttatgacagtgccgacaacccgctcaccgtaggcatggcgaatcgcagctttgccgtcgacttgggccccagcgtgcgttggaccacgccggtgggtgtgctgaactttgattatggctttgacgtcagcagccgcagcgacggtcaggtcgcgcaattgcaatttattcgaccacttgtcagcgagattggatttcgcctgaatggcgtcgttggcgcaacatggcaaaacgcggcgatgaataattattactggggcgtgcgggcttctgaggcgaccgcgactcgtgccgcctacaccgccggcgccggtgtgggtctgtcggttggcctatccgggctgtacgctttcggcccaaccagcgccctgttttatggtgccaccattaaccggctgtcgagcgctcagtccnacagcccgatcgccgagcgcgggtttgcgccgctgatttacctcggctacggctggcgcatgtagtctcgacaagctacgtctcgtagctgggcgattcctgccccgagcgtaaccagtccggcgagacattacagatacgcgccaccacttccatgttgccgttggccggcagcgcttcccctgacagccacttgctcacggttgaaaccgccaccgaagaacctgcctgcatcgcgcaaaaagctcgcagcaactgcgtcgggcggttggggtctatgccggcgttcgcaaggctgctgcgcagccgtctgctgaacgcttctctctccttgaaattcaggtgggctgccatagcaacgggtggtgtgcgtaggtgagagttaaatcctgaacattgtcatcaatcgtgtcggctaattgcgcgtgatttcattcaatcgctacacgcaagctgggcaaatcaataccactcaccaccgccacccactcctggccactgcacatcggcgcggctggaagccagccaccgatcgccaagcactgaccagcaacgaacgggctctcgctggtaagttcgatgtgccgctgatgcagcgcgtaggcgtgctgcagcgatttatccaaccgatcacgccccataccaaagccaacaatctgcgcgccctgacgctcgaccacattcaaggtcatggttgcgttcgacacgagttgatcaaacacggtacgacttttttgcgagagggtctttgcctcgcccatcaccaggtgcgaatgaaaaccgttggcgcagactttgtcggcgtcgacccagcgctcagatttgaacgggttctgcagaatttcgagtgccagcgctaccgagtcgaagcgctgcaagaaggtctgcaacccctcaccgggctcaggcgttgagcccaaaccgaacaccagggtgggttccaccatcagtggcttggtaccgcgcagcttgatcgcggtggcattgtcctcggcgtgcaacaccgagtgctggtacagatagcccaagcgcggtaactgaaccgcctcactggtagcgattgactcgcccaaaatcattttgcggccgaccagctgccagccttcggcaacacccagggtgtgcaacgtgtcgagcactcgcacgctctcttcgcggtccaaaccgagttgctcggcctgtggctccagtagcgcgcgtttgccttgattcgcctgaattgcgtgcgcgtaagacagaagtcgggaggtatgcagcatttgcggcccctctaaatgtgtagaattggaacatgttgtaccgactttacttctacacttctaataaaatttctctatcaaccccattaaatctatagttgtgtaggtttatgtgctaaaaatcttgtatttacaaggccagctggttaagattgtgcaggttatgcattgaagaaattttcagagctttctgcttagtttttaagaaagaaacgcatggacactgcgactgctgtcaagctgctatcgatcggcgcgatttcgcgcgaaactggcattcatgtctctaccatccgcatgtgggaggcgcgctatggcgtgctgcaacccgtgcggaccgacggcggtgcgcgccggtacagcagcacagacctcgagcggctaagactgatcaagttgttggtagatcgtggtcacaagccgagcgcgctggccaagctgacgcttgatcagttgagctcggaattcatagggccacctgcccgcgctggtgcgaacgcgccggtagcgccgagaatcgcctccatgggcagcgcgacatggcgctcgttactgttcgctgatccggccatgaagccttggacccccgccgcgcattttgacgagttggcagatgttgaaagccggcttgaaacgtttgatgtcggcatcgtgctcacgcccgcgttgcagatgaacctggctaaatatctggccgctgcgctctccgtgtacaagaccaagacgctggtggtgatctatgaattcagtagcagcagcgtgattcgttttctgagtgcgcttggtatcgagtgcatcaaataccccgcagcgccgatggatctggcgcgtagcctggcatcgattgtcgagtcgcggcaggcagatgcacactcgccggcgcagccgcgatttggcatggagcggcttcacacaatcgcggcgaccgactctcacttgctgtgtgagtgtcccaaacatcttgccagcctgatcatcagcctgcacagctttatccaatacagtaaccagtgtgtgaacgactcgcccaaggatgccttgatccatgaaaaactacgggatattgcaagcctcggtatcgtgcaactggagtccgggcttgatcttgtgttggaagccgaaaaaataaatcaagtccacgccgcatgaaaccgatcgcgatttttcgtcattctgcggctgatggtccagcctacctcgcgacgtttttacagcagcagcagattccctaccaagaagtgcgaatcgatcgtggcgaccctgtcccgaagcaggccgatgcgtatgccggtatcgcgctcatgggcggaccgatgagtgttaacgatccgctgccttgggtagccgactcgttggcactgatccgcgatgcggtcgagcgcgatgtgccgttgatcgggcattgcctcggcggtcaattgatcagtaaagcgctcggcggcgctgtcacgcgtaacccgaatggtaaagaaattggttggcaccagctgcatgtgacggatgctgccttgggtcggcattggctgggtaccgatgatggcttggttgggtttcactggcacggcgaaacgttcacactacccactggtgcgagttggctggcgcgcagcgaggcctgtaccaatcaggcgtatgtgcttggcccgcacattggtatgcagtttcacatcgagatggatgcgccaaccatcgccagctggtgcgatgagggcgcgccggaagtcgatgccgcccgcagtaaacccgacgtgcatccgcacgtgatgaccacgcagcagattgcagagcgcacgccacagcaccttcccgcgatgcgcgcggtcgccgaacatttgtatcagcgctgggtcggtaatctacgcggatagcccaatgcgggcacgccgcatgactacccggctcgaccacctgcattaactgcctgcttcaaccgcctacactaactgcctggttcaactgcctgcttctgcttgctgtgcctcttgctcgcgccggtagcgcaacgatgacatcaccgatgctgcaataaacgcgataccaat

SEQ ID NO: 351 - DNA, 4000 bp, Escherichia coli
  misc_feature (1326)..(1326): n is a, c, g, or t
  misc_feature (2008)..(2008): n is a, c, g, or t
  misc_feature (2336)..(2336): n is a, c, g, or t
  misc_feature (2615)..(2615): n is a, c, g, or t
  misc_feature (2989)..(2989): n is a, c, g, or t
  misc_feature (3007)..(3007): n is a, c, g, or t
  misc_feature (3024)..(3028): n is a, c, g, or t
  misc_feature (3032)..(3036): n is a, c, g, or t
  misc_feature (3041)..(3047): n is a, c, g, or t
  misc_feature (3051)..(3053): n is a, c, g, or t
  misc_feature (3062)..(3062): n is a, c, g, or t
  misc_feature (3066)..(3069): n is a, c, g, or t
  misc_feature (3073)..(3076): n is a, c, g, or t
  misc_feature (3079)..(3081): n is a, c, g, or t
  misc_feature (3086)..(3087): n is a, c, g, or t
  misc_feature (3090)..(3090): n is a, c, g, or t
  misc_feature (3097)..(3099): n is a, c, g, or t
  misc_feature (3106)..(3107): n is a, c, g, or t
  misc_feature (3110)..(3113): n is a, c, g, or t
  misc_feature (3124)..(3124): n is a, c, g, or t
  misc_feature (3130)..(3131): n is a, c, g, or t
  misc_feature (3134)..(3135): n is a, c, g, or t
  misc_feature (3138)..(3138): n is a, c, g, or t
  misc_feature (3141)..(3141): n is a, c, g, or t
  misc_feature (3144)..(3149): n is a, c, g, or t
  misc_feature (3156)..(3156): n is a, c, g, or t
  misc_feature (3159)..(3159): n is a, c, g, or t
  misc_feature (3162)..(3162): n is a, c, g, or t
  misc_feature (3166)..(3166): n is a, c, g, or t
  misc_feature (3169)..(3172): n is a, c, g, or t
  misc_feature (3175)..(3175): n is a, c, g, or t
  misc_feature (3178)..(3178): n is a, c, g, or t
  misc_feature (3181)..(3181): n is a, c, g, or t
  misc_feature (3190)..(3192): n is a, c, g, or t
  misc_feature (3196)..(3199): n is a, c, g, or t
  misc_feature (3202)..(3202): n is a, c, g, or t
  misc_feature (3207)..(3209): n is a, c, g, or t
  misc_feature (3212)..(3213): n is a, c, g, or t
  misc_feature (3218)..(3221): n is a, c, g, or t
  misc_feature (3226)..(3226): n is a, c, g, or t
  misc_feature (3229)..(3230): n is a, c, g, or t
  misc_feature (3238)..(3248): n is a, c, g, or t
  misc_feature (3253)..(3254): n is a, c, g, or t
  misc_feature (3259)..(3260): n is a, c, g, or t
  misc_feature (3263)..(3264): n is a, c, g, or t
  misc_feature (3267)..(3269): n is a, c, g, or t
  misc_feature (3273)..(3277): n is a, c, g, or t
  misc_feature (3280)..(3281): n is a, c, g, or t
  misc_feature (3285)..(3286): n is a, c, g, or t
  misc_feature (3290)..(3294): n is a, c, g, or t
  misc_feature (3298)..(3298): n is a, c, g, or t
  misc_feature (3305)..(3310): n is a, c, g, or t
  misc_feature (3314)..(3314): n is a, c, g, or t
  misc_feature (3320)..(3321): n is a, c, g, or t
  misc_feature (3324)..(3324): n is a, c, g, or t
  misc_feature (3327)..(3329): n is a, c, g, or t
  misc_feature (3337)..(3339): n is a, c, g, or t
  misc_feature (3341)..(3342): n is a, c, g, or t
  misc_feature (3344)..(3345): n is a, c, g, or t
  misc_feature (3347)..(3347): n is a, c, g, or t
  misc_feature (3349)..(3351): n is a, c, g, or t
  misc_feature (3354)..(3357): n is a, c, g, or t
  misc_feature (3359)..(3360): n is a, c, g, or t
  misc_feature (3363)..(3363): n is a, c, g, or t
  misc_feature (3365)..(3373): n is a, c, g, or t
  misc_feature (3375)..(3378): n is a, c, g, or t
  misc_feature (3380)..(3381): n is a, c, g, or t
  misc_feature (3384)..(3384): n is a, c, g, or t
  misc_feature (3386)..(3387): n is a, c, g, or t
  misc_feature (3391)..(3401): n is a, c, g, or t
  misc_feature (3403)..(3405): n is a, c, g, or t
  misc_feature (3407)..(3408): n is a, c, g, or t
  misc_feature (3410)..(3411): n is a, c, g, or t
  misc_feature (3413)..(3418): n is a, c, g, or t
  misc_feature (3421)..(3422): n is a, c, g, or t
  misc_feature (3424)..(3426): n is a, c, g, or t
  misc_feature (3429)..(3430): n is a, c, g, or t
  misc_feature (3432)..(3432): n is a, c, g, or t
  misc_feature (3434)..(3434): n is a, c, g, or t
  misc_feature (3437)..(3438): n is a, c, g, or t
  misc_feature (3440)..(3443): n is a, c, g, or t
  misc_feature (3445)..(3456): n is a, c, g, or t
  misc_feature (3458)..(3463): n is a, c, g, or t
  misc_feature (3465)..(3468): n is a, c, g, or t
  misc_feature (3470)..(3472): n is a, c, g, or t
  misc_feature (3474)..(3478): n is a, c, g, or t
  misc_feature (3480)..(3481): n is a, c, g, or t
  misc_feature (3483)..(3488): n is a, c, g, or t
  misc_feature (3491)..(3491): n is a, c, g, or t
  misc_feature (3493)..(3495): n is a, c, g, or t
  misc_feature (3497)..(3500): n is a, c, g, or t
  misc_feature (3504)..(3504): n is a, c, g, or t
  misc_feature (3506)..(3511): n is a, c, g, or t
  misc_feature (3513)..(3518): n is a, c, g, or t
  misc_feature (3520)..(3522): n is a, c, g, or t
  misc_feature (3525)..(3529): n is a, c, g, or t
  misc_feature (3531)..(3531): n is a, c, g, or t
  misc_feature (3533)..(3538): n is a, c, g, or t
  misc_feature (3540)..(3540): n is a, c, g, or t
  misc_feature (3542)..(3542): n is a, c, g, or t
  misc_feature (3544)..(3544): n is a, c, g, or t
  misc_feature (3550)..(3553): n is a, c, g, or t
  misc_feature (3556)..(3556): n is a, c, g, or t
  misc_feature (3558)..(3558): n is a, c, g, or t
  misc_feature (3560)..(3560): n is a, c, g, or t
  misc_feature (3562)..(3563): n is a, c, g, or t
  misc_feature (3565)..(3565): n is a, c, g, or t
  misc_feature (3567)..(3574): n is a, c, g, or t
  misc_feature (3577)..(3577): n is a, c, g, or t
  misc_feature (3579)..(3581): n is a, c, g, or t
  misc_feature (3583)..(3583): n is a, c, g, or t
  misc_feature (3586)..(3586): n is a, c, g, or t
  misc_feature (3588)..(3590): n is a, c, g, or t
  misc_feature (3594)..(3598): n is a, c, g, or t
  misc_feature (3600)..(3602): n is a, c, g, or t
  misc_feature (3604)..(3604): n is a, c, g, or t
  misc_feature (3607)..(3608): n is a, c, g, or t
  misc_feature (3611)..(3615): n is a, c, g, or t
  misc_feature (3617)..(3622): n is a, c, g, or t
  misc_feature (3624)..(3624): n is a, c, g, or t
  misc_feature (3628)..(3631): n is a, c, g, or t
  misc_feature (3633)..(3633): n is a, c, g, or t
  misc_feature (3635)..(3635): n is a, c, g, or t
  misc_feature (3637)..(3643): n is a, c, g, or t
  misc_feature (3645)..(3656): n is a, c, g, or t
  misc_feature (3658)..(3658): n is a, c, g, or t
  misc_feature (3663)..(3666): n is a, c, g, or t
  misc_feature (3668)..(3669): n is a, c, g, or t
  misc_feature (3673)..(3674): n is a, c, g, or t
  misc_feature (3676)..(3686): n is a, c, g, or t
  misc_feature (3690)..(3693): n is a, c, g, or t
  misc_feature (3695)..(3699): n is a, c, g, or t
  misc_feature (3701)..(3703): n is a, c, g, or t
  misc_feature (3705)..(3705): n is a, c, g, or t
  misc_feature (3707)..(3710): n is a, c, g, or t
  misc_feature (3712)..(3712): n is a, c, g, or t
  misc_feature (3714)..(3714): n is a, c, g, or t
  misc_feature (3717)..(3723): n is a, c, g, or t
  misc_feature (3725)..(3726): n is a, c, g, or t
  misc_feature (3728)..(3731): n is a, c, g, or t
  misc_feature (3733)..(3740): n is a, c, g, or t
  misc_feature (3743)..(3744): n is a, c, g, or t
  misc_feature (3746)..(3750): n is a, c, g, or t
  misc_feature (3752)..(3752): n is a, c, g, or t
  misc_feature (3756)..(3759): n is a, c, g, or t
  misc_feature (3761)..(3764): n is a, c, g, or t
  misc_feature (3766)..(3766): n is a, c, g, or t
  misc_feature (3768)..(3769): n is a, c, g, or t
  misc_feature (3771)..(3773): n is a, c, g, or t
  misc_feature (3775)..(3775): n is a, c, g, or t
  misc_feature (3779)..(3786): n is a, c, g, or t
  misc_feature (3788)..(3791): n is a, c, g, or t
  misc_feature (3793)..(3793): n is a, c, g, or t
  misc_feature (3795)..(3796): n is a, c, g, or t
  misc_feature (3798)..(3798): n is a, c, g, or t
  misc_feature (3800)..(3807): n is a, c, g, or t
  misc_feature (3809)..(3812): n is a, c, g, or t
  misc_feature (3815)..(3818): n is a, c, g, or t
  misc_feature (3820)..(3823): n is a, c, g, or t
  misc_feature (3825)..(3828): n is a, c, g, or t
  misc_feature (3831)..(3832): n is a, c, g, or t
  misc_feature (3834)..(3834): n is a, c, g, or t
  misc_feature (3836)..(3836): n is a, c, g, or t
  misc_feature (3839)..(3843): n is a, c, g, or t
  misc_feature (3845)..(3847): n is a, c, g, or t
  misc_feature (3849)..(3851): n is a, c, g, or t
  misc_feature (3853)..(3863): n is a, c, g, or t
  misc_feature (3865)..(3867): n is a, c, g, or t
  misc_feature (3869)..(3873): n is a, c, g, or t
  misc_feature (3875)..(3886): n is a, c, g, or t
  misc_feature (3889)..(3889): n is a, c, g, or t
  misc_feature (3891)..(3896): n is a, c, g, or t
  misc_feature (3899)..(3902): n is a, c, g, or t
  misc_feature (3904)..(3904): n is a, c, g, or t
  misc_feature (3906)..(3910): n is a, c, g, or t
  misc_feature (3913)..(3915): n is a, c, g, or t
  misc_feature (3917)..(3919): n is a, c, g, or t
  misc_feature (3921)..(3923): n is a, c, g, or t
  misc_feature (3925)..(3937): n is a, c, g, or t
  misc_feature (3939)..(3943): n is a, c, g, or t
  misc_feature (3945)..(3950): n is a, c, g, or t
  misc_feature (3952)..(3952): n is a, c, g, or t
  misc_feature (3954)..(3955): n is a, c, g, or t
  misc_feature (3957)..(3961): n is a, c, g, or t
  misc_feature (3963)..(3965): n is a, c, g, or t
  misc_feature (3967)..(3968): n is a, c, g, or t
  misc_feature (3970)..(3973): n is a, c, g, or t
  misc_feature (3975)..(3977): n is a, c, g, or t
  misc_feature (3979)..(3981): n is a, c, g, or t
  misc_feature (3983)..(3987): n is a, c, g, or t
  misc_feature (3989)..(3989): n is a, c, g, or t
  misc_feature (3991)..(3992): n is a, c, g, or t
  misc_feature (3994)..(3996): n is a, c, g, or t
  misc_feature (4000)..(4000): n is a, c, g, or t
tatgaactgtttgtaatcattactccggctccttttggagtaagcagttctgcgagcagggcaccctcaaccctgccgtccagcaaatgacaccgttcaacaccatgaacacaggcttcagtcagtacattcaattgcaggcgctgtgatgaaggtaaatccggattttttttcaaccattgctgaacactttctgttgtcatttccagagaatctgagccatcaatttgcggcaatgttaatgtatccagtacaataaatttttttgcacgtaagcgcgttgccacttcaaaggcaacctgatttggatcaagaatccacaatcgtcccttttctcccagtgcaaaaggtggtagtataacaagctttgagtttgaaatttcctgacggagtgtttccaggtcaagtccgcaaacgtttccagtgaagtgtgtaccgaaatttccggaaaaagattttttctctgcaaacatgaaatgaccggttaaggtttgaagctgccgactacaactcctgaaccgagtcagtaactgccagtttgcagaagaaattgcctgttcaatcagcggtaaatgtgtttcttccgcaacaagaataccgtcttcagtttggcaaacaagaccaccatcagttagaaacttgcggatctgtgtttctgcgccatggatcaaaacgattctgataccaacttgttgcaagagcgctaaatcttcaattactctgaaattgtgaccattaagcaaatctccgcttagttgaaccacgaaagtttgctgatggaactcttccagatagggcagggaagcccgcaaattatgaataaaaccggacaactccggatcaagagaatgctgtggcatgggttatattaaaaaaaaagttgaactggaatcttcaccgcaaagtaaacaaaaagcggaagttctttcaatcgtgattcctgctttcaacagcgcaaaactgctgtcaatctgtcttgaagcccttgaaaaacaaactgcgcaaaaatcctgttttgaagttacagttgcagacgatggttccacagatgaaactttgcaaatgctgcagcagtttaaagcacgctctgagttacagcttcaatggactacaattccgaattccggtccaggcaatgcccgtaatgccggagttgctttatcttccggaacatggatcgggtttatggacgcggatgttattccacatccggactgggtaaaaaatgcacttacgctaattcagcaaaaaccggaagccggagcatttgagggccgtacagaagtcactcaacgcagccgggctacgccattcacgcatcaaacngaaaacattgacggcggacgctacccaacatgtaattttctggtccgccgaaacttagcacattttcatccggcttatcttattcctttccgggaggacacagatttagcgttcagcattttagctgcaggatttccgattatatttgctcccgaactgattgtggaacatccacctctaccttcaagctatttacggccgctggttttagcacgaagatattattatgacggtttattgtctcggagatttccccgccgttaccgtaatgatttggacgcacatcagataattggtctcaaaattccgcatttgaagaagaaattatactctttatttgtgctttctcaaattgtttttcttggatcacagcttttcggtttatccggaaagagtttgtttctggcaggaagtgcctaccttttgtgcctgctaatgactgccggagcaagtctgcgctttgcaaatttgcgggatctttcgctcaaagactggcttgtctttatttgccagcagcacgtgctgccgtgggtgatgggttattcactgtttcggggctggttggattttcgcggagaacctgagtattcggccagttaattgtgacggcaggactatacgataatttgactatttactcaaagcaattcagaatggaaaatcaccctttgaagagttgtgncagacgtcaactcctggtcttattttaatttgtcgttgaatgcagatacccggaattattcagtttggattcaaagacaaactgactcaggtcagtaaaacaaaagatttaaatcagaaaataagtgtaattcaagatgtttgttacctataaactttcagaaaaatcatttaaaaacctccggaaaaaaggagtcagtgatgttgctctaaacgaccttactgagctggagaacagggtatttccaaactcgtatatttttttgagccgtgtccggaagctccctcaggcagaagaaatcatgaaaaatgaggcggatcttttgaangcagcaaaggggtttttgcgcctggaccttctgattccgaaccgcacaatcagggaatggaccgaggctctgatttttgcggttgtagtggcaaccattgtccggacctatttgtttgcaccttatcaaattccatccggatcgatgctgccgactattcagattggagaccacatatttgccagtatgtattcctatggctcaccgattcccttcacagatatcaaactttttaaaaaacctgtactgcggggagatattataatttttccatttccnagtgacccttcggttgactacataaaacgcgcagttgggctgcctggtgagacactggaaattcggaaagaccaggttttcataaatggagaacaacttgatgagccttacgcatattatgaaccaaatgaacggagaacccgactggcgcagggtttaatgtcctcaactccggtcagccgctttggtccgattaagattccggaaggtaaaatatttgcgatgggagataaccgatacaacagtgcagatagtcgttactggggttttgttgatctgaaaacagttgccggaaaaggacagattatctactggtcgcacgatcctgatgaaaatatttttggcggatatagatttggccgtttacttgattncctgaaataataagtcancaagagcagtttttttnnnnnaaannnnnaaaannnnnnnaaannnaattccccnaaannnncccnnnnggnnnggaannggnaaaaaannnaaaaaannccnnnnggaaaaagggnaaaaannggnnccnttnccnnnnnnaaaaccnaanccnaaanggnnnnaanttnttnttaaaaccnnnaaannnnttnaaggnnnccnnaaaannnnccaanttnnaaaaattnnnnnnnnnnnggttnnggaannaannggnnngggnnnnnccnnaaannaaannnnngggngggtttnnnnnnaaantttggnnaanggnnnaattccgnnncnntnnantnnnggnnnngnnaangnnnnnnnnngnnnncnnttncnnaaannnnnnnnnnntnnncnnannannnnnnttnncnnnggnntncnaannannnngnnnnnnnnnnnngnnnnnntnnnnannntnnnnntnncnnnnnnttngnnngnnnntttngnnnnnncnnnnnnannnttnnnnntngnnnnnntncngnaaaaannnnggnantngnngnannnnnnnnggnannncntgnannngggnnnnnannngnttnnccnnnnnannnnnntngggnnnntngncnnnnnnntnnnnnnnnnnnngnaaaannnngnntttnngnnnnnnnnnnntttnnnngnnnnngnnntngnnnngnanttnnnnnnncnncnnnngnnnnnnnnttnngnnnnncngggnnnngnnnnancnntnnngnaaannnnnnnntnnnnantnnancnnnnnnnnannnnggnnnntnnnnannnnaanntntnggnnnnngnnngnnngnnnnnnnnnnngnnngnnnnntnnnnnnnnnnnnggnannnnnnttnnnngntnnnnnaannngnnntnnngnnnnnnnnnnnnnannnnntnnnnnntnannannnnntnnntnntnnnnannnannntnnnnnantnncnnnaaan

SEQ ID NO: 352 - DNA, 4000 bp, Escherichia coli
  misc_feature (958)..(958): n is a, c, g, or t
  misc_feature (1786)..(1786): n is a, c, g, or t
  misc_feature (3466)..(3466): n is a, c, g, or t
  misc_feature (3472)..(3473): n is a, c, g, or t
  misc_feature (3476)..(3477): n is a, c, g, or t
  misc_feature (3480)..(3482): n is a, c, g, or t
  misc_feature (3487)..(3487): n is a, c, g, or t
  misc_feature (3489)..(3489): n is a, c, g, or t
  misc_feature (3491)..(3493): n is a, c, g, or t
  misc_feature (3498)..(3498): n is a, c, g, or t
  misc_feature (3503)..(3503): n is a, c, g, or t
  misc_feature (3505)..(3505): n is a, c, g, or t
  misc_feature (3507)..(3507): n is a, c, g, or t
  misc_feature (3510)..(3511): n is a, c, g, or t
  misc_feature (3513)..(3515): n is a, c, g, or t
  misc_feature (3517)..(3517): n is a, c, g, or t
  misc_feature (3519)..(3521): n is a, c, g, or t
  misc_feature (3525)..(3526): n is a, c, g, or t
  misc_feature (3530)..(3533): n is a, c, g, or t
  misc_feature (3535)..(3535): n is a, c, g, or t
  misc_feature (3537)..(3537): n is a, c, g, or t
  misc_feature (3539)..(3539): n is a, c, g, or t
  misc_feature (3546)..(3547): n is a, c, g, or t
  misc_feature (3549)..(3549): n is a, c, g, or t
  misc_feature (3552)..(3553): n is a, c, g, or t
  misc_feature (3556)..(3557): n is a, c, g, or t
  misc_feature (3560)..(3560): n is a, c, g, or t
  misc_feature (3564)..(3567): n is a, c, g, or t
  misc_feature (3573)..(3573): n is a, c, g, or t
  misc_feature (3575)..(3575): n is a, c, g, or t
  misc_feature (3580)..(3580): n is a, c, g, or t
  misc_feature (3583)..(3583): n is a, c, g, or t
  misc_feature (3585)..(3585): n is a, c, g, or t
  misc_feature (3588)..(3588): n is a, c, g, or t
  misc_feature (3592)..(3593): n is a, c, g, or t
  misc_feature (3595)..(3596): n is a, c, g, or t
  misc_feature (3598)..(3599): n is a, c, g, or t
  misc_feature (3601)..(3601): n is a, c, g, or t
  misc_feature (3604)..(3604): n is a, c, g, or t
  misc_feature (3607)..(3607): n is a, c, g, or t
  misc_feature (3609)..(3609): n is a, c, g, or t
  misc_feature (3612)..(3613): n is a, c, g, or t
  misc_feature (3622)..(3627): n is a, c, g, or t
  misc_feature (3631)..(3631): n is a, c, g, or t
  misc_feature (3635)..(3636): n is a, c, g, or t
  misc_feature (3638)..(3638): n is a, c, g, or t
  misc_feature (3643)..(3644): n is a, c, g, or t
  misc_feature (3646)..(3646): n is a, c, g, or t
  misc_feature (3649)..(3650): n is a, c, g, or t
  misc_feature (3653)..(3654): n is a, c, g, or t
  misc_feature (3657)..(3659): n is a, c, g, or t
  misc_feature (3661)..(3661): n is a, c, g, or t
  misc_feature (3663)..(3663): n is a, c, g, or t
  misc_feature (3665)..(3666): n is a, c, g, or t
  misc_feature (3672)..(3690): n is a, c, g, or t
  misc_feature (3693)..(3696): n is a, c, g, or t
  misc_feature (3698)..(3699): n is a, c, g, or t
  misc_feature (3701)..(3702): n is a, c, g, or t
  misc_feature (3705)..(3705): n is a, c, g, or t
  misc_feature (3708)..(3708): n is a, c, g, or t
  misc_feature (3713)..(3713): n is a, c, g, or t
  misc_feature (3716)..(3716): n is a, c, g, or t
  misc_feature (3718)..(3719): n is a, c, g, or t
  misc_feature (3727)..(3729): n is a, c, g, or t
  misc_feature (3732)..(3732): n is a, c, g, or t
  misc_feature (3734)..(3735): n is a, c, g, or t
  misc_feature (3744)..(3750): n is a, c, g, or t
  misc_feature (3753)..(3753): n is a, c, g, or t
  misc_feature (3756)..(3756): n is a, c, g, or t
  misc_feature (3762)..(3762): n is a, c, g, or t
  misc_feature (3764)..(3764): n is a, c, g, or t
  misc_feature (3769)..(3772): n is a, c, g, or t
  misc_feature (3774)..(3774): n is a, c, g, or t
  misc_feature (3781)..(3781): n is a, c, g, or t
  misc_feature (3783)..(3785): n is a, c, g, or t
  misc_feature (3791)..(3792): n is a, c, g, or t
  misc_feature (3794)..(3794): n is a, c, g, or t
  misc_feature (3798)..(3800): n is a, c, g, or t
  misc_feature (3805)..(3805): n is a, c, g, or t
  misc_feature (3807)..(3807): n is a, c, g, or t
  misc_feature (3810)..(3810): n is a, c, g, or t
  misc_feature (3813)..(3813): n is a, c, g, or t
  misc_feature (3815)..(3815): n is a, c, g, or t
  misc_feature (3818)..(3820): n is a, c, g, or t
  misc_feature (3822)..(3822): n is a, c, g, or t
  misc_feature (3824)..(3825): n is a, c, g, or t
  misc_feature (3828)..(3828): n is a, c, g, or t
  misc_feature (3830)..(3832): n is a, c, g, or t
  misc_feature (3835)..(3835): n is a, c, g, or t
  misc_feature (3837)..(3839): n is a, c, g, or t
  misc_feature (3841)..(3842): n is a, c, g, or t
  misc_feature (3845)..(3846): n is a, c, g, or t
  misc_feature (3850)..(3850): n is a, c, g, or t
  misc_feature (3852)..(3852): n is a, c, g, or t
  misc_feature (3855)..(3855): n is a, c, g, or t
  misc_feature (3858)..(3859): n is a, c, g, or t
  misc_feature (3862)..(3863): n is a, c, g, or t
  misc_feature (3865)..(3872): n is a, c, g, or t
  misc_feature (3877)..(3878): n is a, c, g, or t
  misc_feature (3880)..(3880): n is a, c, g, or t
  misc_feature (3883)..(3883): n is a, c, g, or t
  misc_feature (3885)..(3885): n is a, c, g, or t
  misc_feature (3887)..(3888): n is a, c, g, or t
  misc_feature (3890)..(3894): n is a, c, g, or t
  misc_feature (3896)..(3898): n is a, c, g, or t
  misc_feature (3900)..(3900): n is a, c, g, or t
  misc_feature (3902)..(3903): n is a, c, g, or t
  misc_feature (3908)..(3909): n is a, c, g, or t
  misc_feature (3911)..(3912): n is a, c, g, or t
  misc_feature (3914)..(3914): n is a, c, g, or t
  misc_feature (3921)..(3921): n is a, c, g, or t
  misc_feature (3923)..(3924): n is a, c, g, or t
  misc_feature (3926)..(3926): n is a, c, g, or t
  misc_feature (3929)..(3930): n is a, c, g, or t
  misc_feature (3932)..(3933): n is a, c, g, or t
  misc_feature (3935)..(3935): n is a, c, g, or t
  misc_feature (3937)..(3938): n is a, c, g, or t
  misc_feature (3941)..(3942): n is a, c, g, or t
  misc_feature (3945)..(3945): n is a, c, g, or t
  misc_feature (3947)..(3947): n is a, c, g, or t
  misc_feature (3949)..(3949): n is a, c, g, or t
  misc_feature (3951)..(3951): n is a, c, g, or t
  misc_feature (3953)..(3957): n is a, c, g, or t
  misc_feature (3960)..(3960): n is a, c, g, or t
  misc_feature (3962)..(3964): n is a, c, g, or t
  misc_feature (3967)..(3968): n is a, c, g, or t
  misc_feature (3970)..(3973): n is a, c, g, or t
  misc_feature (3975)..(3975): n is a, c, g, or t
  misc_feature (3978)..(3979): n is a, c, g, or t
  misc_feature (3984)..(3988): n is a, c, g, or t
  misc_feature (3990)..(3993): n is a, c, g, or t
  misc_feature (3996)..(3998): n is a, c, g, or t
tgggggcggtctcccgcttcaaatgcggcctccagcacggcaaagtcagcgccgcgccggatcagctcggcgtcctttgccccacggaagcttttgcccccggtcagcagccagacggcttccaacaggttggttttgccctgcccgtttgccccgcacagaaccgtcaactgcggggcgggttccaaaacagcggcggataaattgcgataatccgtcaccgcaaggcggttcagccgcatcagcagccctccgcgatctgaacctggcggccttccagctccaccacatcgcccggcacgcattttttaccgcgcatggtgcagggttccccgttcagcttcacttctccgccctggatcagctccttggcttcgccgcccgtttcacacaggccggcaaatttcagcagagcatccaatttgataaattccgtgtggattcgtactttttccatcgtatcagccttcattcttaaagcgtaccggcagcaccaggtaaataaagtcttcgccctccaccggcaggacctttaccgggctcaaggggccgttgatctccaggcgcagcttttcgcacttggaatagcgcagcgcatccagcaggtagcggttgttgaacccgatttccatggaatcgccttccatgctttccggcgtaaactcatccaccaccttgcccagcggggtctggcagcgcacagttactttatccggtgcaaaattgatgcgcagcgggttcttcaaacgatcggtaataatcaaagaagcacgttccagcgtatcaataaagctcttgcagtcgatcacgaccttggtgcggctctctttgggaatcacgctctcataattcaggaactcgccctcgatcaaccggctcatgatggtgtagccgttggtagtgaacaccacatagcggcggtttgcatcaattttgaccggttcgtccggcccgccgntgattttcagcagctcctgcagcgtttttgccggaatgataatgcggatatcgcgggtgcattccacatcccgcttaatgatggccaggcggtaaccgtccagagccacaaccgtcaggcggcccggctcgatcacgaacaattcaccggtgtgtgcgggcttcttatcttccacagcgaccgcatagatggtcttttcgatcagctcgcgcatcatcgaagtcggaatggtcatggtattttcggctgccgtgttgggcaggctggggtaatcgctcgcgttcatggcggggatctcaaactctgccacgccgccagaaataattgccataccttcgttattcagctccaccgatacggtgccggacggcatacggctgaccatggagccaaacagctttgcttccaaaaccgtctcgccgggtacctgaacattgcactcaatgttggtggtgatgcccatttccatatcgtagccggtcagcgtcagctggaacccttcggctttcaggtaaatgccctccagcacggggatcgccgcgcggttggtgatggcgcgggaaacgccgtcgatcgcagcagacagcagcgacttgtcacattcaaacttcaatgttgtcacctcgtatataatcactaaacttacagaaaactgtgaagtgttgtagcctggcagacggttcagaaatctgaaatatccgttttgtataatccttatttgctgatgggcctgacggtgcagaacacgtaaaatgtcagggtaaactagatactttgatagtcatagtagtaggctacgttgaatctgtggaaaagcctgaaacctcngattccgaagcaatttttgaggacctggctttccgcaaaacctcgtggaaagaaaaatctcaaatgtggaaaacctgacctttcaacctgctctgtggaaaatccgtgttaattgttgaaaaatcagttgaaaatgttgaaagtctaaaactgctgtcggaacccggaatatccgttttgaaaacccggaaaaggcatggcatgttctgcatattcatgtataaacatgcagaacgccgggcgtttcattgtcaacctgcagcatgcatcaggcacggatgttcttcatgatgtcgtccacggtctccttcaggtggcggtccttgccgatgttcttctccatcgtattgatggagtacacaacggtggaatggtcacgctggaattcggaaccgatggcttccatgctcataccggtgatctcgcggatgatatacatcgacatctggcgggcggcactcacattggcgctgcgctttttcccgcggatgtcggagggaatcacattataggtgcgcgccacttcgttgatgatcttttcaatcgtaacggggatgggctgggtatcattcagtgtatccttgatggcggtcgtcgtcacgccgatgcagggggcaataccctccaacatatagtaggcgttcagctttttcactgcgccctccagctggcggatgttctgcttcagatggttggcgatgtattccgcaacgtcatcaggcagatccagattcagcaattcggccttgcgcttgacgatcgccacacgggtttcgaaatcaggcggctggatatccgccgtcaggccccactcgaaccgggtgcgcagacgctcttccaggctcttgatctccttggccggccggtcggatgccagcacgatctgcttgccggcattatgcagcgtattaaaagtatggaaaaactcttcctgcgttgattccttgcccgccaaaaactggatatcgtcgatcagcaacacatcggcttcgcggtatttctggcggaactgttcggtcgttgccattttgaccgcggtgatgatctcgttggtaaacttttcgcagtccacatagacgatattgtagtccggatggtttttgtggatctcgatctgaatcgcgttcagcagatgcgttttgcccagaccggacggtccgtaaatgaacagcggattgtaagcgccggacgggtttgccgcaaccgcctgcgccgccgcaaaggcaaattggttggacgggccgcggatgaagttttcaaaggtgaaatcataccggcccgagggcaggctggcttcatccattgggcgtttttctttggcagcctctggttcaggctgcggcacagtgaacttgacctcaacatcaaagccaagtacagccttaaacgcatccttcagcagacccgtataacggtcagacacgatcttacagataaaatcattgcggacttccagcgtgatgcagttggaattttcaaagctgaccgctttcagcccgctgatgtaatactggtacgtcgcgtcggcagtatgttcgcggcaataggctttggccgcgtccagtacgtcgttgaatgaatccatggatactccccacttttgtgttagtcaaggcaatgcactgccgccccgcaggctgccgcccaatttttgcaaacaaaacacaagccgccccccantataannaannaannncgccncntnnntccanaaaantncngcnncnnncngnnnggtnntgcnnnncngncnaaaattnntnggnnggnnggnggannnngcagcngncggcngcngnggngaanntnntnncnttnccngnccnncaaaaccgnnnnnnccanccgnngnaaggnngnccnnaannccnnncngncnntttttnnnnnnnnnnnnnnnnnnntannnnannannaanttnccccnaanannattataannnggnannattttccannnnnnnggnaanaaaagntnaaaannnngnaaaaaangnnngttttnnancaannntccancnaanccncnccnnncngnnggntnnnttncnnntnnttnnccgntnggnccnnccnngnnnnnnnnaaaanncnatncntnncnnnnngnnntngnncgccnngnngnttttttngnngnttnntnntnannaanntgncntncntnnnnnatnannnaanncnnnnangcnnccccnnnnncnnnnggnnntt

SEQ ID NO: 353 - DNA, 4000 bp, Escherichia coli
  misc_feature (917)..(917): n is a, c, g, or t
  misc_feature (920)..(920): n is a, c, g, or t
  misc_feature (930)..(930): n is a, c, g, or t
  misc_feature (934)..(935): n is a, c, g, or t
  misc_feature (977)..(977): n is a, c, g, or t
  misc_feature (1424)..(1424): n is a, c, g, or t
  misc_feature (1978)..(1978): n is a, c, g, or t
  misc_feature (1989)..(1990): n is a, c, g, or t
  misc_feature (1998)..(1998): n is a, c, g, or t
  misc_feature (2007)..(2007): n is a, c, g, or t
  misc_feature (2014)..(2014): n is a, c, g, or t
  misc_feature (2016)..(2017): n is a, c, g, or t
  misc_feature (2031)..(2031): n is a, c, g, or t
  misc_feature (2037)..(2037): n is a, c, g, or t
  misc_feature (2053)..(2053): n is a, c, g, or t
  misc_feature (2064)..(2065): n is a, c, g, or t
gaatcaatcaaaaggactatccagagatttatttgttctacctgcaaaactcctttattaaatcccagatttcaagctaagggttttaaatttaaaatttgccctttttgtggaggtaaaatagtacatcggattgatgataatatagaaacaattgtaacgagattggaagagtataaaaaacgaacccagccaatttttaaggaattagagaaaagaagatatagaatttacaaaattagcggcacaccgatgccacataagattcacaaaaaaataatttcttatttaactaaatgattaatttgaaatctccgcaggaaattaaaaaaatagcaactgccggcagaattttggctaaagttttaaaagcggttgttaaagaggcaaaaattggaactcagttaagtcaattaaataaattagcttatcaattaactaaaaaagaaggggcccagccggcttttttaggttatcagccggacggcgccagccggtcttttggcgcttcaatctgcgcttcggttaatgaaattgtagttcatggctttccaagcgattataaacttcaatccggcgatgttttaaaaattgatttcggaatagagtatcaaggattttttgctgacgccgccgtaactattggcatcggcaatatttccaaagaagcgaaacatttaataaaaactacccaattggctctaaaaaaagcggttaaacaggcaaggccaggcaagaccttaggcgatatcggctggattatccaaaaaaccgcagaagacagaggattaaaaataattaaaagtttaaccggtcacggcgttggtttaaaacttcatgaagagccgactatttataattttggcgagaaaggtaagggcgttgaattaaaaccggggatggtcttggcaattganccnatgctggctnttgnnacggaaaaaatcattcaaagaccagatgaaagctgggccacngccgacggctctttatcagcccattttgaacacacaatagtgattaccgaaagaggagcgaaggtcttgacaaaattataaacttgtgtattattaaagcataagattagaaaggccaattgtggcaaacagagggcctttaatggctctttgaaaactttataaaaaaagaaaggagggtgtgcgatggaaagatcgtgtgccaaaaaagaggaaagagagtttggaataggtatggttcacgaagggattattacccttcgtagcctcggcttaaccgctgagggctgggagaaaatgaaagatgacaaggagttggccaagaaggtggttgagctaattgaaggcgaaaaagagatttggttggaaagaattgttgcccgagagcgcgcctgccatctggctttctttgaccaagaatttgatttaacagctttcgcccagacnttaaaaaagtacggcgaaagcaaaatcagattttggcagaagcttgaaatggagcccgtatttttgccagaagtggcgatgccgcaggataccaatttccgcggctggaaagtcaagccggaatcttggttctggcagaaaattgccgaaggcagaatcttacgtcaagtcggcaacaagttggtgccaatcaaggaagttcggcttgaaggcattacggctctgattgatacgcggctcaagccgaaatatgacgccggcaagcagatgtacgaaaatgacaatttgctcggccccattattgaggacctgcgcagagccaaaaagattgccaaatacgaatacggtcctaagtcttctcgtttcggcgtttctgctgatgaatgggaaacctgtagtaagccggtattagctcaaaaacttggactggatgaatctcaaattcgtctggaacgagagattgaagctaacgtcattccccagatttatctttatatgtcccgcaaagatgatggcaagacagacacttgggaatggcgagaggaatattttgngggccgcggcnnccggctcnacggcggcnactctgncnntggcggtttggcgnatgtcnactgcaattcctctgncagccactggnnctacgggtcgtttcgtcctctggcagtgctttgaaacttgaattttgtatctttgaaccttttgaattctgagggttgagaaattaatctcaacccttttctttttttgaaattttgctaaaataataattgagagtaggttaatgtataacaatttacggattgttatcaccgaaatcctaaatatttaatggccagagtttcttaattctacggagtaagaaagtgtgccaaaattatttagagcactgcttgtctgtttctaatgcgggtgtgttaaatttaacaaagcactgccgcagaataaaatacagaagggagttttattttacaaatcaaccttcagtgataacgggggaaacaggcaatttttgaggaccgcggcaaccggctcaacggcggcaactctgacaatggcggtttggcgaatgtcaactacaattcctctgacaaccactggaacaacaggtcgtttcgtcctctggaagtctctaaataacttaaaaggacatcttttgatgtccttttgttcaacttacatatctaatccagccgccgatcatcttcccgatttcctgaagtttttcttgaagaattagatattttttgttatcaatggatttaatctcgtaagccaatctaatcagcgttttcaaaagatttactttggtatctatttctttaaggaaagacaatttttcttgtttcggtgaataaacagtttttaataaaaattccaatatctctaagattaaattttcaattttctggcctaaagaatatttttcgcttttcggaaataattttaaacattcgtgaaataatttataaaactctaaaatcttatgtaccagcggcacatcaaaaaatttagaggtttcgggggggggcattaaaagtcataatatttttgacgaaataatctcgcttgaaaatctgtttttggcttggcaggaattccggcgaggtaaaaggaataagtcagatgtccaaaaatttgagtttaatttagaagataatttatttcaacttcatcaagagctgagaaatgaaatttatcaacattcttattataccacattttgtatttgcgacccaaaattaagacggattcacaaagccagcgttcgcgatcggattttacaccacgcggtttttagaattttatatcctatttttgacaaaggatttatttttgattcctattcctgccggcttggcaagggaacgcacagggcggttgatagattggaaaggttttgtcgccaattaagcaaaaacaaccgcataaatattttcgctttaaaatgcgacatcaaaaagttttttgattcagttgaccaagatattttaatggaaattattaaaaagaaaattcaagacagcaaagtcattcggcttatagaaaaaattattagaagttttgaaacagaaaaaggaaagggtctgccgcttggcaatgttaccagccagttatttgccaatatttacttaaatgaacttgaccagtttattaagcataaattgaagattaaatattatctgcgttattgcgatgattttataattttagaagaaagcaaagagtgcctaattggcctaattcccttaatagataattttctaaaagaaaaattgaaattaacccttcattctgataagataataatcagaaaatatcatcaaggcattgattttcttggttatgtatcactgccgcattaccgacttttgcggacaagaaccaaaaagaggatatttagaaaaataaaaattaagtatcaagatttagagaggggtttaatttgtgaagaattttttaaccaaagcttgcagtcctattttggaatttttaaacactgcaaaggctataaaattaaaaagagaatttatctcttactaaacgactaattcccaaagcattgcttaaagtaa

SEQ ID NO: 354 - DNA, 4000 bp, Escherichia coli
  misc_feature (1989)..(1989): n is a, c, g, or t
  misc_feature (1991)..(1991): n is a, c, g, or t
  misc_feature (2476)..(2476): n is a, c, g, or t
acggtaacaatgagatcattattgctaatcgtaacggacgtgctattcgcttccatgaagctgctgtgcgtgtaatgggacgtactgcaacaggtgtacgtggcataacattggataatgatggacaggatgaagtagttggaatgatttgtatcaaagatttggaaacagaatctgtaatggttgtttctgaacagggatatggtaaacgttctgaaatagaagattatcgtaaaaccaatcgtggaggtaaaggtgtaaaaactatgaatattaccgaaaagactggtaaactggtaacaatcaaatctgtaactgatgaaaatgacttgatgattatcaataaatctggtatcacaatccgtctgaaagtagcagatgtccgtattatgggacgtgcaactcaaggtgtccgtctgattaatcttgagaaacgtaacgaccaaataggctcggtatgtaaagtaatgacagaaagtcttgaagatgaaattcctgctgaggaaaaagaaggaacaattataagtgatcctaatgcagatacaccgaatgctgaagacgtcacggacgtaaatgaaagtaataacgatattgaagaatagacataatattaataattaatcaaacaacaatcatgaaaagagtattattttcgatggttttattgatggctgttagcttctcatttgctcagatgaagaatgtaaaagaagcaaaaagcattgccaatgatgtgaaacctaattttaagcaagctgaacagctgattgaagaggctatgaagaatcctgaaactaaggatcttgctgacacatgggacgttgctggatttattcagaagcgtatcaacgaagagcaaatgaaaaatgcttttctgaaaaaaccgtacgatacattaaaagtatacaacagtattttgaagatgtatgagtactataataaatgcgacgatttggctcaggtacctaatgaaaaaggtaagattaaaaacaaatatcgtaaagcaaatgcttctagtatgttggctgaacgccctaatttgattaatggtggtatccaatatttcaatttggataagaataaggaagcattaaaatttttcgctacttatgtagaatcagcttcttatccgatgttggctgataaagagttagctaaaaatgatacacttcttcctcaaattgcatattatgcaacattagcggctgatagagtaggcgataaagatgctattatcaagtacgctccttcagcattgtctgataaagatggaggtaagtttgctatgcagttaatggcagatgcttataaagctaaaggtgatactgctgcatggattaaatctttggaagaaggtattcttaagtttccaggaaatgattatttctttgcaaatctagttgattattataatacttctaatcaagcttctaaagcaatggaatttgctgataagatgttaactaatgatcctaataataagttatatttatatgtgaaggcatatctttatcataatatgaaagagtatgataatgcaatcgaatactacaaaaaagctattgctgctgatccggaatatgcagaagcttattctaatgtaggtttagtgtatctgatgaaagcacaagattatgcagataaagcaacaacagatatcaatgatcctaagtatgctgaagctcaagcggcagtgaagaaattctatgaagaagcaaagcccttctatgaaaaagctagagctttaaaacctgaccagaaagatttatggttgcaaggtctttaccgtgtatactataatttgaatatgggtccggaattcgaagaaattgataagatgatgaaataatatatttctttgatgaagaaaaagaaggttacacaaaagttgccttctttttttatgctttttaaaaatatgagttcattaaaaaacagcaaaagggagcaaagtttatttattgctcccttttgctattaaacataatntngattattccactgtttaaaacactaaaattctatttcttttgatcatccgttcataacaagtaacggcgtatctgaatgaaaaatcatcttacgagcaatacttggattgaataatcgagcgaatatatttcttttgtatgaagtcaatgcgattatatctatttgattatctttgatatattgttcaagtccttttagtagattatcactcattacgacatcataatggatttcaagccctgggtattgcttgtgaaaatattcttttatgccaacaagttttatttcattccacgtatcttttgattcagcaagatgtatcaaagatactgaaaaatgaaatgacttccaactattgaaaaatgcatcaaaagctattaaatctctttgatcgaaattagttataaaagcgatctgttttacctcactgaattgtttgaatggtgtattctccggaatagctaatacggctgtacgatttcgntcaataacctcagcagttacactgccaatcagatctatatctttttgattttttcctcgtgtccccataatgatgagtttaggacgttgctctttagcgtatctcaatatttcttcttctggaatgccttcacgtaaaatacagctatatttgacatctggaaattcccccgattcaactttatcttttattttatcagataaagctttgagatcagaatgaactttgtgaataattgtttttacagattcttcatctccaatttgatagttgaatacatctccgtatggcaatgacgatgcatatataggtgtaaaatatacatgcaacaaaataatctctgcgttctctgttttagctaggttgaaggcaaattcacatgctttcatcgaataactagagaaatcgaccggaattaaaatcttatttgatttttctcctttttttgtttccttctctcctactatactttccgatagccaagcagagctttctgtgattttcagtgcatgcggtagatcgctttccttaattcgtaagcgtactccagaggatacaacaggctgtatttggttcacattatgaatgtatgtctcaataccttcattttcaagtacattttttagaatctgagctttggtatatgtcagaattgctagagttactaatttgtcttccataattgatacattttgaaggtgaacaaataagaaatcccaattgtttaacgcaattgggatttctgtttgctatattttaaacttgcacagattcggtagcctgttctttttgcatactcatattcaattcatctagaatctttaaagcccgatcgagaactgttgtatcgtctaacataacaagcccaccatctggaccgggctcaagatgtattccgacactttttccctccttgaaattatggcctccgaaaaagtttcgcacagtatctacgtgtaaaccaagttcgtctgctattcgatgcatgctaccgctgggcaatgaatctttaatcttacgaagttcattaaatgttattgttctcatgtctcataaatttaatggttagtactatgtgattttttatcacgctataaacttaagcaaaaaaaaagataaaacaaattatttgcttatcttttttttcaaaattgataaaatctattaataccttttatatcacttcaatagcagaagctgggacccatcctacttttccatcttctaagtgaatttctttccattctttcatagaattgtctttgacgtttacctttcttccttcatgaagaataaataaactagtaccactttcacttggagtacttcgcactgtgacactcggattcataactatcgcttcgttacggtttaccaaattttctttttgttgtgaagcaaaaagattagagcatactgtgattattaaaaagataatccctgaaatgaagcctatctttttccacataatctgttttgaaaatataaagaagtagagagatactatcagtagaatgaaagaaa

SEQ ID NO: 355 - DNA, 4000 bp, Escherichia coli
  misc_feature (1955)..(1956): n is a, c, g, or t
  misc_feature (1964)..(1964): n is a, c, g, or t
  misc_feature (1970)..(1970): n is a, c, g, or t
  misc_feature (1991)..(1992): n is a, c, g, or t
  misc_feature (2018)..(2019): n is a, c, g, or t
  misc_feature (2024)..(2025): n is a, c, g, or t
  misc_feature (2426)..(4000): n is a, c, g, or t
cggtagccaagcgtccacagaacttgactttagcaaccaaacacgcctccagatgttctcggcgcgtggtacgaccgtcaagagcatacagtttgccaaaggtgcgccacttgaggcagcaatcctcccgtcctctcttaccacattgaggttagagtatcttcccaacttgcaaatgggaggattgactgttgtaggctacagcaatatagagaccttcatctttgccggctgtcccggattgaactggcagacattgttaggacgttgtacgaatgtcgttcgaatcagagtcgaaggattgtcgcttgagggagacggaaccttgctcaatacctatcttaacaagaagggtgtcgatgcggagggcaatgccgttgatacctgttcgcttgtaggcagctataccttgacacgctacccatctgatgaggaattggaaacttggagagcacactacccggaactgaatatcattctgcctgaatacacgactatatcgtttgatgattcggtttcagacggagagaatattaccaacctcgacaaccttacaggatatgcctatggcaatacctacgaggcaagcgggcatatcaaccgtatattgaaccaacgccatagatgtgtggcaaagaagaccggcgcaggtgaagtaaccatttgccaactgcacgacaagaactccaactactatgcggatgcggagaacttcttgtctgcaaccgccgccgacctcacaggtggcgatggaaacgtatttatgttcgagccccattattggtacaaaggtgtgaatgaccacctgaataaaaagaaatacgcattcttcagtagcaacgaggcgtgtccgacaatggctgacagtgtgaaggtgctgcttgaggatatgaccgtaaagaaagggtatgcagtccgttcaagtgttgattacacgacacgagcagatgcagagacaacgatgtcctcagactccgttgtaaccgtaaatgttcagggctacaagcaagtccgttatccgagcctttcgtcagctttatacggagctatcttcgtggatgcagacggtaatgtcgtcaagcgtatgaaggcgacctccgacagcggtatattggatggtatgtattgttttacagacatacctgaagacgctgtttcacttgtgtttactattgtaaccgcagcaccgtttgactatgtactgcttacaaagtccgacaaaattgaagcaatcgagcctgattgggtagaacatgaagagtgcttggtaggtgtctatgaagcatatttgaaagacgacttcctgtattcaatcagtggagtcggttcaaccgcatcagtcagccaagccgattttcgtgtctatgctcggaacagaggcactggcttccagttggtggattgggaaatgcataaggatataggcaacctgttctttgccaagtatggcggtcgcgactcgcagggtatctgcggaccgggcacgcacacaaacggtagggcaacaggagcctccaatgccacaggaatgcaggacactaccgccaatgctgacggcagttggtacaagcaaacgctttcaagcgatggtacttattacccaagcggtaatgcctacgtgctgaagaatgaaggtgacgaaacaagaacggcaatcaattccccggttgtgcttggatatgagaactggcatggtaacaaagccgagtggatggataatgtcggattctgtacgaatgcggtagattacaagtgggatatcggtttgcctgatggtaccaagcgagaagttcagggcgcaaaatatagtggtaattacttttatccgaagtgtgtgatacatggcagatatatggacacaatggttgcgttgtcaggaggctctaccagtacttattaccacgattgtacctaccaaaatgccacaaagggccgtgtggtttaccggtcgaacnncaacgcgngctcgnatggcggtgtgtcgtatgcgnncgcgaattacgactcatcgtatgcgnncacgnncatcgggtcgcgtctcgccttccgcggcaaaatcgtggtggcgcgaagcgtggcagcgtacaaagcgatagtcgaaatctcgtaagcggagcaaagcgacaaagcgtaaaacgaacggcgtttgaatggttttcaaacgccgtttttatatcaaataccggcgtaagccggtcgataatatttagaaaaagggggatacctctcagaggtacatttcgttttggaaaatagaacgcttcgttcaaaaattgcgaaacgcttcgatttgcggattatacaattaaggcggagatagttcgtctggatggtattttgatgaaaatagatgaaggaaagagtatatatgctaagcttcccgtattgattgaagaatgtgagatattgttggatgggaaaccttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 356 - DNA, 4000 bp, Escherichia coli
  misc_feature (1387)..(1387): n is a, c, g, or t
  misc_feature (1962)..(1962): n is a, c, g, or t
  misc_feature (1969)..(1969): n is a, c, g, or t
  misc_feature (1984)..(1985): n is a, c, g, or t
  misc_feature (2391)..(2391): n is a, c, g, or t
  misc_feature (2397)..(2397): n is a, c, g, or t
  misc_feature (2406)..(2406): n is a, c, g, or t
  misc_feature (2408)..(2408): n is a, c, g, or t
  misc_feature (2410)..(2413): n is a, c, g, or t
  misc_feature (2417)..(2418): n is a, c, g, or t
  misc_feature (2420)..(2428): n is a, c, g, or t
  misc_feature (2430)..(2430): n is a, c, g, or t
  misc_feature (2432)..(2432): n is a, c, g, or t
  misc_feature (2434)..(2436): n is a, c, g, or t
  misc_feature (2439)..(2439): n is a, c, g, or t
  misc_feature (2441)..(2441): n is a, c, g, or t
  misc_feature (2443)..(2443): n is a, c, g, or t
  misc_feature (2445)..(2447): n is a, c, g, or t
  misc_feature (2449)..(2450): n is a, c, g, or t
  misc_feature (2452)..(2452): n is a, c, g, or t
  misc_feature (2455)..(2461): n is a, c, g, or t
  misc_feature (2464)..(2465): n is a, c, g, or t
  misc_feature (2469)..(2469): n is a, c, g, or t
  misc_feature (2472)..(2473): n is a, c, g, or t
  misc_feature (2475)..(2475): n is a, c, g, or t
  misc_feature (2478)..(2478): n is a, c, g, or t
  misc_feature (2480)..(2482): n is a, c, g, or t
  misc_feature (2485)..(2485): n is a, c, g, or t
  misc_feature (2487)..(2487): n is a, c, g, or t
  misc_feature (2491)..(2491): n is a, c, g, or t
  misc_feature (2493)..(2495): n is a, c, g, or t
  misc_feature (2498)..(2499): n is a, c, g, or t
  misc_feature (2501)..(2501): n is a, c, g, or t
  misc_feature (2507)..(2507): n is a, c, g, or t
  misc_feature (2512)..(2512): n is a, c, g, or t
  misc_feature (2514)..(2514): n is a, c, g, or t
  misc_feature (2523)..(2525): n is a, c, g, or t
  misc_feature (2527)..(2527): n is a, c, g, or t
  misc_feature (2529)..(2529): n is a, c, g, or t
  misc_feature (2532)..(2533): n is a, c, g, or t
  misc_feature (2537)..(2538): n is a, c, g, or t
  misc_feature (2540)..(2541): n is a, c, g, or t
  misc_feature (2543)..(2543): n is a, c, g, or t
  misc_feature (2545)..(2546): n is a, c, g, or t
  misc_feature (2549)..(2549): n is a, c, g, or t
  misc_feature (2551)..(2552): n is a, c, g, or t
  misc_feature (2558)..(2558): n is a, c, g, or t
  misc_feature (2567)..(2567): n is a, c, g, or t
  misc_feature (2569)..(2569): n is a, c, g, or t
  misc_feature (2573)..(2573): n is a, c, g, or t
  misc_feature (2576)..(2576): n is a, c, g, or t
  misc_feature (2579)..(2579): n is a, c, g, or t
  misc_feature (2583)..(2584): n is a, c, g, or t
  misc_feature (2586)..(2586): n is a, c, g, or t
  misc_feature (2591)..(2591): n is a, c, g, or t
  misc_feature (2595)..(2595): n is a, c, g, or t
  misc_feature (2599)..(2599): n is a, c, g, or t
  misc_feature (2602)..(2602): n is a, c, g, or t
  misc_feature (2604)..(2605): n is a, c, g, or t
  misc_feature (2609)..(2613): n is a, c, g, or t
  misc_feature (2615)..(2617): n is a, c, g, or t
  misc_feature (2620)..(2621): n is a, c, g, or t
  misc_feature (2623)..(2624): n is a, c, g, or t
  misc_feature (2626)..(2626): n is a, c, g, or t
  misc_feature (2628)..(2629): n is a, c, g, or t
  misc_feature (2631)..(2631): n is a, c, g, or t
  misc_feature (2634)..(2634): n is a, c, g, or t
  misc_feature (2636)..(2636): n is a, c, g, or t
  misc_feature (2638)..(2639): n is a, c, g, or t
  misc_feature (2641)..(2641): n is a, c, g, or t
  misc_feature (2643)..(2644): n is a, c, g, or t
  misc_feature (2646)..(2648): n is a, c, g, or t
  misc_feature (2650)..(2650): n is a, c, g, or t
  misc_feature (2655)..(2655): n is a, c, g, or t
  misc_feature (2657)..(2658): n is a, c, g, or t
  misc_feature (2662)..(2663): n is a, c, g, or t
  misc_feature (2665)..(2665): n is a, c, g, or t
  misc_feature (2667)..(2668): n is a, c, g, or t
  misc_feature (2676)..(2677): n is a, c, g, or t
  misc_feature (2679)..(2686): n is a, c, g, or t
  misc_feature (2689)..(2701): n is a, c, g, or t
  misc_feature (2703)..(2703): n is a, c, g, or t
  misc_feature (2707)..(2708): n is a, c, g, or t
  misc_feature (2711)..(2712): n is a, c, g, or t
  misc_feature (2714)..(2715): n is a, c, g, or t
  misc_feature (2718)..(2719): n is a, c, g, or t
  misc_feature (2721)..(2721): n is a, c, g, or t
  misc_feature (2726)..(2728): n is a, c, g, or t
  misc_feature (2732)..(2732): n is a, c, g, or t
  misc_feature (2734)..(2734): n is a, c, g, or t
  misc_feature (2774)..(2776): n is a, c, g, or t
  misc_feature (2778)..(2782): n is a, c, g, or t
  misc_feature (2784)..(2784): n is a, c, g, or t
  misc_feature (2786)..(2787): n is a, c, g, or t
  misc_feature (2790)..(2792): n is a, c, g, or t
  misc_feature (2794)..(2794): n is a, c, g, or t
  misc_feature (2796)..(2797): n is a, c, g, or t
  misc_feature (2801)..(2805): n is a, c, g, or t
  misc_feature (2807)..(2807): n is a, c, g, or t
  misc_feature (2810)..(2811): n is a, c, g, or t
  misc_feature (2815)..(2815): n is a, c, g, or t
  misc_feature (2817)..(2819): n is a, c, g, or t
  misc_feature (2821)..(2824): n is a, c, g, or t
  misc_feature (2832)..(2834): n is a, c, g, or t
  misc_feature (2836)..(2837): n is a, c, g, or t
  misc_feature (2843)..(2844): n is a, c, g, or t
  misc_feature (2846)..(2846): n is a, c, g, or t
  misc_feature (2848)..(2849): n is a, c, g, or t
  misc_feature (2852)..(2859): n is a, c, g, or t
  misc_feature (2866)..(2870): n is a, c, g, or t
  misc_feature (2872)..(2876): n is a, c, g, or t
  misc_feature (2878)..(2880): n is a, c, g, or t
  misc_feature (2882)..(2885): n is a, c, g, or t
  misc_feature (2887)..(2891): n is a, c, g, or t
  misc_feature (2895)..(2895): n is a, c, g, or t
  misc_feature (2902)..(2907): n is a, c, g, or t
  misc_feature (2909)..(2911): n is a, c, g, or t
  misc_feature (2913)..(2913): n is a, c, g, or t
  misc_feature (2915)..(2916): n is a, c, g, or t
  misc_feature (2920)..(2921): n is a, c, g, or t
  misc_feature (2923)..(2924): n is a, c, g, or t
  misc_feature (2929)..(2930): n is a, c, g, or t
  misc_feature (2932)..(2932): n is a, c, g, or t
  misc_feature (2935)..(2935): n is a, c, g, or t
  misc_feature (2939)..(2942): n is a, c, g, or t
  misc_feature (2945)..(2948): n is a, c, g, or t
  misc_feature (2950)..(2950): n is a, c, g, or t
  misc_feature (2953)..(2954): n is a, c, g, or t
  misc_feature (2956)..(2963): n is a, c, g, or t
  misc_feature (2965)..(2971): n is a, c, g, or t
  misc_feature (2975)..(2979): n is a, c, g, or t
  misc_feature (2982)..(2982): n is a, c, g, or t
  misc_feature (2984)..(2984): n is a, c, g, or t
  misc_feature (2987)..(2990): n is a, c, g, or t
  misc_feature (2993)..(2993): n is a, c, g, or t
  misc_feature (2995)..(2995): n is a, c, g, or t
  misc_feature (2998)..(3003): n is a, c, g, or t
  misc_feature (3009)..(3009): n is a, c, g, or t
  misc_feature (3011)..(3011): n is a, c, g, or t
  misc_feature (3014)..(3014): n is a, c, g, or t
  misc_feature (3016)..(3016): n is a, c, g, or t
  misc_feature (3018)..(3021): n is a, c, g, or t
  misc_feature (3024)..(3029): n is a, c, g, or t
  misc_feature (3033)..(3034): n is a, c, g, or t
  misc_feature (3038)..(3038): n is a, c, g, or t
  misc_feature (3042)..(3045): n is a, c, g, or t
  misc_feature (3047)..(3050): n is a, c, g, or t
  misc_feature (3052)..(3053): n is a, c, g, or t
  misc_feature (3056)..(3059): n is a, c, g, or t
  misc_feature (3061)..(3061): n is a, c, g, or t
  misc_feature (3064)..(3068): n is a, c, g, or t
  misc_feature (3071)..(3071): n is a, c, g, or t
  misc_feature (3073)..(3074): n is a, c, g, or t
  misc_feature (3076)..(3077): n is a, c, g, or t
  misc_feature (3080)..(3084): n is a, c, g, or t
  misc_feature (3088)..(3088): n is a, c, g, or t
  misc_feature (3091)..(3092): n is a, c, g, or t
  misc_feature (3096)..(3097): n is a, c, g, or t
  misc_feature (3099)..(3100): n is a, c, g, or t
  misc_feature (3102)..(3102): n is a, c, g, or t
  misc_feature (3104)..(3104): n is a, c, g, or t
  misc_feature (3109)..(3110): n is a, c, g, or t
  misc_feature (3112)..(3114): n is a, c, g, or t
  misc_feature (3117)..(3119): n is a, c, g, or t
  misc_feature (3122)..(3126): n is a, c, g, or t
  misc_feature (3128)..(3129): n is a, c, g, or t
  misc_feature (3131)..(3131): n is a, c, g, or t
  misc_feature (3133)..(3133): n is a, c, g, or t
  misc_feature (3137)..(3138): n is a, c, g, or t
  misc_feature (3141)..(3141): n is a, c, g, or t
  misc_feature (3146)..(3150): n is a, c, g, or t
  misc_feature (3152)..(3154): n is a, c, g, or t
  misc_feature (3157)..(3157): n is a, c, g, or t
  misc_feature (3159)..(3161): n is a, c, g, or t
  misc_feature (3164)..(3164): n is a, c, g, or t
  misc_feature (3168)..(3174): n is a, c, g, or t
  misc_feature (3176)..(3176): n is a, c, g, or t
  misc_feature (3178)..(3182): n is a, c, g, or t
  misc_feature (3185)..(3185): n is a, c, g, or t
  misc_feature (3189)..(3189): n is a, c, g, or t
  misc_feature (3191)..(3192): n is a, c, g, or t
  misc_feature (3194)..(3196): n is a, c, g, or t
  misc_feature (3200)..(3200): n is a, c, g, or t
  misc_feature (3203)..(3203): n is a, c, g, or t
  misc_feature (3205)..(3205): n is a, c, g, or t
  misc_feature (3207)..(3207): n is a, c, g, or t
  misc_feature (3212)..(3212): n is a, c, g, or t
  misc_feature (3214)..(3215): n is a, c, g, or t
  misc_feature (3221)..(3227): n is a, c, g, or t
  misc_feature (3229)..(3229): n is a, c, g, or t
  misc_feature (3231)..(3231): n is a, c, g, or t
  misc_feature (3233)..(3233): n is a, c, g, or t
  misc_feature (3235)..(3235): n is a, c, g, or t
  misc_feature (3237)..(3238): n is a, c, g, or t
  misc_feature (3240)..(3241): n is a, c, g, or t
  misc_feature (3243)..(3243): n is a, c, g, or t
  misc_feature (3249)..(3249): n is a, c, g, or t
  misc_feature (3251)..(3253): n is a, c, g, or t
  misc_feature (3255)..(3256): n is a, c, g, or t
  misc_feature (3258)..(3258): n is a, c, g, or t
  misc_feature (3261)..(3261): n is a, c, g, or t
  misc_feature (3263)..(3265): n is a, c, g, or t
  misc_feature (3268)..(3271): n is a, c, g, or t
  misc_feature (3273)..(3273): n is a, c, g, or t
  misc_feature (3276)..(3277): n is a, c, g, or t
  misc_feature (3279)..(3283): n is a, c, g, or t
  misc_feature (3285)..(3285): n is a, c, g, or t
  misc_feature (3287)..(3292): n is a, c, g, or t
  misc_feature (3295)..(3295): n is a, c, g, or t
  misc_feature (3298)..(3299): n is a, c, g, or t
  misc_feature (3301)..(3302): n is a, c, g, or t
  misc_feature (3305)..(3305): n is a, c, g, or t
  misc_feature (3307)..(3307): n is a, c, g, or t
  misc_feature (3309)..(3310): n is a, c, g, or t
  misc_feature (3312)..(3317): n is a, c, g, or t
  misc_feature (3322)..(3324): n is a, c, g, or t
  misc_feature (3326)..(3326): n is a, c, g, or t
  misc_feature (3329)..(3329): n is a, c, g, or t
  misc_feature (3331)..(3336): n is a, c, g, or t
  misc_feature (3338)..(3338): n is a, c, g, or t
  misc_feature (3341)..(3344): n is a, c, g, or t
  misc_feature (3347)..(3348): n is a, c, g, or t
  misc_feature (3350)..(3353): n is a, c, g, or t
  misc_feature (3356)..(3356): n is a, c, g, or t
  misc_feature (3358)..(3359): n is a, c, g, or t
  misc_feature (3361)..(3361): n is a, c, g, or t
  misc_feature (3363)..(3364): n is a, c, g, or t
  misc_feature (3367)..(3367): n is a, c, g, or t
  misc_feature (3371)..(3372): n is a, c, g, or t
  misc_feature (3374)..(3374): n is a, c, g, or t
  misc_feature (3378)..(3378): n is a, c, g, or t
  misc_feature (3380)..(3384): n is a, c, g, or t
  misc_feature (3387)..(3388): n is a, c, g, or t
  misc_feature (3390)..(3394): n is a, c, g, or t
  misc_feature (3397)..(3397): n is a, c, g, or t
  misc_feature (3399)..(3402): n is a, c, g, or t
  misc_feature (3404)..(3404): n is a, c, g, or t
  misc_feature (3406)..(3407): n is a, c, g, or t
  misc_feature (3413)..(3414): n is a, c, g, or t
  misc_feature (3418)..(3418): n is a, c, g, or t
  misc_feature (3420)..(3420): n is a, c, g, or t
  misc_feature (3422)..(3423): n is a, c, g, or t
  misc_feature (3428)..(3430): n is a, c, g, or t
  misc_feature (3433)..(3433): n is a, c, g, or t
  misc_feature (3435)..(3436): n is a, c, g, or t
  misc_feature (3438)..(3438): n is a, c, g, or t
  misc_feature (3440)..(3441): n is a, c, g, or t
  misc_feature (3444)..(3447): n is a, c, g, or t
  misc_feature (3449)..(3449): n is a, c, g, or t
  misc_feature (3451)..(3452): n is a, c, g, or t
  misc_feature (3457)..(3458): n is a, c, g, or t
  misc_feature (3462)..(3463): n is a, c, g, or t
  misc_feature (3465)..(3468): n is a, c, g, or t
  misc_feature (3470)..(3471): n is a, c, g, or t
  misc_feature (3474)..(3474): n is a, c, g, or t
  misc_feature (3480)..(3481): n is a, c, g, or t
  misc_feature (3483)..(3484): n is a, c, g, or t
  misc_feature (3486)..(3487): n is a, c, g, or t
  misc_feature (3489)..(3496): n is a, c, g, or t
  misc_feature (3498)..(3499): n is a, c, g, or t
  misc_feature (3501)..(3509): n is a, c, g, or t
  misc_feature (3517)..(3520): n is a, c, g, or t
  misc_feature (3523)..(3525): n is a, c, g, or t
  misc_feature (3528)..(3528): n is a, c, g, or t
  misc_feature (3530)..(3531): n is a, c, g, or t
  misc_feature (3533)..(3533): n is a, c, g, or t
  misc_feature (3539)..(3542): n is a, c, g, or t
  misc_feature (3544)..(3545): n is a, c, g, or t
  misc_feature (3549)..(3550): n is a, c, g, or t
  misc_feature (3553)..(3564): n is a, c, g, or t
  misc_feature (3566)..(3566): n is a, c, g, or t
  misc_feature (3568)..(3568): n is a, c, g, or t
  misc_feature (3571)..(3572): n is a, c, g, or t
  misc_feature (3574)..(3574): n is a, c, g, or t
  misc_feature (3576)..(3577): n is a, c, g, or t
  misc_feature (3581)..(3581): n is a, c, g, or t
  misc_feature (3583)..(3583): n is a, c, g, or t
  misc_feature (3585)..(3587): n is a, c, g, or t
  misc_feature (3590)..(3591): n is a, c, g, or t
  misc_feature (3593)..(3593): n is a, c, g, or t
  misc_feature (3596)..(3598): n is a, c, g, or t
  misc_feature (3602)..(3604): n is a, c, g, or t
  misc_feature (3606)..(3609): n is a, c, g, or t
  misc_feature (3611)..(3614): n is a, c, g, or t
  misc_feature (3616)..(3616): n is a, c, g, or t
  misc_feature (3618)..(3620): n is a, c, g, or t
  misc_feature (3622)..(3622): n is a, c, g, or t
  misc_feature (3625)..(3625): n is a, c, g, or t
  misc_feature (3630)..(3634): n is a, c, g, or t
  misc_feature (3636)..(3646): n is a, c, g, or t
  misc_feature (3648)..(3648): n is a, c, g, or t
  misc_feature (3650)..(3650): n is a, c, g, or t
  misc_feature (3654)..(3655): n is a, c, g, or t
  misc_feature (3665)..(3665): n is a, c, g, or t
  misc_feature (3667)..(3667): n is a, c, g, or t
  misc_feature (3670)..(3673): n is a, c, g, or t
  misc_feature (3675)..(3675): n is a, c, g, or t
  misc_feature (3678)..(3682): n is a, c, g, or t
  misc_feature (3684)..(3684): n is a, c, g, or t
  misc_feature (3687)..(3688): n is a, c, g, or t
  misc_feature (3690)..(3690): n is a, c, g, or t
  misc_feature (3696)..(3698): n is a, c, g, or t
  misc_feature (3701)..(3703): n is a, c, g, or t
  misc_feature (3706)..(3707): n is a, c, g, or t
  misc_feature (3710)..(3713): n is a, c, g, or t
  misc_feature (3717)..(3717): n is a, c, g, or t
  misc_feature (3719)..(3720): n is a, c, g, or t
  misc_feature (3724)..(3726): n is a, c, g, or t
  misc_feature (3728)..(3729): n is a, c, g, or t
  misc_feature (3732)..(3732): n is a, c, g, or t
  misc_feature (3734)..(3736): n is a, c, g, or t
  misc_feature (3740)..(3741): n is a, c, g, or t
  misc_feature (3743)..(3744): n is a, c, g, or t
  misc_feature (3746)..(3754): n is a, c, g, or t
  misc_feature (3756)..(3764): n is a, c, g, or t
  misc_feature (3766)..(3768): n is a, c, g, or t
  misc_feature (3771)..(3771): n is a, c, g, or t
  misc_feature (3773)..(3776): n is a, c, g, or t
  misc_feature (3778)..(3779): n is a, c, g, or t
  misc_feature (3781)..(3782): n is a, c, g, or t
  misc_feature (3784)..(3785): n is a, c, g, or t
  misc_feature (3788)..(3791): n is a, c, g, or t
  misc_feature (3793)..(3796): n is a, c, g, or t
  misc_feature (3799)..(3799): n is a, c, g, or t
  misc_feature (3801)..(3813): n is a, c, g, or t
  misc_feature (3815)..(3816): n is a, c, g, or t
  misc_feature (3818)..(3825): n is a, c, g, or t
  misc_feature (3827)..(3828): n is a, c, g, or t
  misc_feature (3832)..(3841): n is a, c, g, or t
  misc_feature (3845)..(3847): n is a, c, g, or t
  misc_feature (3850)..(3850): n is a, c, g, or t
  misc_feature (3852)..(3858): n is a, c, g, or t
  misc_feature (3860)..(3862): n is a, c, g, or t
  misc_feature (3865)..(3870): n is a, c, g, or t
  misc_feature (3873)..(3873): n is a, c, g, or t
  misc_feature (3875)..(3876): n is a, c, g, or t
  misc_feature (3879)..(3882): n is a, c, g, or t
  misc_feature (3884)..(3884): n is a, c, g, or t
  misc_feature (3886)..(3887): n is a, c, g, or t
  misc_feature (3889)..(3890): n is a, c, g, or t
  misc_feature (3893)..(3893): n is a, c, g, or t
  misc_feature (3895)..(3895): n is a, c, g, or t
  misc_feature (3898)..(3899): n is a, c, g, or t
  misc_feature (3901)..(3901): n is a, c, g, or t
  misc_feature (3905)..(3907): n is a, c, g, or t
  misc_feature (3909)..(3914): n is a, c, g, or t
  misc_feature (3917)..(3917): n is a, c, g, or t
  misc_feature (3919)..(3920): n is a, c, g, or t
  misc_feature (3923)..(3925): n is a, c, g, or t
  misc_feature (3927)..(3929): n is a, c, g, or t
  misc_feature (3932)..(3935): n is a, c, g, or t
  misc_feature (3937)..(3937): n is a, c, g, or t
  misc_feature (3939)..(3944): n is a, c, g, or t
  misc_feature (3946)..(3949): n is a, c, g, or t
  misc_feature (3951)..(3955): n is a, c, g, or t
  misc_feature (3957)..(3957): n is a, c, g, or t
  misc_feature (3959)..(3962): n is a, c, g, or t
  misc_feature (3965)..(3973): n is a, c, g, or t
  misc_feature (3975)..(3993): n is a, c, g, or t
  misc_feature (3997)..(4000): n is a, c, g, or t
tcctggccccttgcaatgaccaggcgcgagaaatccccgggggtctggaaaatgcgttcaactcgcacggtcagttccatgttggtggattcgatacgaccggccggcacctcgatattctcgcgccgcagggctgatgccacatcagtgactgtcaactggcgggcagcgagggcctgccggtcaagccagacgcgcatcgcgtagccgccgttgccgttgatctggacattggcaacgccgtcgataatggcaaactggtcgaccagaaagcgattggcatagtcattaagttcgaggaaattcagctgcgtgctacgcagattcaggtactggataggacgcgaatcattatctgccttggagatttgcggagggtccacatcctcgggcaatgcctgcgtgatccgggagattttctccctgatgtcattggcgcccacttcaatgtcataacccacattgaattcaaccgagacactggcactgccgtcccggctggatgacgtgatactggcaatcccttcgataccattgatctggtcctcgagaagttgtgtgacctgggtttcaaccacctcggctgatgccccgggataggaggcgctgatggatactaccggtgaggaagtatcgggatattcacgcaggggcagttccaggaatgagagtaagccgaagcataccagcagcaagctgatgacagtggcgaaaaccggacgttttacggaaatatcggaaagaatcatggcgtctcaaatcaggaagaaagtgatcaaggagtcctcaggaacctgagcgtgccatatctggctgggcggcattgcttgccatagaggtgacgctgtcactggtcatgatgctgactttctgaccgggacggaccttgttcactccgcggctgatcacgcgatcacccggcgtcaggccggacagaatttccacgacaccagggcggcggcgccccaactcgacttttacctgttgcacttggttattgtcatccaccacgtagacataggcgttaccctggctaacgatggcggaaagttccggtactaccatggagagttgctcattcagctccatttcaaccgtcattaacatccctgggcggagcaggccttccgtattgttgatatgggcgcgcagggagacagaacgggtgaccgggtcaatgcgtgagctgaccacgcgtacttcaccctcaaaaacacggtcaggataggcaatggttgaagccaagattttctggccggtacccaactgggccaggtgtttttccggtacagtgaaatccagcttgatgaacgagatatcatccagcgttgttatcaccgtgtttgccgttgccagggtgccttcactgacgttgcgaaaacccagnacaccggtgatgggcgcccggacaatacgatcttccatggccaccatgacaccttccaggcgtgcatcagccatttccatggccgcttttgctacatcaaggtcggtacgtgccacgagactgcgaccatagagttcctcgatgcggttgaactgacggcgggcttcctcggccccggccagcgcttcgtcgagccgggcggcctcggattcattggtgagttccaccaggatatcgccctgctggacaaagtcgccatcctcaaagcgcacctggctgatggtgtctgaaacctttggcaccacgtcaacagactcgttggctacggccgtagcgatggtctcgacccgctcggtgatgcgctgcatttcgaccagggtaacttcgacctgggtctcacctccccgggctccaaaagggccacccatcgcaccggcagaatcctgcagggtgcgatcgaccacgaagtagataaccagggcgagagccaggacgaaaaagataacgatgggatgacgcttgataaaagccactgttttgctccggtaagctaaagtgccagcaagaaggttctncaacatnacgcagattacaatnngctttgtacgcaaaccggtgcttgccagattcaaaacctcacggtctgggaggcaaattcacgaaatttcacatttcaaacatggtgtccggcaaaatagccggcgctggcaaaggcttgaacaagcccgaaagtccgttaaaagcccagacgcaatttgtcgccctgtcttccgggacagagcgattcaagggaagcagctaagggaggacattgagactagtggtgggcccaccagggtaaacccgagcgatgtatttgacgcgacagcgtcaggagaggggaacgcccgcaatctgtgattgcgggctggacagtccttgaggcacgcgcatttttccaaagggaaaatggtgggcccaccaggactcgaaccagggaaaacgaattatgagttaatttgttngactanatacttatntnannnnatgnnannnnnnnnnantntnnnaantntnannnanntnacnnnnnnnagnngganganntngangnnnatntnacgnannnttnngnagccgnaaatngnctcgttccnnntnanctnntttnngnnancnncangnngaaaanagttaaagncnaaanttngtnaggnncntgggnaacnctcnggnannaaannnnnannnatnncnngnanntncangntnntnanngnnntnttggncnntttnntngnnttttttgnntnnnnnnnnaannnnnnnnnnnnngntttnnaanntnntgnnantcatnnnaagncnggcgattaaaccctgcaggatcatgctgcctgtgcctggnnngnnnnngncnnaannngnannggcnnnnntngcnntaancnnnannnnaaaaaatnnnannaaaaannancnnaannnnnnnnttttgtnnnnntnnnnnannncnnnntnnnnngtgnttttttnnnnnntnnngntnntatnngnnttggnnanttngaannnntannnngnttnnannnnnnnntnnnnnnncttnnnnnaangnatnnnnagngnaannnnnngaaacnanttnancnnnnttnnnnnncccnngcgntttnnnntnnnntnnaannnncnaannnnnccnanngnncannnnngccnacnnggcnnannangnccacnnannnaannnggnnnnntnngngncctnngtnaaaannnnntnnnttntnnnccntgannnnnnngnannnnnggntttngnngnnnaaantgntnanagggnanncaggcnnnnnnngntncngnanntnncntatccntnnnanngntcntnnngcnnnntnaannannnnncntnnnnnnccntgnncnnccngngnnannnnnngaaannngnaangnnnnnnanggnnnncanngnnnncancnncnannacntcgnngncaancnnnnnttnntnnnnnccntnnnntncnntttttnngagnangnnaagcnnnggntnncntnnaannnntncnnccagnncttnntnnnncnnttngcgctnntnncnntnnnnnnnntnngnnnnnnnnngttatcannnntcnnnatngnngncattcnnnncnncctnnccnnnnnnnnnnnncngnggnnancnnggtncngnnnttnncngtnnncccnnntnnnncnnnntncnnntnccnaaaannnnnannnnnnnnnnncngntganncaaaaaaggncnaannnngncannnnngnaanntnggtttnnnagnnnttnnagnnnntatngnnagtnnngnnagntnnntganntnncnnnnnnnnnannnnnnnnngnnngantnnnncnncnncnncannnncnnnnatnannnnnnnnnnnnnanngnnnnnnnngnngccnnnnnnnnnnaatnnntgnannnnnnnannnagnnnnnncangnnctnnnngncnntnncgncnatnncngccnnntnnnnnnganannggnnnannnggnnnntncnnnnnntnnnnannnnntngnnnnggnnnnnnnnnannnnnnnnnnnnnnnnnnnaagnnnn

SEQ ID NO: 357 - DNA, 4000 bp, Escherichia coli
  misc_feature (103)..(103): n is a, c, g, or t
  misc_feature (244)..(244): n is a, c, g, or t
  misc_feature (830)..(830): n is a, c, g, or t
  misc_feature (1141)..(1141): n is a, c, g, or t
  misc_feature (1237)..(1237): n is a, c, g, or t
  misc_feature (1985)..(1985): n is a, c, g, or t
  misc_feature (2268)..(2268): n is a, c, g, or t
  misc_feature (2355)..(2355): n is a, c, g, or t
  misc_feature (2357)..(2357): n is a, c, g, or t
  misc_feature (2492)..(2492): n is a, c, g, or t
  misc_feature (2837)..(2837): n is a, c, g, or t
  misc_feature (2934)..(2934): n is a, c, g, or t
  misc_feature (2941)..(2941): n is a, c, g, or t
  misc_feature (2960)..(2960): n is a, c, g, or t
  misc_feature (2963)..(2963): n is a, c, g, or t
  misc_feature (2987)..(2987): n is a, c, g, or t
  misc_feature (2996)..(2996): n is a, c, g, or t
  misc_feature (3012)..(3012): n is a, c, g, or t
  misc_feature (3047)..(3047): n is a, c, g, or t
  misc_feature (3157)..(3157): n is a, c, g, or t
  misc_feature (3229)..(3229): n is a, c, g, or t
  misc_feature (3238)..(3238): n is a, c, g, or t
  misc_feature (3265)..(3265): n is a, c, g, or t
  misc_feature (3268)..(3268): n is a, c, g, or t
  misc_feature (3272)..(3272): n is a, c, g, or t
  misc_feature (3277)..(3277): n is a, c, g, or t
  misc_feature (3285)..(3285): n is a, c, g, or t
  misc_feature (3293)..(3293): n is a, c, g, or t
  misc_feature (3297)..(3297): n is a, c, g, or t
  misc_feature (3307)..(3308): n is a, c, g, or t
  misc_feature (3315)..(3315): n is a, c, g, or t
  misc_feature (3318)..(3318): n is a, c, g, or t
  misc_feature (3323)..(3323): n is a, c, g, or t
  misc_feature (3325)..(3327): n is a, c, g, or t
  misc_feature (3345)..(3346): n is a, c, g, or t
  misc_feature (3348)..(3348): n is a, c, g, or t
  misc_feature (3350)..(3350): n is a, c, g, or t
  misc_feature (3362)..(3363): n is a, c, g, or t
  misc_feature (3367)..(3367): n is a, c, g, or t
  misc_feature (3370)..(3370): n is a, c, g, or t
  misc_feature (3376)..(3376): n is a, c, g, or t
  misc_feature (3378)..(3379): n is a, c, g, or t
  misc_feature (3385)..(3385): n is a, c, g, or t
  misc_feature (3389)..(3389): n is a, c, g, or t
  misc_feature (3391)..(3391): n is a, c, g, or t
  misc_feature (3394)..(3396): n is a, c, g, or t
  misc_feature (3399)..(3399): n is a, c, g, or t
  misc_feature (3402)..(3402): n is a, c, g, or t
  misc_feature (3404)..(3404): n is a, c, g, or t
  misc_feature (3406)..(3406): n is a, c, g, or t
  misc_feature (3409)..(3409): n is a, c, g, or t
  misc_feature (3411)..(3412): n is a, c, g, or t
  misc_feature (3419)..(3420): n is a, c, g, or t
  misc_feature (3422)..(3422): n is a, c, g, or t
  misc_feature (3428)..(3428): n is a, c, g, or t
  misc_feature (3431)..(3431): n is a, c, g, or t
  misc_feature (3433)..(3433): n is a, c, g, or t
  misc_feature (3436)..(3436): n is a, c, g, or t
  misc_feature (3440)..(3440): n is a, c, g, or t
  misc_feature (3443)..(3443): n is a, c, g, or t
  misc_feature (3445)..(3445): n is a, c, g, or t
  misc_feature (3448)..(3450): n is a, c, g, or t
  misc_feature (3454)..(3454): n is a, c, g, or t
  misc_feature (3456)..(3456): n is a, c, g, or t
  misc_feature (3460)..(3461): n is a, c, g, or t
  misc_feature (3463)..(3469): n is a, c, g, or t
  misc_feature (3473)..(3473): n is a, c, g, or t
  misc_feature (3476)..(3476): n is a, c, g, or t
  misc_feature (3480)..(3481): n is a, c, g, or t
  misc_feature (3485)..(3485): n is a, c, g, or t
  misc_feature (3491)..(3491): n is a, c, g, or t
  misc_feature (3495)..(3495): n is a, c, g, or t
  misc_feature (3497)..(3498): n is a, c, g, or t
  misc_feature (3507)..(3508): n is a, c, g, or t
  misc_feature (3510)..(3511): n is a, c, g, or t
  misc_feature (3513)..(3517): n is a, c, g, or t
  misc_feature (3519)..(3521): n is a, c, g, or t
  misc_feature (3525)..(3525): n is a, c, g, or t
  misc_feature (3527)..(3530): n is a, c, g, or t
  misc_feature (3532)..(3534): n is a, c, g, or t
  misc_feature (3536)..(3536): n is a, c, g, or t
  misc_feature (3540)..(3540): n is a, c, g, or t
  misc_feature (3542)..(3542): n is a, c, g, or t
  misc_feature (3544)..(3544): n is a, c, g, or t
  misc_feature (3547)..(3549): n is a, c, g, or t
  misc_feature (3551)..(3552): n is a, c, g, or t
  misc_feature (3559)..(3564): n is a, c, g, or t
  misc_feature (3566)..(3567): n is a, c, g, or t
  misc_feature (3570)..(3576): n is a, c, g, or t
  misc_feature (3580)..(3582): n is a, c, g, or t
  misc_feature (3584)..(3585): n is a, c, g, or t
  misc_feature (3593)..(3594): n is a, c, g, or t
  misc_feature (3599)..(3599): n is a, c, g, or t
  misc_feature (3601)..(3602): n is a, c, g, or t
  misc_feature (3607)..(3607): n is a, c, g, or t
  misc_feature (3609)..(3609): n is a, c, g, or t
  misc_feature (3613)..(3613): n is a, c, g, or t
  misc_feature (3615)..(3615): n is a, c, g, or t
  misc_feature (3617)..(3619): n is a, c, g, or t
  misc_feature (3624)..(3625): n is a, c, g, or t
  misc_feature (3627)..(3627): n is a, c, g, or t
  misc_feature (3630)..(3630): n is a, c, g, or t
  misc_feature (3635)..(3635): n is a, c, g, or t
  misc_feature (3638)..(3638): n is a, c, g, or t
  misc_feature (3643)..(3643): n is a, c, g, or t
  misc_feature (3645)..(3647): n is a, c, g, or t
  misc_feature (3649)..(3651): n is a, c, g, or t
  misc_feature (3655)..(3658): n is a, c, g, or t
  misc_feature (3660)..(3660): n is a, c, g, or t
  misc_feature (3666)..(3666): n is a, c, g, or t
  misc_feature (3668)..(3669): n is a, c, g, or t
  misc_feature (3671)..(3671): n is a, c, g, or t
  misc_feature (3673)..(3673): n is a, c, g, or t
  misc_feature (3675)..(3676): n is a, c, g, or t
  misc_feature (3678)..(3678): n is a, c, g, or t
  misc_feature (3680)..(3684): n is a, c, g, or t
  misc_feature (3687)..(3689): n is a, c, g, or t
  misc_feature (3692)..(3695): n is a, c, g, or t
  misc_feature (3697)..(3697): n is a, c, g, or t
  misc_feature (3700)..(3700): n is a, c, g, or t
  misc_feature (3703)..(3705): n is a, c, g, or t
  misc_feature (3708)..(3711): n is a, c, g, or t
  misc_feature (3713)..(3714): n is a, c, g, or t
  misc_feature (3716)..(3718): n is a, c, g, or t
  misc_feature (3722)..(3722): n is a, c, g, or t
  misc_feature (3724)..(3725): n is a, c, g, or t
  misc_feature (3732)..(3733): n is a, c, g, or t
  misc_feature (3737)..(3737): n is a, c, g, or t
  misc_feature (3739)..(3740): n is a, c, g, or t
  misc_feature (3742)..(3743): n is a, c, g, or t
  misc_feature (3745)..(3748): n is a, c, g, or t
  misc_feature (3750)..(3760): n is a, c, g, or t
  misc_feature (3766)..(3766): n is a, c, g, or t
  misc_feature (3768)..(3769): n is a, c, g, or t
  misc_feature (3772)..(3772): n is a, c, g, or t
  misc_feature (3774)..(3775): n is a, c, g, or t
  misc_feature (3777)..(3777): n is a, c, g, or t
  misc_feature (3780)..(3780): n is a, c, g, or t
  misc_feature (3782)..(3785): n is a, c, g, or t
  misc_feature (3789)..(3790): n is a, c, g, or t
  misc_feature (3795)..(3795): n is a, c, g, or t
  misc_feature (3801)..(3803): n is a, c, g, or t
  misc_feature (3805)..(3805): n is a, c, g, or t
  misc_feature (3808)..(3808): n is a, c, g, or t
  misc_feature (3810)..(3810): n is a, c, g, or t
  misc_feature (3813)..(3815): n is a, c, g, or t
  misc_feature (3817)..(3818): n is a, c, g, or t
  misc_feature (3821)..(3821): n is a, c, g, or t
  misc_feature (3823)..(3824): n is a, c, g, or t
  misc_feature (3826)..(3826): n is a, c, g, or t
  misc_feature (3830)..(3832): n is a, c, g, or t
  misc_feature (3834)..(3834): n is a, c, g, or t
  misc_feature (3837)..(3837): n is a, c, g, or t
  misc_feature (3840)..(3841): n is a, c, g, or t
  misc_feature (3843)..(3843): n is a, c, g, or t
  misc_feature (3848)..(3849): n is a, c, g, or t
  misc_feature (3855)..(3855): n is a, c, g, or t
  misc_feature (3857)..(3858): n is a, c, g, or t
  misc_feature (3863)..(3863): n is a, c, g, or t
  misc_feature (3865)..(3865): n is a, c, g, or t
  misc_feature (3867)..(3867): n is a, c, g, or t
  misc_feature (3869)..(3873): n is a, c, g, or t
  misc_feature (3876)..(3876): n is a, c, g, or t
  misc_feature (3880)..(3881): n is a, c, g, or t
  misc_feature (3885)..(3885): n is a, c, g, or t
  misc_feature (3888)..(3890): n is a, c, g, or t
  misc_feature (3892)..(3892): n is a, c, g, or t
  misc_feature (3894)..(3894): n is a, c, g, or t
  misc_feature (3896)..(3896): n is a, c, g, or t
  misc_feature (3900)..(3905): n is a, c, g, or t
  misc_feature (3921)..(3921): n is a, c, g, or t
  misc_feature (3923)..(3926): n is a, c, g, or t
  misc_feature (3928)..(3929): n is a, c, g, or t
  misc_feature (3933)..(3934): n is a, c, g, or t
  misc_feature (3937)..(3937): n is a, c, g, or t
  misc_feature (3941)..(3941): n is a, c, g, or t
  misc_feature (3947)..(3949): n is a, c, g, or t
  misc_feature (3952)..(3953): n is a, c, g, or t
  misc_feature (3955)..(3955): n is a, c, g, or t
  misc_feature (3957)..(3957): n is a, c, g, or t
  misc_feature (3960)..(3966): n is a, c, g, or t
  misc_feature (3973)..(3973): n is a, c, g, or t
  misc_feature (3979)..(3981): n is a, c, g, or t
  misc_feature (3984)..(3984): n is a, c, g, or t
  misc_feature (3986)..(3986): n is a, c, g, or t
  misc_feature (3994)..(3994): n is a, c, g, or t
taaacttttagcaaaattcataaactcatctaatgagggtatatttatattttctcttgttgatgtatgaattgttttttcttctaatattttaggttgaatntcatttataatagggctttctatcatttttttgaatggttctgattcttgacttactttatttttaatatttaaagtctctttttggagtgattcttgtagtaagaaagaaatatcagttattattctataaatacttggnaccccatttcttgtttgatactgaattaaaccaacatttcttaattttgatttaagagcattaatagttggtctagttaaagataatttttgacctattgcattatctgatattgtgaaatctttgccatcattttgtctacatttttccaatagaaaaaaatataatgcaatagcagaagctcctaatggagatttttcatttatagaccaaaatttggttgttaattcagtataattcataattcattctcttttgctataatttcaagaacttttttcttatctattacgattaactttcccacttgagatattgcgtcatctatcatcccagagtttttaattttagaagcagttgttcttgaacagcctaatatctttgccaagcctttcaatccatacacatattctttaatttcttttttttgcccagttactaccttatgcaactctatatattctgccaccgtaaggtgtaataattgagtattaggattgatgtccatagtatttataatttattattaaataactctaaagctttttctctatcaataattatttttctgcctctttggattatngcttcatcaaatattccttgactttttaatcgagaagcgtgggttttagaacaccctattaaatctgctagaccattaattccatatacatactcttttttttctataacttcttgttctggattattaggtatttcggtatatttctgaaatgcttgtaaaaaatcaccaagagtcagttgccatattggagtgtctctatcaatattcatttttatgattttaagtcggttatcattacttccattttacattccaaagaatacttattattcattgctttttcatagagaatatctataattctgtcntcaaaggagtttccactcatcactctaattattttattataagaaattttattttctttggaaacatttgtcaaatcccctctataaaagtatttncgaagttcttctacaaattgtttttgtaatatttttcttctttctgctattctttcaggggaaacttcaatagaataataatttagactttgctctctgagccttttttcacattctataaagtatattcttgcttgttttcctttttcgtttctttccagcattgaaagttcttttgccatatctattgaaagaaggtattctttcattgggcgtcctccttttgggttttttccaatttcggaaaaaactacatagtcttgattttcaatgaatccaaattgctcaatacgctcatttatccatgctccaaaaacttttcctacctccaaaaacttatgtaattctctcgctgaaataaaagaatttccattgtgttgtgtaattttaattaactctttcatttttagattttttaggttttactgatgaattatataactgataatttttaaaaatctcttcttctgtaaagccttgttctttatagaacattaccgcttcccaaagggttagattcctgctattccttcttgctaaaccaagaactgattgttgctgatttccaagtctttttgctaattctatactgaagttattatcattcagtattttttcaatgatggtttcacttacttccataatttttatatatttgttgttaatttgtatttaaaatataactatatttatattgcgaatatataatattttatataaaatactactatttatatactttattatntaaatattattgtaaataactgattgtcagaaacaaaatttttatgaaagatagattaataatttttttagaatatttaggcattggacaaaataaatttgctcaaaatgtaggtttatctgctggatatgttaataatttaggagaaaatatcagctctcgaagtttaaataagatattgaatgtgtaccctcaattaaatgaaaaatggcttttaacaggaaaaggtgaaatgattaaaccaataaatacgcaaaaagcaaaaggaaataatagtataaanagtaatataaataacattgaaggaaatgtgacaatttcccacaatgatttttcaaatttattagagcttcaaaaagggtatcaagangnacaaaaggaattaaatgaaagattaaaaacaagtcaaaaacaaatagatacattattggaaattctaaagaataagtaattatgaaaaagattctccttgtagcattaacatttcatgctatctttttttctgcncaaaagaaagataattgtacagatataatgaagagatgggatggttgggatatttataaaaaacctaccaccgagagtgtaaaaaaatgcatctccaaagatgaaagaaaaattaaaatagaagttataaataaaggagattataaagacttataccaaattctatatttagagtttaaaaaagtaaacaataatgatttctctcctattctgaaatattccgaacacacaccaaatattgtagtggatgaaacttatgataaaataaattggagaggagaaggaggtactattaatgaacacactatatttgtttttcaaggatatagtggagtagaaagcgancccaatatacctttaaaagaaatagaaatttacgaaaccacagctcctgttttatctggaatattaagaataatgggaacatatcgcaaagattttnaccatantatacctacaaatcttacnaanacaataaatatatattcagatggnaaattattnatttcaaaagaatacnaatttagtgaacttgaaagaacaggtggaataacnatagaatttaatagtaaatgataaaataccacgcacaatttttattagacaaagaaaaagacaaccctactgctaaacttcgttataggataaaatggagtggatttatngttgcttttaatgtaggctatagaatagaagttgataagtggagtaaggaaactcaacgctgtaaaataaanactacacanggtgacaagaaagttcctgcaaatgtnatnaatngtaanatacaaanatatgaanaggngtgtgaaaanntatttanaanatttnannnagaaaataaaatacctanngntnatgaatttagannaganttnaataangnnataggnaaananaannnaantanananganannttatttnntntttttnatnanttnattnaanangannnagananaaannannnnnnntttngancaannttanaaatgnaagnanntaaaaaacnntnncnnnnntnnnatantnnnntnnnantatntnanttnnntnnagaaaannnnnnannatnnnnnnnatannntnngaatgaannaaagnannaaaantnaacnantnnnaaaannanatnttctntanaatgntnnntnnnatgnnnngntaaaangnnananannantnnnnntannnttnnnntnttnaannnaannnnannannnacanannaaaaaannatantnntnncnnnntnnnnnnnnnnnaaattnannaantnnanaantnnnnaaannaaaanccattnnnanaananaannnannttntnntntttnnntnttntanngnattgnnattttnanntgttntnantnnnnnaanaaannatantannnangnanatannnnnnttactacaattaaaangnnnnannatcnnatnatanaattannnaannanantannnnnnntttaganaaatannntananataaaatntttgat

SEQ ID NO: 358 - DNA, 4000 bp, Escherichia coli
  misc_feature (1956)..(1956): n is a, c, g, or t
  misc_feature (1959)..(1959): n is a, c, g, or t
  misc_feature (1962)..(1963): n is a, c, g, or t
  misc_feature (1968)..(1969): n is a, c, g, or t
  misc_feature (1980)..(1981): n is a, c, g, or t
  misc_feature (1984)..(1984): n is a, c, g, or t
  misc_feature (1986)..(1987): n is a, c, g, or t
  misc_feature (1992)..(1992): n is a, c, g, or t
  misc_feature (2007)..(2007): n is a, c, g, or t
  misc_feature (2016)..(2017): n is a, c, g, or t
  misc_feature (2019)..(2020): n is a, c, g, or t
  misc_feature (2022)..(2022): n is a, c, g, or t
  misc_feature (2029)..(2029): n is a, c, g, or t
acagtcagcatcaacggcagacgcgtcgaggcggtagtcggccgctccctgttcgagtgtgccgacagtctggaggtgaaggtcccctcctcatgcccaagagccggcacctgtcacgagtgcatcgtgcaggttctctccggcatggacgccctggagctacggacggaggaagagagcttcctcggtggcgacttccggctcgcctgtcaggcacggattcgtacagccgaccaagacgtggtcgccgcgtcgctcaggcggcaacagcagattgtagccgagggatcggctgatctccgggagcactgggaacttgcgccctcgactcgacgggacggtgccaacgtggttagagacggccagatcatcgacgactaccgcggcgcgatcttggggctcgcggtcgatatcggcaccaccacggtctccgcctcgctgatggacctcgagagcggtgcaaccgtggccctgacctctttcgagaacccgcagaccttcggcggcagcgacgtgatgcacaggatccactacgacggccagcacccgggcgagctgcagcgcgtgttggtcagcttcctcaatgccgagctgaaggcgatgcctggcgaccgggatcagctctacgaagtcatggtcgtcggcaacccgaccatgcgcgatctgttcctcggtctcgacgtgcagagcctcggccagaagcccttcaagtcgcagacggaacacgaccgcgacgccggccgcgcctcctccactgccgtcaccaggaaacccaaagacctcgggctgcggatgagcccggcgggagcggtcttcggcgctccgctcattgcctgccacgtcggcgcggatgccgccgcgtgcatcctcgccactcggctgcatgaggcggttgagccggcaatgatcatggatatcgggaccaacaccgaggtcatcctgggcaacaaagaccgcctgctgtgcgcctcctgtgctgccggaccggccttcgaaggcggcaagatcaggtacggcatgtcgggaattgagggcgccatccagtcagtgcggctccgcaacgggcatgtcgagatctcgaccattggcgacgtgcaacccaccggcatttgcggctcaggtctcatcgacctgatcgccgaactggtgcggcacggcagagtgaacggccgcgggcgcttcacgggtgacgcgaaggagtgcgttatcgacgaagccaccggcatcaccttcgccgagtccgatgtccaggagttggctcaagccaaaggcgcgacgcacgccggcacctcactgctcctcaagcacttcccactgccgttggcggacctgaccacgctctacctcgccggcggcttcgccaactacatcgacgtagacaactcccgactcatcggcctcacgcccgacctcccgcccgaccgcctccacaagatgggcaacgccgccgcagagggcgccaaggaactgcttctctcagtcaacaagcgtcaggaactggaccgggtcgtcggcagcatcgagcacctcgaactcgagagtgacgaggacttcttcacctacttcgtcgaaggctgcctcttcggcgagaactgacgctctcccctacccggcgtcttctccgtctctgccagcctgactcccgtccgttagcagtgacggagaatctgccctacgtcgcgcaccacctggccgggcgcctattgcgtctcagcagcatggatagcaggctggcgatcacttccgtaagtctcgctcgccggcaggggggcaagcccccctgcaccccccttggctccgggcttgctgcccggtccgctgcctcccggctccgccgggaccgcgctccgcgctggcagccgtcccgtgccgccgcccttcgccctgcttatgctcaagggaatggaacggaggccctcgttgaactgggggcgagaacgaggcggaagccgaggncgncgnnccggnngcccggcccgnnccngnngcggnacgcgcagcggcagncgcgagcgnngnngntccaacngccgccgcggacgacgcggtccgcgcccccttcagccccctcatccacccaagggctgccgtcctccggcgccccgtcgtagttgttgtgccagtgatcctcgcaccattcccagacgttgcctaacatgtcatacagtccccagtggtttggcagcttgcccttcaccgggtgtgtggtccggccggagttctcgccgtaccacgccagcctgtcgagattcgggcaccggccgtccatgctggtcagctcctgtccctcttcttcgccgtagggggcgtacagggcgccgccggtccccgcgcggcaggcgtattcccattcggcttcgctgggcaggcgggccacgtcctcgcgcggctcgggcagcagcccggtcagtcgctcgcagaacgcccgggcatcggccgagctcacctgttccacggggcgtttgtcagcttccttgggtccctccgcaaagcggctggggttcgcgccgctcaccgccttgtagaattcctgcgtcaccggcgtctcgcccagccagaagccgtcgtcgattctgaccccgtgcaccggcccttcgtcggaataccgttccgcctcgccttgcggcgaccccatgtcgaagcggcccggatcgatccagcgcagccggtggacgacctcgccgagaaccagctcggcaaacacgccgtaccgatcggcgccgaagccgcccgcccaggtgggcggttcggggggagccagcgggatgcgcaagtgcttgttcacagcgtctcctcgccgggcgaaaggggagaaggcggccgggagccttcgtcgcgggcctccgcccgcgctaccaacacccggccgccgctcggtgcttcgccccgccgggccgtcgggcccgacgggacagggtcactgcccggttcaacggggaactcatccgcaatcaacttgattgtggatgagttccaggacctccgtccattcccttgagctgggggcgagaacgaggcggaagccgaggttgtcgttccggttgcccggctcgttcctgttgcggtacgcgcagcggcagttgcgagcgttgttgttccaactgccgccgcggacgacgcgcgtcgcgtcgaggatgacgcggttcgcgcccttgggcagtgcccgaaatctctgctcagcagcttccggcgcagcggtgcgccggttgtccagtccgtgcgcgcgaggatgctgcgggcgatggccgccgcggcaccctcctcgatccgctctcgcctcaacgcctcttcacacgccttgagccgccggcgggcgcgccgacagctccgcgaactgaggcggagcgtgcccgggaagaccacgaacccgaggaacggcagcccggcctcggagcggttgaggcagggcgatttgaggtccaagtcaaggcgggtctcacaatactctcggagggcgcgctcccaccgcagcagttcgcgcgtggattgtccccagaccacgatatcgtccatgtagcgcacatagcccggggcgcacagcacctctttggcatagtgatccagcccgctgaggtagtggttcgcgaagtactggctggtcaggttaccaatgggcacgcccgccccggcatgacggcacccccgtagcgtagtctcttgtgggtgtctcccgccagccgccggctcggcgcaccggcgacgcccacaagaggctacactacaaggtcccaacggcccaagctcgtgtgcgccacagtgccgagaggcacccaggggcaagcccgtggccgcgcaacccgcggcactcgcgtagccatcgatgaccctgtcaagcaacgccaacagcggcggctccttgaacagccgggccaggagcgccttgagacgctcgtgcgagagactgtcgaagtatttgcggacgtctagcttcaggtagaacgggaactgccgcgcgaaagccgccgcgcgttccagcgccgctagcgtccccttgccaggc

SEQ ID NO: 359 - DNA, 4000 bp, Escherichia coli
  misc_feature (42)..(42): n is a, c, g, or t
  misc_feature (45)..(45): n is a, c, g, or t
  misc_feature (66)..(66): n is a, c, g, or t
  misc_feature (330)..(330): n is a, c, g, or t
  misc_feature (1997)..(1997): n is a, c, g, or t
  misc_feature (2120)..(2120): n is a, c, g, or t
  misc_feature (2888)..(2888): n is a, c, g, or t
  misc_feature (3461)..(3461): n is a, c, g, or t
  misc_feature (3506)..(3506): n is a, c, g, or t
aacataacttcagagaagataaaccaagccattccataaacntangatgtttttaattgattactntcaagacctgctaaatgttcctttatgacttgtctgaaccagaaaaataaagttgtaaataaagaggcaaaaccagcatataaaatataaacagaattgctatctgcatcgccgaggctattgatggtgctgctagctcccattactaataaaaacaaagagaaagccataaaaattgggaatctactttggtctggtacgtaatagttttgtgtactcatcttttaatgctccatttcgtgatggtctttatgatcatgatgngcaagagcctcatcatcatattcagtaatatcaaaaattgtataagaaagaataatgttttcaatagcttcaggtaactcgtttgatactagaagttttactggcaatagcgcctcttcgcctggcgctaattcttgttgttcaaagcaaaaacattctaacttttttaagtgagccgctgcatttgatggagctacgctcggaacagcctgagctgtcatttttttatctgtagtgttctttacataaaaagttgcggtgtaatatttacctgttgaaattgtcataactttttcagagggctcaaaagtccatggcatgttctcgttgtttgttgaaataaactgtaagccaagaggtctgccttcttctattacaagcttgtcagcattttctgattgaaatacttttccattaattccagttacttcacaaaaaacatcatataaaggcacaagcgcaaacccaaaagcaaacattaatggcactgcaattacgagtcgccttaaggtttttttagcctcagaattcattaatcaacctttggaggggttgtaaatgtatgataaggagccggcgatgctaccgtccactctaatcctctggcaccttcccaaacttgatctgttgcttttttaccacccattactgttttgacaacaataaataggaatagtatttgagacactccaaataaaaaggctccaactgtagataccatattccaatcagcgaactgaagagcgtaatctggataccttcttggcatgccagctaagccaataaaatgttgaggaaagaaagttacattaactccaataaacgaaagccagaaatgaagttttcctaacctttcgtcatacatatttccacaccattttggaatccagtagtacacagcagccataattgaaaaaatagctccaggtactaatacgtaatgaaaatgggcaacaacaaaatacgtatcatgatattgaaagtctgctggcgtaattgcaagcattaatccagagaacccgcccatggtaaataaaacaacaaatgctatagcaaataacattggtgtttcaaaagttattgaacctttaaacattgtagcgatccaattaaagactttaacaccggtaggcaccgcgattaacatcgtagcccacataaaaaataactcagcagcaagaggtaaaccaactgtaaacatatgatgtgcccatactacaaaagatagaatggcaatcgaaagcattgcccaaaccatagaagagtagccaaaaagctgctttcttgagaaggtctctattatatgagaaacgattccaaacgctggcaggatcattatgtatacttctggatggccaaagaaccaaaaaatatgctgaaataaaacaggatcaccgccacccgctgcattaaagaaactggttccaaaatgaatatccataagcatcatagttacagctcctgcgagaactggcataacagcaattaacaaatatgctgttattaaccaagaccatacaaaaagtggcattttcatcaaagtcacgccaggggctcgcatattcatgattgttacaacaacattaattgctcccataattgatgaggctcccattatgtgaactgagaatataaaaaatgttacgctgggcggcgcataggttgtngacagtggtgcataaaatgtccaaccaaaattaggtgccccaccttccataaataaagaagataaaagaataaaaaaagcaaatggtagtatccaaaaacttaaattgttcattctaggcagngccatatctggcgctcctatcatcattggaactaaccagtttgctaaaccaacaaaagcaggcataactccaccaaaaatcattattaggccatgcagtgtaatcatttgattatagaattctggttctactatctgcatgcctggctgaaataattcagctctaattaccattgccattgctcctcctattaggaacattgcaaaactaaaccaaagatataaagttcctatatctttatggtttgttgtgtaaagccatctagttaaacccttagcaggcccatgatgatggtcgtcatgatgattttctattactgcgctcatattttctttctctctttaatattaaatctttggttttttgtaatctacaatatcttttggaacaacgatttcaccgtcaccattttctttattgccccatgattgacgtgtatatgttatgacggctgccagctctacttctgaaagataactaaatgaattcattgcggctccttgaacaccttccataagaatttctatatttctttctttattatttaaaactacgtcgctaccagcaagggctggaaatatcccaggaataccctgaccatttgtttgatggcatgctacacaattaactgcataaacactttcacctcttgcaactaattcttctgctgtccaatctttagttgttagctcggccatcttcatagctgcttctttctttccggaaacccattcatcatattcgttttgctcaactacctttactacnataggcataaaaccatgatttttaccacatagctcagtacatttgcctctataaatacccggcttatctactttggtccaagctgtattaacaaaacccggtatggcatcttgcttgatagcaaaagcaggcatccaccaagaatggataacatcattagctgttattaaaaatcttacttttttacctacaggtattaccaccatttcatcaacttcttgtaaatagttttcgcccttgggaacaaggttgttgatttcatccatatcagttgatagattggagaaaaagcttacatcatcttctaaataattatattgccatttccactgataacccgttacctgaatatttagatctccagcctcatcatcatatatttttaccagtgttttagatgctggaattgccatagctattaatattaaaaatgggattattgtccatgcaatttcaactttatgattttcatgaaaagaagctgcaactggattcttcttctttgtatgtgcatacatcgaataaaacataacaccaaaaaccacaacgccaattgctacgcatatccaaaanataagcatgtgcagttcaaaaacttcattactaatatcagttacncctcttgtcatattgagagcgaaccaatctgccttcatgggagctgaaaaaattagaagcgcagacataattttaatctgcaaattttgtaaatatttaaaagacatttctttatcctttgagtgtgctaacaaaaataaaacttatttatatacaattataaggtatatctataattaaaacaaaatatagactgtaaatttcggtgcatatgatatctttttgaagtgttttttactagcttttaggatttttataatcttgaatattaattacattaattgattgttttttgttgttgatttccttaggtctttcctctgtaaattcacacttaacacaataaattaaattgttttcagcgttgatggctatagtatctttagcactacatgatgggcatgttgctccggcaataaactgaaccattttcattctgacatgctcttaaggtcttctgatactttatctgtttctggatttacgccaaacca

SEQ ID NO: 360 - DNA, 4000 bp, Escherichia coli
  misc_feature (41)..(41): n is a, c, g, or t
  misc_feature (1173)..(1173): n is a, c, g, or t
  misc_feature (1989)..(1989): n is a, c, g, or t
  misc_feature (2029)..(2030): n is a, c, g, or t
  misc_feature (2430)..(2430): n is a, c, g, or t
  misc_feature (2611)..(2611): n is a, c, g, or t
  misc_feature (2998)..(2998): n is a, c, g, or t
  misc_feature (3060)..(3060): n is a, c, g, or t
  misc_feature (3067)..(3067): n is a, c, g, or t
  misc_feature (3244)..(3244): n is a, c, g, or t
  misc_feature (3397)..(3397): n is a, c, g, or t
aatcttgcaattgctttctaagtttagacgcttgatagatnattgattgtctatcaggggttgcacttacggctgcagcagatggtgtaggtgctcttacatcagctacaaaatctgcaatagttgtatcggtttcatggcctatagagcttatgataggggttttgcaattaaaaataactcttgcaagttcctcctcattaaatgcccatagatcttcgattgagcctccacctctagccaatatgataacgtcacatcgattgcttgtatcggctgcttcgagagcctttatgattcttttatgggcattttctccttgaactatcgtgtcataaagaaggatatcagcaaaagggtatcttgaatttaaaactttaatgatgtcttttattacagatccatttgaggaagagatgacaccaattgtttttggagtttcagggagtgcttttttattttctaaagaaaataaaccctcagtttttaatttattttttagttggtcaaatgcaagctgaagatttccaacacctgcaggctccatttgttgcactattagttgaaagtcacccctttgttcatagagtgttggggcacctctgatcactactgacatgccattttcaggggaaaactgtattttgcgctgactaagacgaaaaaaagcacatctaatttgcccgtttgaatcctttagagaaaaataccagtgcccagaagagggtctagataaatttgatatttcaccttgaacccagcaatgaggtatgttttgttcaattgaatttctacataattttacaaaatctgaaacagagtaaatttcatcaagatcaaacatcagctttgagatgaacaaacaccgcccctgtaccgcccatatcttgagggcaagaacaaaaagctaaaacctgaggatgctgcttaagatagtgaactacttgagatttaatgatagatagaccgttatttgagtggtagcctttgccatggattatatgtataaatctctcgttagagtggaaatgaataaaccttgaaagtgactggcaagcttcttcgatcttatgaccatgtaggtctatagatggggtagagccaatatttccttgcttcatttttttaattatttttggcgacaatccaactttgaaatgaattacaggctcngagcctgaaatatttggctcgtacaaatatttatagtcttcaaaaggtttattcagtttatttttgaaaggctggtttttattattgctatccttgtcaatagttttttgttgttcaacggcatttctaaataaagatttatcgctttcatcaatcataatggtaataaattttatgtataaaaaaaccctcaaaggagggttttaattataactatgatttttgctatttagatattaacctgctaaaaaccaaattaacaatctaattttatagagctttaatttgggagataaggcgagacttttttctggcagcttgatttttatgaattaagcctttactgacagcctgatcaacattcttttgcatcactttgaagccactaatggcctctttcttatttccagcagaaattgcagaaacaaccttcttaacaaaggtgcgaactttagctcgaatttgtgaattatgttggttacgttttactgcttgtcttgcgcgtttctttgatgctgctgagttggccatattgttttatttaatggttaaattacaaaaacatgaattatagagtctcacctgtatttatgcaagtattagtttgcaccaacttaatttgctagtgatttaacgtattgaagtgtttttttcttattgagcagtaagtgccaggtttttccgccttgagatttccataaagacacagctcttatgccagctaaaagtagagcccttatatggtttgcagtgtgacggtttgtgaggtagatttgttcacccctgaccataatagtcggattgaggctgccaagngtatttttgtaaagttcagcaagtctagcaattgaattgnngtgatgaatgtcaaaaaattcctgtttattaataagactaatttcattggaaatctgatttaacaaatctggttttttcattaattttttttcaagattaattaatgctgtcgcatacaacatcacattatgcatatctattgactttttctcgaataaaaactttaaagaatcaaaacctatttttaaatcttctggagaggtgaaaatttcatcaaccgagtcgctttcattaacaatgctatttaagcttgctctattagtgtggctatcgcattgtccggttgaggcgagttggtgtactaatgctgtagattgaaatatgcttgccaatgctagggtttgttttgctgttttattcattagccttagatttaattacgcttccaccaaggcaaanatcgtcatcataaaaaacgactgactgaccaggtgttatagctctttgagtgtctttaaaatcaacttttatacaatcaccatctagcataattaccttacattcttgagatgcttgacgataacgtattttagcatcacatgtaagtggaaaattaggggctttatctatccagtgaacnctgtctgctacaagtgaattgtgataaagcaaagggttgtcaccctgaacggcgactattttatttgattcgattagtttatctgcaacaaaccatggctcaggagaatcactaaatccaccaccaatctcaagtcctttgcgttgaccaattgtgtagaaaggaagaccatcatgatgtttaataaatcgcccatcttcatcaacaatatcgcctttctctttaggcagaaaattagtcaagaattctgcaaatggcctttcacctataaagcaaattcccgttgaatctttcttttcagaatttataaagttattattttttgcaatttcacgaacatgttttttgtttatttcaccaagcggaaataagctttgagagagttgntcttgatttagtaagtgaaggaagtagctctgatctttattgccatcaattccagtttttangagatantttttattattttcagcaattcttgcgtagtgaccagttgcaattttattggcaccaaggtcttttgcataatctaagaatgctttaaattttattttctggttgcacaatacatcaggatttggagttctaccttttttatgctcagacaaaaaattctcaaagacgtcttcccantattcgtgtgagaagtttactgtgtgaagctttatgcctagttggtcggcaacctgctgtgcatctgataagtcttgagatgcactacaatatttgtcatcgtcatcctcatcccagtttttcataaacaaagcttctacttgaaatccttgntctagaagaagaaaggctgcaacagatgaatcaacacccccagagaggccaacaataattttattagcagtgatactcattactcttgatcgtaggcgctgacaatttttttaaccaattgatgcctaacaacgtcatgagcatcaaaattacaaaaagcaatattgtcgatgttatgaagaattttaattgcatctataaggcctgattggtttggaacaggtaggtctatttgagtgatatctcctgtaattaccatcttcgaaccaaatcccattcgagttaaaaacattttcatttgaggtatggtggtgttttgagcttcatcaagaataatataagcctcatttagggttcgacctctcataaaagctaatggggcaacctcgatgacttgcttctctattagcctatttactctttcaaagcctataaattcatagagtgcatcatatatagggcgcagataagggtcaactttttcacttagatcgcccggcaaaaaacctaatttctctccagcttcaacggcaggtctaactagtactattcttttaatgttggagctttcaagagcctcaacggccctcgcgactgctaaat

SEQ ID NO: 361 - DNA, 4000 bp, Escherichia coli
  misc_feature (1512)..(1512): n is a, c, g, or t
  misc_feature (2632)..(2632): n is a, c, g, or t
  misc_feature (2677)..(2677): n is a, c, g, or t
ggtgtgtaattcggccgaaacatcgtcgtgccggtctctttaatgctttggcccaaggcttttgccgcgatcgcaacaccgttcacattcgataatttaccttggtcggtcccaaatcccagtgcggtgtaacgcttgacgtgttcaacactctcgaagccttcgcgggtcgcgatttcaatcgcagccgccgagacatccaattgataatcgacgaactggggcggtgccttggccgtcggcaaaggatggggcacctgaaacaaggcctgcaacgcgaagccgatgctttcgctacccgatattgcaagacttttcggcgcgtcgaaccccagtctcgatagcgcttggtgcgcagcgatcgcgccctgctctaaactttcgcccaaagcaaactccccggtcacagcgccagcaaacaacagtcgctcgtgatcaggattcggtacaaagccacaaacatcttcgcgccaaaccggccgatgccctagatgagccgacaaatgcacaacgggtgaatagccgccagagcttgcgatgacatctgctgccagctttctgaccggacccaatcgagcatcagcttgggcatcaaaatcgcaaacaacagccgctttaaccgaggcgccacccaccacgtcaacgaccactgccccctgaatgaccaccacgccagctgattctgctcgtgtaaccaggctcgacgttggggcggcgcgcgcatcgaccaccgttgcactgccggtccccgccgccaaccaatcgattgcagcctgatagccagcgtcgttattggtcgcgaccactaaggcattaccgggccgaacgccatagcctttcaaatagactgatacagcgcctgccagcatacaacccggcacatcgttgttggcatagaccaggggccgttcatgggcaccgctggccagcaccacttcccgggcccgaatacgatgcatccgctgccgggctaacccttgggtcacggtcggcgcaagatgatcacgacaacgctcgaccactgtgacgaagttgccatcgtgaaacccggtcgccgtggatctcaagaggacctcaacattggccgcagccctcagcgcatgaagcgttgcctgaacccaaacacgcgccggcgcgtcgtcaacctgatcatcgctaaagcgcagccaaccgcccggtgtgggattttcatcaacgatgatgatccgagcaccagaaggttgggccgtcagggccgctgcaaggcccgccggtccggcaccgataatgagcaggtcacagtgccgattgatcttgtcgtagatctcaggatcgggttcggtcggcgcaaaccctagacctgccattttacgaatcacgcgctcagccgcatgccagactggctgtgaatacatcatcgttttgtaataaaacccggggggcatcatttttcctgcgagcttgccaaccatcgccatcgcatcccactcgaggctgggccaaccattcgtcgttcgacagaccagaccctcntagagcgcttgttcggttgctcgaacatttggcacctgggtgctcggcgtggcacccacttggagtatcgcgttgggctcttcgaccccggcggctatgatcccccgcggccgcccgtacttaaaactgcgaccgacgattttgacgccattcgccaacaaagccgaggccaatgtatcgccgcgaaaaccttgcagcgtgcgaccattaaacgtgaacgttatgggcacatcccgatcgattagacgaccctctgcaattcgattaacttgtttcattgcaacagcgcctcatctttgaccggttgcgcacccatcgcataggtttgctcgatgtcgtaggtcaccgtatctcgcacaacattaaaaaaccgccgacagcctgccgcgtgataccacatttcatgatgccgtccacgtgggtttcgacgaaagtacaggtaggtgccccactgcgcatcactgcagcttgctgggtcgtctgggcgcgcaagatgggcctccccgctgtaatgaaactcgggttcatctcttaattcttggcaataaggacaatgaattcttaacatgctgctctcataaagatctaatgcgcgacgccggctgcaccgtgctcatcaatcaatgcgcccgaataaaatcgatccagcgcaaagggtttggccaaagccggaatctcatcactcgccaagcagtccgcaaagacatggcctgaacccggcgttgccttaaaaccgccggttccccagccgcaattaaagtacaggttttcaaccggcgttttgccgatgatggggcaggcatccggcgttgtgtcaacaataccgccccattgtcgattcatcgggacccttgagaacattggaaataattcaatcatcgcagcaagggtatgctcaatgacgggcatcgagcctctctgaccataaccggtatagctatcaatacccgcaccaatcaccagatcgcctttatcggactgggagacatagccatgcacctgattcgacatcacgacggtattcaaaatgggtttgatcggctccgagactaaagcttgaagtggatgcgattcaatgggcagctcaaagccgccgtaaccggcgagcacacccgaattncccgcgaccacgcagcccactcggccggcatggatcaccccatancgatcggtaaccaccccccgtagctgatcgccttcaagctcgaagccggtcacagcacacgcctgcaacagatcaacccccaaagcatccgcagcgcgagcgtatccccaagcgaccgcgtcgtgccgcgcaacgccacctcgcggctgccaagaggcgcctaaaatgggataccgcctagcgcttgtaatatcgatatgcggcacgatctttttgacacccgaggcatccaaaacttcgccgtcaatgccgttcagccgattagccgaaacccttcgctcgatatcgcgcatgtcttgcagggtatggccaaggtttaaaacgccccgctgcgaaaacatcacgttgtagttcagctccgttgagagggtctcccaaagcttcaacgaatgttcgtacaggtgcgccgcttcatcccagagatagttcgaccgaacaatggtcgtattgcgacccgtattgccgccgccaagataccctttttcgatgacggcgatattggtcacattgtgcaccttggccaaatagtaggccgttgccagaccatgtccgccgccaccgacgatgatcacatcgtagtgcttcttaggttcagggttacgccaagatcgctgccaattttgatgatgcgacaaagcatgcctgaataaactaaacgctgaaaaccgttgcacctaaccctcgcctaacccttccggatgtttcgatgcgtcttgctctgcatcatggtttgccaaaataccaaaagacgtctcccgcctggcgaaggccaaggcctcactggcgatgtttggaatcaaaccggttgcttcctctgtgaggactaaattcgatcccagggttacccgcagcgagcgttctgatttcggcgataagctcatatatttcttatacgtgcgattaaaatgtgcggtcgactcaaaaccacagatcgacgaaatatcgacgattgagcaggtcgtttggcgcagcagctgtttggcccgttctaatcgaacctttaggtagaaccgagagggcgtaatgcctagaaaattcaggaacaagcgctccaactgccggcgcgaaacccctgagtaggcggccacgtcaaccagatcgatcggctcttcgatattagcctccatcaattgcaccgcactggccaattttggctgactcgcaaacacattattttccatccgcaaccgctgtggctcctggctgtcccgaatgcggtcgcacacgaacatatccgatatcgcattggctaatggcgctccgtaatgatcggcgaccagatgcagcatcatatgcagcgcgacatcgccgccggtacaggtg

SEQ ID NO: 362 - DNA, 4000 bp, Escherichia coli
  misc_feature (921)..(921): n is a, c, g, or t
  misc_feature (1214)..(1214): n is a, c, g, or t
  misc_feature (1367)..(1367): n is a, c, g, or t
  misc_feature (1385)..(1385): n is a, c, g, or t
  misc_feature (1397)..(1397): n is a, c, g, or t
  misc_feature (3305)..(3305): n is a, c, g, or t
  misc_feature (3496)..(3496): n is a, c, g, or t
  misc_feature (3502)..(3502): n is a, c, g, or t
  misc_feature (3518)..(3518): n is a, c, g, or t
tgtgtcaataaaactaaactatcaggtggccgcgacgcaacctttttttaggatgataaatttttcttatctcgtgctctactttcatctaaaacgtgaatgatcggcgggtggacccagtctgtaacatttataagaaaaagctgacagcttccgacattgcctgaacgaatgaacaggcataaattgttaaactaagtgaagtgagaagtggaatgagaagttttcgaccttgatcatgcaggaacgcatggcgcgaacagaatggagtaataaatgaaaaaagtcgcaatagtggggttggggtggttaggtatgccactcgcaatgtctctggccatgaaggggtatgaggttgtcggcagcaagactacgcctgacggcgtcgacgccgcgcgcatgtgtggtatcaactgtttccctctggtcttcaagccggagatggagtgtgaagccgccgatctggacgtgctattaaatgtcgacgcgctgatcatcactctgccggcacgccggacggtggaaggcagtgagctctattttcaggcggtgcagcagctggtggacagcgcgctggcctataatgtcggccgcatcatctttaccagctcgacgtctgtttatggtgatggcacgggaaccatgcgcgagaattcgccgctgagtccggtaacgccgagcggcagagtgcttgaggagctggaaaactggttccatcgcctgcccaatacctcggtcgatgtgctgaggctcgcaggtttagtgggggccgatcgccatccgggaaggttccttgctggcaaaactgacgtgcagggcggggatgatggtgtgaatctggtgcatcaggatgatgtgattgaggccatcacgttgctgctcggtttgccaaaaggcgggcacacctacaacttatgcgcnccagtgcatacgcaaaagcgtcacttctatccggcctttgctcgccagctggggctgaccgaaccgcagtttgctgaagttgctgaaaatcagccgaagggcaagttaatcgacggcagtcttatctgcaaagagctgggttttgagtatcaataccctgatcctgaaatgatgcccgtgagttaattagctagttagctaatcaattgaataaaccctctcaatcaatagagggttttttttcggttagatataaagaccgccgatgaataacaggaaataaggtgaaaaantttcactgttaacgttttcagttcaacttttaattatttattgttcgatattgagctgcttttattaccaataaaatgacaaatgtgtgatggatattttaattattctttactgttgctgggtgaaataaatttctaacagccttaaaccgncttctgctagcgcttttnggccggtgaatnccatgccttatgttgtccgcgtaataaaattcctaagactagtctgagcatttcctcttcgatggcataaaactctttttaggtttgcccctaaagtttccgttccctgtgccgataccccagttgcccgcagatcgggccgcacacttcaccctgacttctgtatcctccctgagggcagaaggttttctgctgcaaaaattatttgttacacaccttgactttgtacacttataaagccgtacttactgacggtatccccacgcttattcctgaattaacctgaaaaaccttcctaaacagtacttcaacgaccattttttaaagaacaagctatttttaaagcaatctggattttttgctatcaaaagtcacttttgtgaatttttaggctaaaaatgatgcattaatcatgtttttgtatggttaatttggctttatttagatgttgtactaaatgatctaaaaatgaatgaaaaaacggggctgagaagggattttaagacgcatttttacttttggataaattttgagctgtttttttactcaaatcactctttttggataaaaataagttttatttttgtgacgcacatcacactttatccaaaattcgctgagggcgagattgtatgtgctaatgattcggggttacatttgcgtcgtattaagattaatcctaataatgtatgtaaaagcgtttcactgaatgacacgcaatcacagcaacggaccctgccgaaaagctacaactgataaattattaaatttaattagccgtgaaattgtcacatttatagtttacatcaggaactactttgtattggcggtgaatcataaaccgcgagataaacccgttttgtcctcgcaaacatttctttgaaaaaatgaaatgtgatgttcatcgtccaatggccaattgttttgatagtaaaaaaatactctgtcggacttaaaaaccaaacagtgattatatctatcaaccagttatgaattcatagctgacggtatggggtaaacaagcatgtcagaattgcttaaacatatttatgacatcaatctgtcatatttgctgttagcacagcggttaataaacgacgaaaaggcttccgcgatgttccgcttggggatcgacgatgtcatggctgatgcgttggggagccttactttgccgcaaatggtgaagttggctgaaacgaatcagttgctgtgtcagtttcgtttcgacgacagcaagacaattgaacgtctgacccaagagtcgcgagtggatgatcttcagcaaatccacacaggtatcctgttgtctagccatttgctgaaagggctttcagctaaagacagcagcgcctctaagaaaagggcataaccatgtcctcgataaaagcatcatcgacaccgaaagaggcttcggccaaacccgtcgagaaaagtattgttcaggaagcgcgggatattcagttagcgatggagttgatttcgctgggtgcccgtttacagatgctggaaagtgaaacgcagcttagccgtggtcggttaatcaaactctacaaagagctgcgtggtagccctccaccgaaagggatgttgccgttctccaccgactggttcatgacgtgggaacagaacattcactcctccatgttctacaacgcctacaccttcttgatgaagagtgggcattgcaatggcgttgaggcggttatcaaggcatatcgtctgtatctggagcagtgtccagagcagccgggtgaagcgccaattttggctctgactcgtgcatggacactggttcgattcgttgacagcggcatgctgcaactctcttcctgtaactgctgcgatggttcttttattacccatgcacaccagccacgtcacggttttgtgtgcagtctttgccaaccnccttcacgagcagtaaaaaaacgtaaactttccccggaagctgccgatagtacatctcaagagctggacgaaaaggtcaagcgcgcggtttgagatgatgtgggcagcatagtgcgaaaggtcacgtgatgctaaagagtggtgaaatgccactctttacaatacctccccaacatccccaatagttttgnttgtcngctgacaagacaaaanctcaattctctcttcaagcgcgcttcctctggtctggcctatacccaaaagccacatcgaattaaggaatcatcgtgctagtactcatcggttacatcgtggtcctgggctcagtttttggcggcttcatgctggttggcggcgagctgggcgcgctctatcagcccgcagaactgctgatcatcggcggcgccggtattggtgcgtttctggtcggcaacaacggcaaagccatcaaatcgacacttcgcgcactgccgaaactgttccgcgcatcgcgttacagcaaggcgctgtatatggatctgatggcgctgctctatcgcttactcgccaaatcgcgccagcaggggatgctgtcgctggaaaacgacatcgataatccgcaggaaagcgatattttcactaattatccgcgcattcttgccgataaacatttggtggaatttctcactgactatctgcgtctgatggtcagcggc

SEQ ID NO: 363 - DNA, 4000 bp, Escherichia coli
  misc_feature (121)..(121): n is a, c, g, or t
  misc_feature (1571)..(1571): n is a, c, g, or t
  misc_feature (1970)..(1970): n is a, c, g, or t
  misc_feature (1991)..(1991): n is a, c, g, or t
  misc_feature (2015)..(2015): n is a, c, g, or t
  misc_feature (3393)..(3393): n is a, c, g, or t
acttggatatgtcattctaccaggttgcttttcaaatgaagaagtaaataatcttcgcaaagccatgacaacagtctttaatgagaagactgaggctaacataattgaaaagtcttcgggngtagttcgtactgcaatgggtctacatcttcggagcaagatttttgatgatctcacgcggcaccctaatttttttgaacctgcgtgccagatacgtggtcataatctttatattcagcagacaaaaattaacgtcaaagctgcctttactggtgaagtttggcaatggcattacgattttgcaacccatttcggagaagatggagtgcccaaaccactggctttgaatttacatgtctttcttgatgatgttactgaattcaatggtccacttttcttcattcccaaatctcataaatatggttctgcaccatcaaaactggatactgtcactacgaattatccattatgggttgttgatcagcagactgtcaaagctattgtaaaagaaaatggaattatatcggctcgtgggaaagctggtacagttgtgatttttgtagataacttggtacatggttcagcacataatatgtcacccttggacagagcaattttttcagctattcttaatccgtgcgataatgctcaaaccaaatttgctcgaccagaatacaaacatgggcgagatttcaaacctattaagacttcatcttataaaagtctgttgatttgattatttatttaaaataggtataccttaaaagccttgggattcacatttaacaagcatttcgaaactagaggcgggataaataaaaaaattataaaattttcaaatcaaaaagaaaatttacagatccaccaattaagaaagtccagagaaaaaatataaaaatataataataagttcgcattgaacctaatataggaagactaaatgtttttatttagaccggatcttgttcaaagtttgatataaacaaaataaagaaagaaaaaatatttgaaaaatcaatcaacaaggaagttagaaaaagatcttttaaagctacatactaaagattttactgataaggataaactcacagttctacatcttatattggacggtaaaatagctgatgcaaaagatatgttgaaacctcaaggtgtacccgaaaaagaggtagacaatattattcaagaatacaaaaaaaataagaaaaaatttactaaaacatggagaagataaattaattgaatgtggcgcaaaaaaagaaaagaacatagaatttttgatagaataatgcttgcagtttttctattagttgcgttcgtttacatagtgaaatttcttatggggtttttttaaaaagaatagttaaaaattttatattaaattaagaggaccgctaatcatcacagtccagtagaggaaaataaaagcgtaaaaaaaaataattctcattttttacgccagccctaccactactgataagaatacaagaataagtgcccaggatatataagatttcggtgactttcgtagaggatatttagttgcagttctcattgagcgtctatgtagngagagattgtgtttaaaaattgtcggaggaaataaaagagaaagaattttttgtcgcagttaagaacctggtggtcggcgaattgtaaaccgattgagcacctgaatatgattgccaacacctcacctcgaaacttgaggcgggataaataaaaaaactatctctaagcgtgtttctgttttaaagaattattgtcctataaaatataggacacttatactagacttgtacctaggctccgtttagacattttgagaacaaagagaaggctaaccgataaccagatctagtttcttttttcccagtctttcatttccggaaggtgtaataaggtacgtttctcctaggttcatagccaattcgttctcgctatccattaagatcatgtgcatgaagaanaccatacctggttgcaaaacnactggatttccagtgtaaagcatnggccaatccatccagtttggagaaaaagttgttccaagagaatagccgcaggcattcattctagattttttatatcccaaacggtcaaaaacatcggcatgtacatcaaatacttcaccaactttatttccaggttttaatttattttcacagctttttaaagcttccacgcaagccgcatacatttttttttgcttgtcgtttacttttccaatcggtatcgttctgaacaaggcagagtggtagtgtttataagttcctgcccattctaaagaaagttgatcaatctcatctaattttcgtttttcactttgatagcgacaaagtagagcgttctttcccgatccaatgataaactcgttagcagggtaatctcctccacccttaaaaataacaccttgcatttcagccaatatttttgcctcatcttgcccagcgtgtgcatatttccatactgcttccatagcattgtctgcaagttccgctgccttttttacataaactatttcagtgggagatttagtaattcttaaataagaaattaattcagatttatcatgaagggatgcaaagttttctaatgaattatttaatcgaatggcattccttccagttaaaccatatgcttcatactcaacccccagattagatttctctaatcctaattctgataaaatattctttaattcatcagcaggattagcattatctttatccatccaaatccgaatatccttaataatggaagtattttgagcctgtcttaaatctggtgccctagttaataagattaaatctcctttagaagttaaaattaaagattgaaaatatacataaccaaatgtgtcgtatcccgttagccaatacatagactcttgtctgaacattaataaaccatccagattttctttctttagtttagcaataactttagattttctttctaagaattcttcttttgtaaaatgaatagccattaattttatttaattggtttatttttacccctcatgaaaactaaaactaagcatccatttttggtataagaagaatgggctgaaccaggttcaaaagttacaaaatctccttttttaagaactttattatcaggatcaattaactctccatctagcattagaaactcttcataatttgtatgttcatgagataagctcttagctccagggtccatttttaatacgtaagtaccttgtccggtttctttattgtaagtaatcttgtgccaactcattccaggaactaccgaaccataattatcaaatggttcaaattttacattaaaagggtttgttatttttcttttattcactcgacaaactgttttaggttgggttctaaataattaggtcctttcatnactttacctttttcattatgaataggttttccatccttacctaatttactcatgtttgctctttgaacttctttaaaacatttatctaaattaatcccgtaggcataaccagcgccataagttacatataaaatatcagttaaggcatccgcaatttcttttaaattttttgttttcattgcatgttctaactcatttaattcctcttttatcagatcaaatcgaagtagcatggttttgtcgtttggaaattgaggtttagttctaactatttgaccgaaagcttccataaatgtttttacgtcttcaaaattgctcatatttaaatcctcctttatttagcagtccaaccaccatccactaatatggatgttccagtgatcatagaagaggcatctgaagcaagaaaagcaacagcggttgcaacatcactgactttagcgatacgaccgagtggaatattattaattatttctcttttaaattttttgttattgaaaaactttttagtcattggtgtatcaacaaaagttggacaaaccgtgtttacacgaatattgttttttgctaaatcaacagccattccttttgttaaaccttctaagcc

SEQ ID NO: 364 - DNA, 4000 bp, Escherichia coli
  misc_feature (3860)..(3860): n is a, c, g, or t
  misc_feature (3955)..(3955): n is a, c, g, or t
  misc_feature (3969)..(3969): n is a, c, g, or t
aagggttttgagggtgttgccagatgccgtccttaactatttgacgaaagaagagtcgaattttgagggattcggtacggacgagcatcaaacttgcgcgaggagatttattttaagaaggagtaaagagatgacgacgacgaccggcaaagacagcattaactttacggtggaaggtgtggaagttgagcggccattcgtgagataccgcgggtgtaggagtgctacggctggatcgattacagaacgaaatgccgcgagcgagtcggtgtcgaacgcgtctttggagattacgagcgttcggccgttctcgatggcgttgaaacgtctcggcgacttaaaggttgcgtgccaacgcgcaaacgttcccattgagaatatggtgccatttttcactccgaagactggaaaaaagagaaaagctgccgaggcaatgaatggaatcgagaaagaagaagtatccgttttagacatttcttctacgccgctttccgtcatggctataccgcgactggagaagcaagccatagtgacttgtcttcgtcgcgagttgcctttatcacttggattctctagcgatgaagaatatttagaatcattcgcggcgtttcatcacttgagcatcgataaaggctcactcattgaccgaactgtcagaccagacgtacaagcgaagaaggagtattatggcttcagatacgccgatgtagtgtttgagaatacaacggaaagatgggtttatccgatcactttgttgcttaaacagaacggcgcaaccgaaatagctgcgagaaataccgaggaattctcgcaatcgttgatcgtgaagaactttgcggaaagtatcgagtctacgacgcatttgggcatctccgtctcgttttttcgagacgaagagaacggtgcaatagaacgagaggcgatggctaacgaacttgctaatagtgatgatattttggacgcaagtgcgaatcagatttctatagacccgctcttacaggcgctgcaaacgcactcgccgccgtttctcgggtttcgcttggccctggatgagtatatcgacccggttcttgaaaatactccaaacactagacgacgtttgcgaagagcgtcgtcgatttcagccggagcaaacttcaacgatgtcgtgcacgacttcagaggattgcctacgcaaagtacggtaccgttgacgcttgatttaaaccaaccgctcgcgattgatgagcaagatagaatggacgtggttcgggcgcaacaacgccactttctattgaatagcccggttcaagacgaggaagtagcgatggcgttcacaacgttggatgagaggaagacgaaggaagcaaagacgatagagaaagctacaacgataaaaacgccgccgccgcccaaagcacgcgtgccacacttttctaaaagtagcacgaagacgacgacaaagccgccaccaaagaagatgaaaagtgaagaaaaaaattcctcgacggagagattcgatgcaatatcggagattttgcgagacgcagaggagaaaactcttctgtcgaaaagtggaggatcgaaatacctcaccatagacgatttgctattcttcttggaatattctgatccaaacgtgggcgcagactgtcgcaaaaagattgggaggcgaaacggtttcggtcgagcagacgtgatgaaggtcgttctgcaactcgttaagaaaaccgcagcacgaagaacatttcgcggaaggaaggacagagttgcatgatgtgggtaccgttggtgctactatctgctgtactatattcgttattattagaaaagagaaacacaatcgcatacgttgtaatgctaataagagagacatacacacagacattttttctaaaacatcttagccgcgacatctttgacaaccgccgcgatcttgccttcatcctccgcgctcaacgcgccaattgaactcgcattgattgattctaccacgtctgcaatattaatttttgcttgcgcaatgcacgcgttggcaaattctagcatttttgctccgcttacgtcttctctctccgcgaaggaggttttcgtcatagcgtaaacgcctatgaacgattcagcaatcgatcgtacctcaccgggcgtttgtttcataaataacccgaccgcgtcggatttcgcgtttaactttctcttctcttcgccggacttgccgtacgcagacatgtcgtcggattgcatgagttgtaaacgaagctctaacgcgttgatttttttaaacgcttgcgcttgccccggcgcgccgatgcgactgacggacattttttgatcccaaatccatcctgtttcaggatcgaaatctttgataaacacttgcccgtctgtgatggacataaactcctcaaccaacggacgcggttgcgtgtacgcattttccggtgcgctcgtttgattgttgcgtttggcgtaattcgtagtgctcgacgcttgcgatgctgcttcgcctttctttttcaacccatccgcgagcttcttttgcaacgcttctggcatgttctcgaagtttgcaaccgtttctcgcgctttttgcatgtaatcaatcgatccttcaccatttaaagaaccggtatagtctttgtcgtacgcgccaattggatgcgtcatcgctcctaacaacgtgatcgacccaccccctaatttatcattcaatcgagctactctttgtaaagtcgttcctaaaaaccgtctgcgctccgccatggcggcgctcactaacattccttcaatctcttctttgttttcgtcggattcgtcgtctaattttgcatccggagcgagttcggccatttctcgcgcgaatcctgtcatcccgctaaaatcgtcgacacacaagagcgcgtcttggccgcttttacgcgcgccttccgcgatagcgaaagcggttaaagtagcgacgtatctttccgcaattgtggcatctttggaaactgtcactacagttgtcgatgtgttcgtattttcttcttctaaaacgttgagcgctctggcgatttcttgcgatttctctttactcgcacccaccgcggcgtacacgcaccgaacgttgctctttttttgcgcgctcacggacatctgtaaaaactcagaaactcccgtgttcggttcaccggaaacgagcaaacactgtcctcttccaatcggtgtcaaaacatccacggcggacgcgccggtaatcaaaggcgtcgtgattggtttcctcgcgtccactggcggtggatccgcgactaaattctcaccactttgttcgctcaaatacgcttccgagatggattgaaatccgctcgcgctcgttggcgcccccaacgcggaaacaattcttcctctcaaatccttctccggcggaatctgaaacgctttcgatttacttttcttgttctcctcgtccatcttctccacctccaacgcgtccccgactttaatctctgccacgttatccgaatccggcacgtgcaccgcgcccaacttcgtcgctaacatcgcgaacgatttcggctccctgtgacttaacaaaatcgccttcgcttgtaacccgggaaagcgcaacaccgatccgagttgcacgctcgaccgcaaaccttccaaaacgagcaaaccgcccggttgaatcgaagtcaccgttcccgtttgcccaatcgacgtttgcccgtccgtttcttctcgcgtggcgtcgataacttcctgtccttcaaacgcgtctaccccttcttcgccgccggcgaaggcacccgcggaggaggagaaggcacccgcggaggaagaggaggcggtttttgaaaacacgccgatcgtattcgcgttcctctcgtcgttcttcccgntctttatgtcgtcctctgtttctcttccggttgcctttgcagaaaaagacttcgacgaatgaagcgaagtgcgcgaagaaaaggaagacaaagangcgtatcttccacntccgccgccgcctttccctgcgcttctctgc

SEQ ID NO: 365 - DNA, 4000 bp, Escherichia coli
  misc_feature (61)..(61): n is a, c, g, or t
  misc_feature (75)..(75): n is a, c, g, or t
  misc_feature (243)..(243): n is a, c, g, or t
  misc_feature (267)..(267): n is a, c, g, or t
  misc_feature (291)..(292): n is a, c, g, or t
  misc_feature (329)..(329): n is a, c, g, or t
  misc_feature (448)..(449): n is a, c, g, or t
  misc_feature (459)..(459): n is a, c, g, or t
  misc_feature (465)..(465): n is a, c, g, or t
  misc_feature (512)..(512): n is a, c, g, or t
  misc_feature (528)..(528): n is a, c, g, or t
  misc_feature (570)..(570): n is a, c, g, or t
  misc_feature (573)..(573): n is a, c, g, or t
  misc_feature (578)..(578): n is a, c, g, or t
  misc_feature (580)..(580): n is a, c, g, or t
  misc_feature (716)..(716): n is a, c, g, or t
  misc_feature (973)..(973): n is a, c, g, or t
  misc_feature (1538)..(1538): n is a, c, g, or t
  misc_feature (1985)..(1985): n is a, c, g, or t
  misc_feature (1991)..(1991): n is a, c, g, or t
  misc_feature (2479)..(2479): n is a, c, g, or t
  misc_feature (2485)..(2485): n is a, c, g, or t
atgccttttgaacctgctccggaagtggattgataggtagaaaccaccactcgtttaatanttgcggcctgatgnagagggttgagcgcaaccaccatttggattgtggagcaatttggattagaaattatgcctttgtgtttgaacaccatttgcgggttgatttccggaacaacaagcggtacatccggatgtaatcggaaagcactgctgttgtcaatcaccactgtaccggcatcaacngcatgaggtacaaattctttgctncgcccttttccagcagaaaaaaannccaaatctactccttgaaaagattttgtcgtcagttnttcaacagtgatttgttcaccacaaaactcaagtttctttccaacggaacgttcggaagcaagcagttttaaattgttaataggaaatttacggagttccaaaagtttaagaaattccnnaccaacagcnccggtngcaccggcaatcgcaacatttttcaaatttatttttttgtgaaaggnatattaaaatattttnttattactaattgataatgagtgtccactgaattctgtatanatnaatantnacagaatcaagggggcatcagttcagaagttttcaggttcctgctgacttataatgttttcggcaaactgaaacatagctgtcgtttccgccgatctgtatttgctcaccggactttaacggctctccattctcancaagacgaagtaccatgttcgcttttttaccacagtgacagatagtctttatttccaccagttcgtctgcccacgccagtaaatgcagacttccttcaaaaagctctcccttaaaatcagtacgcaaaccataggccagtacagggatcccaagtttatcaacaatctctcctaatgcataaacctgggtttttgtcaaaaattgagcttcatcaagcaaaacacagctcaaaggagtttttttgtcaattttctcngtcagagcaagtaaatcatcttctgactcaaaactggctgcatccgactccagtccaattcgtgaacgtaccctgtcggggttataacgatcatcaacttttggcttaagtaccagtgttttcattccacgctcacgataattatatgctgactgaaggagtgtcgtggtttttcctgcattcattgcagaataataaaaatacagcttggccatctgtgtcagagaaaaaaatgatggtcacaaaaaacaccattcttttctttggacgaatggtagaaaaatctatgagctaagtataattcttctggaaaatataaaagtggtaattttagcaacaaataagaaaataataaaggaagaaattacatgaaagcattgtggaaggggcaaggcacacttgttgctcatatttattaagccccggagagtggctccgccacttgaatccttttacaaattcatgaatttaaatcctgagcctagcatgacctgggatttgctccatattcactccggggtgtagcctcaaaagatacagactccccaaacatatttcaagcagnaattataaaaaaaaatatttttttgaaatattttttttcagacttgaagactattttttttagttcatcccatacctctgatttatttatttttatttcttttttggattttattacaaaaaaagtaagaaacaaaaaaaaataaatttcataattattttcacgaaaaacatttttatctttgtaaaaaatttcacttgaagttttgttagcactctagtatagtgagtgctaaaaggattttattcgaaaaaataaaggttattatggacacccaaaaatttacagaaaaatcgctgtctgccttggaaaatgcacacaacgatgcagttcgtcgtaaaaactccgagttgtccacagtccatcttttgagttccttaacttttcaggaaaatggtttagttcccaggattttcgaaaaaatggagatcgattctgaaaaatttncacagncactggaatcatctttgaagtctttaccgactcttagcgggagttcagcaggaagagtgggcgctagcggtgaaatgaatcaggccttggtgcgagccgaagatgaagcaaaaaaactgcaggacgaatatgtaagtgttgaacatcttttgctggcattgaccgaggagggacgtaagggtcctgcaggaaaaatattggctgagaatggagttacccgtgaacgtttaatgggtacaattcaggatgtacgtggaggacagagagtgacaagtcagaatcctgaggaaacatacgaggcacttgaaaaatatgggacagatctgagtcagcgtgcacgtgatggaaagctggatcctgtgatcggtcgggacgatgaaattcgtagagtgatacaggtactttcgcgtcgcacaaaaaacaatccggttctgattggagagccgggtgtaggcaaaactgcaatagccgaaggtttagcacagcgnattgtncgaaatgatgtgccggacagtttaaaaaataaaaagctggtttcgcttgatatgggtgccctgattgccggagcgaaatatcgaggtgaatttgaagagcgtcttaaagcagtcctcaaggaagttgtagattcagatggacaaataatgcttttcattgatgaactgcatacagttgtcggtgcgggaaaaactgaaggttctatggacgcaggaaatttgcttaaaccaatgctggctcgcggcgaactgcattgtattggtgccactactctggatgaataccgaaaacatatcgaaaaagaccctgcactcgagcggcgttttcagcaggttttggtggatcagcccacagttgaggatacgatttcgattttacggggcttaaaggaacgttacgaaatacatcatggtgttcgtataaaagatgcatctttgattgccgccgcaacgctttctcaacgctatatttcggatcgctttcttccggataaagccatcgatttgatggatgaagcggcagcgcgtttaagagtagaaataaattccatgcctgctgaaatggatgaaatatcacggcgaatactgcaattgcaaatcgaaaaagaagcactgaaaaaagaaaatgatactgcttccaaagagaggctgaaaaaactgtctaaagagttggcagagttgcagcacagctttgacaatttgactctgcaatgggaaaaagaaaaatctgctttacaggatatgagtgaattgaagcaggaaatagaagaagtgcgtctgcaaattgaacgtgcacggcaggactataatttggaagaggcagcacgtttggaatatggtgaacttccggaactggaaaaaaggctgaaaaccacacaatctgaagaacaaagcggcaagaatcaactactcaaggaagaagtagatgcagaggacattgccgaaattgtaggacactggaccggaattcctgtgcagaaactgattgaaggagaaggcgaaaaattgttgcgacttccggaacagctgcatcaacgagtggttggacaggatgaggcgattgatcttgtttcggatgcagtaatgcgggcacgctccggaatcaatgatccaaacaagccgcttggaagttttatatttttgggcccaacaggtgtaggcaaaacagaattggcacgggctttggcagaaaatttatttgatgatgagcagaacatgatccgcattgacatgagtgaatacatggaaaaacatgcggtttcccgtttaattggtgcacctcccggatacgttggctttgacgatggtggacaactcactgaagcagtacgaagaaaaccttacagcgttttgttgttcgatgaaattgaaaaggctcactttgatgtttttaatgttttgctgcaaattcttgatgacggaagacttactgactcacacggacgtaccgttgatttcaaaaacacactggtaatcatgacttcgaatattggcagtcaaaaattgatcaaccaa

SEQ ID NO: 366 - DNA, 4000 bp, Escherichia coli
  misc_feature (29)..(29): n is a, c, g, or t
  misc_feature (84)..(84): n is a, c, g, or t
  misc_feature (93)..(93): n is a, c, g, or t
  misc_feature (132)..(132): n is a, c, g, or t
  misc_feature (225)..(225): n is a, c, g, or t
  misc_feature (255)..(255): n is a, c, g, or t
  misc_feature (297)..(297): n is a, c, g, or t
  misc_feature (432)..(432): n is a, c, g, or t
  misc_feature (464)..(464): n is a, c, g, or t
cactatgccatccatacccctatacaacntgacatgcgtttctaccagaagtacctggacaaaggccttcctccggtagaagcngcctatgcnactctcattgagggtatggacaaaagtctgggagacatnatggattatctggacaagaacaacctgacggaaaacactatcctcatcttcatgtccgacaatggcggtttggcggcccatacccgcgccggncaactgcatgtccagaactatccgctcaanagtggtaaaggttccgcctacgaaggaggcatacgtgaaccnatgattgtccgctggccgggcatcgtagcgccccaaacccaatgcgaccattacctgatgatagaggacttcttccccaccatccttgagatggcaggcgtagacaactatacaaccgtacagcaacgcgacggnatcagtttcatgccattgctcaccggaaaagntaaaatgaaagaccgtgatatctactggcattatcccaatagctggggtccttccggcccgggcatcggagccacttgctccatccgttcgggcgagtggaagctggtgtattatttcggtgacggtagacgggaacttttcaacatccccgccgacatcagtgaaaaacatgatatggcccgagagaagcctgaagttgtcaaagagttgtcacggaaattaagtaattacctccggtctgtggatgcgcagcgccctctgttgcgtgccacccgccaaccagctccctggccggacgaaatatagaaaaaagtatgaaacgaaacctttccctcctccttgtgtccctgctttttgcagggacagctcttgcccaagaacataatccgggcagcgtacagccggatacgattcagaaatcctccgagaaatctttccggaaacaacgctctccacgaacagaccatggcccggtaggtatcaatatctccttatggaaaaacatctccacacagcggactgataccataggaagcacctgcttcaatctgggtgtgttctcctccatgaaccgtctgaatggcctcggcatgaatattcttggcagtgtaaccggcagggatgtgaacggtgtacagatggcaggtctgtcaaatatggtggggggaagcatgcgaggcatgcagatagcaggaattaccaacatcaatggcaacaaccttatcggagtatccgtttcgggactggtaggtatcaccggaaaccatgcgcaaggcgtcatcatttccggtctggcaaacatcagtggggactataatcgtggcgcctccataggcggcctgttgaatatcagcggagaaggtgcttccggcatacactttgccggactcgccaatatttccggtggaaatttcaaaggattttcaggggccggcctgctaagtgtaatcggtgaagacttgaatggcatgcagatgtccgcccttaccaacatcaccgccggagatatgaccggtgttcaggtttccggcctgggcaatgtggtgggtggtacagcccgaggattacaaataggcgctgccaatatggccatacgtgccaaagggcttcaaataggtctattcaactactacaaagaaaaattagatggtttccagttgggattagtcaatgccaatccccaaacaaaagttcaactgatgtttttcggtggtaatgccaccaagctgaatgtaggtgcccgtttcaagaaccggctcttctataccatcctcggtggcggtacccattatctggattttggcgataagttttccgctgccctcttctaccgtgccggtcttgaattaccgctctacaaacagctgttcatcagcggagatctgggataccaacatatagaaaccttcaagaacaaggactacggcattccggcacgtctctatgccctccaggcacgtgtcaatctggaataccacctgaccgagcgctttggcatattcctcaccggcggttatggcggcagccgctactacacccaagggaaaacctatgacaaaggcatcattgtagagggcggggtgacgatactgaaattataaattattgtttctccttaatcagccccgtcctatacgccaccagcagtttcatcaaatcctgaatctgcgtaacgagttcacttcctttatccgtatccttcaccatcatacgctgcgaattgaattcgacaaccagggttgtagacttgatgtcttgtccttcttcaatggctttctgacggctctggaacggctcatgctgcaccaactgcaagccgtgggaatgatataccagcgtatatcccgcaattcccgtttccggctgataggcttttgaaaaaccaccgtcaatcaccagcagcttaccatccgctttgatgggtttctcacctttaatggtctttaccggtacatgtccgttgatgatatgcgaatgtggccccggcttcacgccgaactcttcaagaatgcggtcacacacctcagcctcgttgcgcaaagcatagtaatgccctttcgtctccttatgcaatgttttgtcggccacaaaatagcgttcaaaggtagccatcttgtctttatcgaaggaaggggcatccggtccgcaccacatgtaccagacataatccagtgcaaactgtttctcgtccgaaccgtcctcgtcaaagtaagcggtacgtatcagctggtcggtctttttcagcaacttacgtccccagtattccttttggccgatgcggacatgtttaaaactgccgtccgcattcagaggcacggaagcatgataaagcaggttactgttgcacaccagatacatgccgccatacgtaaacaagcagcgcatgtgcttcttcatcttctcgctgttcatgaaagaagaatgaatccggtgcatcagttcgcgctcttcgtccgacagacgatacgggtccgccgggtctacggtggggaaattcacatcgcgcaacggatattccttgccttcgtatacaaacacaccacgctcgaaatccaccagatgcagcagtttccggttctccataccgaactcaggacggcggctgatgatttccgcctccagtttcaactggataaccgtaatcgccttgtgcatctgtgtaatcagccgcaaggtcttctcattgtattccgcatcggcaaagttcattttcggcgcaaagatggtgcaagggtcatccgcataggtatccatggcaaacgttgcaagcggcaacagattgatgccataaccatcctccagcgttgctaaattggcatagcgcatcgacatacggattacgttggctatacaagcatcattacccgatgcggcacccatccacagaatatcgtggttaccccattggatgtcgaaattatgataatcacagagagtatccatgataatatgcgcacccggtccgcggtcgtatatatcgcccacgatatgcagcgagtcgatggtcaagcgctggataaggttgcacatcgccacaataaaatcatccgcacgcttcgtagagataatggtactgattatgacattgatataggcatgcttgttaggttcgatgctcgattcgtgcaacagctcttgaatgatatacgagaactctgctggaagtgccttgcgtactttcgaacgggtatatttggacgaaacgttctggcatacttttaccaactggttcagtgttatcaaataccagtcatccaggtccgtttcctgctccttgataagttgcagcttctcttccggataataaattaacgtacagatttccttcttctcactttcgcgcagtgtatgcccgaatatttcgttcaccttacgtttcactgcccccgatgcattcttcagcacatgctgaaaagcctcatactcgccatgaatatccgtcagaaaatgctctgtacctttcggcagattcagaatggcctccagattgatgatttctgtactggcatcagcaatggtaggaaaactgcgtgat

SEQ ID NO: 367 - DNA, 4000 bp, Escherichia coli
  misc_feature (1)..(5): n is a, c, g, or t
  misc_feature (7)..(10): n is a, c, g, or t
  misc_feature (12)..(13): n is a, c, g, or t
  misc_feature (15)..(17): n is a, c, g, or t
  misc_feature (19)..(21): n is a, c, g, or t
  misc_feature (23)..(25): n is a, c, g, or t
  misc_feature (27)..(32): n is a, c, g, or t
  misc_feature (34)..(35): n is a, c, g, or t
  misc_feature (37)..(40): n is a, c, g, or t
  misc_feature (42)..(43): n is a, c, g, or t
  misc_feature (45)..(45): n is a, c, g, or t
  misc_feature (47)..(50): n is a, c, g, or t
  misc_feature (52)..(52): n is a, c, g, or t
  misc_feature (54)..(60): n is a, c, g, or t
  misc_feature (62)..(84): n is a, c, g, or t
  misc_feature (86)..(95): n is a, c, g, or t
  misc_feature (97)..(100): n is a, c, g, or t
  misc_feature (102)..(104): n is a, c, g, or t
  misc_feature (106)..(106): n is a, c, g, or t
  misc_feature (108)..(111): n is a, c, g, or t
  misc_feature (113)..(115): n is a, c, g, or t
  misc_feature (117)..(120): n is a, c, g, or t
  misc_feature (122)..(130): n is a, c, g, or t
  misc_feature (132)..(137): n is a, c, g, or t
  misc_feature (139)..(139): n is a, c, g, or t
  misc_feature (141)..(143): n is a, c, g, or t
  misc_feature (145)..(151): n is a, c, g, or t
  misc_feature (154)..(154): n is a, c, g, or t
  misc_feature (191)..(192): n is a, c, g, or t
  misc_feature (255)..(255): n is a, c, g, or t
  misc_feature (300)..(300): n is a, c, g, or t
  misc_feature (1979)..(1979): n is a, c, g, or t
  misc_feature (1983)..(1983): n is a, c, g, or t
  misc_feature (1987)..(1987): n is a, c, g, or t
  misc_feature (1991)..(1991): n is a, c, g, or t
  misc_feature (1995)..(1995): n is a, c, g, or t
  misc_feature (3449)..(3449): n is a, c, g, or t
nnnnncnnnngnncnnntnnntnnnannnnnncnngnnnngnnangnnnngntnnnnnnnannnnnnnnnnnnnnnnnnnnnnngnnnnnnnnnngnnnngnnngngnnnngnnngnnnngnnnnnnnnntnnnnnngncnnngnnnnnnnggngcgcgcgttcggcgaagcgagagtgcaaacgttcgcnnttggtccgagacacggcgtcttcgtcactgattcgggaaacgcgcacgctttcggttggaacntgtatggctcgtgtgggctcggcgatactttcggtgatttcgtcnccaagccgacggtaattgagagcttgagacgcgtcgacgtgcgcgtcgattcggtggcgtgcggcgacgcgttcacacttctcctctcgacagacggctatctgtacgccaccggctccaactcggacggccaactcggcgtgcacgaatcagacgtctcacgaggcgcgtcgactcgaacgccgacgctcgtggaaccaccgaacgggatcgacgcctttgtatccgttcgatgcggccctcgacacgcttcggcgctcgccgacgacggcgccgtctacctctggggatccaacgaccacgctcagctcaccggctggaacgaacacggaaatggcgcagacgacatcgtcgttaccctacatcccccgttcacgagagccgcgccagctgtcggccgacgcgtcgtccatcacgtatgtggccgagcgcactgttcaattttcatcgacgaagtcgatttatgatccttcacaacaccggtgaccttgtagataatttgagcatttcattccattcgcagttcgtcctttccgaataccgcgcatccctcccgtcgcgttctctttcgcgttcgcgcgctcataatggctaagccctagtcgctagggtttatatctatgagagttgtatctctgcgaggatttgtgcgagtgcccaccgcccgtcacacgctggcgcgtcgcgaccacttggcacgttcgaccgcgagagccgatgcgcgcgcacgcgatgaccaaatctgcgtcttcgcgcgcgcatgctccgacgcgcggcgcgagagagcgccgcgcgagcacgagcggacgcgataagatgacgtcgtcctgtggtggatcggtcgtctcgcgtcgacgacgcgaaacccgagcgagggcgacggtgacgggcgaaaagaaaatagagaacgatgcggagacgccgagttgggcgacagaaatgtcgacgcgggtgatgagcgggattttggcgacggcattggcggcgacgtgcgcgacggagcccgcgttggcggcttcggagtcgacgaggttgtccatcagagaagagattcgtcgcgaggagcgcgccgtggtggatgaggtgattcgcgacgaacagattggactcgaggcgatccgtgagggcgcgacggcgggtgaacgtctggatatgtttttggaaaaagagcccccggtggcgatcttcttcaccgccatgctcctcgtaaacggatcctttggtctcatttacaccctcttcgtccgcgaaaccgacgccgggccgggcggggagttcggcaaaggcatcgtcgcccttcgcaaggaggttgtcaagggcatattcgcctttttcaactccgccttgggtagatacaccacgcgcgacggcgagtcttcgtagttcgctcgccgctcaaccgcacctcgatgtaacattaatctcagcgccatcgcttccccggtatcaatcatcacatttttccctctttcatttgtatacctttcccgcgctctccgtcgcatcgtcccagatcgcgcgctgcgcgttccttggagagcctctttcgttcgctcggctgcgacgacgactgagagtaacactaaaaacgcgaacacccacgcgaatggagcttgaagtccatcttcactcttcgtcgcgtcgcgaacgaccggcggaaaccgcgagcgaacgaacgnacgnacgnacgnacgnacgtggagacacctcaccgacgatgcacaccgaacgcgacggactcctcggcgcgtcggcgtcgtcggcgtcaccgaatccatcggctgcggatgaatactttgacgcggaaccgcgcgcgcgtcgagcgcgtacccgcgcgatggcgttcgtcgcgctcggcgcgttggcgacgatgtgcgtcggtgcggcgatgacggatgatatgcttcgacacacgcgacggattcggggagacggggaggttgggaccgacgcgaggcgaacgccgcgtttgggcggattgccacaggtgacgccggcgccgccgtggaagggatactcgaatggtgggatggtcgcgacagagtttatggcgatgaatgatctggaccaggtgccgatgacggaggaagaggtagacgcagccaagtacgtgacgccgttgggtgtgaatggttttgaagcgtcgaggtatttggacggggagaataagacgagacgcaagttagagacgccgatgatgatcatagcgttggacgcgagcgtgaaggatcaaaagaaggctctcgatctcaaggcatcgattgaaagatcgtaccggctcgagccgactcagagtttggtgacgctcgagagcgcaacctatcccgcaaggtggccagagactatcgaactcgcggatgaagccgtcgaagagttgaccaagttgcggccgtacggggcgctgtactacattcaaagccttcacagcgcgcacaaaaacaacgacacgcttcctcgcgccgcgatgggagtgtcgcatcacattgggtgcttgttttctcacatgcgcatgtggcggttacacgccaagagacacaaccaatggtccttcatctttgagagcgacggcggatggtggctcggtgcgcctccgaagcatcttcagagcatcgtcgaccacgcgccgcatcgcgcggatctcatctttaccaagagaggtttcgtcaactctggtcagtttgtcaagcagtggaaatcgggcgaagacatgatgtacatgtaccgcgtcaaccggatgatcggcggcgcgggtttatcgagctacctcatcggcccgaatttcgtcgataaaatttacgagcaaatcgtcttccaccgcggggcagacatggtagacgcttggttgatgctccgcatgtgcagcacgaaggatgagcgatacacgacgtacaagagccggatcaactgcttccacgccgagtcaaagttgaaacccgcgcgacaagtcggcggttatcttccggaatggtacggcatcgatgagaccccgcgcgatacggataactggaacgagtggctcaagtacgagcgcaacggaacggcgtactacgagcgagcgagcgagcgaatggctgcgtggaacgccgcgcaagaggaaaagcgggcgctcaaggctcaactggcgacggagctcggcgaacccgcgcccnaattgggacgcgagcagaccgtcagggagcgacgccgacgcgcgcgagcgctcaacagacaaatccgcgccaacgctcgaggccagcaaccagcggcgcgcgaatagatcacacatcagagacttttttgattgtagtttttacaccaggtacacacgcgttgggagtttgacatcacatcacccgttctccaaccgctctctcctgacctcaactgaggaaaacgcgcgcgcgcctcacaacgcgaccgacgcgtcggatcggccgacccatcgcgcgcgtgcatcgacgcgagaggaaacaagacgtttgccgacgcgtgaagagccgcgcgtgaagacgaagaaccgacgacgacaaagggaaggatggatgacgagatcaagtttttgagaagaccggtggacacgctgcgcctcggactcgccgcggcgcgtgaggttggaacgtcgaagacgaaacacccggtgcaagcgatgcaagaggaggtgcgtgaaaagacggagcgacgacggcggcgactacgatcacggaacggcgatgcgcgcatc

SEQ ID NO: 368 - DNA, 4000 bp, Escherichia coli
  misc_feature (4)..(4): n is a, c, g, or t
  misc_feature (94)..(94): n is a, c, g, or t
  misc_feature (154)..(154): n is a, c, g, or t
  misc_feature (1012)..(1012): n is a, c, g, or t
  misc_feature (1052)..(1052): n is a, c, g, or t
  misc_feature (1198)..(1198): n is a, c, g, or t
  misc_feature (1203)..(1203): n is a, c, g, or t
  misc_feature (1358)..(1358): n is a, c, g, or t
  misc_feature (1450)..(1450): n is a, c, g, or t
  misc_feature (3337)..(3337): n is a, c, g, or t
  misc_feature (3356)..(3356): n is a, c, g, or t
  misc_feature (3482)..(3482): n is a, c, g, or t
  misc_feature (3608)..(3608): n is a, c, g, or t
ggtngcgcctttcatgggccctttcatagctccagcaccgcaacctgtgcaaatattaaattcacgcaaacccaactgataacctacttttttngtatattgatattcggtttcacctattgaatgtccaccccagcaaactactaaatttggntccgtcaagtctctctgtaatcctgtattacgtaaaatatgaaagacaaaatcagtgattgaagacgattgatttaaatcaaaacctcctttttttgaaagttctgtaccaacaaacacaatatcacgcagcaccgaaaacagatgttcattgatgccctgaatcaactttccatccacaaatgctttgggcggtgcattgcggatttcaagcttgatgctgcgagtctgctgtacaacttcaatgctgaaatcggggaaactttcgaacatttcttttccgctgtcagtgtgactgtcactgttcagcacagcgagggcacagcgtcggaacagttcattcagtcctccgttttgaggatcactgagttggcgaatttcttgttgtgaaaggaaatctaggataccttttggacgaatactggcatccataatttacaggctgggaaaaaggtttgaaataaagaaatgaaaagcttagtttagcggcaggaaagagtttttaagaggcacaagaagattagttcatggctttaattgctggattcctgattttttgatgagttgaggaattatttttagtgccctctgctcaccgatttgtatttacggactgaccagtccgtttaacaacttgctcaattgaactgactgcttgctggtgcagaggcagatggcactcccgcagatgcgccgccaactgcaaacgaactgatgccacgttttgtttcacgactgccgcattccggacagtcaatttgtgaatccatttcagaaaaccgacgaagttctgtaaatccacttgtgcattgctgacactggtattcataaagaggcatttttctcctgcattaaatanttgaaaaatcagtgttttagtctatcatgttttatgttgnaaatcaatcagttttagtactgtgctagattgtcgctgaaatttcttgagacttttttgaattaactgatgagagacattttaatgatataataatatactgaaacagaaataattcaggctaaatagtaaacaaactaatgtaantgaanttaaatcactgtttgagaaatccgcaaaataatcattattacaagcagggatactaaatattatcttgtattttaagacaggattaccatagaatcaaacgttccaacaatagccaataaacgtatttttaggctgttttaatcaaagtacttantcagagaataattatgaagttcattaaagtatctttagcaattttcatttcacttttattgtttagccaaacaggcagcgcccaagagtctnctgccgaaaacacgaagcagagttcaacaggaaccgaggatgtcactggggattttgtttttcacaaggtgtctgcaggagataacaaaaaagtatttcgcgatgctgtgacaggacacattgtcagtaacaaagggatacagaatttttatgctgtgcctgcagttgaaaccaaatggctaggcacaataattaattctgaaatcgaatggcataaacaactgcagaaacttgaacagacataccgtaaaacatttcagagacgtgctgagctaaaatccggccaaagcgatcgtgcagtacgtataggaaactacagcttgaatatttctaaacttgaaaaagagattgctgaaatacgtcggcaaattgtccagattaacgttgatcagcaggtttatattaacagtcttcgcaaaacgccgatcacgactctagttgctatcaaaacgctttatacgcctgatttaatgagcagcaaggacaaacttgatgtgcttaacagcgcaattttcaacagtatggaagaaccggtgttgggccatataagctcgacttacggaaacagtatcaccattccatttcaatccggacatattcgcgtgacctacatgtatccggaaaatatcacgtattttgattctgaagcaaatgaacatgtctatctgtttttgcgcgtggaagcctaccctttttcaacaggcgcttcaaacgatggaactgttgaggacagaggagtaggagtagaaatcctttcaaatattaagcaaatccagtcttacctcaacacaaaagaagttggtgataaacgtttaatggactggctgatcaaagaatatagcaatcaaaaactcaacaatgatcatctgttgaacttgatcacaggcaagttaggtgatttcaaaatgttccgcaatggtctaaagcagagtatttcagagctacgttcaaaagtaaaaattatcgttgctcaaagggattcgcttgttggcagtggagacgcggaaattatcgaagctgaatacaaacaagcaaaaaatctttatcatcaattctatgcaacaagaaatgtactgactcaggagaagtatactcttgaaaacgatgtgatgttcagtttcttccacatggaaggtgaatcaactaagaaaaacgctaacactgaacaaaaacaaatgctggattcaaatgttgcatcaaatattcctatcagcggcagaccactgaaagatatttttactgatatcctgattactgcaaatcaaaaaaggaaacttaatctgcagaactatcgtgaaagaatttaccgtgcaaacgaagaacagacacagctcattcagggtgcattagagtgggaagtgaaaagtgaagaattcagcattttgaaacttactcgtggaaatgtaggttcaagaagccattttgtactgcatcttgcaaaacgcagcagtctaatttccaagcctggctttcctgcaccaaaaagcggtgtctgcaagtcaacactcttgtttaaacgtggaaaaaatgcgatgcgtaactcttcaaaacctgcattggataaactcgcaaaatgcctgcgtaaatacccaaaacaaatgatccagattactggtcatactgacccactcaaaccggattatggcgaaggttcaaaattcagtaatgttactttaggcttaaaacgcgctgaggcggtcatggactctttaattgcgctggacttcaaccctggccgtttcattgtagtcagcaggggagcaaaggatcctgttgccattggaagagaaaagaaagacctcgagaaaaaccgaagagttgaaattatctcaacaccaaaggaataatccgatccttaattaaactaacagctttaacggatttgcnggtagagtttcaggaactnctcaacaaagtaagtggcgaacttctcagtgtacgctgagtggcaagccatgctaccccaacgcttaaagctgtaactccgataatgctgcctaaacttgtctgccaagtccatttccagagattntcaaaaaaccaccaggaaattccgtaagacattattaagctgaaagccaccccgaacaagcctgcaaaaatacccagcaccgcaaattcaatttgtatcatcttctggatgtcggaaaatctggcnccaagtaccttaagcagattcagctcccagagtcgtccctcaacttcgtgacgtgcaattgaaaagacaaccaccaggcctgccagaattgagagataggccatcagcctgagcgccaaaaccatttgatcagaaattttcaagactcgcccaaccatgcgtgtcacatcaatcacggaaacatttggataatcactgacaatccggttttgcacattcagccggagtgatgcgtcaagaccgcctattgagcctaaaaatgttccgggggcatcttctaaaactccgggttgaaaaagaatgaaaaaattcggttgaaaactattccactgtacccggcgcaggttgatgacgatggcctcgaccaaaacttcctgcacattaaaggtcaa

SEQ ID NO: 369 - DNA, 4000 bp, Escherichia coli
  misc_feature (791)..(791): n is a, c, g, or t
  misc_feature (1157)..(1157): n is a, c, g, or t
  misc_feature (1523)..(1523): n is a, c, g, or t
  misc_feature (1529)..(1529): n is a, c, g, or t
  misc_feature (1857)..(1857): n is a, c, g, or t
  misc_feature (3574)..(3574): n is a, c, g, or t
  misc_feature (3697)..(3697): n is a, c, g, or t
ctggtttattcgttctgcatgaagggcataaaattgaaattaaagataattccatgcgcgaatggaaagagattcgcttggaagatggtaaggtagggtggattcctgcttctgcgatagaagtgatttaagagtatccattgctaaatatagaagcccgtatgaaataaaggaaactatttccttttacttcatacgggttctttttgtatttatgagaatgttaaacatataatggaaaaatacagataaatagtttgttttatctttttttttccttaagtttatagcgtgataaagaaataacaaagtattaaccattaaatttatgaatatgagaacgataacatttaatgaactccgtaagattaaagactcattacctagtggtagtatgcatagaatagccgatgaacttggacttaatgttgacactgtaagaaatttctttggcggtcataactttaaggagggtaaaagtgttggaattcacttagaacccggtccggatggcggtttagtaatgattgatgatactaccgttcttgatcgggctttaaaaattttagatgaaatggcaggtgaaactgctgaacctgttcaggcttaagaaaagaaagtaaagaaggatcccaattgctgagaaacaattgggatttcttgtttgttttgtaaataaatataatagacgacttatggaagataaattagtaacattagcgattcttacgtatgctaaggcacaaatactaaagaatgttctcgaaaatgaaggtattgagacttacatncataatgtaaatcaaatacagccggttgtatcttccggtgtgcgtgttcgtataaaagaaagcgacttaccgcatgctttgaaaattacggaaagctcggcatggttgtccgaagaagtagtgggagagaagatgccccaaatagagaaaggcagtaataaggtcttgattcctgtcgatttttcaagttattcattgaaagcatgtgagttcggttttaattttgcaaaaaacatagatgctgaagtagttttgcttcatgtatattttacacctatctatgcgacttcattgccatacggtgatgtttttaactatcagttgagtgatgaagagaatgtccggaatatattgcagaaagtacantcggatttgaatgctttgtccgataaagtaaaagctaaagttacatccggagagtttcctgatataaaatacacttgcgtattgagagaaggcattccagaagaagagatattacgctattctaaagaaaatcgtccgagaattatcatcatgggaacgcgtggtaagaatcagaaagatattgatttgattggtagtgtaaccgctgaagttatcgagcgtagtcgcgtaccggttttagccattccggagaatacaccgttcaaagaatttaacgctgtaaaacgtattgcatttattacgaattttgaccagcgcgacttgatagcttttgattcattaatcaatagtttaaagccattttgnttctcngtttctttaatacacttagctgatgtaaaagacacttggaatgagataaagttgggtggcattaaagagtatttccaaaaacagtatccgcaattggaaattcattatgatgtagtgaagaatgatgacttccttaatagcttggatgaatatattaaaactaatcacatagatattattacattgacatcatataagcgaaatatattttctcgtttgtttaatccaggaattgccagaaaaatgattttccattctgatacaccattgctggttatctatgggcggcctaattgaaatgataattttaatctgtctaggtaaggangtgggctaccgctaaatgctgaattagttttagtggagtccacttattttttatcttttcatggttatactattacatgtcccatttcctatgtttgtgatgtaatatcaatattatgtttaatatataacaccataaactaaaataaacctttatccttctctaatttggaagaaaattataccaaagatagcttacatattcaagctatctttggtatagtagcaattcaattattgcatcaatttttctatttcatcaaattcaggacccatttgtaagttataataaactctgtataatccatttagccacaaatctttctgttcaggtttcagttctcttgctttttcataattaggtcttgccttttcatagaaaactttcagtgtagcttggtcttctttgtattttggattattgacatcagtagtagctttttcagagaaatcctgagcttgcaggcaatagattaagcccaagttggaatatgcttctgcatagttaggatctacttcaatggttttgttgtagaattcaatggctttttcataatctttcatgttatgataaaggtatccttttacgtacaaatagaatgtgttattaggatctttagccaacatatcatctgcaaactgcattgcttcgtcaaacttattattattgctataataatcaatcagatgtccaaagaagaatgaatgttcaggatacttttgaataccatcttttaaggaagcgatccacttgacagtatcaccttgagctttcaatgctgtagaaataaattccatggcatatttacccacttctttgtcctcctttgcataaggtgcatatttcaacacgcttggataatcttccattttggctgcagctaagcttgcataataagcaatttggggcaatacagtatctgtttgaagcagattctccttttcaaacataggattgatggcaatgtctacataagttgcgaagaaatccaaagcctctttattcttatctaaattaaagaactggataccaccgttaatcaggttgggacgcgcagctaatatagcagcactgttcgatcttctgaacttatttttgattttacctttttcgttaggaatctgtgcaagttcatcgcatttaaagtagtatttgcacatattcagtgcgctgttatacactttaagagtatcataaggctttcttaaataagcattctccatttccttttcattgattctcttttgaataaagccggctacatcccatgtttcggcgttgtctttggtttcagcattgttcagagcttcattgatgagcttctctgcttgtgcaaaatccggttttacgtcgttagcgatgctttttgcctctttcacgctcttttcctgagcgaaggtaaagcctgccgcaagtagtaaaaccattgaaaataatactcttttcatgattgtagaaaattttaaattaatattgtgtctattcttcattttcattgtttactatatcgttctgagttttttctgatgcatcgctatcctcttctgcaatgatatcctcttcggtttccgaggtaactttacatacggagccaatttcatcattacgtttttcaagattaatcagtcgtactccctgcgtagcacgtcccattatacgaacatctgctactttcagacggatggtgatacccgatttattgataatcattaaatcnttctcatctgttacagacttgattgttaccagtttaccggttttatcggtgatattcatagtttttacacctttaccgccacggttcgtcttacgataatcctcaatatcggaacgcttaccntatccttgttctgacacaaccatgattgtctcagtttcagggtctttgatacaaatcattccgacaacttcgtcttgtccgtcttcatcaagcgtcatgccgcgtacaccggtagctgtacgtcccattacgcgtacggcactttcgtggaaacggatggcacgtccgttacgattggcaatgataatctcattgtcaccgttagtcatgcgcacttcaattacgcggtcatcttcgcggattgtaatggcattgacaccattttggcgaggacgggaatattgttcgagcaatgttttctta

SEQ ID NO: 370 - DNA, 4000 bp, Escherichia coli
  misc_feature (1991)..(1991): n is a, c, g, or t
  misc_feature (3783)..(3788): n is a, c, g, or t
  misc_feature (3791)..(3792): n is a, c, g, or t
cccgaaactgcacgccacggcgccgccgccgccgatgcagcgcgatccggatatcgagcgcgaggtcgtagagcacatgcgccgcgccggcgccctcgatgcgctgcgcgagtcgacgatcgccgcgctcaaaacgaacgaagagctcaaaacctttgccgaattcgcggtgcgctcgagtcaggcgttgcgagatccgtacgcgcgctcgaggtcgcgaaaagagctcgtggatgagttgttcgtggagattgagcaacggctgatggatgaagtgcgagcgaagacgtttgagacgttgacggagacggaggcgggcgccgtggggcgagaggcgtacgagagaacgtacgccgcgcgagaggatgtcaagcatgacgggcgttgattgcgtgcgtgcgaggtgtaggattgttaaactagcgttgatttagcgttgaaatgtacagtagatagagtattacgcgaatgttttgtgaagaacgtatagcgagggtgcagtgaactgcgagcacatttctaaataacattttttctattttttttctcaatgatagcttctagtcgcggcaccgagggtagcgatgccgtcgccgagcgcccacgatgcctcaacgtcttggttcttgtagcggattttatcgagcatgtggatcgtttcggtgtcgctcacgccgtaaccagtcgtgagcagcgcgtaaatgtacgtcaactccaagcataaataatcaacatcaacctttgccgcgacggcgaatgggaattcactcgcgagtttggcttgaggcgtcacgcatgcatgcgatgcggcagtcttgaatgcgccggccgtggtggatacgatcgtcgacggcgtctttggatgcggcgcgaccccggcttgaacaccgcgctcgacgatatacgacatgacatacaatggcgtctttctcggtgtcgtccacgccccagcgaacgaacacggtcctcgtccgcacttagttctattatcttcttcaaatgtctctatcacagcggcgagacaacgcttgaaatcggtccctaacgttgcgcttccctttgcctcgtacgtctcacccggctcgagaccgtagcaatcctttgtacacgtgtcttgaacgctaccaggtaagcacgggtgcgtgccatcttcatcgcgcttaccaaatcggtacaatttcgctcgcacggcgatgagaccgtatcccttgaagctatgaatgtacgcgctgtacgcgctaaacggcgtctgaattttacgcacatacccgctcggcgccttatccataatcgcgctcccgaccgcatacgcgatttgtgtcgagcctccacctaaatcaataacagctacagtggactcgggtgattttccgagtcgttctaataaatagttcgtcgcaacccagccatgcgcgccttcgtctaccccatccataatcgaaacaaacgtttcgctctgcggatgaaagcccgcgcgcgcaatcttcgctcgcacgctatccatgatggcatccgcagcgccctgaccttcaggcattaatcgaagtccagcggtggcgcgaacgctgaacggcgtcgccgagcgcgcgagctcgggaaccactgacttggcgcgagagatgagttcgtcgagcgatgcgctcgcggcgtccgcagaagacccgtacgacttcaaccctggctcgatggcgtgaaagtactccgaatgcagtcgctcgcggccaaaatagtccgtctgaaacgtaaagacgtgaacgcgagagccagttgagccagcgtctaacacgatgctaaatctttttgacgttcgagtcgaggcaaagcctacggcgtctgaccacagcgtgaacgtgaccgtgagtgcaatgacgacaatgaaaaccacgagtgtggtgagcgaccgcggcgaactcgccgcgcgtgttggggcgaatgccatggcgcctcggatgcgcgcgcggcgcatgcgaggccgagtttgcggtcgatangtagccgcatacatgagagtgcactgcgaggtcatagaggcgtgaatgatagtattattacaacagtatgagttttatcgttatggtaccgtagagttacactggacatcgccgacgaagtggctttctcgccaagagaagcgcgacgcacatcgctccggcgagcgcggcgagcatcgcaaaaaatccactgggagtgtcaaacgtcggataagtcgcgccaagcaagccactgaagtagttgccaaaaaagtatgaaccaaaccaaagcccaatgatcgcgctgagcaagccttcgggggctatttttgaaatgtacgacagcgccaccggaaacgtgtacaattcgccagccgtgaggaaaatttgattcaacacaatccaaatcacgctcactcgcacgggcgacgcatgagagtcgaccgggagtgcgccaaacattagaaccgcaaacgacgtggcgagtaaaccacatccgagggcgattttggtcacttggtggggttcggaattcgtcttcgcttgacgttcccacaccatcgtcaccgccggcgtgagagctaataccaacgccggattgagcgccgcgacgaactctgtaggcaagccgtgtaaattaatgtgctcatccgcaaaaatcattagcgttgatccttgctgctcgtatacgacggaaaatgccacgccagcgacgcatacgatgagcgtcgccatcatcgcgttgccgttctcccgcatcaaatccaacatctttgcaaacgagttcttctcattcaccgccagcggcgatgtcaaaggcgtggtatctccgccgaattcttcgtcgcgcacatccaacgtcgtcgcatcaattacttccactcgtgaatctaagatgtacctcctgttcgtcgtgtaaatgaccaacgcgcacgccatgccaatcgccgcgctcgcgaacgccgcaccgtaaccaaaatacacgcgaacggttcccgcaatcagcggcgagaagaacgctccgatattaatgcaacagtaaaaaattgaaaacccttgatcgcgtctcgggtcatccttggcgtacaacgcgctcagctgcgtcgacatggatggtttaaacgccccgttcccgacgcacaccaaaaccaatccaatcacaaacgcccactcactcgccatcgccgcgtacccaatcgccatgattgtcgcaccaactaacgccgaacgatgagaaccgagaatggcgtcagaaatcacccctccgaacaccggcgtgagatacgtgaggcacgcaaaccaaccgtacaaacgcgcgctcgtctcctccgccgccaccttccgcgccgccatcgcccccgcactcgcggcatgtgttgagaaatcatacccactcgccatctgtcctatcgcccgcaatccaaacacccgatcgacatcgaacgtcgcgtccgagagaatcttcgtcgcgtacaacaccaacagcgcgcgcgctgcgtagtacccgaaccgttcccacatttccgtcgcgcccacgaccgcgagaccgacggggtggccgtaaatcgttttacgtcgcgcggtgccgccgctgccgccgccgctggcgctaccgccgagacgcggcgaacgcgcgcgcgatgcgccgagaagcggttcagcatcatctcccgcgccttcgacgtccccgcgcgcggcgcgatcgtcatccgtcgacgacgacgacggcggcgccgacggcatgcgcgcacctctcgtctcggcctccgtgcgcgtccctgtgcgcgcgtgttccgtgcgcgcgcgcgcgcgnnnnnntgnngcgctggagtgccgcgctggcgcccttcacttcgcgtcgttcgccgaccgagtccgcacgcgcgcgcacgctcgaacgcgcgcacacacacgcacgcatggcgcacgcatcgctcgtcgcgtcgcgcgcgcccgcgaccgtcgctcgcgcgcgcgcgcgcgctgggcaccgacgttcggttggattaatcattccagcgcgtggcgaa

SEQ ID NO: 371 - DNA, 4000 bp, Escherichia coli
  misc_feature (1987)..(1987): n is a, c, g, or t
  misc_feature (1989)..(1989): n is a, c, g, or t
  misc_feature (2981)..(2981): n is a, c, g, or t
  misc_feature (2983)..(2984): n is a, c, g, or t
  misc_feature (2989)..(2996): n is a, c, g, or t
  misc_feature (2998)..(2998): n is a, c, g, or t
  misc_feature (3000)..(3004): n is a, c, g, or t
  misc_feature (3006)..(3006): n is a, c, g, or t
  misc_feature (3008)..(3008): n is a, c, g, or t
  misc_feature (3011)..(3011): n is a, c, g, or t
  misc_feature (3013)..(3013): n is a, c, g, or t
  misc_feature (3015)..(3018): n is a, c, g, or t
  misc_feature (3020)..(3021): n is a, c, g, or t
  misc_feature (3023)..(3024): n is a, c, g, or t
  misc_feature (3027)..(3027): n is a, c, g, or t
  misc_feature (3029)..(3030): n is a, c, g, or t
  misc_feature (3032)..(3035): n is a, c, g, or t
  misc_feature (3037)..(3041): n is a, c, g, or t
  misc_feature (3044)..(3049): n is a, c, g, or t
  misc_feature (3051)..(3053): n is a, c, g, or t
  misc_feature (3055)..(3055): n is a, c, g, or t
  misc_feature (3058)..(3058): n is a, c, g, or t
  misc_feature (3060)..(3064): n is a, c, g, or t
  misc_feature (3067)..(3072): n is a, c, g, or t
  misc_feature (3074)..(3083): n is a, c, g, or t
  misc_feature (3085)..(3086): n is a, c, g, or t
  misc_feature (3089)..(3089): n is a, c, g, or t
  misc_feature (3092)..(3100): n is a, c, g, or t
  misc_feature (3102)..(3102): n is a, c, g, or t
  misc_feature (3105)..(3107): n is a, c, g, or t
  misc_feature (3109)..(3109): n is a, c, g, or t
  misc_feature (3112)..(3114): n is a, c, g, or t
  misc_feature (3117)..(3118): n is a, c, g, or t
  misc_feature (3120)..(3125): n is a, c, g, or t
  misc_feature (3127)..(3127): n is a, c, g, or t
  misc_feature (3134)..(3136): n is a, c, g, or t
  misc_feature (3138)..(3139): n is a, c, g, or t
  misc_feature (3141)..(3141): n is a, c, g, or t
  misc_feature (3143)..(3147): n is a, c, g, or t
  misc_feature (3149)..(3158): n is a, c, g, or t
  misc_feature (3160)..(3164): n is a, c, g, or t
  misc_feature (3166)..(3166): n is a, c, g, or t
  misc_feature (3169)..(3170): n is a, c, g, or t
  misc_feature (3172)..(3173): n is a, c, g, or t
  misc_feature (3175)..(3175): n is a, c, g, or t
  misc_feature (3177)..(3178): n is a, c, g, or t
  misc_feature (3180)..(3180): n is a, c, g, or t
  misc_feature (3182)..(3183): n is a, c, g, or t
  misc_feature (3185)..(3186): n is a, c, g, or t
  misc_feature (3188)..(3191): n is a, c, g, or t
  misc_feature (3193)..(3198): n is a, c, g, or t
  misc_feature (3200)..(3206): n is a, c, g, or t
  misc_feature (3208)..(3211): n is a, c, g, or t
  misc_feature (3214)..(3217): n is a, c, g, or t
  misc_feature (3219)..(3220): n is a, c, g, or t
  misc_feature (3222)..(3222): n is a, c, g, or t
  misc_feature (3224)..(3225): n is a, c, g, or t
  misc_feature (3228)..(3228): n is a, c, g, or t
  misc_feature (3232)..(3236): n is a, c, g, or t
  misc_feature (3238)..(3239): n is a, c, g, or t
  misc_feature (3241)..(3246): n is a, c, g, or t
  misc_feature (3248)..(3248): n is a, c, g, or t
  misc_feature (3251)..(3251): n is a, c, g, or t
  misc_feature (3253)..(3253): n is a, c, g, or t
  misc_feature (3256)..(3256): n is a, c, g, or t
  misc_feature (3258)..(3268): n is a, c, g, or t
  misc_feature (3272)..(3272): n is a, c, g, or t
  misc_feature (3278)..(3279): n is a, c, g, or t
  misc_feature (3281)..(3281): n is a, c, g, or t
  misc_feature (3283)..(3284): n is a, c, g, or t
  misc_feature (3286)..(3287): n is a, c, g, or t
  misc_feature (3289)..(3292): n is a, c, g, or t
  misc_feature (3296)..(3309): n is a, c, g, or t
  misc_feature (3311)..(3311): n is a, c, g, or t
  misc_feature (3313)..(3315): n is a, c, g, or t
  misc_feature (3317)..(3319): n is a, c, g, or t
  misc_feature (3321)..(3321): n is a, c, g, or t
  misc_feature (3323)..(3324): n is a, c, g, or t
  misc_feature (3328)..(3331): n is a, c, g, or t
  misc_feature (3333)..(3334): n is a, c, g, or t
  misc_feature (3338)..(3345): n is a, c, g, or t
  misc_feature (3347)..(3348): n is a, c, g, or t
  misc_feature (3350)..(3353): n is a, c, g, or t
  misc_feature (3355)..(3355): n is a, c, g, or t
  misc_feature (3357)..(3358): n is a, c, g, or t
  misc_feature (3362)..(3366): n is a, c, g, or t
  misc_feature (3368)..(3373): n is a, c, g, or t
  misc_feature (3376)..(3381): n is a, c, g, or t
  misc_feature (3383)..(3383): n is a, c, g, or t
  misc_feature (3385)..(3386): n is a, c, g, or t
  misc_feature (3388)..(3391): n is a, c, g, or t
  misc_feature (3393)..(3396): n is a, c, g, or t
  misc_feature (3398)..(3399): n is a, c, g, or t
  misc_feature (3402)..(3402): n is a, c, g, or t
  misc_feature (3404)..(3404): n is a, c, g, or t
  misc_feature (3407)..(3408): n is a, c, g, or t
  misc_feature (3411)..(3416): n is a, c, g, or t
  misc_feature (3418)..(3423): n is a, c, g, or t
  misc_feature (3425)..(3426): n is a, c, g, or t
  misc_feature (3428)..(3431): n is a, c, g, or t
  misc_feature (3434)..(3436): n is a, c, g, or t
  misc_feature (3438)..(3444): n is a, c, g, or t
  misc_feature (3446)..(3447): n is a, c, g, or t
  misc_feature (3449)..(3450): n is a, c, g, or t
  misc_feature (3452)..(3452): n is a, c, g, or t
  misc_feature (3455)..(3456): n is a, c, g, or t
  misc_feature (3461)..(3461): n is a, c, g, or t
  misc_feature (3463)..(3463): n is a, c, g, or t
  misc_feature (3465)..(3466): n is a, c, g, or t
  misc_feature (3468)..(3468): n is a, c, g, or t
  misc_feature (3470)..(3473): n is a, c, g, or t
  misc_feature (3475)..(3476): n is a, c, g, or t
  misc_feature (3478)..(3482): n is a, c, g, or t
  misc_feature (3484)..(3485): n is a, c, g, or t
  misc_feature (3487)..(3491): n is a, c, g, or t
  misc_feature (3493)..(3498): n is a, c, g, or t
  misc_feature (3501)..(3501): n is a, c, g, or t
  misc_feature (3503)..(3503): n is a, c, g, or t
  misc_feature (3505)..(3506): n is a, c, g, or t
  misc_feature (3508)..(3513): n is a, c, g, or t
  misc_feature (3515)..(3515): n is a, c, g, or t
  misc_feature (3518)..(3525): n is a, c, g, or t
  misc_feature (3527)..(3527): n is a, c, g, or t
  misc_feature (3531)..(3534): n is a, c, g, or t
  misc_feature (3536)..(3536): n is a, c, g, or t
  misc_feature (3543)..(3544): n is a, c, g, or t
  misc_feature (3546)..(3546): n is a, c, g, or t
  misc_feature (3549)..(3551): n is a, c, g, or t
  misc_feature (3553)..(3553): n is a, c, g, or t
  misc_feature (3555)..(3563): n is a, c, g, or t
  misc_feature (3565)..(3570): n is a, c, g, or t
  misc_feature (3572)..(3572): n is a, c, g, or t
  misc_feature (3576)..(3576): n is a, c, g, or t
  misc_feature (3578)..(3578): n is a, c, g, or t
  misc_feature (3580)..(3581): n is a, c, g, or t
  misc_feature (3584)..(3584): n is a, c, g, or t
  misc_feature (3586)..(3587): n is a, c, g, or t
  misc_feature (3589)..(3598): n is a, c, g, or t
  misc_feature (3600)..(3600): n is a, c, g, or t
  misc_feature (3602)..(3608): n is a, c, g, or t
  misc_feature (3611)..(3611): n is a, c, g, or t
  misc_feature (3614)..(3614): n is a, c, g, or t
  misc_feature (3618)..(3618): n is a, c, g, or t
  misc_feature (3622)..(3622): n is a, c, g, or t
  misc_feature (3624)..(3624): n is a, c, g, or t
  misc_feature (3626)..(3627): n is a, c, g, or t
  misc_feature (3629)..(3631): n is a, c, g, or t
  misc_feature (3633)..(3638): n is a, c, g, or t
  misc_feature (3640)..(3642): n is a, c, g, or t
  misc_feature (3644)..(3647): n is a, c, g, or t
  misc_feature (3649)..(3652): n is a, c, g, or t
  misc_feature (3654)..(3657): n is a, c, g, or t
  misc_feature (3659)..(3659): n is a, c, g, or t
  misc_feature (3661)..(3661): n is a, c, g, or t
  misc_feature (3663)..(3667): n is a, c, g, or t
  misc_feature (3669)..(3672): n is a, c, g, or t
  misc_feature (3677)..(3679): n is a, c, g, or t
  misc_feature (3681)..(3681): n is a, c, g, or t
  misc_feature (3683)..(3684): n is a, c, g, or t
  misc_feature (3686)..(3687): n is a, c, g, or t
  misc_feature (3690)..(3693): n is a, c, g, or t
  misc_feature (3696)..(3696): n is a, c, g, or t
  misc_feature (3699)..(3699): n is a, c, g, or t
  misc_feature (3701)..(3704): n is a, c, g, or t
  misc_feature (3707)..(3709): n is a, c, g, or t
  misc_feature (3711)..(3711): n is a, c, g, or t
  misc_feature (3714)..(3715): n is a, c, g, or t
  misc_feature (3718)..(3720): n is a, c, g, or t
  misc_feature (3723)..(3724): n is a, c, g, or t
  misc_feature (3728)..(3728): n is a, c, g, or t
  misc_feature (3731)..(3731): n is a, c, g, or t
  misc_feature (3733)..(3745): n is a, c, g, or t
  misc_feature (3748)..(3751): n is a, c, g, or t
  misc_feature (3753)..(3753): n is a, c, g, or t
  misc_feature (3755)..(3755): n is a, c, g, or t
  misc_feature (3758)..(3761): n is a, c, g, or t
  misc_feature (3763)..(3768): n is a, c, g, or t
  misc_feature (3773)..(3774): n is a, c, g, or t
  misc_feature (3776)..(3779): n is a, c, g, or t
  misc_feature (3782)..(3783): n is a, c, g, or t
  misc_feature (3785)..(3792): n is a, c, g, or t
  misc_feature (3795)..(3795): n is a, c, g, or t
  misc_feature (3797)..(3797): n is a, c, g, or t
  misc_feature (3799)..(3803): n is a, c, g, or t
  misc_feature (3805)..(3806): n is a, c, g, or t
  misc_feature (3809)..(3811): n is a, c, g, or t
  misc_feature (3813)..(3815): n is a, c, g, or t
  misc_feature (3817)..(3821): n is a, c, g, or t
  misc_feature (3823)..(3827): n is a, c, g, or t
  misc_feature (3829)..(3829): n is a, c, g, or t
  misc_feature (3831)..(3831): n is a, c, g, or t
  misc_feature (3833)..(3834): n is a, c, g, or t
  misc_feature (3837)..(3839): n is a, c, g, or t
  misc_feature (3843)..(3843): n is a, c, g, or t
  misc_feature (3845)..(3846): n is a, c, g, or t
  misc_feature (3848)..(3852): n is a, c, g, or t
  misc_feature (3854)..(3858): n is a, c, g, or t
  misc_feature (3860)..(3863): n is a, c, g, or t
  misc_feature (3866)..(3866): n is a, c, g, or t
  misc_feature (3868)..(3869): n is a, c, g, or t
  misc_feature (3871)..(3872): n is a, c, g, or t
  misc_feature (3874)..(3874): n is a, c, g, or t
  misc_feature (3876)..(3879): n is a, c, g, or t
  misc_feature (3881)..(3882): n is a, c, g, or t
  misc_feature (3886)..(3886): n is a, c, g, or t
  misc_feature (3888)..(3888): n is a, c, g, or t
  misc_feature (3890)..(3890): n is a, c, g, or t
  misc_feature (3893)..(3897): n is a, c, g, or t
  misc_feature (3901)..(3905): n is a, c, g, or t
  misc_feature (3908)..(3909): n is a, c, g, or t
  misc_feature (3911)..(3912): n is a, c, g, or t
  misc_feature (3914)..(3917): n is a, c, g, or t
  misc_feature (3920)..(3927): n is a, c, g, or t
  misc_feature (3931)..(3938): n is a, c, g, or t
  misc_feature (3940)..(3941): n is a, c, g, or t
  misc_feature (3943)..(3946): n is a, c, g, or t
  misc_feature (3949)..(3949): n is a, c, g, or t
  misc_feature (3951)..(3951): n is a, c, g, or t
  misc_feature (3953)..(3955): n is a, c, g, or t
  misc_feature (3957)..(3957): n is a, c, g, or t
  misc_feature (3959)..(3971): n is a, c, g, or t
  misc_feature (3973)..(3975): n is a, c, g, or t
  misc_feature (3977)..(3979): n is a, c, g, or t
  misc_feature (3982)..(3982): n is a, c, g, or t
  misc_feature (3984)..(3984): n is a, c, g, or t
  misc_feature (3986)..(3989): n is a, c, g, or t
  misc_feature (3991)..(3994): n is a, c, g, or t
  misc_feature (3997)..(3997): n is a, c, g, or t
  misc_feature (3999)..(3999): n is a, c, g, or t
gggagctgctacgtcagttctggatgtccacgccgatgataacgtctgtgcgatgggagaaagcgacgaaggtctgcaaatccgtcgagatcttgtacgataaactcgaaggagtgaaaagttcgctcccttccgcccaccgacatatcgcttctcagcgccttaggccgctgctcggtgcgtttgattctgcgttgacgttttatgatgacgagaaaactcgtcgtcctcaggcgtacgctgactttgagaagacagcgacgcaagaaaattcatagattgatcaattagacgtagccatgaaatcaatcatagaagatttagatgcagcgcgtcctcgattttgacaagctcaaagtagggcggcagaggtcttcagtgcctcctcactcttcaactcgagacgtgtcggcgacggattcgatactagctcggtagcctgcgcgcactgtcaaaaacatgtttcgtcaggcgctgaaggccgcgcgacgcgctcgcgcgcaggcgtttcgtcacagtttagctcagcgtcgtggtcatgccaacgccaatcgtgggacgtcgtgcgcggcgtccgcgctcggtgcctgccgcgatggacgctcgaccgcggcgtcaagcgcacgatcgtacgtcgcggcgagcgcggcggcgaataactcgttgtacggctctatgctcgtcgagcgcatcccagtcgtaattcccgaagccccggcgtgggagcgcgagtacaaggaatggagcgaagcgcgacgcgacaagtttagggtgaaactccccgatcaaatagtcgaagcgaaaggtttattagacaacttgccggattttgagccggcaccgagagagacggaggcggatcgcacgggcgacagaagtacgctgcatcgcaaacttcccgagttcctcttcctcgtcgtcaaggaaaaagacggcaagtggggcttcccaaagtctaaacacgatgacggagagacgatgcgccaaacggctgagcgatcgctgaaagctttcgcgggagattctttagagtgttgggtggtcgggaatgcgccgcagggtcactacgaaaccgccgacggcacgacattttattaccgcggttcatacatcgagggtgagttagaattgcaagatggttacgtcgagcacgcgtgggtgacgaaagaggagctaggtgaatactttgacgccgatcatcacgatttgttgaagagaatgctttagaattgcgcggcgacgtcgcgaatagctttgtgtaagaggcgggaaatttgtagccttaatcgtgttgctttcaacgttttacactcgatcttccgctttgactatctaactatcgatacacatctcgaacctctcccacatcgcgttctctacgccgtaggcgccgtccattgcgtcttgttcgtcagcttgttgtggtaatatggccgtccgagcttgtcgtaatacatcacccatccctccaccatcgcccccttcgcaccacccgtcgcggtttccgtctttgctggttcttcttcgctctcagacacctcctcccccgccgcccgtcgcttctctcgttcctccttgcgcatctttttcttggcgtacgccttggcctcgcgcgccatcttcctaaagtctggctccttcctcgcctttggtgcgctctgcggcggctctatgacgaagcactcgcgcggccatcgattggcccaatccacgttcccattcatgcaaaacgccgcctgatgtccctcgatcccgcatatgttacacccgtgtatggacgacccttgcggtcgtcgcagtttgtggtgcttctccatgcttcgtgcgcgttatcgcgcgttcgaacgcgcgtcgacgcgcgcgcgcgtcgtcgtcgtcgtcgtcgtcgtcggctcttcgctcgcgtcgcgcgtcgctcgggacgatcggacgcaccgccgcgtcgcgtcgtcgtgtgacgcgcgcggcgtcgttggaaattcacaangngctagggttcagcaaatgtccatcccgggcgcgacaaatggcgcgcgcgcgacgccgcgtgacgcctctttgacgcgcgcgtggggttgagaaaatggtgaacgtacgtcgagacgatggcgacgcactcgacgcgttcgacgcggcggctcgacgcgcgacgcgacgcgcgcgcgcgcgatgggacggcgcgggacgcgcgcgcgttagggctcgcgagcgatcgcgctcgagacggtgatgactgacgacgacgacggatccgatgcgcgcgaacgcgaacaggtgccgaaatctaagaagacgttctgcaaggggtgcaagaagcactccgcgcacaaggtgacgcagtacaagacgggcaaggcgagcctgtacgcgcaaggtgcgtggcgcgcgaaaaccctacgatggatgacggtcgacgcgcgcgatcgcgcgcgcgctcgagcgatggcgcggatgcgacgcgcgcgacgacgcgcgcgtgaaacgtattcttctcgtcgacacgcgtgactgacgactcgatgcgcgattcgcacaccgaacacagggaagcgtcgttacgattccaaacaagcggggtacggtggccaaaccaagccggtgttccacaagaaggcgaagacgacgaagaagattgtcttgcgcttgcagtgcggtacgtgcaaacaagtccacatgcacccgatcaagcgttgcaagacgttcgaaatcggcggtgacaagaagaagcacgtgacgacgaactactaggcgcgtcgtgcgtccgggattcaaaagtctcgcgcgcgaagacgcacgtattagcacgggtcttcgcgctctttcttagtgtggtgggagtcggtagattcagtcgaggttgtaagctcgagtaatcgtataaaaatttcttcgccatcgcggcgtcgcatcgtccgtcgcgcgcgtgagacgagtcgcgcaaagcgtcatcgtctcgtcgtcgtcccggtctcaacaccctncnnttgcnnnnnnnngncnnnnntngncgncncnnnngnngnngangnngnnnnannnnncgnnnnnncnnnanaanannnnngannnnnntnnnnnnnnnncnncgncgnnnnnnnnngntgnnngncgnnncgnngnnnnnncnacgacgnnntnntngnnnnncnnnnnnnnnntnnnnntnatnntnntntnntncnncnncnnnngnnnnnngnnnnnnntnnnnaannnngnngngnngangatnnnnncnncnnnnnncntcntnttntnnnnnnnnnnngcgncgacgnngntnntnntnnnngcgnnnnnnnnnnnnnnantnnncnnngngnngccnnnnannaagnnnnnnnngnngnnnntncnncccnnnnngnnnnnnttnnnnnngntnntnnnngnnnngnnggngntgnngcnnnnnncnnnnnnannannnntcnnngnnnnnnngnngnngncgnnggtgntntnntngnnnnannannnnntnntnnnnngnnnnnngcngncnncnnnnnngncgnnnnnnnngntggnnnncntcgtcgnngnggnnntntnnnnnnnnnannnnnncntctncncnncgncnncnnnnnnnnnntncnnnnnnntcntcntcgncgcngngnngnnngnnnnnntnnncnnnnannnnannnntnanannnnncnnnncaacnnntngnngnngtnnnncancancnnnntgnnnanccnnccnnncgnngtgntgntnnnnnnnnnnnnnggnnnnangncgnnnntnnnnnnaacannannnncgnngnnnnnnnntgntntnnnnncnncgnnntnnntnnnnngnnnnngnantnnttnnncgangnngnnnnncnnnnngnnnnccncnncnncntnnnncnncgtngngncgnnnnncaannnnntcnncnncnnnntcnnnnnnnngatnnnnnnnnannannnnacnancnnngnannnnnnnnnnnnntnnnannnatnangnnnngnnnnttntnc

SEQ ID NO: 372 - DNA, 4000 bp, Escherichia coli
  misc_feature (330)..(330): n is a, c, g, or t
  misc_feature (722)..(722): n is a, c, g, or t
  misc_feature (729)..(729): n is a, c, g, or t
  misc_feature (1949)..(1949): n is a, c, g, or t
  misc_feature (1951)..(1952): n is a, c, g, or t
  misc_feature (1961)..(1961): n is a, c, g, or t
  misc_feature (1964)..(1964): n is a, c, g, or t
  misc_feature (1967)..(1967): n is a, c, g, or t
  misc_feature (1969)..(1970): n is a, c, g, or t
  misc_feature (1990)..(1991): n is a, c, g, or t
  misc_feature (1999)..(2000): n is a, c, g, or t
  misc_feature (2009)..(2009): n is a, c, g, or t
  misc_feature (2012)..(2012): n is a, c, g, or t
  misc_feature (2018)..(2018): n is a, c, g, or t
  misc_feature (2381)..(2381): n is a, c, g, or t
  misc_feature (3136)..(3136): n is a, c, g, or t
acttgtactcgcaaagttctttctccccgtcgtccgggtcgattttgatttgcttccagtcctcaacgtgaatgccgcacttgtggcaaataaattcgtcgcagtctatgtagtcccggttctcgttgtatgtcagcggttgcaggctctccggggcaatggtcggttcggcattcaaactgccctcgatcatctgcactacactggttttgattttcccgtgtgtcagctcccctttcagtgcatactctatgttcttgagtacctgcatgaaatggtttgcatcaaccagacgtttttctttcattttcttttcccgctttctttctnggcgttcgcttcttctttggcaaatccggtatcgtcaccacaatatccctttgtttctccatttccgccgggattgcctcgaccagacttttgaatttttgcaaggtttgaacctccgtcgccgcgaaaatgaactgcgccagttcttccggtgttccctgctggacggaatgaccgtccgggtatgttgtgatcgtcatttttcttcgcctttcagtttcagttccactttcggcatgggctgatccgaacggttcatcggttcatagaaatcgacccactgtccaccctccgggaagtcgtgccacgcaagcgcgtaccggatcgtcagccaaacggtttctgctctgtatgcttctttcatggttgtgtcgatagatgcaggcggaacnttctgcntccaaagtgcgtccatgccctgccgcatctggttacgaagccgcatacacttgagaaaatccgcttcgtggtctttatgaaactgctttcgttcttcggtcgtgtggcaccgcttttccatcttgtccacataatcccagcagcaaacctcattggtgaagtcctcaaactggcccatgcggaaccggaggtattcttcgcacgcctgcttcacggcctgtgctgtctcccggctcatggtgatggtcacggcctcaacctctgccggggtcttattttttgttaccattctgtcacctcaacaaatcctgacagccggggcaccgtagccatcccgtaccagaaccccctctttttccgtaaaaaacattgtcgtcttgaacggaaagtttgctctgtcgatgccagcttcggcggcagcatcggccagcattttgcacgggccgtaatcactcccgatggaaaagccgaaagcttgaatgcttttcgcgtattcctcaatgctttttgccaatgccgccttgaatgtgttcagctgatccagcgtaacgctctgtcgcatcgtatccgcaaggaagcacactgcaacagaggtaaagctatcgtctccgttgctatgcggctggtgatccatcagctttccagcccaccagctgacagccttttcaatatcatcctttgccaaaatcataccgtttccccgcctttctttttcagaggttcaggccccgttccatagtccggcacccagccgcccggccagtcgtgccgctggctgcgttcgtatttcttgaccattgcggccagctgaatagcttccaccgctgcgtggattgccacatcataaatgagattcaggtgctcccgcttcatgggttcgtttctcttgacatctcgccacagccggattgtcaagccaaagtggagcttccgcacctcgtctatcagttcgtccagttcttcccggatcaccgcatacccttcatgcggacttgcgaacatccgaaagcggcggtttgctgccgccagctccttctttgccagagcacggacatcttttgtgataacgtccatggttattcctccgcccggctcttgatttcagccagcagatcatccaatggaacatcggcgaggcaaaacccggcttctccttcatcctcggtagagacccagagtgtagagggaaagtacaaagcggggcgaacaccataggagtngnngtaccagtngtngtngnnggagccatcggtgttgacgnnccagacgnngctgctatngcnggtgtncggagagcaattcggcgtaccgtaaggcgtcgccaaccaccacggcgtatctaccttcgggatcagccgccaatactttccatactgacgcagggtcaacaggccgattctgtattcaacggttccgtattcggtctgtccggttgtgtcctgcaggtcgatcttgaacggaataaaagtatccagcggcgtacccttctcggtaaactctgccagacagttacccagatacttcataacatcgctccggcgcagatcgttgggacactccgggtcgtcgccgtcacggaacggcattttcgtccaaatgtcctttgccagcaccagacaaccgtgttcgtctgcatccagcttcacaaactntttgcccagcgccttgaagatgccgccatttttcacattgcccaaagttgtgcttttcaaaatcttgctcatggtcgtttctccttcttattactcctgctgctcggaatccttttcggcgttcaaatcatcgaacgtctgttccggttcttcctgttcaccgatgtgagtttctgccagcattgcaaccagttcttgcagctttgcttctgcgtagtccggcaccgtatatgccataacggcggctcgtaccctcatgccgttcttcacgacataataaaccgttccgtcggtttgttttctctggtaatagcggataaaaccgttattcttaatttcatcctccagcggcgcaaggtgcgactgacagataatgccgaccatgtggcgatcctcggtcacaagcgggataaggatttctccactgcagtaaataccgatgcccagtttcttcacttcgacttcatccttaattgtgtcgtcaagattgaaaccctgaaaatcaattttgtatgcacagtcgaagtcgttgtaaaccaccttttcgatcatggtatcctcgctgattcccagcatagcgcccatctggttgcggttcagcggacgcgggaaaccggtagcgcagtaaatcgccgacgcagttccaatgtagaaatcatcactctcgtcgttatggaaaacattgcagacaagctgccgcttgaccatctttgtcagccctgaaagtttcatcttttgaccacctccacgtccgntttttccgtttcactaaacctcggataaaaggtcattgcgcacatccgtgcctcacggagtgctgcatctgagctttttgcgtccagcttgtacggtagctgcatcttgtttttcgtgtagctgtcaatgccgaacagcatgatactgaactttgccattttctgctcctttctgctcattttctttcggtgggcacttccgggcttgaaccgggcggggcctattccctatgctcatataaaaaggagccgccgctctgggcggctccaaaagatcagttgatgccgttgataatggggatgctgttaccatcgccaacataggcaggcagttcaccgttccagcgggattccacgtcggtgatcttgtagtattccagcaggttgctgttcagactgtcgttcaaggcgcggtttgcttccgcctttttctctgcaacgtacaactctgcgtccgctgcaaccttagacttttccgcttccgcattggctgcgatcaggtcagcgtccgccgtggcctgtgcttcgacacggcgcttgtcggcgtcagtctcggctttttccttttcctgctgggccttgacctttgcttccaccgcatcggtaaaggtatcagtgaagtcaaaattggttacgctgatatactgcaggtcgatgttgtactgtgccagcacttcccgcagtttcgtgtccatctgggaagcgactgcatcccggttagaaatcaggctgcttgcatcgtagtgggcaactacagctttcaccgtttcaaggacacggggagtaatcagggtgtcctcatactttttgccgacctctttgtagatggtcattgcatttgcctgattgatccggtagccaacc

SEQ ID NO: 373 - DNA, 4000 bp, Escherichia coli
  misc_feature (1)..(7): n is a, c, g, or t
  misc_feature (9)..(11): n is a, c, g, or t
  misc_feature (14)..(14): n is a, c, g, or t
  misc_feature (18)..(21): n is a, c, g, or t
  misc_feature (23)..(41): n is a, c, g, or t
  misc_feature (43)..(51): n is a, c, g, or t
  misc_feature (55)..(59): n is a, c, g, or t
  misc_feature (62)..(64): n is a, c, g, or t
  misc_feature (66)..(67): n is a, c, g, or t
  misc_feature (69)..(69): n is a, c, g, or t
  misc_feature (72)..(72): n is a, c, g, or t
  misc_feature (77)..(78): n is a, c, g, or t
  misc_feature (80)..(87): n is a, c, g, or t
  misc_feature (89)..(96): n is a, c, g, or t
  misc_feature (99)..(100): n is a, c, g, or t
  misc_feature (102)..(105): n is a, c, g, or t
  misc_feature (108)..(108): n is a, c, g, or t
  misc_feature (111)..(111): n is a, c, g, or t
  misc_feature (113)..(115): n is a, c, g, or t
  misc_feature (117)..(125): n is a, c, g, or t
  misc_feature (127)..(132): n is a, c, g, or t
  misc_feature (134)..(134): n is a, c, g, or t
  misc_feature (137)..(139): n is a, c, g, or t
  misc_feature (141)..(141): n is a, c, g, or t
  misc_feature (143)..(145): n is a, c, g, or t
  misc_feature (148)..(150): n is a, c, g, or t
  misc_feature (152)..(152): n is a, c, g, or t
  misc_feature (156)..(157): n is a, c, g, or t
  misc_feature (160)..(162): n is a, c, g, or t
  misc_feature (164)..(165): n is a, c, g, or t
  misc_feature (171)..(172): n is a, c, g, or t
  misc_feature (174)..(179): n is a, c, g, or t
  misc_feature (182)..(187): n is a, c, g, or t
  misc_feature (189)..(194): n is a, c, g, or t
  misc_feature (196)..(196): n is a, c, g, or t
  misc_feature (198)..(198): n is a, c, g, or t
  misc_feature (200)..(200): n is a, c, g, or t
  misc_feature (203)..(204): n is a, c, g, or t
  misc_feature (206)..(207): n is a, c, g, or t
  misc_feature (209)..(209): n is a, c, g, or t
  misc_feature (211)..(212): n is a, c, g, or t
  misc_feature (214)..(214): n is a, c, g, or t
  misc_feature (216)..(216): n is a, c, g, or t
  misc_feature (219)..(228): n is a, c, g, or t
  misc_feature (231)..(231): n is a, c, g, or t
  misc_feature (236)..(237): n is a, c, g, or t
  misc_feature (239)..(247): n is a, c, g, or t
  misc_feature (250)..(251): n is a, c, g, or t
  misc_feature (253)..(253): n is a, c, g, or t
  misc_feature (255)..(255): n is a, c, g, or t
  misc_feature (257)..(260): n is a, c, g, or t
  misc_feature (262)..(263): n is a, c, g, or t
  misc_feature (268)..(271): n is a, c, g, or t
  misc_feature (273)..(273): n is a, c, g, or t
  misc_feature (276)..(282): n is a, c, g, or t
  misc_feature (284)..(286): n is a, c, g, or t
  misc_feature (288)..(288): n is a, c, g, or t
  misc_feature (291)..(291): n is a, c, g, or t
  misc_feature (293)..(293): n is a, c, g, or t
  misc_feature (295)..(296): n is a, c, g, or t
  misc_feature (298)..(298): n is a, c, g, or t
  misc_feature (302)..(304): n is a, c, g, or t
  misc_feature (306)..(308): n is a, c, g, or t
  misc_feature (310)..(310): n is a, c, g, or t
  misc_feature (312)..(312): n is a, c, g, or t
  misc_feature (314)..(318): n is a, c, g, or t
  misc_feature (320)..(321): n is a, c, g, or t
  misc_feature (323)..(324): n is a, c, g, or t
  misc_feature (326)..(334): n is a, c, g, or t
  misc_feature (337)..(341): n is a, c, g, or t
  misc_feature (344)..(346): n is a, c, g, or t
  misc_feature (349)..(349): n is a, c, g, or t
  misc_feature (351)..(352): n is a, c, g, or t
  misc_feature (354)..(354): n is a, c, g, or t
  misc_feature (356)..(363): n is a, c, g, or t
  misc_feature (366)..(366): n is a, c, g, or t
  misc_feature (369)..(371): n is a, c, g, or t
  misc_feature (373)..(376): n is a, c, g, or t
  misc_feature (378)..(380): n is a, c, g, or t
  misc_feature (384)..(385): n is a, c, g, or t
  misc_feature (387)..(387): n is a, c, g, or t
  misc_feature (391)..(391): n is a, c, g, or t
  misc_feature (394)..(397): n is a, c, g, or t
  misc_feature (401)..(402): n is a, c, g, or t
  misc_feature (404)..(407): n is a, c, g, or t
  misc_feature (410)..(411): n is a, c, g, or t
  misc_feature (413)..(415): n is a, c, g, or t
  misc_feature (417)..(423): n is a, c, g, or t
  misc_feature (425)..(428): n is a, c, g, or t
  misc_feature (430)..(430): n is a, c, g, or t
  misc_feature (432)..(433): n is a, c, g, or t
  misc_feature (437)..(437): n is a, c, g, or t
  misc_feature (440)..(443): n is a, c, g, or t
  misc_feature (446)..(451): n is a, c, g, or t
  misc_feature (453)..(453): n is a, c, g, or t
  misc_feature (457)..(460): n is a, c, g, or t
  misc_feature (463)..(465): n is a, c, g, or t
  misc_feature (467)..(468): n is a, c, g, or t
  misc_feature (472)..(482): n is a, c, g, or t
  misc_feature (485)..(485): n is a, c, g, or t
  misc_feature (488)..(488): n is a, c, g, or t
  misc_feature (490)..(491): n is a, c, g, or t
  misc_feature (493)..(493): n is a, c, g, or t
  misc_feature (496)..(500): n is a, c, g, or t
  misc_feature (502)..(502): n is a, c, g, or t
  misc_feature (505)..(507): n is a, c, g, or t
  misc_feature (509)..(514): n is a, c, g, or t
  misc_feature (517)..(518): n is a, c, g, or t
  misc_feature (520)..(525): n is a, c, g, or t
  misc_feature (527)..(527): n is a, c, g, or t
  misc_feature (529)..(534): n is a, c, g, or t
  misc_feature (536)..(546): n is a, c, g, or t
  misc_feature (548)..(548): n is a, c, g, or t
  misc_feature (552)..(552): n is a, c, g, or t
  misc_feature (555)..(556): n is a, c, g, or t
  misc_feature (558)..(558): n is a, c, g, or t
  misc_feature (560)..(560): n is a, c, g, or t
  misc_feature (562)..(563): n is a, c, g, or t
  misc_feature (565)..(565): n is a, c, g, or t
  misc_feature (567)..(568): n is a, c, g, or t
  misc_feature (570)..(574): n is a, c, g, or t
  misc_feature (578)..(578): n is a, c, g, or t
  misc_feature (581)..(581): n is a, c, g, or t
  misc_feature (583)..(588): n is a, c, g, or t
  misc_feature (590)..(591): n is a, c, g, or t
  misc_feature (594)..(597): n is a, c, g, or t
  misc_feature (599)..(602): n is a, c, g, or t
  misc_feature (604)..(604): n is a, c, g, or t
  misc_feature (610)..(610): n is a, c, g, or t
  misc_feature (612)..(614): n is a, c, g, or t
  misc_feature (619)..(624): n is a, c, g, or t
  misc_feature (626)..(627): n is a, c, g, or t
  misc_feature (629)..(630): n is a, c, g, or t
  misc_feature (632)..(636): n is a, c, g, or t
  misc_feature (638)..(640): n is a, c, g, or t
  misc_feature (647)..(649): n is a, c, g, or t
  misc_feature (651)..(651): n is a, c, g, or t
  misc_feature (653)..(653): n is a, c, g, or t
  misc_feature (658)..(662): n is a, c, g, or t
  misc_feature (664)..(664): n is a, c, g, or t
  misc_feature (666)..(668): n is a, c, g, or t
  misc_feature (670)..(670): n is a, c, g, or t
  misc_feature (672)..(675): n is a, c, g, or t
  misc_feature (677)..(679): n is a, c, g, or t
  misc_feature (684)..(684): n is a, c, g, or t
  misc_feature (686)..(690): n is a, c, g, or t
  misc_feature (692)..(698): n is a, c, g, or t
  misc_feature (700)..(700): n is a, c, g, or t
  misc_feature (702)..(704): n is a, c, g, or t
  misc_feature (707)..(709): n is a, c, g, or t
  misc_feature (712)..(712): n is a, c, g, or t
  misc_feature (714)..(714): n is a, c, g, or t
  misc_feature (716)..(717): n is a, c, g, or t
  misc_feature (719)..(719): n is a, c, g, or t
  misc_feature (723)..(723): n is a, c, g, or t
  misc_feature (725)..(727): n is a, c, g, or t
  misc_feature (729)..(729): n is a, c, g, or t
  misc_feature (731)..(732): n is a, c, g, or t
  misc_feature (734)..(734): n is a, c, g, or t
  misc_feature (736)..(736): n is a, c, g, or t
  misc_feature (738)..(739): n is a, c, g, or t
  misc_feature (742)..(742): n is a, c, g, or t
  misc_feature (747)..(747): n is a, c, g, or t
  misc_feature (749)..(749): n is a, c, g, or t
  misc_feature (752)..(754): n is a, c, g, or t
  misc_feature (756)..(768): n is a, c, g, or t
  misc_feature (770)..(771): n is a, c, g, or t
  misc_feature (773)..(773): n is a, c, g, or t
  misc_feature (775)..(778): n is a, c, g, or t
  misc_feature (782)..(782): n is a, c, g, or t
  misc_feature (785)..(787): n is a, c, g, or t
  misc_feature (791)..(792): n is a, c, g, or t
  misc_feature (794)..(795): n is a, c, g, or t
  misc_feature (797)..(800): n is a, c, g, or t
  misc_feature (802)..(802): n is a, c, g, or t
  misc_feature (805)..(805): n is a, c, g, or t
  misc_feature (812)..(812): n is a, c, g, or t
  misc_feature (814)..(818): n is a, c, g, or t
  misc_feature (821)..(823): n is a, c, g, or t
  misc_feature (830)..(830): n is a, c, g, or t
  misc_feature (832)..(836): n is a, c, g, or t
  misc_feature (838)..(840): n is a, c, g, or t
  misc_feature (846)..(847): n is a, c, g, or t
  misc_feature (850)..(851): n is a, c, g, or t
  misc_feature (853)..(854): n is a, c, g, or t
  misc_feature (857)..(857): n is a, c, g, or t
  misc_feature (859)..(860): n is a, c, g, or t
  misc_feature (862)..(863): n is a, c, g, or t
  misc_feature (865)..(865): n is a, c, g, or t
  misc_feature (869)..(870): n is a, c, g, or t
  misc_feature (872)..(874): n is a, c, g, or t
  misc_feature (876)..(877): n is a, c, g, or t
  misc_feature (881)..(881): n is a, c, g, or t
  misc_feature (884)..(884): n is a, c, g, or t
  misc_feature (886)..(889): n is a, c, g, or t
  misc_feature (891)..(892): n is a, c, g, or t
  misc_feature (895)..(898): n is a, c, g, or t
  misc_feature (900)..(900): n is a, c, g, or t
  misc_feature (902)..(906): n is a, c, g, or t
  misc_feature (909)..(910): n is a, c, g, or t
  misc_feature (912)..(912): n is a, c, g, or t
  misc_feature (915)..(919): n is a, c, g, or t
  misc_feature (921)..(925): n is a, c, g, or t
  misc_feature (929)..(935): n is a, c, g, or t
  misc_feature (937)..(943): n is a, c, g, or t
  misc_feature (945)..(946): n is a, c, g, or t
  misc_feature (948)..(949): n is a, c, g, or t
  misc_feature (951)..(957): n is a, c, g, or t
  misc_feature (959)..(960): n is a, c, g, or t
  misc_feature (962)..(963): n is a, c, g, or t
  misc_feature (965)..(965): n is a, c, g, or t
  misc_feature (968)..(969): n is a, c, g, or t
  misc_feature (971)..(978): n is a, c, g, or t
  misc_feature (981)..(984): n is a, c, g, or t
  misc_feature (987)..(990): n is a, c, g, or t
  misc_feature (996)..(997): n is a, c, g, or t
  misc_feature (999)..(999): n is a, c, g, or t
  misc_feature (1002)..(1009): n is a, c, g, or t
  misc_feature (1011)..(1011): n is a, c, g, or t
  misc_feature (1014)..(1014): n is a, c, g, or t
  misc_feature (1016)..(1016): n is a, c, g, or t
  misc_feature (1018)..(1019): n is a, c, g, or t
  misc_feature (1021)..(1022): n is a, c, g, or t
  misc_feature (1024)..(1025): n is a, c, g, or t
  misc_feature (1027)..(1028): n is a, c, g, or t
  misc_feature (1033)..(1034): n is a, c, g, or t
  misc_feature (1036)..(1037): n is a, c, g, or t
  misc_feature (1039)..(1041): n is a, c, g, or t
  misc_feature (1043)..(1044): n is a, c, g, or t
  misc_feature (1048)..(1051): n is a, c, g, or t
  misc_feature (1054)..(1056): n is a, c, g, or t
  misc_feature (1058)..(1061): n is a, c, g, or t
  misc_feature (1063)..(1066): n is a, c, g, or t
  misc_feature (1068)..(1068): n is a, c, g, or t
  misc_feature (1071)..(1074): n is a, c, g, or t
  misc_feature (1077)..(1077): n is a, c, g, or t
  misc_feature (1080)..(1080): n is a, c, g, or t
  misc_feature (1082)..(1082): n is a, c, g, or t
  misc_feature (1084)..(1086): n is a, c, g, or t
  misc_feature (1088)..(1088): n is a, c, g, or t
  misc_feature (1094)..(1098): n is a, c, g, or t
  misc_feature (1100)..(1102): n is a, c, g, or t
  misc_feature (1104)..(1110): n is a, c, g, or t
  misc_feature (1113)..(1114): n is a, c, g, or t
  misc_feature (1116)..(1117): n is a, c, g, or t
  misc_feature (1119)..(1119): n is a, c, g, or t
  misc_feature (1121)..(1122): n is a, c, g, or t
  misc_feature (1125)..(1125): n is a, c, g, or t
  misc_feature (1127)..(1130): n is a, c, g, or t
  misc_feature (1133)..(1136): n is a, c, g, or t
  misc_feature (1138)..(1138): n is a, c, g, or t
  misc_feature (1146)..(1150): n is a, c, g, or t
  misc_feature (1154)..(1154): n is a, c, g, or t
  misc_feature (1159)..(1160): n is a, c, g, or t
  misc_feature (1162)..(1162): n is a, c, g, or t
  misc_feature (1167)..(1167): n is a, c, g, or t
  misc_feature (1169)..(1169): n is a, c, g, or t
  misc_feature (1172)..(1178): n is a, c, g, or t
  misc_feature (1182)..(1182): n is a, c, g, or t
  misc_feature (1185)..(1189): n is a, c, g, or t
  misc_feature (1191)..(1191): n is a, c, g, or t
  misc_feature (1196)..(1197): n is a, c, g, or t
  misc_feature (1199)..(1203): n is a, c, g, or t
  misc_feature (1205)..(1205): n is a, c, g, or t
  misc_feature (1208)..(1208): n is a, c, g, or t
  misc_feature (1211)..(1213): n is a, c, g, or t
  misc_feature (1215)..(1220): n is a, c, g, or t
  misc_feature (1222)..(1223): n is a, c, g, or t
  misc_feature (1225)..(1225): n is a, c, g, or t
  misc_feature (1227)..(1228): n is a, c, g, or t
  misc_feature (1231)..(1232): n is a, c, g, or t
  misc_feature (1235)..(1237): n is a, c, g, or t
  misc_feature (1239)..(1239): n is a, c, g, or t
  misc_feature (1241)..(1241): n is a, c, g, or t
  misc_feature (1243)..(1243): n is a, c, g, or t
  misc_feature (1246)..(1246): n is a, c, g, or t
  misc_feature (1250)..(1250): n is a, c, g, or t
  misc_feature (1252)..(1253): n is a, c, g, or t
  misc_feature (1256)..(1256): n is a, c, g, or t
  misc_feature (1258)..(1258): n is a, c, g, or t
  misc_feature (1264)..(1266): n is a, c, g, or t
  misc_feature (1269)..(1271): n is a, c, g, or t
  misc_feature (1273)..(1274): n is a, c, g, or t
  misc_feature (1277)..(1277): n is a, c, g, or t
  misc_feature (1279)..(1280): n is a, c, g, or t
  misc_feature (1282)..(1285): n is a, c, g, or t
  misc_feature (1289)..(1290): n is a, c, g, or t
  misc_feature (1293)..(1296): n is a, c, g, or t
  misc_feature (1299)..(1300): n is a, c, g, or t
  misc_feature (1302)..(1302): n is a, c, g, or t
  misc_feature (1304)..(1307): n is a, c, g, or t
  misc_feature (1311)..(1312): n is a, c, g, or t
  misc_feature (1315)..(1317): n is a, c, g, or t
  misc_feature (1319)..(1321): n is a, c, g, or t
  misc_feature (1323)..(1327): n is a, c, g, or t
  misc_feature (1330)..(1336): n is a, c, g, or t
  misc_feature (1339)..(1339): n is a, c, g, or t
  misc_feature (1341)..(1342): n is a, c, g, or t
  misc_feature (1344)..(1344): n is a, c, g, or t
  misc_feature (1348)..(1348): n is a, c, g, or t
  misc_feature (1350)..(1353): n is a, c, g, or t
  misc_feature (1356)..(1356): n is a, c, g, or t
  misc_feature (1358)..(1358): n is a, c, g, or t
  misc_feature (1360)..(1360): n is a, c, g, or t
  misc_feature (1362)..(1365): n is a, c, g, or t
  misc_feature (1367)..(1368): n is a, c, g, or t
  misc_feature (1370)..(1370): n is a, c, g, or t
  misc_feature (1373)..(1374): n is a, c, g, or t
  misc_feature (1377)..(1378): n is a, c, g, or t
  misc_feature (1380)..(1383): n is a, c, g, or t
  misc_feature (1385)..(1386): n is a, c, g, or t
  misc_feature (1388)..(1389): n is a, c, g, or t
  misc_feature (1394)..(1395): n is a, c, g, or t
  misc_feature (1397)..(1398): n is a, c, g, or t
  misc_feature (1401)..(1403): n is a, c, g, or t
  misc_feature (1405)..(1410): n is a, c, g, or t
  misc_feature (1412)..(1412): n is a, c, g, or t
  misc_feature (1414)..(1414): n is a, c, g, or t
  misc_feature (1417)..(1420): n is a, c, g, or t
  misc_feature (1422)..(1425): n is a, c, g, or t
  misc_feature (1461)..(1462): n is a, c, g, or t
  misc_feature (1465)..(1467): n is a, c, g, or t
  misc_feature (1469)..(1479): n is a, c, g, or t
  misc_feature (1482)..(1482): n is a, c, g, or t
  misc_feature (1485)..(1485): n is a, c, g, or t
  misc_feature (1487)..(1488): n is a, c, g, or t
  misc_feature (1490)..(1490): n is a, c, g, or t
  misc_feature (1527)..(1543): n is a, c, g, or t
  misc_feature (1545)..(1547): n is a, c, g, or t
  misc_feature (1550)..(1551): n is a, c, g, or t
  misc_feature (1553)..(1553): n is a, c, g, or t
  misc_feature (1555)..(1556): n is a, c, g, or t
  misc_feature (1593)..(1601): n is a, c, g, or t
  misc_feature (1604)..(1605): n is a, c, g, or t
  misc_feature (1609)..(1622): n is a, c, g, or t
  misc_feature (1659)..(1660): n is a, c, g, or t
  misc_feature (1662)..(1667): n is a, c, g, or t
  misc_feature (1669)..(1670): n is a, c, g, or t
  misc_feature (1672)..(1672): n is a, c, g, or t
  misc_feature (1674)..(1680): n is a, c, g, or t
  misc_feature (1683)..(1688): n is a, c, g, or t
  misc_feature (1725)..(1732): n is a, c, g, or t
  misc_feature (1734)..(1746): n is a, c, g, or t
  misc_feature (1748)..(1749): n is a, c, g, or t
  misc_feature (1751)..(1754): n is a, c, g, or t
  misc_feature (1791)..(1815): n is a, c, g, or t
  misc_feature (1817)..(1820): n is a, c, g, or t
  misc_feature (1857)..(1859): n is a, c, g, or t
  misc_feature (1861)..(1865): n is a, c, g, or t
  misc_feature (1867)..(1869): n is a, c, g, or t
  misc_feature (1871)..(1881): n is a, c, g, or t
  misc_feature (1883)..(1886): n is a, c, g, or t
  misc_feature (1925)..(1939): n is a, c, g, or t
  misc_feature (1941)..(1944): n is a, c, g, or t
  misc_feature (1946)..(1947): n is a, c, g, or t
  misc_feature (1949)..(1952): n is a, c, g, or t
  misc_feature (1989)..(1996): n is a, c, g, or t
  misc_feature (1998)..(1999): n is a, c, g, or t
  misc_feature (2001)..(2010): n is a, c, g, or t
  misc_feature (2012)..(2015): n is a, c, g, or t
  misc_feature (2017)..(2018): n is a, c, g, or t
  misc_feature (2324)..(2324): n is a, c, g, or t
nnnnnnncnnncancgcnnnnannnnnnnnnnnnnnnnnnntnnnnnnnnnaaannnnntgnnncnntncgnaaaanncnnnnnnnntnnnnnnnngcnncnnnnctnccnannnannnnnnnnngnnnnnngnagnnnancnnnccnnngntttnntcnnncnntgcacnnannnnnnggnnnnnncnnnnnnangnanagnnanngncnncncngtnnnnnnnnnnaanctcanngnnnnnnnnnacnncntngnnnncnntatcnnnngnaannnnnnntnnnanaangnannanaaannntnnntntncnnnnnanntnnannnnnnnnntgnnnnntgnnntcngnnancnnnnnnnnaanagnnncnnnntnnnactnncngaanacnnnnccannannnnctnncnnnannnnnnncnnnnanannacgnacnnnnaannnnnngnaaannnnttnnnannatcnnnnnnnnnnnaanagngnnantannnnntnccnnnannnnnnctnntnnnnnnanannnnnncnnnnnnnnnnnanagcnccnntntncnntncnnannnnntctnccntnnnnnnanncannnnannnncnccactngnnnccctnnnnnntnncnncnnnnncnnntgccgcnnnancngccgnnnnntncnnncnannnntnnnttccncnnnnncnnnnnnnanannngcnnnganancnncnatanannncncnncngntnncanttccncnacnnntnnnnnnnnnnnnncnntntnnnnatcnctnnnaagnncnncnnnntnctnttccgcnannnnnttnnntcccgcntnnnnncnnngagccnnaannanngcntnnanntnctcnncnnngnnttcnttnannnnannatnnnncntnnnnntcnnantannnnntnnnnnattnnnnnnnannnnnnnanncnntnnnnnnncnntnntnacnnannnnnnnnaannnnaannnnaaaaanncnccnnnnnnnntncgncngnnanncnntnntcatnncnntnnncnnaatnnnngtnnncnnnntnnnntntcnnnnatnccngnannngnaaatcnnnnnannncnnnnnnnaannanntncnncanannnnagnnnnantataccannnnnttcnaatcnnantaacnanatnnnnnnntcanatnnnnnanaaacnnannnnngnatnccnnnannnnnnanncntnntanntcnnntncncnganatantnnctntnaaccannntcnnnanncananngnnnnaagnnatnnnncannanannnncaannatnnncnnntnnnnncannnnnnnaantnncnatgnannnngcnancntnnnnanntntannaannannnncnnannaaaanngnnctnnncnnnnnnangnagnnnncnnnnttttaccactatctggaattacatcactctcaaacnnaannngnnnnnnnnnnnaanaantnntngttttaccactatctggaattacatcactctcaaacnnnnnnnnnnnnnnnnngnnnatnntngnngttttaccactatctggaattacatcactctcaaacnnnnnnnnnagnnaccnnnnnnnnnnnnnngttttaccactatctggaattacatcactctcaaacnnannnnnnanncngnnnnnnnatnnnnnngttttaccactatctggaattacatcactctcaaacnnnnnnnnannnnnnnnnnnnntnntnnnngttttaccactatctggaattacatcactctcaaacnnnnnnnnnnnnnnnnnnnnnnnnntnnnngttttaccactatctggaattacatcactctcaaacnnnannnnnannncnnnnnnnnnnntnnnngttttaccactatctggaattacatcactctcaaacatnnnnnnnnnnnnnnngnnnntnntnnnngttttaccactatctggaattacatcactctcaaacnnnnnnnntnntnnnnnnnnnntnnnnanngttttaccactatctggaattacatcactctcaaacctcaaatttcaatctcaatttgcgtatctattaaagtcctctacgagtaaaactgctatcacttggcagtgcaattcggatatggtaaaaatttactcaaaaatttgacataaatcttcatcaataataaataaattttctaattctattttatcataacatttcccttctaaaagaataaactgtaatttttcttctaacgcgttgttataaaacgactcttttatctctttcggtaagaaatcccgaaatccatggaagaaaaagcangtttcaccaaacaggatgttccagtttttcataaaagacaacatttgttctggaagattcgtcccttccatatcaatgcgaagatgaatcgctttcatcatctctataagatcgacgtccatatcataagtaagaggaagcggtacctgttgtgataaatgctctgcatatgtaagaatatttcccatggctgtccttgtttcccggtaaaaactttcagtcatcgcttcttctcttagtgcagcaaataatttggtcaagattttcctattattaaaatccatatccaaaggactaagaagcaatactgatttctttctaagatctaaatgtgtctcctcttcaaaaagaacaaaacctcctgtgtctccttgtatctgcctgtacaactccatcagcctgtcataatgataaagaggattttccatagaaatgacagggatatcctgttcctccatacatacggttttctcccactccggataggaaagtttcataaaatcaccaatctatcatgactatcaataacttcttttttcttctctcccaaaataagttccatacccgcatattgcctttctgtaaccgtcagtacttgtatcaggccctcttccggtttcatacatttgatgtgcttgaccgctatacctgctgctacaggatttaaaacaatttttgtgtatacagactcctgcatcatgataaatccgtcagaaatcaatgctctccgaaattgtatatacgcctttctttgctgcgccgtttctaccggcaggtcaaacagcaccatcactcgcataaacctattcctcatatatctctgaataaaaagacaataaagataagtcttgttcctctaaagcacgaaaaacgctccggcagtatattcctatcgcatgtgttacggtggtcttctttcctttgattaaaacttgtcggttcaatatatctataagttgatgcttctcttcagtagtcaacttctgcggtgccatccgcagtacaagcatatccaccataggtctgaaaggctccatcaaatcactccccaaattaaacggattaaatatattatcatgaaacaatccaatttgtgtcatatagcctgaagcggcgatttcccgattacaagcggagagaataacggcatacccataattaagcgccccattctctacggtttcatctcttcttgaaaaatcctttccccataatgcattaaaatagacttttgccgcatgaccttctctattcgttatatcacctggctctacttctttcatatatcgctctaacaacctggcttctttactgcactcaaaagcaatcagcacctgtttttgcttatcgattttctctttaacgatctgcgcccatatttcttttttcagacaagaatcccacttcagctgggaacggatctgccggctggaatcatggctccctcgataaggaagtatctctcctgccggatttcttctttcatcgcagaaaataattttgatttttcggtgaagacattcgttgatccacgcggcagtcagcgaaacagccgtagtttcaatcatgaccgtctccacttcttccataaatatccggtgaacttcttctccccttataaccatatatcccaagctatattctatttttgcccgtttagatagtacaaccgtccg

SEQ ID NO: 374 - DNA, 4000 bp, Escherichia coli
  misc_feature (444)..(444): n is a, c, g, or t
  misc_feature (477)..(477): n is a, c, g, or t
  misc_feature (777)..(777): n is a, c, g, or t
  misc_feature (1401)..(1401): n is a, c, g, or t
  misc_feature (1464)..(1464): n is a, c, g, or t
  misc_feature (1470)..(1470): n is a, c, g, or t
  misc_feature (1473)..(1473): n is a, c, g, or t
  misc_feature (1989)..(1989): n is a, c, g, or t
  misc_feature (3278)..(3279): n is a, c, g, or t
  misc_feature (3293)..(3293): n is a, c, g, or t
  misc_feature (3817)..(3817): n is a, c, g, or t
  misc_feature (3837)..(3837): n is a, c, g, or t
  misc_feature (3845)..(3845): n is a, c, g, or t
  misc_feature (3850)..(3850): n is a, c, g, or t
  misc_feature (3857)..(3857): n is a, c, g, or t
agccggatatggttcggcgtgatttcaaccagttcgtcatcatcgataaattcaattgcctgctccagggtgtacttcaccggcggcgtcagcacaatattttcatcggtgcccgatgcccgcacattggtcaactgcttgcctttaatcgggttgacgggcaagtcattccctcgggaatgaattccaacaatcatgccttcatagatcgcttcgttcggattgataaagagtcttcctctgggctgcaggttaaacaagctaaagcctaaactcttgccactcaccatggagaccaaaacaccgttgcgtcttgagttgatgtcttcgcctgaacgcaagtcgtagtgggagaacacgctactgatgatcccgccaccggaggtcaaggtcatgaattccgatcgaaagccaattaaaccgcgagttggaatgacaaagtcnagtcgaacccgtccctttgaatccgggaccatnttactgagtgagcctttgcgggtgccaatcacttccatgatggcgccttggtgtatctgctcgcaatcgatactcagattttcgaagggctcatgaatctcgccatcgacctccttgagaatcacttctggacgcgacacaccaagttcatacccttcccggcgcatggtctcgatgagaacccccaaatgcagctcacctcgacccgacaccacaaacttatcggccgtatcgcccggggcaactcgcaacgccacgttgtattgcaactcaagctctaaacgatcctttaaatttcgnctggttacgaacttcccatcctgaccggagaaaggcgacgtgttgacctgaaacgtcatcgagatggttggctcatcaaccaccaaggctggtaacgcctcaggctgatcgacctgacacaaggtgtctgaaatcttcaaaccatcgataccgcatacacaaacgatatcaccggcactggcggattcaatttcaacgcggcttaatccagaaaagcccattacctgcagaattctgcccttcttaacttggccttcggcattcaccaccgccacactctgaccctttcgaatctcacctcgggtgatgcggccaagaccgatgagcccgacatagctgttgtagtccaacgcactgatttgcatttggagtgggccactttcttcaacctgcggtggtggcacctgatcaacaatcaggtccaacaaataacttaagtctgaccctaaatcatcgcgactcggacctgcaatcccctgcattgcagagccgacaacgacgggaaagtcgagctgctcttcggttgcacccaattgatcgaacaactcaaagacttcatcaatcacccagtctggccgggcgccgtcacgatcgatcttgttaaccattaaaatagggttgagnttattttcaaacgcctttcgggtcacaaaccgggtttgcggcatgggcccttcgaccgcatcnacgagnaanagaaccgagtcgaccatactcaagatccgctcgacctcaccgccaaaatcagcgtgaccgggcgtatcaacaatattgatgcgaacgccgcgccaatctaacgcagtatttttcgcaaggatggtaatgccgcgttctttttcgaggtcattggaatccatcaaacgctcgccgctttcatctcctcgctgcagggcgccggcctgcgatagcaacttgtcgatcaaggttgtttttccatggtcaacgtgcgctatgatagcgacattgcgtagattttgagacataacgagcaatccgaaaaggcttaagggccgaaggagcgggattatactgaaatccgcctccggtgcgaggattctgggcaacaaggtcatcaaggatttcaggcgatagcggtttggcatcaacgatcatcaattttatgccgcctgaaggacaagaacccttgggccaaatcgtctaagacgctaatggccgttattgctctattttggtgcgagcctgttattcagngcgctattttggtgcaaaatggccgccgctgaatctttacttccgataaatacgataggtatcagttacttaaacccttttagctcatggcatagtctttgctttttcttacccaagcaaagccaagtgttggggctttaccgttttcaacccgcgaagggtctggctggcgacgttgcgagcacaggaccttcgttacaaaccaaggagttaactcaatgatgaaggcaaaattagaatatatctggctcgacggctatgagcccacccaaagcctacgcagcaaaacaatggttcgatctgacttctcgggcaagcttgaagactgtccaatgtgggtcttcgatggcagctcgaccgaacaagccgagggcggcagctcagactgcctactcaaacctgttgccatcatccccgatcccgatcgcaacaatggctatcttgtcatgacagaagtcttaaatcccgatggtagcccccatgtttccaacggacgggcaacgatcgatgacgatgatgctgatttttggttcggttttgagcaagagtacttcttgtgggataccgacaccgatttaccacctggctttcctcgtggcggcttccctggacctcaaggcccgtactactgcagtgttggcgcgagcaacaccttcggccgagatttcgtcgaagagcacttggacatctgcctcgaggccggcctcaacgtcgaagggatcaacgctgaagttgcaaccgggcagtgggaattccaaattttcgccaaaggcgcgcatgaagcgggggaccaaatttggctagcgcgctacctgctcgagcgtacgggcgagaaatacggctacgccattaattatcatcccaaaccccttggcgatacggactggaatggctctggcatgcacgcgaacttctccaacgccgccatgcgggatctcggtgacgaagccgtttttacaaaaatttgtgaaaactttgggcgtcacatcgagcgtcacatgagcgtttatggtgcctacaatgaccagcgcttaacgggcaagcatgaaacacagtcgatcgatcagttcagctatggtgtctctgatcgtggcgcgagcattcgcatccccgtcagcaccgtggtggatggctggaaaggccgcttagaggaccgaagaaccgcctctaatgccgacccttataaggtcgccgccgccatcatcaagaccagcaaagaagcactggcctgatccaaccgctcgagcaccccttaagggcgtgctcgagcacttcttcgacaaggcaanngctggcaatcccgnttaccactgccaatccagcatcctctgcgcctaccgattttttctaagctggctttccgccactttgttttatactgtttaaaccgtcatcaatcggataatgccatggcccgtctgatcctcaaccttattttcgcagcccttctgctcaccacaggatcgtttaccgcggctcagcaggatgacccgagctatcgtttgcgcctggtgtcgagcttgggtgagccaaaagttcaggccattgccggacaactgccttttaatgtgcaggttaaaccgagactcgcaaagcaccatgccctctacatcgaaactgaggatggccaaatcagagccgccgcagcccccggtgaaaccatcgtgcaagccgtcccccgcgggctgcacactttttatttgatcattaaagaggtcaaaaccggtcgagagatcagtcgatcagccccccttgaccttgatgttcggcgctatatttcacgccaataaccttgagcgcaccaaattggtgcggtaaactcgcgaantccctggccctgccaccctnaatcaggnatccngcgcctnttttaattggtgcggatcttgcttttaaactggcatgaatcaaacattccaacaatcatcacaacattaccgacagcttatggaccaaaccgccattgataacttgaccacggccgtcctgctgctcgatcgaaacttgaacc

SEQ ID NO: 375 - DNA, 4000 bp, Escherichia coli
  misc_feature (479)..(491): n is a, c, g, or t
  misc_feature (493)..(493): n is a, c, g, or t
  misc_feature (495)..(497): n is a, c, g, or t
  misc_feature (499)..(502): n is a, c, g, or t
  misc_feature (504)..(505): n is a, c, g, or t
  misc_feature (507)..(511): n is a, c, g, or t
  misc_feature (513)..(518): n is a, c, g, or t
  misc_feature (520)..(525): n is a, c, g, or t
  misc_feature (528)..(532): n is a, c, g, or t
  misc_feature (534)..(534): n is a, c, g, or t
  misc_feature (538)..(541): n is a, c, g, or t
  misc_feature (543)..(544): n is a, c, g, or t
  misc_feature (546)..(547): n is a, c, g, or t
  misc_feature (549)..(549): n is a, c, g, or t
  misc_feature (551)..(551): n is a, c, g, or t
  misc_feature (553)..(555): n is a, c, g, or t
  misc_feature (558)..(561): n is a, c, g, or t
  misc_feature (563)..(568): n is a, c, g, or t
  misc_feature (570)..(572): n is a, c, g, or t
  misc_feature (576)..(583): n is a, c, g, or t
  misc_feature (587)..(590): n is a, c, g, or t
  misc_feature (593)..(595): n is a, c, g, or t
  misc_feature (598)..(598): n is a, c, g, or t
  misc_feature (600)..(612): n is a, c, g, or t
  misc_feature (614)..(619): n is a, c, g, or t
  misc_feature (622)..(624): n is a, c, g, or t
  misc_feature (627)..(630): n is a, c, g, or t
  misc_feature (632)..(634): n is a, c, g, or t
  misc_feature (636)..(636): n is a, c, g, or t
  misc_feature (638)..(645): n is a, c, g, or t
  misc_feature (647)..(650): n is a, c, g, or t
  misc_feature (653)..(655): n is a, c, g, or t
  misc_feature (657)..(670): n is a, c, g, or t
  misc_feature (672)..(673): n is a, c, g, or t
  misc_feature (675)..(680): n is a, c, g, or t
  misc_feature (683)..(688): n is a, c, g, or t
  misc_feature (690)..(692): n is a, c, g, or t
  misc_feature (694)..(703): n is a, c, g, or t
  misc_feature (706)..(708): n is a, c, g, or t
  misc_feature (710)..(710): n is a, c, g, or t
  misc_feature (713)..(714): n is a, c, g, or t
  misc_feature (716)..(720): n is a, c, g, or t
  misc_feature (723)..(727): n is a, c, g, or t
  misc_feature (729)..(730): n is a, c, g, or t
  misc_feature (732)..(737): n is a, c, g, or t
  misc_feature (739)..(742): n is a, c, g, or t
  misc_feature (744)..(745): n is a, c, g, or t
  misc_feature (747)..(748): n is a, c, g, or t
  misc_feature (750)..(750): n is a, c, g, or t
  misc_feature (753)..(755): n is a, c, g, or t
  misc_feature (758)..(765): n is a, c, g, or t
  misc_feature (767)..(771): n is a, c, g, or t
  misc_feature (773)..(780): n is a, c, g, or t
  misc_feature (784)..(792): n is a, c, g, or t
  misc_feature (794)..(796): n is a, c, g, or t
  misc_feature (798)..(799): n is a, c, g, or t
  misc_feature (802)..(805): n is a, c, g, or t
  misc_feature (809)..(818): n is a, c, g, or t
  misc_feature (821)..(823): n is a, c, g, or t
  misc_feature (825)..(830): n is a, c, g, or t
  misc_feature (832)..(832): n is a, c, g, or t
  misc_feature (835)..(839): n is a, c, g, or t
  misc_feature (841)..(851): n is a, c, g, or t
  misc_feature (853)..(854): n is a, c, g, or t
  misc_feature (863)..(864): n is a, c, g, or t
  misc_feature (866)..(867): n is a, c, g, or t
  misc_feature (870)..(871): n is a, c, g, or t
  misc_feature (873)..(873): n is a, c, g, or t
  misc_feature (875)..(877): n is a, c, g, or t
  misc_feature (880)..(880): n is a, c, g, or t
  misc_feature (882)..(883): n is a, c, g, or t
  misc_feature (889)..(894): n is a, c, g, or t
  misc_feature (900)..(900): n is a, c, g, or t
  misc_feature (902)..(902): n is a, c, g, or t
  misc_feature (904)..(904): n is a, c, g, or t
  misc_feature (909)..(909): n is a, c, g, or t
  misc_feature (913)..(913): n is a, c, g, or t
  misc_feature (915)..(915): n is a, c, g, or t
  misc_feature (917)..(918): n is a, c, g, or t
  misc_feature (921)..(921): n is a, c, g, or t
  misc_feature (923)..(924): n is a, c, g, or t
  misc_feature (929)..(929): n is a, c, g, or t
  misc_feature (932)..(936): n is a, c, g, or t
  misc_feature (939)..(939): n is a, c, g, or t
  misc_feature (941)..(941): n is a, c, g, or t
  misc_feature (949)..(949): n is a, c, g, or t
  misc_feature (951)..(951): n is a, c, g, or t
  misc_feature (956)..(968): n is a, c, g, or t
  misc_feature (970)..(980): n is a, c, g, or t
  misc_feature (984)..(984): n is a, c, g, or t
  misc_feature (986)..(989): n is a, c, g, or t
  misc_feature (991)..(994): n is a, c, g, or t
  misc_feature (997)..(1008): n is a, c, g, or t
  misc_feature (1011)..(1011): n is a, c, g, or t
  misc_feature (1013)..(1014): n is a, c, g, or t
  misc_feature (1018)..(1023): n is a, c, g, or t
  misc_feature (1026)..(1029): n is a, c, g, or t
  misc_feature (1031)..(1039): n is a, c, g, or t
  misc_feature (1041)..(1041): n is a, c, g, or t
  misc_feature (1044)..(1044): n is a, c, g, or t
  misc_feature (1047)..(1051): n is a, c, g, or t
  misc_feature (1053)..(1056): n is a, c, g, or t
  misc_feature (1058)..(1066): n is a, c, g, or t
  misc_feature (1068)..(1068): n is a, c, g, or t
  misc_feature (1071)..(1076): n is a, c, g, or t
  misc_feature (1078)..(1081): n is a, c, g, or t
  misc_feature (1083)..(1085): n is a, c, g, or t
  misc_feature (1088)..(1094): n is a, c, g, or t
  misc_feature (1096)..(1108): n is a, c, g, or t
  misc_feature (1110)..(1113): n is a, c, g, or t
  misc_feature (1115)..(1130): n is a, c, g, or t
  misc_feature (1132)..(1137): n is a, c, g, or t
  misc_feature (1139)..(1167): n is a, c, g, or t
  misc_feature (1169)..(1173): n is a, c, g, or t
  misc_feature (1175)..(1197): n is a, c, g, or t
  misc_feature (1199)..(1205): n is a, c, g, or t
  misc_feature (1208)..(1215): n is a, c, g, or t
  misc_feature (1220)..(1220): n is a, c, g, or t
  misc_feature (1222)..(1230): n is a, c, g, or t
  misc_feature (1232)..(1236): n is a, c, g, or t
  misc_feature (1238)..(1239): n is a, c, g, or t
  misc_feature (1242)..(1242): n is a, c, g, or t
  misc_feature (1244)..(1248): n is a, c, g, or t
  misc_feature (1251)..(1262): n is a, c, g, or t
  misc_feature (1264)..(1275): n is a, c, g, or t
  misc_feature (1277)..(1282): n is a, c, g, or t
  misc_feature (1284)..(1299): n is a, c, g, or t
  misc_feature (1302)..(1311): n is a, c, g, or t
  misc_feature (1313)..(1315): n is a, c, g, or t
  misc_feature (1318)..(1324): n is a, c, g, or t
  misc_feature (1326)..(1329): n is a, c, g, or t
  misc_feature (1331)..(1347): n is a, c, g, or t
  misc_feature (1349)..(1357): n is a, c, g, or t
  misc_feature (1359)..(1362): n is a, c, g, or t
  misc_feature (1364)..(1374): n is a, c, g, or t
  misc_feature (1376)..(1396): n is a, c, g, or t
  misc_feature (1398)..(1409): n is a, c, g, or t
  misc_feature (1411)..(1412): n is a, c, g, or t
  misc_feature (1414)..(1415): n is a, c, g, or t
  misc_feature (1417)..(1420): n is a, c, g, or t
  misc_feature (1426)..(1433): n is a, c, g, or t
  misc_feature (1435)..(1442): n is a, c, g, or t
  misc_feature (1444)..(1447): n is a, c, g, or t
  misc_feature (1451)..(1452): n is a, c, g, or t
  misc_feature (1454)..(1459): n is a, c, g, or t
  misc_feature (1461)..(1461): n is a, c, g, or t
  misc_feature (1463)..(1463): n is a, c, g, or t
  misc_feature (1466)..(1470): n is a, c, g, or t
  misc_feature (1482)..(1482): n is a, c, g, or t
  misc_feature (1496)..(1496): n is a, c, g, or t
  misc_feature (1498)..(1498): n is a, c, g, or t
  misc_feature (1500)..(1500): n is a, c, g, or t
  misc_feature (1513)..(1513): n is a, c, g, or t
  misc_feature (1517)..(1517): n is a, c, g, or t
cttggaaaatccgcatatcattcgtacctttaaatacagttggttggatgtaataaccaccttccatatttccagtagtctctgcggcaccaccaccaatcaacaattcagcgccttcttttttcccaatatccatgtacgatagaattttttcgaattgctcacgcgatgcttgcgcaccaaccattgtatttgagtcaagtggatcactttgaacaattgctttaatgcgctccaaacatcgagccatgaagtcatcataaatatcttcatggatcaacgcacggcttgggcaagtacaaacttcgccttgattaaatgcaaacaatactagaccttcaatagctttatcaaagaatgcatcatcttcatccatgatatctttgaagaaaatatttggtgatttaccacctaattctaatgtgcatggaatgatatttgcagaagcatattgcattatcaaacgaccagttgttgtnnnnnnnnnnnnngnannntnnnnannannnnnannnnnngnnnnnngcnnnnnancctnnnnannanngncntnnnctnnnntnnnnnngnnngcannnnnnnnatcnnnnatnnnttnannnnnnnnnnnnntnnnnnnggnnnttnnnncnnntngnnnnnnnncnnnncannntnnnnnnnnnnnnnnanntnnnnnnttnnnnnncnnnannnnnnnnnnaannntncanngnnnnnttnnnnnanntnnnnnnannnntnntnngnagnnntannnnnnnntnnnnncnnnnnnnncacnnnnnnnnncnnntnnggnnnnaatnnnnnnnnnnaannnannnnnntnatnnnnngnnnnnnnnnnntnngaattagtnntnncanntntnnnttnannattttnnnnnntttctncntnattcnttgntnannatntnngtttnttnnnnngcncnttattgtncnggatnnnnnnnnnnnnncnnnnnnnnnnntttnannnntnnnnttnnnnnnnnnnnnttngnnaaannnnnnaannnntnnnnnnnnnantanaannnnngnnnnannnnnnnnnantannnnnnannnntnnnatnnnnnnnannnnnnnnnnnnntnnnngnnnnnnnnnnnnnnnncnnnnnnannnnnnnnnnnnnnnnnnnnnnnnnnnnntnnnnntnnnnnnnnnnnnnnnnnnnnnnncnnnnnnnctnnnnnnnntattntnnnnnnnnntnnnnnannttntnnnnnttnnnnnnnnnnnngnnnnnnnnnnnnannnnnnannnnnnnnnnnnnnnnttnnnnnnnnnntnnnaannnnnnnannnnannnnnnnnnnnnnnnnnannnnnnnnntnnnntnnnnnnnnnnnannnnnnnnnnnnnnnnnnnnngnnnnnnnnnnnntnnannannnnaaaagnnnnnnnnannnnnnnncnnnnaaanngnnnnnncncnaannnnngtgggggcaccngaaatatgctgaantnanttattattttagntaanaaaaagtagtttctttaagtccaatcgagggccacctggccacgataagctgtaatttttacctctgccattatttcaccatacttttcaaaaaactcttcaccatttttttcccagattttgttacagtcttcatatgcagccatatctttatattcaagccagttacccatcattaattttccttcagggagaaatagacggctagaatgaaatcttatcataccttgtggtctcagcttatcagcaagtaaagccatttccttttcaaatatttcatgtgatttatccataatttcttggttgggatattcaattgttgtaaaactaattattgtatcggacaacttattctctccttgtatcaaatattaacttatgtgttaatttctacatactttgtgagtgaagttaataattacgtaaggtaataaattggtttagcttgaattgttataaactttatgtatcgttacttcgtggtcggtcactagcccacattaaaaaaaggccctgtcaaaaatttgattaggagcctgtatgtattccaaaacaaatattctatctgatgatttaatttacatttttgataaaaagacgggtgagaaatttttcaaacaatcttctacacagttttgccagatagttcattataaaataaaatcagagaaatctggtgaaacacttttactatcagcggatggaataaaacgccgttttacccaaactcctcatacagaacataaacaattaaaagacatttttagatggctgcaaaaaattagatgattaatgtgattcagagcatttagtgaagcggctcatcaccaatttcagccatttttttatctaatagtgctctcattttctttttaatatttgtgtattttggattattgatttcgttaaaaagttccaaaggatcttttttacaatcaaataactcccattcacgatcttcaccgccgtgatttgttccaggtaagttaaagccctcgttgtaccaataaatcaatttataattttgatcccggatcccgtaatgagagtatgcattgtggtcaggatctttatgcatccaatatcggtgatatgccacctgtggccaattttcaggaatagtattccttagtaacggttttaaacttttaccctgcatatatgagggagtttttaaccctgcaaaatctaagaatgttggagcaaaatctacgttgcagcaaatatcatcagatatttgaccagattttatttcaattggataacgacacagaaaaggcatttgaaatgactcttcataaataaatcgcttatcaaaccagccgtgttcacctaagaaaaaaccctgatctgatgtatagattacaattgtattttccgttaaatgattttcatcaagataatctaagagttgaccaacactttcatctatcgaagcaatagtagcgagatatcttttcatgtatctttgatatttaaattggtgaaattctttttgagtttcaaagctaaatcgttcaccggtgtgtttatctatgagtattagattttttacattggaggggtttggaattttgcgttttgaacttttaggtcttgtacgtaatccaatttctgatccaccctctggctggaccaagccaagatcgtcataagtaacgtcatcttttattcgcatcttagcctcagcagcggctttggctcgatttttatagtcatcatcaaaggtactgggaactttaatatcagatgtaaaaagctctcgatattttggatgaggttcccattctcggtgtggagctttatgatggcacattaagaaaaatggttttttagaatttcttgatttgagccaagctaaacttttctctgttataatttctgtagcgtaaccatgttcttcaacctcttgacccatttcaataaaatgagggtcaaaataatctccctgacctggtaaaacagaccaataatcaaaaccagtaggttcatgatttttgccttctccaaggtgccatttacctacgattgcagtttgatagcctccagtttgaaggtgcttggcaacgttaggcatcttattgttcataggggtattcaaagtagtaacacaatttacgtgattgtaagttcccgcaaggatcgctgctctacttggtgtgcaaattgaatttgttacataacaatgattaagtcgaatgccttcatttgcaatacgatcaatatttggagtgttgttaatgccatactcatatgcgcttatggcttttgaagcatggtcatcagccattataaataaaatatttggttgttcagacaaagcaaacctatcaattgtattatttaaatctaatcaaataaattttgataaagcaattagttaatatcaagaacagcagccagttgtacactttggttttttaattggctggagatcactttctgatacaggaaattcacctgtcaatgtcatggtagatatt

SEQ ID NO: 376 - DNA, 4000 bp, Escherichia coli
  misc_feature (436)..(436): n is a, c, g, or t
  misc_feature (3764)..(3764): n is a, c, g, or t
ccagaatggatgattgtcagcgccgatgtacgtttgatcgccgaagaacaggatcaggctgaatggtcgcaaacccctggggcggaacaaacctcgatggccgaagaagggggcgggtttatttcgcgcacccgcttggttgaatcaagctgccggcattttctggcttgggtcaaccgctggcaagatgacgggttccgtccgctttatgacagttggatgcagcggttagaagcatccgcgccaattgatttcgctggtggcgaacaggctgaatggctgggtcttgatgaacatggcggcgcgttggtcaagcttgatggaaaagcatcatcggttatgccacatgaactcgaagctgtttgtggcacgccagttctgccctaaggggctggtctgttatggatagggaattggtaaaccagctatgaaactngcaaaaaccatccggtttgacccgtctgatctgaatgtgtttccgctggcagccgatgaaggcgaatgggcgcttgttggcactttctgctttgccggtattggtgaggccgatattaaaggcaaggtaaaacaagcgtttagcaatgggtttttggggcttgactcaatgggcttctcaaccttggttagcattgtcacggtaaagccggatgatcttgataagattgaaaaacggctttgttcgatttttatgaatgagtttggtgcccctgacgaagcagcggcgatggtcgcggtaactgaagaaatcaagttcatggcagatttatgcgccgaacataaaaccggcactttgctggcgattcagcgcagccttggcgatgatggaattcgcgagtctttccgcagccttgccaagcctgaatcttgcgccgagcagaaaatatggacaatggtcgatgatgatgacccagcagatagtgcagagcatcacgcgcatggtcagggataataggcaccgttgattgggccttcatggagtttgagaacgtaatgagcaatgatttttggcttacatctggatggcatttaacacttcgtgacgatcacgggcatatggtgccaagcgccgattttatgcgcgcctatttcatgcgtgaagaagtggccccggaagaggggtcatgcgatgctgaaattgcgcttcataagaaattggttgatgatccttttgcggcggtggtgccaacggatctatttgaaattgctgataaagatgttgtgcataattatcaggcggttttgcggttccgtaattttctggcagattatccgactttggaatcggcttatatggcaatggcacgcaatgcccagccaaatatcccgccgctgttttttgaacagatagcgcagattattcttcgcaatattcttgatggcgaaaccgatcctttgcaattgcgggcagccgagattctattccgcaatcaggtggtaacgcttgatgatgggcgaatcatggttgctgatcatgcaacagtgcaactgcaatcaggcatgcaaaaggcacttgagccaacaagcgcaaacgatgaggtgcaaattgatattctcgccacggaaacggccgatgaatattgggaacgatccgacctgtttaacacctcaattgacatcgcctatacccagccagcacttgatggtttggcgcgggttttagaaaaatggattgcgcattttctgccgcttgcggttcgcgtttcgccaatggtcaaaatcgaagatgaagcctggtcgtggcatattggtcttgatgccgaagccaccaaaattctgaatgatctgtatcgtggtgacgaggttgacgagcctcgattgcggcgcattttatgtcttttcaaattggaaaccgataacgggtttgtcgctgaaatggcgggtaaaccggtgtatcttgggctggcaatggatgaggcaggagtcgtaagaatgaaaccgcaaaacttgcttgtaaatctgccggttagcgatccatcttaatttaatgcgtaaatatatttaaggctgatctgcagcaggtttcgaatccaacccgccgcagatttaacagcttgattaattcagataatcgtcagttgtgcggggctttggccgatcgcgcatttccatcattttatctttttgctcgaacatggcctcaacacggcaatcctcacacattttcaagatatcggtctttgcgctgtcttgaaacatgctgtgatcggcaagcttgctgatcacccgctcgattgatttcgaactgccaaatggtttgccgcatgatgtgcattcaaatggtgtatcttcgataatcagctcggttgccatcgcgctgtcggcaagattgaattgcggcacaagcgcgatcactttttcagggcaggttgcaacgcaaataccgcattgcagacaggcatcttcacggaacagcaattgcggtgcatcaggattatcctgcaacgcgccagcggggcaagcgctgacacaagacaggcatatcgtacaattgtctgtatcgatctcaacacggccataaggcgcaccagcaggcaaatcaatcacggttcccgccgtgccatttgcattggcaaggccgcgcatggcaagccgtgtcattgaacgcggcgcaccaattgggctgaatggcgctggtttggcattgtttttacatgggctgttgtaaaagatttcggcaaccgcgtcagggtcgacagcatcaacaaggataatgcggttatcagcatcagccttaacaccggcaagcattgatcgtgccaatgtcacctgatcgacaagcggggcattttcaacatctttggccggattcagcagcacaaagacctgctgataaccaagcgcaattgccgccaccataatatcatgtccagcacgacccattgcatgcatcgaaacaggcagcaggctggctggtaaaccacggccaaaacgggcgatggtttcaatcatttcagcgccataggagtcatcatgaagcaacaggcttggggttttgccgccagctgcctgataataatcatgaaggttggcgatactggtcaacaacccgtctgccggcgggtaggcggtttgggctgcacccgatgggcaaacagcgccgcaaagcccgcagccaccgcaaatggccgggtcaatcgcaacatgatcaccaaggctttgaatggcgccggctgggcagacatcaagacagcgtgaacagccgccaattttattgcgtgaatgcgcgcaaagattttcatcaaaattcacatagattggcttttcaaagccgccaatcatttgcgccgcttcgctttcgatgttggcaagcgcgttgatatcatcaccggcggcgcggaaatatccgtcgcgtttttcccagccagtgaaaagtggcgtatcgcctgtcaggtcaatcagaatatcgcagcttgtttcgacatcatttgccggcgtttcaaattgaagcgagtcccggcttgatggtagggccgcgccaaattgatcgatcaccagatcaaaatgcgtgaaatggcctttggcgcttttgattttaccggttgcaaggatgccgcagtcctttgttggaaacagatcatcggttgggttggcaatcataacggtaacgcctaattgaccatttaatttttggccaagcgcaatggcggcatcagcaccgccgttcggacggcccatatcggcataaatcaggcagcggccatcagaatttagcgcaaggcttcgtgatggtgtttggccatcgcctgcctgtttgatcagggcgncgattttggcggtgctggttgctgattcatctgaccagccagcgcgctcacggatattgacggttgcgggcgaggggcattcaatctcttcggcaatggcgtcaaaaactgacgtttcctgcgtacaggcaatcagcaaagattggttcgcgtcgcgcgcatcgcgcatcgcggcggccagatcgcctgtttctgtccggcaaagcgaggttgcgatcgtgcagccaccttcggca

SEQ ID NO: 377 - DNA, 4000 bp, Escherichia coli
  misc_feature (2002)..(2002): n is a, c, g, or t
acagaccatggaccgcacatcggtgctgcctcccccaggctcacccttgaggcgccagctgatcgcgtcctcttcagcatcgtcgccgatgagcatgctcaggcgcacaatgccgctggacacaatcacagaagtcaacgagcagcgagcaatcagcccccccccagaagtgcccgtgacagcaattgcaggcgagacgccgccggaggccccgggccaggtagccgtaaagacagatgcaagcgagccatccgctagcgacgtcacccaagtcgccttgcccagcatccaagcgattctgagcagcgagcatctcgcacgtgagtatcagctgctcctgcaaagacctatcctcgcctccaccaccgttaccgcctcccctgccaccaccgtccccgcctccaccctctccatctctaccaccgccaccgccatcggcgccccctccctcaccaccacgttcaatgccgccgacgatcgccagccgtcccgggggctcgaggccgagaacgccaggctgaggatggaggtgcacgaacttcgaacagtgctggcgaagtgcgagtcgacgaccaagtcaagcagcacgcagtcaaaatcgattagcctagcatcaccgatgccgatgacgccggagatgcaagcatacgtagttaccggctcatcgatagcagccatcgaggcggagcagagtgcgattctgcgtcgctccgccgtaagccacacagatcaagtggcggcgactaccttgaggccagtcatcctggctcccacggtggagaagatgcggctgcacgacctggaagaacaccgtcggctgctggctgtgcgcgtcatccaggccatgtatcgggagtggaaggaggagcgccgccgacggaggcagccgcgggggacgacgaacgacaaagaagcagccgggcgctcgaagcagaaggcgaatgagaaaaagagtatgggccagcttgcactcgctgcgcgcatggccgcgaagaacaagactgagcccagcacagcggacagtgagacggagctaaagaagcgcgtgcctacgagagcgagccgatacatgatggctgcctcgacgtttgtgccaagcaaagggcgcgatgcagatatcagtcagggacgtctcgagcggatcgtgggcataccgcctgctctcgtcttcaacgcaatggagcgcgagcacgcctccgaaacgcttttcagttcgttcagcatcgatagcaccacgccgcgttcagagtggatgtacgtgctctttgaagaggtcgggtcgcgaccagaccgtgtccatgactgcacaccggagcgcgtgggttggcgactgcaagattttgtgctgtgcgacacggcgcgccgcgcctccctcacgcttgaggaggtaattgcaatccgcctttacactgggcccatgagcgagtggtacaattattcgctgcgcgacaggcgcaaggatgagttcacggctaccatccacactatcaactcagcaatcgtcaagctttcgacgctgcagcatgcggccacagtgtatcggcttatgacgatcaccaagcccatcgaccaggtgttcgccatagatgagagtggctcctgctgtggctttgaggtgggcttcctgtccacgacgagcagtcggaatgtcgcgttgcggctttccgagacccgtgttcacaagctagcacccgccggaaagcgcccatcactcacgggcgtcgccaaggcagccaaggttgctgctgaaccggaaaagaggaccgtcctcatgcgcttgagggtagtgcctttcgatcacgctggcgatgtgtcgttcgcttcacaagtccccgctgagggcgagattgtcttcgcgccgctgacgactctcgaggtagttagcttctatgaggacgacgccgacggagtcatcattgccgacgtgcgtgcgcgccgcagccatccagcacgcacgactacacagactatcggcaggatgaaggcgacgcatgtggatctngtggacattatgctcgacgagctcaaggcggccggtgctcccgagccttcgctcctgccactcgcgtgcttgcaattggatcgcaaggccgaggagcgcagctcacagtacaacctcccagacacatacgttgagtacacagcaactgcgctccaagtgcaccagcgcgtcttgcgccaactgagcgccgcgtcgaattgggccgacacgagcggtaaggacgccttcaaccgcatgatcggcgtgatagcactgcaggcgcagacgggcgaaattgaggctgcaatcgagctcgcgaagctcgctttcaagaagtctgggctaaacgcagagataacgaaccttcccgaagaactcggtcgggacatcgagtgggcggagaaggtggccgtcagcaagaagacgaaccaggccatgacagtgatcaagccctcggatgtgaagaagatgttctcatccccagtacatttcattttggaggcggccttgtacttcttcagcttgggagccgctcagccttggccacctctgattgccacgctcctctccaggctcacgcctgctggtcacgtagcatggggcgaactcatgcgcatgcaccttgatcggcagaagaaggtgatcaacaccaacgtgctcgtctggaatgagaagacgaagcgctggcagcaaggggtcatgtcgggtagtgaacgaatggttcgctatggtcatgaagagcgtggcgcgggctccattaagcacttgctttatccagtcgacgcggggatcggtgctctattcaacgaggtagtgggcagtggagacgagacgctggtcagcacgcttctcgaggcaaaggcgagcatgctctacagcgacgagcgcgccaactccaccttgcacctggcggtcgcgaagggcaaagcaaacgtgtgcaagctgctgctcaaggtcggcgctgacatgacgctgccgaacgcagacggccttacaccatgggatctcgccttgcgcagcagcaaccgcgcagtcgcgactgttctcaatccaggtgcggtagacctggacttggagggtcaggatacgccgtcgtcagcgctcggtggcaaccagcaagacaaggacttggtcagagatctgctcaagtttgccatcgcaggcgacaaggaacgtatgaagaaagtgatcgagtccgcgactggcaaaatcggtgagatgaacggtttcgtggacatgcccaacaaagacgaggtcacgcctctcatgtttgcagcacactcggacgcagaggatgcattgttatgcacgcgcatcctcatggagaggggggcgtcacagctgaagatatcgaggcgaggatgcactgcgctcatgatggccgcagccgctggaaacatccccatagtcaacatcctgctgcatcatcgagctcagattgaccggaagtgtatgggtggctacacagctctgcatctcgccatcgaatacgggcacgcagaagtggccacgaatcttatcatcgccggtgcggatgttaacacgaggctggacaatggctggagctgcttgatgacagccgcgcattgcggaacagtcggtgtgctgaaggatctaatcgagaagcctgatgacgcgaacgtcactttcacgccgccaaacgtggacaagcaatcgggcgagttcgccccaattcacatggccgcattccatggcttcgcatcaacgttgatggagttggtacgcctcggtgctgccatcgacctgcccatgaaaaatggctggaccgcgctcatgatcgcggcactgcaggggcacaaggcagcttgtgaggcgctgctgcagagcggcgcgcatatcgatcttcaatcgccattggacggcacgactccgcttatggccgcagtgtccaatccctacactgccgactgcgtcggcctgctgctccaggcgagcgcaagcgtgaatctgcgtgatggcatgggtttggacgcaatcatgttcgcctgtcgcaatggc

SEQ ID NO: 378 - DNA, 4000 bp, Escherichia coli
  misc_feature (546)..(546): n is a, c, g, or t
  misc_feature (588)..(588): n is a, c, g, or t
  misc_feature (627)..(627): n is a, c, g, or t
  misc_feature (639)..(639): n is a, c, g, or t
  misc_feature (1061)..(1061): n is a, c, g, or t
  misc_feature (1834)..(1834): n is a, c, g, or t
  misc_feature (1982)..(1982): n is a, c, g, or t
  misc_feature (1991)..(1991): n is a, c, g, or t
  misc_feature (2016)..(2016): n is a, c, g, or t
  misc_feature (2190)..(2190): n is a, c, g, or t
  misc_feature (3737)..(3737): n is a, c, g, or t
cgcctacttggctggggcacggtcgggaaccagtgctcagaaaaaccgctccgcggtgagtggcggtggggcaaagccatggcgacaaaagggtaccggtcgcgcgcgagcaggaaccagccgcagcccgatttggcgaggcggcggtcgagcgtttccgtcggccaaccgatcttatgctcagaagctaaatcggaagatgtaccgagcagccatacgatccatcctctctgaactggtccgccagggccgcgttctcatttgcgacgatatccttgttgacgaaccgaaaacctcgaagatgtccaagacgctgcaagggctgggtatctcgggccgcgtgctactggtgacctcggagtttgatttaaatgtggcgctctccgcgcgtaatctggttggggtcgagaccctcgaggcctctgagctcaacccagtgagcctggtgggcagcgaacacgtgatcttttctgaggcggccgttaaaaaggtagaggaggcactgcaatgaacatggaacgtcttcaccagatcatcctcgctccngtgatttctgagaagagcacctcggctgccgatctggccaancaggtggtcttcgaagtgcttccaaacgcgaccaagccngaagtccgtcangccgttgagcatcagtttaacgttaaggtggaagacgtacagattgttaatgtgcgtggcaaggtgaaacgctttgggcgctctcccggaaagcgccgtaactggaagaaggcatatgtccgtcttgccgaagggcaagacatcgacttcatgggtgcaggcgcctagacgtcaagcaagggctcattcggaacgctcattcggaaattagacgtaagaacaggattactcagatgccagtcgtaaaacaaaagcccacgtcagccggccgtcgaggcatggttcgtgtggtctccccagacctgtacaaaggtcgaccgatagcggctcttaccgaatcacaaacggccactaacggccgcaacaatgcgggtcgaataaccgttcgccatcggggcggtgggcacaagcatcattaccgnattgtggatttcaagcgcttaaaagacggtattcctgctcgcgtcgagcggttggagtacgacccgaaccgtagcgcgcatattgctttgctgctctatgctgatggcgagcgccggtacatcattgcccctaaaggtttaagcgcgggtgattcggttgtgtcgggcagcgacgccgcgatccggcccggcaacacgctgccgataaagaatattcccgtgggctcggtggttcattgcgtagagctgaagcccggaaaaggtgcacagctcgctcgctcggctggcgcatctgttcagtatctgggtcgcgaaggagcctatgcgctgatgcgccttcgctcaggtgagacgcggaaagtactcgccgagtgtcgggcaactatcggcgaagtgggcaattcagaaaattcgcttcgcaaatttggaaaagcgggcgccaagcgctggctcggtatccggcccacggtccgcggtgtggcaatgaacccggtcgaccatcctcatgggggcggcgaaggccgcacctccggcggccgccatccggttagcccgtggggtacgccgacgaaagggtaccgaacgcgccgaaacaagcgcaccagttcaatgattattcgcagaaggaagaaataggtatgcctagatccgtcaaaaaaggcccctttgttgatcattcgctgtgggcgaaggtatctaaggcaaaagacgaaggctcgcggcgcccgattaagacctggtcccgacgatccatgatcatgccggaatttgtnggattgaccatcgcggtgcacaacggaaagcaacacgtgccggtgctggttaccgagaacatggtcggtcataagctcggtgagttcgccgcgacccgcaccttccggggccacgtggcggatcgcaagacgaagtagggctgccggnattttaaanccgcctgaatgctattcgacgcaancaacagccaaaaaaagacagatcaaagcaagaagtaagaatagagcctatagaaaaaaagagacgaaacgagcggtggttaccgcatgtctcagcatgacactagcttagagagattaagaaaatggaagtcaaagcggtcgcccgatttgtccggttgtctccccaaaagggncggctggttgcggatcaggtgcgaaatctgccggtgggtaaggcgttggagctgctgcagttcagtccgcgaaaagcggcaggcgtgattcgcaaggtgctggaatcggccattgcgaacgccgagcataacgagggcgctgacatcgacgagttgcgcgtgagtcagatcatggtggatgagggtccagttatgaagcggtggctcccgcgggcaaaaggccgggccactcctttgatcaagccaacgagtcacattacggtcagcgtcagcgacgtcgctaaagggggcaattagcaaatgggtcaaaagattcatccaaacgggtttcgcctaggcgtcatccgtgactgggacgccaagtggttcgcaatgggtagcacctatgctcgaaacctcgttgccgatcaggggattcgtaagtttctccgcaaacggcttgccaacgctgccgtgagcaggattgagctggttcgggctggtgagacgctcaatgtcaccattcacacggggcgcccgggcattgtgatcgggaaaaagggagaggatattgagaagttgcgccgcgatattctggcgctgaataacaatgtgccggtacaggttgctgttgaagaaatccgcaagcccgagttggacgctcgactcgttgctgagaacgtgtgtcagcagctcgagaagcgaatcatgttccgtcgggcaatgaaacgcgcggttcagaatacgatgcgactcggcgctaagggcgtgaagattatgatctcgggccgattgaatggggcagagattgcccggaccgaatggtaccgagaaggccgcgtacctttgcacaccttgcgcgctgatgtggactacggcttttctgaggcgcaaacgacgtacggcgtgatcggagtgaaggtttggattttcaagggagaaatcctcccaggcgcctctgaggtggaagcgccgaagaccgcgcaagcgaacgccacagtctgaggtcaggttagatgctccaaccgaaaagaacaaaattcaggaaacaacaaaaaggccgaaatcgcggtctggcggtgcgtggcagcaacgtcagttttggcgactttggcctgaaatgcaccggacgcggtcgcctgaccgcgcgccagattgaggctgctcgtcgggccattaaccgctatgtcaagcgcggtgggcgggtctggattcgggtcttcccggataaaccggtatcgaagaagcctctggaagtacgaatgggaaaaggaaaggggaaccccgagtattgggtcgcgttggtacaacccggcaccatgctttatgaaattcagggcgtggaggaagagatggctcgagaggcctttcgacttgcgggagcaaaacttccgatatccacgtcgttcgtcaaacgtcaggcagcgtaggattaaacggcaatggcggaaaagaaagtggtcggcatgaacgccgaagaacttaaggcagagcttatcgatctgcgcaaggaacaattcaacttacgcatgcagcgtggaaccggtcagttggcgaatccttcgcgnttcaaggtggttcgacggcaaattgcgcgaattaagactcgcatgagtgaaataaacaggactgtgtcatgagcgaagaacaatctacgcaaaaagcctcgagtgcacgtacgcttcagggcagcgtcgagagcgccaagatggataaaaccatcacggttctggtggagcgtcagcttcagcaccctctgtacaaaaaatacatccgccgatcgacccgattgcacgcgcatgacgaaaacaacgagtgtcagaagggcgat

SEQ ID NO: 379 - DNA, 4000 bp, Escherichia coli
  misc_feature (762)..(762): n is a, c, g, or t
  misc_feature (786)..(786): n is a, c, g, or t
  misc_feature (930)..(930): n is a, c, g, or t
  misc_feature (1677)..(1677): n is a, c, g, or t
  misc_feature (1992)..(1992): n is a, c, g, or t
  misc_feature (2001)..(2001): n is a, c, g, or t
  misc_feature (2015)..(2015): n is a, c, g, or t
  misc_feature (3242)..(3242): n is a, c, g, or t
  misc_feature (3524)..(3524): n is a, c, g, or t
  misc_feature (3530)..(3530): n is a, c, g, or t
  misc_feature (3532)..(3535): n is a, c, g, or t
  misc_feature (3539)..(3539): n is a, c, g, or t
  misc_feature (3543)..(3548): n is a, c, g, or t
  misc_feature (3550)..(3551): n is a, c, g, or t
  misc_feature (3553)..(3553): n is a, c, g, or t
  misc_feature (3556)..(3557): n is a, c, g, or t
  misc_feature (3559)..(3560): n is a, c, g, or t
  misc_feature (3563)..(3564): n is a, c, g, or t
  misc_feature (3570)..(3572): n is a, c, g, or t
  misc_feature (3574)..(3579): n is a, c, g, or t
  misc_feature (3581)..(3585): n is a, c, g, or t
  misc_feature (3587)..(3589): n is a, c, g, or t
  misc_feature (3593)..(3595): n is a, c, g, or t
  misc_feature (3599)..(3600): n is a, c, g, or t
  misc_feature (3602)..(3606): n is a, c, g, or t
  misc_feature (3608)..(3608): n is a, c, g, or t
  misc_feature (3610)..(3613): n is a, c, g, or t
  misc_feature (3615)..(3617): n is a, c, g, or t
  misc_feature (3620)..(3622): n is a, c, g, or t
  misc_feature (3624)..(3624): n is a, c, g, or t
  misc_feature (3627)..(3629): n is a, c, g, or t
  misc_feature (3631)..(3633): n is a, c, g, or t
  misc_feature (3636)..(3642): n is a, c, g, or t
  misc_feature (3644)..(3647): n is a, c, g, or t
  misc_feature (3649)..(3649): n is a, c, g, or t
  misc_feature (3651)..(3653): n is a, c, g, or t
  misc_feature (3655)..(3658): n is a, c, g, or t
  misc_feature (3661)..(3661): n is a, c, g, or t
  misc_feature (3663)..(3668): n is a, c, g, or t
  misc_feature (3671)..(3672): n is a, c, g, or t
  misc_feature (3674)..(3674): n is a, c, g, or t
  misc_feature (3676)..(3678): n is a, c, g, or t
  misc_feature (3680)..(3681): n is a, c, g, or t
  misc_feature (3685)..(3685): n is a, c, g, or t
  misc_feature (3688)..(3688): n is a, c, g, or t
  misc_feature (3690)..(3693): n is a, c, g, or t
  misc_feature (3696)..(3696): n is a, c, g, or t
  misc_feature (3698)..(3698): n is a, c, g, or t
  misc_feature (3700)..(3700): n is a, c, g, or t
  misc_feature (3702)..(3703): n is a, c, g, or t
  misc_feature (3705)..(3706): n is a, c, g, or t
  misc_feature (3708)..(3711): n is a, c, g, or t
  misc_feature (3713)..(3713): n is a, c, g, or t
  misc_feature (3716)..(3717): n is a, c, g, or t
  misc_feature (3720)..(3721): n is a, c, g, or t
  misc_feature (3723)..(3724): n is a, c, g, or t
  misc_feature (3726)..(3726): n is a, c, g, or t
  misc_feature (3728)..(3729): n is a, c, g, or t
  misc_feature (3731)..(3731): n is a, c, g, or t
  misc_feature (3733)..(3735): n is a, c, g, or t
  misc_feature (3739)..(3741): n is a, c, g, or t
  misc_feature (3743)..(3752): n is a, c, g, or t
  misc_feature (3754)..(3755): n is a, c, g, or t
  misc_feature (3757)..(3757): n is a, c, g, or t
  misc_feature (3759)..(3773): n is a, c, g, or t
  misc_feature (3776)..(3776): n is a, c, g, or t
  misc_feature (3779)..(3785): n is a, c, g, or t
  misc_feature (3788)..(3795): n is a, c, g, or t
  misc_feature (3797)..(3801): n is a, c, g, or t
  misc_feature (3803)..(3804): n is a, c, g, or t
  misc_feature (3806)..(3817): n is a, c, g, or t
  misc_feature (3819)..(3820): n is a, c, g, or t
  misc_feature (3822)..(3830): n is a, c, g, or t
  misc_feature (3832)..(3833): n is a, c, g, or t
  misc_feature (3836)..(3837): n is a, c, g, or t
  misc_feature (3839)..(3852): n is a, c, g, or t
  misc_feature (3854)..(3858): n is a, c, g, or t
  misc_feature (3860)..(3860): n is a, c, g, or t
  misc_feature (3862)..(3865): n is a, c, g, or t
  misc_feature (3868)..(3869): n is a, c, g, or t
  misc_feature (3871)..(3872): n is a, c, g, or t
  misc_feature (3875)..(3881): n is a, c, g, or t
  misc_feature (3884)..(3884): n is a, c, g, or t
  misc_feature (3887)..(3887): n is a, c, g, or t
  misc_feature (3889)..(3889): n is a, c, g, or t
  misc_feature (3892)..(3902): n is a, c, g, or t
  misc_feature (3904)..(3905): n is a, c, g, or t
  misc_feature (3908)..(3913): n is a, c, g, or t
  misc_feature (3915)..(3919): n is a, c, g, or t
  misc_feature (3921)..(3925): n is a, c, g, or t
  misc_feature (3927)..(3928): n is a, c, g, or t
  misc_feature (3930)..(3930): n is a, c, g, or t
  misc_feature (3937)..(3940): n is a, c, g, or t
  misc_feature (3942)..(3944): n is a, c, g, or t
  misc_feature (3947)..(3949): n is a, c, g, or t
  misc_feature (3951)..(3952): n is a, c, g, or t
  misc_feature (3955)..(3960): n is a, c, g, or t
  misc_feature (3963)..(3967): n is a, c, g, or t
  misc_feature (3969)..(3970): n is a, c, g, or t
  misc_feature (3972)..(3976): n is a, c, g, or t
  misc_feature (3979)..(3980): n is a, c, g, or t
  misc_feature (3982)..(3982): n is a, c, g, or t
  misc_feature (3984)..(3988): n is a, c, g, or t
  misc_feature (3990)..(3992): n is a, c, g, or t
  misc_feature (3995)..(3996): n is a, c, g, or t
  misc_feature (3998)..(3998): n is a, c, g, or t
  misc_feature (4000)..(4000): n is a, c, g, or t
ttcaaacccttatcttgcggctcgttagctttgggtgcgcgtaactgttgttgtacaaagtcaccttctgcagttttagagttccgaacgaattgccttagctgctcggccccgctatctgcatcagcagcaataccaatacttggagaaaataaaatgaatatgctgactgcgactgtaatcgcacgcactaagaagagtctttgcaaaatgaaaccttactctgatgggcgatgcagaatttcgcggttaccgccgttgcccattttggatacgaggccagctttttccatatcttccagcaagcgggccgcacggttataaccaatgcgcagatgacgttgtactagtgagattgaaggacgcttgttatccagaacgattgccacggcctgatcgtaaagtgggtctgcttcgccaccaccctcacctgtcaaggcatccatagtggattcatctgcgccttcaaggactccatcaatgtaattggcttcgcctttttctttaagccactcgaccacgcgatgtacttcatcatctgatacaaaggcgccatgtacgcgcactggcaaaccagtacctggggccatgtacaacatgtcacccatacccaacaaagcttcagcgccctgttgatccaaaatcgtacgactatcaatcttgctactcacttgaaacgaaatacgtgttggtacgttggctttaatcaagccagtaatcacatccacgcttggacgttgtgttgctaataccaaatgaatncctgcagcacgggccttctgggcnatccgtgcgatcaactcttcaatcttcttaccttgaaccatcatcaagtcagcaagctcgtcgatcacaatcacaatcacgggcgctttatagattggctctggatcatctggcgtcaagctaaatggattggtgagtctttcncctttttcttcggcttctaaaattttcttattaaagccagcaaggttacgtacgccaaacttactcatcagtttgtagcgacgctccatctcattgaccgcccaattgagcgcgttatacgcctgcttcatatcggtaaccactgggcacaacaaatgcggaattttgtcgtacattgccatctcaagcatcttcggatcaatcatgatcaagcgcacttcatcaggcttagccttaaacagcatcgacaaaatcatggcattgataccaaccgactttccagcgccagttgtacctgcgactaaacaatgcggcatcttcgccaagtcggcaaccattggactgccagaaatatctttacccaaagctagcgttagcaaggaatggttatcgttataaacctgtgaagtcagaatctcagagaggtaaacagactgacgagttgggtttggtaattccaaagccatacatgttttgccagggatagtttccacaacgcgcatactcacaacaccaagtgagcgagctaagtcgcgcgacagattcacaatctgactacccttcacgccaaccgcaggatcaatctcataacgcgttaccactgggccagggtaggcagcaatgaccaccacctgaacaccaaactcggccagcttgcgctcaattaaacgagaggtaaattccagcacatcggcagaaatggtttcttttacttcgggaactggatcaagcaaggccaagggtggnaactctgaatccggaatatccacaaacaaaggttgctgcttttcacgctcaacccgggcactcttaacaatctctactggggcacgcacaatttgtactggagcagcaacctcaacgcgcccccggaattcttctacgtattcttcacgctcttcagccgcggcttcaccaagcttgcggtcttcttcgctctcacgacgctcacgcaaacgcatgtaagccaattcgaggtaacgccctactttttcagcgacatcgagccatgaaaaatgcagaaataaagaaagccccgcacaaagcccaaacagcagtacnaatgtggcnccagtaaagcccanagacatctgcaggggatcgccaatcaattcacccaaaatgccgccagggggacgtggaagctgccagccaagtgaatgcaaacgaatcgactctaagcccatactgctgaccaaggtcaatccaaaacccagccagcgcattaaaaatgaatcaggcttggcctctgggtcggcgggcaaaggaatactccaaagctcacgccagccattaagaacccgacgaccaaagatggcaacccaccaaaaagcagatatcccgaagatatagagcattaaatcggcaatataggccccaaaacgaccgcccaggttcttgggagcctcaaaactagcatgagaccaggctggatcagctttggaataggtggccaaaatggcaaataaagccaagcaaaggccgagggagataaaccagcgagcctctaggagaaggcggggcatcctgccctgcccatcaagttctgggggctgggggctcagtggagtcttggacttcgggtatacagttctcgccatgttctcccgattgtaaacaagcaaatctataatttggggatgacaacaaataccctaaaacactccaaagtcctgatcctcggatctggccctgccggctatacagccgctgtttatgctgcccgcgctaatttgcagcctaccctcatcacgggattggctcaaggaggtcaattaatgaccactacagacgttgaaaactggccggcagaccctgatggggttcaaggtccagaactcatggaacgcttcctaaagcacgctgagcgctttaatactgaaatcatttttgatcacattcatacggcagctctgacagaaaagccaatacgcttagttggcgattctggcacctatacctgtgatgccttgattatttctactggggcctcggcgcaatacattggcttaccaagtgaagaagcttttatgggtcgcggtgtttctggttgcgcaacttgtgatggattcttttataaaaaccaagatgtttgcgtagtaggtggtggcaacactgcagttgaagaagcgctctacctcactggtattgccaaaaaggttatcgtcattcatcgtcgcgataagttccgtgctgagccaattttgaatgaccgcttaatggcaaaagttgctgaaggcaaagtagagctcaaactaaactccacactggatgaagtgcttggagatgaaaaaggtgtcactggtgtacgnatcaagaaacaagatggcagcacagaagatattgctgtaactggtgccttcattgcaattggtcacaaacccaataccgaattgtttatcggtcagctcgacatgaacaacggctacctcaagacccactccggcttagaaggcaatgcgactgctaccaacattccaggcgtctttgcagcaggcgacgtacaagatcacatctatcgccaagctattaccagtgcaggcactggctgcatggcagcactcgatgcgcagcgttacttagagtcgctgtcntaagangnnnncagntgtnnnnnntnntnaanncnnaannaaaaannncnnnnnntnnnnngnnntttnnntttnnannnnntnannnnannnaannnanttnnngnnnccnnnnnnngnnnntnannnannnnttngnnnnnnccnntngnnntnntttnccntnnnnccnantncnnanngnnnncnaannaanntnnantnngntnnnaaannncnnnnnnnnnnanncnannnnnnnnnnnnnnnccnttnnnnnnnttnnnnnnnncnnnnntnncnnnnnnnnnnnntnncnnnnnnnnnannttnntnnnnnnnnnnnnnntnnnnncnannnnttnntnnttnnnnnnnccnttngnaannnnnnnnnnntnnttnnnnnnannnnnannnnnanngnttttttnnnnannnttnnncnnccnnnnnnttnnnnntnntnnnnnaannantnnnnntnnnttnngncn

SEQ ID NO: 380 - DNA, 4000 bp, Escherichia coli
  misc_feature (1)..(1): n is a, c, g, or t
  misc_feature (3)..(6): n is a, c, g, or t
  misc_feature (10)..(10): n is a, c, g, or t
  misc_feature (13)..(18): n is a, c, g, or t
  misc_feature (20)..(23): n is a, c, g, or t
  misc_feature (25)..(25): n is a, c, g, or t
  misc_feature (27)..(27): n is a, c, g, or t
  misc_feature (29)..(31): n is a, c, g, or t
  misc_feature (63)..(63): n is a, c, g, or t
  misc_feature (1985)..(1985): n is a, c, g, or t
  misc_feature (1988)..(1988): n is a, c, g, or t
  misc_feature (3189)..(3191): n is a, c, g, or t
  misc_feature (3194)..(3197): n is a, c, g, or t
  misc_feature (3199)..(3199): n is a, c, g, or t
  misc_feature (3206)..(3208): n is a, c, g, or t
  misc_feature (3210)..(3210): n is a, c, g, or t
  misc_feature (3212)..(3212): n is a, c, g, or t
  misc_feature (3216)..(3220): n is a, c, g, or t
  misc_feature (3222)..(3224): n is a, c, g, or t
  misc_feature (3226)..(3227): n is a, c, g, or t
  misc_feature (3230)..(3230): n is a, c, g, or t
  misc_feature (3233)..(3233): n is a, c, g, or t
  misc_feature (3235)..(3237): n is a, c, g, or t
  misc_feature (3240)..(3247): n is a, c, g, or t
  misc_feature (3249)..(3249): n is a, c, g, or t
  misc_feature (3251)..(3251): n is a, c, g, or t
  misc_feature (3253)..(3256): n is a, c, g, or t
  misc_feature (3259)..(3259): n is a, c, g, or t
  misc_feature (3261)..(3263): n is a, c, g, or t
  misc_feature (3265)..(3265): n is a, c, g, or t
  misc_feature (3270)..(3272): n is a, c, g, or t
  misc_feature (3274)..(3275): n is a, c, g, or t
  misc_feature (3277)..(3277): n is a, c, g, or t
  misc_feature (3279)..(3280): n is a, c, g, or t
  misc_feature (3286)..(3288): n is a, c, g, or t
  misc_feature (3290)..(3292): n is a, c, g, or t
  misc_feature (3294)..(3294): n is a, c, g, or t
  misc_feature (3299)..(3300): n is a, c, g, or t
  misc_feature (3302)..(3302): n is a, c, g, or t
  misc_feature (3305)..(3308): n is a, c, g, or t
  misc_feature (3311)..(3316): n is a, c, g, or t
  misc_feature (3318)..(3319): n is a, c, g, or t
  misc_feature (3321)..(3324): n is a, c, g, or t
  misc_feature (3327)..(3330): n is a, c, g, or t
  misc_feature (3333)..(3334): n is a, c, g, or t
  misc_feature (3336)..(3337): n is a, c, g, or t
  misc_feature (3339)..(3339): n is a, c, g, or t
  misc_feature (3343)..(3343): n is a, c, g, or t
  misc_feature (3345)..(3345): n is a, c, g, or t
  misc_feature (3349)..(3359): n is a, c, g, or t
  misc_feature (3361)..(3363): n is a, c, g, or t
  misc_feature (3365)..(3367): n is a, c, g, or t
  misc_feature (3369)..(3369): n is a, c, g, or t
  misc_feature (3371)..(3375): n is a, c, g, or t
  misc_feature (3377)..(3381): n is a, c, g, or t
  misc_feature (3384)..(3384): n is a, c, g, or t
  misc_feature (3387)..(3388): n is a, c, g, or t
  misc_feature (3390)..(3392): n is a, c, g, or t
  misc_feature (3394)..(3394): n is a, c, g, or t
  misc_feature (3396)..(3396): n is a, c, g, or t
  misc_feature (3398)..(3399): n is a, c, g, or t
  misc_feature (3401)..(3401): n is a, c, g, or t
  misc_feature (3403)..(3406): n is a, c, g, or t
  misc_feature (3408)..(3411): n is a, c, g, or t
  misc_feature (3413)..(3413): n is a, c, g, or t
  misc_feature (3415)..(3415): n is a, c, g, or t
  misc_feature (3417)..(3417): n is a, c, g, or t
  misc_feature (3419)..(3420): n is a, c, g, or t
  misc_feature (3422)..(3423): n is a, c, g, or t
  misc_feature (3426)..(3430): n is a, c, g, or t
  misc_feature (3432)..(3441): n is a, c, g, or t
  misc_feature (3443)..(3444): n is a, c, g, or t
  misc_feature (3446)..(3446): n is a, c, g, or t
  misc_feature (3448)..(3460): n is a, c, g, or t
  misc_feature (3463)..(3463): n is a, c, g, or t
  misc_feature (3465)..(3470): n is a, c, g, or t
  misc_feature (3472)..(3472): n is a, c, g, or t
  misc_feature (3474)..(3475): n is a, c, g, or t
  misc_feature (3477)..(3483): n is a, c, g, or t
  misc_feature (3485)..(3485): n is a, c, g, or t
  misc_feature (3487)..(3488): n is a, c, g, or t
  misc_feature (3490)..(3491): n is a, c, g, or t
  misc_feature (3493)..(3493): n is a, c, g, or t
  misc_feature (3495)..(3496): n is a, c, g, or t
  misc_feature (3498)..(3498): n is a, c, g, or t
  misc_feature (3501)..(3503): n is a, c, g, or t
  misc_feature (3505)..(3507): n is a, c, g, or t
  misc_feature (3509)..(3510): n is a, c, g, or t
  misc_feature (3513)..(3527): n is a, c, g, or t
  misc_feature (3529)..(3548): n is a, c, g, or t
  misc_feature (3550)..(3552): n is a, c, g, or t
  misc_feature (3556)..(3556): n is a, c, g, or t
  misc_feature (3559)..(3559): n is a, c, g, or t
  misc_feature (3561)..(3561): n is a, c, g, or t
  misc_feature (3563)..(3566): n is a, c, g, or t
  misc_feature (3568)..(3569): n is a, c, g, or t
  misc_feature (3571)..(3575): n is a, c, g, or t
  misc_feature (3577)..(3579): n is a, c, g, or t
  misc_feature (3581)..(3581): n is a, c, g, or t
  misc_feature (3583)..(3584): n is a, c, g, or t
  misc_feature (3586)..(3587): n is a, c, g, or t
  misc_feature (3591)..(3594): n is a, c, g, or t
  misc_feature (3596)..(3597): n is a, c, g, or t
  misc_feature (3599)..(3600): n is a, c, g, or t
  misc_feature (3602)..(3608): n is a, c, g, or t
  misc_feature (3610)..(3611): n is a, c, g, or t
  misc_feature (3613)..(3621): n is a, c, g, or t
  misc_feature (3623)..(3623): n is a, c, g, or t
  misc_feature (3625)..(3626): n is a, c, g, or t
  misc_feature (3628)..(3630): n is a, c, g, or t
  misc_feature (3632)..(3635): n is a, c, g, or t
  misc_feature (3637)..(3637): n is a, c, g, or t
nannnnttanttnnnnnnannnnananannnaaaaaaaaaaaaaaaaaaaaaaaaaaaaaaanaaaaaaaaaaaaaaaaaaaaaaaaaaaaaaaaaaaaaaaaaaaaaaaaaaaaaaaaaaaaaaaaaaaaaaaaaaaaaaaaaaaaaagaaaagagattaaaaatagaatattcgaaaccttccatttatgtttagatggacataatttcattgatagtataaattttatggcatagttcaataatttaaattctcctgaatcagaattagaaatttgaaatttaggattaacctcttttggaagaagaatcagtcaatattccattttcatttcctgaagaaagcagctaattggatatccaaataactatctggaccacattttatttttgttaataattatttttcattttataaaatgaatatttttttttataaaatataacatcattttgttttaataataatataaataatgtcaaaaaatgattcaaatactctattattttataaagaattaaattcaacgtgtaatccagaaaaattattagaaatagcaaataaaggtatatttttatatgaacctttatatacatataataatataaaatatcatgaatatgttgtagatataagttttactgcaaatcaaaattttatgatatttaatgataaacaatataaaagattagtttattttttaactaataacgataaaaataactctataaaaaatattgttattaataaatattttttgagtaaattaatgagtgaaacggattataatgtaataaacaattatatcagtaatttggagaaatcccttctaaatgaatctatggactatattattaaatatctatttaaatataattatgtgtcaattcaattttataatttatttactgaaaatcgtaataatttgatttatgatttaatggaatatttttattttgataataaaaattattattttaatgataattttaattataataattatgtagaaatagttgaatatgtcatgagtaatatatatgatgtaaatataataaaatattgtattgaaatgtcgaaaaaacataatatattgatttcacaagataatgtttataattactttaaaataccaatgtgtcttccttttaatataaaaagttacactaaaaaaatatataaatcaaataaattaaagtttattatacaagataatataaaagataaagaatattatgaagaagtcattaatactatattttcagattggttttttgattcaatgaaaactaataatttatttaatttaaatgaagacttttattctaatattatgagtaaatatgatattaatccaaaaataataaataaatatgaaattcataatattaatgatgataaaatatattttacaccattcattaacaaggaagcttataaaaaaacaataactacggaaagtatttctaaagatatatatcctttgcgtgaaaaagttttttacaattctgatgtaataaatttgatattagaaaatcctaattatttattaaatctaaacataaatttaattgatgtggaaatagaatttaataaatatgatttctataccaatgctgtagttgaaaaaattataataataataatatatatggtgtcattactacataataaaggtaattattttattatgaatacattgttattgtatattaaaagatatcataatatggcaattaaaaataataaaatagtatttatttcaaataatttttcgactggaaatttattattaaattatattcgtaaaatttctaataaaacattccggagttatattgtatacgaataatccgatgataagatcaatatttgttacatatttttgtatactgttacgtaatttaaaagaaattacagttattatatttatataataattttaacgatgtacctttttttttttttttaaatattaatttnaanaattatacattaaatttttttttcaaaaaaaaaaaattaaaataattttcatataaatcagcaaataattaatatagaaattattattattattattattattattataaatataataataataatattttactaataaaataatagtaattataaatcgattaatttatattttatatacatattaaaactataaatcaaggattaatttaacttttataaaatttaacattaatttttataaaaaatatgtatatcgtaaattcaaataattttatatttaaattatttattatttaatatttttagctccaaagaaaagtattatatatatatatatttaaatattttgtttagatttaatagtacaatagaaataaaagttatatggtaaaattacaatattgaatattgtaataaatatcataataataattcttactttactaattattcaaaataaatatgtaaactattaaatgacaatattatataaaaaattttcaatatcataaagtgtaaataattctttaataatagactcattttatcatttttaggatttaaataattggagttgaaaacatttctatttaatatagtattaagtattggaaagcattttttgtagaataaataaatcggtttaaagtaataaagaattggtaacatcttgatataaatgaattaaattatatttattttgtattttctaacataaatttatcgtaatccaaacatgattagtgataatttatggtcaaaaccataaggacatggagatgatattttatttcctacgttaaagaccttttaaattttaatatatttttctttttcatcagaaatttcataaccccgaccaattgcagaataatttggataatcaagaatttcttcattttgtaagcactacgagaaataaaataaccatcataatataaactagaactcaatgtggttattaaataacaaagattgtcagtatctatatttccaatagatatattagtaatatctaataaagattctgaagtaataattaataagtttcttaaatatttatttatttatttatttatttatttatttatttatttatttatttatttatttatttatttatttatttatttatttatttatttatttatttatttatttatttatttatttatttatttatgtatttatttatttnnntannnntntattttnnnananttannnnntnnnannttnaanannnaannnnnnnnanantnnnntanannnanaattnnntnnantnnaaattnnntnnnanttaanntnatnnnnaannnnnntnntnnnnaannnnatnntnngnaaantnaatnnnnnnnnnnntnnntnnntnannnnntnnnnntanaannannnananannanannnnannnngnanananntnnatnnnnnannnnnnnnnnannanannnnnnnnnnnnnatnannnnnnangnnannnnnnnananngnnanannanaannnannnannatnnnnnnnnnnnnnnntnnnnnnnnnnnnnnnnnnnncnnnatcnaananannnntnntnnnnnannnantnntnncttnnnnanntnntnnnnnnncnncnnnnnnnnncntnntnnnannnntnctttattacatttctcgatatttcagcgcgatttaatcttttacaacgatttgaatatctatcattttttttacaataatttgttatacattcatcatcattattgcatgcactttcaccaattactgatactccatcttttacaatagaactaaaggaacagatatttttatttttacaataaattacacttttacattttgatacacctatattgccttcgtgataccaagcacatttagtatactttgggcattcgttttcacgaaattcacatggaatatccattctattatataatgataataaaaagaaaaaaaacaatgatatttaatagttaatgattaatactttttaaaataa

SEQ ID NO: 381 - DNA, 4000 bp, Escherichia coli
  misc_feature (155)..(155): n is a, c, g, or t
  misc_feature (167)..(167): n is a, c, g, or t
  misc_feature (185)..(185): n is a, c, g, or t
  misc_feature (215)..(215): n is a, c, g, or t
  misc_feature (497)..(497): n is a, c, g, or t
  misc_feature (731)..(731): n is a, c, g, or t
  misc_feature (854)..(854): n is a, c, g, or t
  misc_feature (869)..(869): n is a, c, g, or t
  misc_feature (941)..(941): n is a, c, g, or t
  misc_feature (974)..(974): n is a, c, g, or t
  misc_feature (1013)..(1013): n is a, c, g, or t
  misc_feature (1019)..(1019): n is a, c, g, or t
  misc_feature (1119)..(1119): n is a, c, g, or t
  misc_feature (1139)..(1139): n is a, c, g, or t
  misc_feature (1400)..(1400): n is a, c, g, or t
  misc_feature (1545)..(1545): n is a, c, g, or t
  misc_feature (1646)..(1646): n is a, c, g, or t
  misc_feature (1685)..(1685): n is a, c, g, or t
  misc_feature (1736)..(1736): n is a, c, g, or t
  misc_feature (1820)..(1820): n is a, c, g, or t
  misc_feature (2047)..(2047): n is a, c, g, or t
  misc_feature (2137)..(2137): n is a, c, g, or t
  misc_feature (3031)..(3031): n is a, c, g, or t
  misc_feature (3088)..(3088): n is a, c, g, or t
  misc_feature (3298)..(3298): n is a, c, g, or t
  misc_feature (3361)..(3361): n is a, c, g, or t
  misc_feature (3365)..(3365): n is a, c, g, or t
  misc_feature (3515)..(3515): n is a, c, g, or t
  misc_feature (3553)..(3553): n is a, c, g, or t
  misc_feature (3577)..(3577): n is a, c, g, or t
  misc_feature (3608)..(3608): n is a, c, g, or t
  misc_feature (3611)..(3611): n is a, c, g, or t
  misc_feature (3629)..(3629): n is a, c, g, or t
  misc_feature (3715)..(3715): n is a, c, g, or t
  misc_feature (3941)..(3941): n is a, c, g, or t
  misc_feature (3956)..(3956): n is a, c, g, or t
cgacgacctctttgaccatgtgtttggcgctggctttgcccacaggtggttttgcccagacaacagaaagctgcgtggccgaaggggagcaaaccgtgttcccatgcgtgctgcctgacggcagtgtcgtggcggatgcggatcagatgatgacnttgcgtgccganggcgatctggcgcaggcncttggtcttgaggcggaagcccagaccgangcgcaagccgagcccgatgcagaagccgccgctgaaaccgtagacgccgcggaagagcaggctgccgccgccgccgaggccgaagccgctgccaccgcagaagcccaagccgccgcggaagagcaagccgctgccgacgcagaggccgccgccgctgccgctgaagcagaagctgctgaggcgcaagctgcagccgatgcagaagccgccgccgccgcgcaggccgctgaacaagaggccgccgaagctcaggccgctgcagacgcacaagccgccgaggcngaggaagctgctgccgccgaagcgcaggccgaagcagagcgtgaggatgcggtcgctgcacagatcgccgcagacgctgaagccaaggctgcagccgaagccgaggcagagcaagacgccgctgcggctgccgaaacctcggaaagccctgaagcgcagtctgccgagacacaggcagatgcccctgccgctgaaagcgatgctggcgtagaggcagaggcgcaagctcaggcngagccggcagagactgagtcgaccgaagaaacccaagccgagaccgacgtgccggcagacagctcttccgacactgaaacgcaggcggaggccgaaacccagcagcaaacggaagagcagatngccgctgatcttgcngccgaacaggctgcggaagaagcccgtcaggaacagcgcgccgctgatgcagccgctgctgccgaagccgcngccgctgctgacagcggtgaagccaaggccgangttgtggtagaagagatcaccgaagaagacacgcgcgcntcgaangaagaattttcgacggccgtcaccggtgacacctctgccgaagccaatacgcaagccaaaaaggatgacgacgacgggctgagcaagttcgagaaagccntgcttgtcggcatcggtgcngtggctgtcgggtcgatcctgaacaacggctcgaaggtcgtgagcaactcgggtgaccgtctggttgttgaagatccgaatggggatctgcgcgttttgaaagacgatgatgcgcttgtgcgtcaggccggtgacgaagtccgccgcgagacgttcaacgacggttcttcgcgcaccactgtgatcaagcctaacggcagcaagatcgtgaccattctgggtcgggacggcaccgtattgcgccggatcaacgtcgatccncagggcaatgaatatgtgctgttcgatgacacccaagccgaagagcgtatcgtggtgaacgagctgcctcaggtccgtccgcaggccaatacgctggccagccagcagaacgaggaagcgctgcgtgccgcgttgcaaacgcagntgcgtggcgatcaggcccagcggtattcgctgcgtcaggtgcgtgatgtccgtcaggtccgtgccctagcaccagagatcgagctggacgctgtgcgtttngccacagggtcggctgcaatccagcctgaacaggcccgngcgctgtccaagatcgggaccgcgatcagcaatgccatcaaggatgatccncgcactgtgatccttgtggaagggcacaccgatgcggttggcaatgcgggctacaaccttgcgctgtctgaccgtcgtgccganaccgttgcattggccctgaccgagtattttgacgtgccgccagccaacctgatcacccaaggctacggtgaaagcgcgttgaaagtaccgaccgagaccgccgaacccgccaaccgtcgtgcggttgtgcgcaacatcacaggtctgctgcgtcagtaaccgcgaccttcaagacatagaaaagcccccgcaggaaactgcgggggctttttgcgtctcgggactgnaagacccggaattatttgcttggcagcggcccgatgagcatgaccatctggcggccttccatcttcgggaagttttcaacgcggccaacntctttggtgtcttcggcaacgcgttcaagcagctcgcggccaaggttctggtgggccatctcacggccgcggaaccgcagcgtgatctttaccttgtccccattgtcgaggaacttgaacacgttacgcatcttgacgtcatagtcattggtatcggtgttcgggcggaacttgacctctttgatctcgatgatcttttgcttcttgcgcgcttcggcttcacgcttttgcgtctcatacttgaatttgccaaagtccatgatcttgcacacgggcgggttggcattgggcgaaatctcgaccagatcaagtccggcatcaacagccatttccatggcgcgatccggtgtcacgacgccgacgttttccccatccgcaccgatcaggcggatttcgttggcgcggatgttttcgttgatgcgcgggccggtgtctctttgcggcggcgcgttatgcggtctgcgagcgatgatggtcgtcctttgattgttgtactgatgtcgagcacggaaggtaaacctgctcatggtcttcttcaagtcgcaaaatggcgcatatacagggtaaaaccgcgtatttttgggggatttacccaaggggaagcagcgtatcgcgcatttgacgctatgtgttggcatatagtatgtgcagcaggggattaacaaagttcaaaggaaccacagcatcatgaaaaacctcatctggattgtcatcgcaggggtgatcgcgcttggcgcgtacatgttgtattcgggccgttcggtccaggagattgcgaccgatgcgtcggatgccgtcaatgctcccgccgcgctggaaagtgcgaccgaagctgtgggcgacgctgtcgaggcgacagagggcgcagtgaccgaggcggtagaagccaccacngaggccgcgaataccgcagccgacgcgctgtcggaagcggccgaggatgtggccgangccgcggcagaggcgggcgaggatgccatgaacgcgggcaagcagatcgccgaggatgcaacgcaagcggcgaatgataccgcagaaggcaacgcggaggtttccaccagcgcagaggccgatgccatggctgccagcgattcagaggcaagcgatgccgccagcaccacacaagcgggcacggcacccgccgctgacccgcaagccgangcagacgccgcagcggttcaagaggaagaagccgccgccgtcgccgcgacagatgcacaggcnagcncagatgcgggggctgcagccgatacagaagttcaggccgacgtcaccgccgatgccgacacgccagagcagttgaccaccgtcgatggctttgatctggagaaggtgcaaaccatgatcgacacctctgatctgcccgccacgcaaaaancgctgctgaagcaagggctggtcaccgccggtgaaaancccgatgccctgcgcgcgatcctngcacggatccgcgaggcgctggcgctttaancgnggcccacgcaaagccganccgccagacatgaaaaagccgcgcctcgaaagagagcgcggcttttgttttatctgtggtgccccatgcaagggcaccgctgcgtnggatcagccgacaaaggccttttcaacgacgtagtgtttggggtcggagttcgccccttcctcgagcccgaaaccttcaagcacgtccttgatgtccttgttgaattcaaggctcccgcagaccatgccgcgatcggtgtcggcgctgatcccgtcgatgccgaggtctttgaacaccgtgccgtcctgcagcagattggtgatgcggcccatcttggggctttgntcacgggtggtggtngggtaatagaccagcttgtcgccgatcatctcgccgatcagcgg

SEQ ID NO: 382 - DNA, 4000 bp, Escherichia coli
  misc_feature (1183)..(1183): n is a, c, g, or t
  misc_feature (1257)..(1257): n is a, c, g, or t
  misc_feature (1276)..(1276): n is a, c, g, or t
  misc_feature (1982)..(1983): n is a, c, g, or t
  misc_feature (1992)..(1992): n is a, c, g, or t
  misc_feature (2012)..(2012): n is a, c, g, or t
  misc_feature (2018)..(2018): n is a, c, g, or t
  misc_feature (2030)..(2030): n is a, c, g, or t
  misc_feature (2040)..(2040): n is a, c, g, or t
  misc_feature (2851)..(2851): n is a, c, g, or t
  misc_feature (3420)..(3420): n is a, c, g, or t
  misc_feature (3433)..(3436): n is a, c, g, or t
  misc_feature (3438)..(3438): n is a, c, g, or t
  misc_feature (3445)..(3445): n is a, c, g, or t
  misc_feature (3447)..(3448): n is a, c, g, or t
  misc_feature (3455)..(3455): n is a, c, g, or t
  misc_feature (3458)..(3462): n is a, c, g, or t
  misc_feature (3466)..(3466): n is a, c, g, or t
  misc_feature (3468)..(3470): n is a, c, g, or t
  misc_feature (3473)..(3479): n is a, c, g, or t
  misc_feature (3481)..(3483): n is a, c, g, or t
  misc_feature (3485)..(3485): n is a, c, g, or t
  misc_feature (3491)..(3492): n is a, c, g, or t
  misc_feature (3495)..(3496): n is a, c, g, or t
  misc_feature (3498)..(3499): n is a, c, g, or t
  misc_feature (3501)..(3501): n is a, c, g, or t
  misc_feature (3504)..(3504): n is a, c, g, or t
  misc_feature (3508)..(3508): n is a, c, g, or t
  misc_feature (3511)..(3511): n is a, c, g, or t
  misc_feature (3514)..(3514): n is a, c, g, or t
  misc_feature (3516)..(3516): n is a, c, g, or t
  misc_feature (3518)..(3518): n is a, c, g, or t
  misc_feature (3521)..(3524): n is a, c, g, or t
  misc_feature (3526)..(3527): n is a, c, g, or t
  misc_feature (3532)..(3532): n is a, c, g, or t
  misc_feature (3535)..(3535): n is a, c, g, or t
  misc_feature (3537)..(3540): n is a, c, g, or t
  misc_feature (3542)..(3542): n is a, c, g, or t
  misc_feature (3544)..(3546): n is a, c, g, or t
  misc_feature (3548)..(3549): n is a, c, g, or t
  misc_feature (3551)..(3551): n is a, c, g, or t
  misc_feature (3553)..(3553): n is a, c, g, or t
  misc_feature (3555)..(3558): n is a, c, g, or t
  misc_feature (3561)..(3563): n is a, c, g, or t
  misc_feature (3565)..(3565): n is a, c, g, or t
  misc_feature (3569)..(3571): n is a, c, g, or t
  misc_feature (3573)..(3576): n is a, c, g, or t
  misc_feature (3578)..(3578): n is a, c, g, or t
  misc_feature (3580)..(3580): n is a, c, g, or t
  misc_feature (3582)..(3584): n is a, c, g, or t
  misc_feature (3586)..(3587): n is a, c, g, or t
  misc_feature (3590)..(3591): n is a, c, g, or t
  misc_feature (3596)..(3597): n is a, c, g, or t
  misc_feature (3600)..(3605): n is a, c, g, or t
  misc_feature (3609)..(3616): n is a, c, g, or t
  misc_feature (3618)..(3620): n is a, c, g, or t
  misc_feature (3622)..(3626): n is a, c, g, or t
  misc_feature (3629)..(3632): n is a, c, g, or t
  misc_feature (3637)..(3638): n is a, c, g, or t
  misc_feature (3640)..(3640): n is a, c, g, or t
  misc_feature (3642)..(3648): n is a, c, g, or t
  misc_feature (3650)..(3652): n is a, c, g, or t
  misc_feature (3654)..(3655): n is a, c, g, or t
  misc_feature (3657)..(3661): n is a, c, g, or t
  misc_feature (3663)..(3667): n is a, c, g, or t
  misc_feature (3669)..(3675): n is a, c, g, or t
  misc_feature (3677)..(3677): n is a, c, g, or t
  misc_feature (3680)..(3682): n is a, c, g, or t
  misc_feature (3684)..(3691): n is a, c, g, or t
  misc_feature (3694)..(3695): n is a, c, g, or t
  misc_feature (3697)..(3703): n is a, c, g, or t
  misc_feature (3705)..(3705): n is a, c, g, or t
  misc_feature (3707)..(3712): n is a, c, g, or t
  misc_feature (3715)..(3715): n is a, c, g, or t
  misc_feature (3718)..(3722): n is a, c, g, or t
  misc_feature (3724)..(3724): n is a, c, g, or t
  misc_feature (3726)..(3727): n is a, c, g, or t
  misc_feature (3729)..(3729): n is a, c, g, or t
  misc_feature (3731)..(3735): n is a, c, g, or t
  misc_feature (3737)..(3737): n is a, c, g, or t
  misc_feature (3739)..(3740): n is a, c, g, or t
  misc_feature (3742)..(3747): n is a, c, g, or t
  misc_feature (3750)..(3751): n is a, c, g, or t
  misc_feature (3753)..(3755): n is a, c, g, or t
  misc_feature (3757)..(3757): n is a, c, g, or t
  misc_feature (3761)..(3764): n is a, c, g, or t
  misc_feature (3768)..(3769): n is a, c, g, or t
  misc_feature (3771)..(3774): n is a, c, g, or t
  misc_feature (3776)..(3779): n is a, c, g, or t
  misc_feature (3782)..(3782): n is a, c, g, or t
  misc_feature (3784)..(3792): n is a, c, g, or t
  misc_feature (3794)..(3794): n is a, c, g, or t
  misc_feature (3798)..(3799): n is a, c, g, or t
  misc_feature (3801)..(3808): n is a, c, g, or t
  misc_feature (3811)..(3811): n is a, c, g, or t
  misc_feature (3813)..(3814): n is a, c, g, or t
  misc_feature (3816)..(3819): n is a, c, g, or t
  misc_feature (3822)..(3826): n is a, c, g, or t
  misc_feature (3828)..(3831): n is a, c, g, or t
  misc_feature (3834)..(3836): n is a, c, g, or t
  misc_feature (3838)..(3840): n is a, c, g, or t
  misc_feature (3842)..(3842): n is a, c, g, or t
  misc_feature (3844)..(3847): n is a, c, g, or t
  misc_feature (3849)..(3857): n is a, c, g, or t
  misc_feature (3859)..(3859): n is a, c, g, or t
  misc_feature (3861)..(3861): n is a, c, g, or t
  misc_feature (3863)..(3863): n is a, c, g, or t
  misc_feature (3866)..(3867): n is a, c, g, or t
  misc_feature (3869)..(3869): n is a, c, g, or t
  misc_feature (3872)..(3875): n is a, c, g, or t
  misc_feature (3877)..(3881): n is a, c, g, or t
  misc_feature (3884)..(3885): n is a, c, g, or t
  misc_feature (3887)..(3893): n is a, c, g, or t
  misc_feature (3895)..(3896): n is a, c, g, or t
  misc_feature (3898)..(3903): n is a, c, g, or t
  misc_feature (3905)..(3908): n is a, c, g, or t
  misc_feature (3910)..(3911): n is a, c, g, or t
  misc_feature (3913)..(3914): n is a, c, g, or t
  misc_feature (3916)..(3916): n is a, c, g, or t
  misc_feature (3918)..(3918): n is a, c, g, or t
  misc_feature (3920)..(3921): n is a, c, g, or t
  misc_feature (3923)..(3931): n is a, c, g, or t
  misc_feature (3935)..(3935): n is a, c, g, or t
  misc_feature (3939)..(3942): n is a, c, g, or t
  misc_feature (3946)..(3955): n is a, c, g, or t
  misc_feature (3957)..(3964): n is a, c, g, or t
  misc_feature (3966)..(3966): n is a, c, g, or t
  misc_feature (3968)..(3969): n is a, c, g, or t
  misc_feature (3971)..(3971): n is a, c, g, or t
  misc_feature (3975)..(3976): n is a, c, g, or t
  misc_feature (3979)..(3981): n is a, c, g, or t
  misc_feature (3983)..(3984): n is a, c, g, or t
  misc_feature (3986)..(3987): n is a, c, g, or t
  misc_feature (3989)..(3990): n is a, c, g, or t
  misc_feature (3992)..(3993): n is a, c, g, or t
  misc_feature (3995)..(3996): n is a, c, g, or t
  misc_feature (3999)..(3999): n is a, c, g, or t
ctccggcggcagattaatgaaaaaaatagcgaaattataaagttaatcgttatttattttggcgccctgctttgcctttttgccctttggcagtattttgccgatttgtataatttgtcggcttatacttttctccgcccggaatatcagaaagtggtttttggtttcccgcgcccgcaggcgacatttttagagccgctgtattttgccaatttcctcttgttgccgacattttttacagcggagagattactcaaagataaaaagatttacccatttatggtcatcaatttgtttctaatgatgctggttgtggttctaacgctttcccgcggcgcttattttgcttttgcttttgcggcgataattttggcaatttttatcatcgtcagattcaaagaatttatccgcagactttggttgacggtttttattgttcttttgggaattgtcgccggcgtgatgctaatttatttgacggtgccacgacagaatttttcactttttgtaacgcatagcggaatttccgatgccgctaccggtggatcaacattggggcgactttacacatctgaattagctttaagtcaatccctaaagtatccgcttggcatcggtgccggcgcttttggcgctttgccagagttcgataatttatatgaaaaaggaatttatcaaacagttgggagtctttatccggaaattttggtcgaagaaggagttttgggatttttacttttcgccgcctttatttggctcctgcttcgccatctctggaaaagcaccgcgtcgggaaaacctgtctcgagcacagccgagagattggagggtctaatttatttagccattcttctggcaattctcgtccaagccgtctctttttcctcgctctacattctgccgatttgggcgttttttgcgcttgcgtggccagtgcctcctacgaaattacaaatttagcgaaagtacaaataagggcaaaattgaatggtttctcgttttggtctggccaaagacgaatcgggcttgacaggaatcgaaaaatgatctatactttttgcagttcccagactggaactattcgaggaggcgaacctctccgttttgtcacggtgaaatcgccggaggaacacccgaaatgtctcggaccaccctctcactgaatacgcaaagacggatcatngcaaggattgcagagaacttgcccgatgacctacccgaagaagatgcgctgaggtgggtcaacgactgcgccgngctcaagaagggattgcgngggctgttgatgccggaaatcaactggttagaccagctggttcaagcagaaaacgacatctacagtgcattccttgttcggggtcaggcgattgatttctcgcagtttaaggcgacgcttaagagccacggcgaggagcacatcagccgctggatccagcttggccttgagccgcactttctgccgaagcggcaattccgacaggacgaaaagcttcgcggctggaaggtcaagcccaagaaatggttctggcaacagatggcggcttgcacgatcaagcgccgcaacgtcgccggtgagctggtcacggtcacagaagctggtttcgatggcgacaccgtcctcatcgatacccggtgcaaaccggcgtatgataacgggcggcagatgtttgccgacgacgaagccttccttggcgggctaatcgaggatcttcgttcgaggggcgagattgcccgctatgattccggtcagcaagacagcagattcggtgtttcgtctctcgaatgggacgaacagatccgcccggcgctcgaagcccggccggagttcaaaggagtgtcatttcgactggagttggcgattgaagccaacactatccctcagatctacgggcggatgccgcgccacaaggacggccagactgatacctgggtctggtatgaggagtttttcgagggcgcctctcgccgtttggatggcggcnnttccggccncggcggtcttgcggatgtcngctgtngcggagtgcgcngccactgggncgacagggcggttcgtcccctgggagttgtggccattttgccgcttggatcttaggtcctttcggcaacttggctcgctccagaaaatcatacgggatcggtttcggctgatcccgtttttcttttttctaaaactttggtacattgactttggaatttgcattgtttccccggctacggtttgggaacaatcaaattccccttgtttggaaaacgttttgcggctacggcttcagaaccaatgccaaaaaggaaaagaaactccttgtctgttcttggtgaagatgtcgcctcggcgattgcttccaaataaaattcaaccccgagagtaatcgaagggcggtggcaatagatgagaacagacaattttcgaggacgcctctaaccgtttgaatggcggcaattccgacaacggcggtcttgcgaatgtcaactgtaacgaagtgaacaaccactggaacaacagggcggttcgtcccctgggagtttctcacaaaacgcgtttaaattgcgcggtttgtgtttttcagccagccaccgatcatcctgccgatctcttgcaatttttcttcaaaagaaatatattttttctggttaataaccctggtatcataacaaagccgaaagaggattttcagaaagtcggtttttgttgaagcagccttaagcccgataattttttcctgagccgcttcaaagcttattcttgaaataatttctaaaagatcaacaatcgtgttttccgttttagctaccaatacttgcgatttcttgggaaaattgtcaatttccagataaaattctttgtagnaatcgtaaattttctggaacaaagggatttcttgcatggatgactcctttctaaaaattattagcttggaaaatttgtttttggcttggaaggaatttcggcgaggaaagcggaaaaaaattgatgttcagatttttgagcgaaatcttgaagacaatttgtttgctctgcaccaaaaacttgcagatggtatttaccagcatggaaattatacctcattttacatcaccgatccaaaacggcggaaaattcataaagcttgcgttcgtgacagagttttgcatcacgcagtttaccgaattctatatccgatctttgacaaaagtttcatttatgattcatattcctgtcggctaaagaaaggaacgtacaaagcgattgaccgtttggaaattttcgtcagaaaaatcagcaagaattattttggcaaatgttttgttctgaagtgtgatattaagaagttttttgccagcgttgatcaggggattcttttgaaaattattgaagggaaaatatttgatcccgaaactttatggctggttagagaaattattgaaagtttcaattcnagagagagagagnnnntncctgccngnnggcaggnaannnnnctgncnnncgnnnnnnnannnanccagcnnttnncnnanatntatntanatnantntgnnnnanntattnaanannnntntnnngnnananannnnacnnnanatannnannnntntntnnnannatnnaacanngcnnnnnntttnnnnnnnntnnnannnnnaannnnaaaanntntnnnnnnnannntnnannnnnannnnnannnnnnnanaannntnnnnnnnnaanncnnnnnnngngnnnnnnttntcnnnnntntnntntnnnnncncnntnnnnnnttnngnnnanaaannnnaaanngnnnntnnnnaanannnnnnnnnanaaanntnnnnnnnnatntnngnnnnttnnnnnannnngcnnngnnnanannnngnnnnnnnnnanananaanntntgnnnnannnnnagnntnnnnnnnanntnnnnnntnnnntnncnntntntnntnnnnnnnnntatntttnnnntttnnnnnnnnnngnnnnnnnnananntntttnngannncnntnntnntnncnnttnt

SEQ ID NO: 383 - DNA, 4000 bp, Escherichia coli
  misc_feature (4)..(5): n is a, c, g, or t
  misc_feature (7)..(7): n is a, c, g, or t
  misc_feature (10)..(11): n is a, c, g, or t
  misc_feature (15)..(15): n is a, c, g, or t
  misc_feature (21)..(22): n is a, c, g, or t
  misc_feature (26)..(26): n is a, c, g, or t
  misc_feature (28)..(30): n is a, c, g, or t
  misc_feature (33)..(34): n is a, c, g, or t
  misc_feature (36)..(41): n is a, c, g, or t
  misc_feature (44)..(52): n is a, c, g, or t
  misc_feature (55)..(57): n is a, c, g, or t
  misc_feature (59)..(60): n is a, c, g, or t
  misc_feature (63)..(64): n is a, c, g, or t
  misc_feature (67)..(75): n is a, c, g, or t
  misc_feature (81)..(81): n is a, c, g, or t
  misc_feature (87)..(87): n is a, c, g, or t
  misc_feature (90)..(90): n is a, c, g, or t
  misc_feature (92)..(92): n is a, c, g, or t
  misc_feature (94)..(94): n is a, c, g, or t
  misc_feature (96)..(96): n is a, c, g, or t
  misc_feature (98)..(105): n is a, c, g, or t
  misc_feature (108)..(109): n is a, c, g, or t
  misc_feature (112)..(112): n is a, c, g, or t
  misc_feature (117)..(117): n is a, c, g, or t
  misc_feature (119)..(119): n is a, c, g, or t
  misc_feature (121)..(121): n is a, c, g, or t
  misc_feature (123)..(123): n is a, c, g, or t
  misc_feature (125)..(126): n is a, c, g, or t
  misc_feature (129)..(129): n is a, c, g, or t
  misc_feature (131)..(132): n is a, c, g, or t
  misc_feature (135)..(137): n is a, c, g, or t
  misc_feature (140)..(143): n is a, c, g, or t
  misc_feature (145)..(145): n is a, c, g, or t
  misc_feature (149)..(156): n is a, c, g, or t
  misc_feature (162)..(163): n is a, c, g, or t
  misc_feature (165)..(166): n is a, c, g, or t
  misc_feature (168)..(168): n is a, c, g, or t
  misc_feature (171)..(171): n is a, c, g, or t
  misc_feature (173)..(175): n is a, c, g, or t
  misc_feature (181)..(185): n is a, c, g, or t
  misc_feature (187)..(187): n is a, c, g, or t
  misc_feature (192)..(192): n is a, c, g, or t
  misc_feature (194)..(194): n is a, c, g, or t
  misc_feature (199)..(199): n is a, c, g, or t
  misc_feature (201)..(202): n is a, c, g, or t
  misc_feature (205)..(207): n is a, c, g, or t
  misc_feature (210)..(211): n is a, c, g, or t
  misc_feature (213)..(213): n is a, c, g, or t
  misc_feature (215)..(215): n is a, c, g, or t
  misc_feature (217)..(218): n is a, c, g, or t
  misc_feature (220)..(224): n is a, c, g, or t
  misc_feature (229)..(229): n is a, c, g, or t
  misc_feature (231)..(233): n is a, c, g, or t
  misc_feature (238)..(238): n is a, c, g, or t
  misc_feature (240)..(240): n is a, c, g, or t
  misc_feature (246)..(247): n is a, c, g, or t
  misc_feature (251)..(251): n is a, c, g, or t
  misc_feature (253)..(254): n is a, c, g, or t
  misc_feature (258)..(261): n is a, c, g, or t
  misc_feature (264)..(268): n is a, c, g, or t
  misc_feature (270)..(275): n is a, c, g, or t
  misc_feature (277)..(277): n is a, c, g, or t
  misc_feature (280)..(283): n is a, c, g, or t
  misc_feature (285)..(285): n is a, c, g, or t
  misc_feature (288)..(288): n is a, c, g, or t
  misc_feature (291)..(292): n is a, c, g, or t
  misc_feature (294)..(295): n is a, c, g, or t
  misc_feature (297)..(297): n is a, c, g, or t
  misc_feature (299)..(300): n is a, c, g, or t
  misc_feature (302)..(307): n is a, c, g, or t
  misc_feature (309)..(309): n is a, c, g, or t
  misc_feature (311)..(311): n is a, c, g, or t
  misc_feature (313)..(313): n is a, c, g, or t
  misc_feature (318)..(322): n is a, c, g, or t
  misc_feature (324)..(324): n is a, c, g, or t
  misc_feature (326)..(326): n is a, c, g, or t
  misc_feature (328)..(331): n is a, c, g, or t
  misc_feature (335)..(335): n is a, c, g, or t
  misc_feature (339)..(340): n is a, c, g, or t
  misc_feature (346)..(347): n is a, c, g, or t
  misc_feature (349)..(349): n is a, c, g, or t
  misc_feature (351)..(352): n is a, c, g, or t
  misc_feature (354)..(354): n is a, c, g, or t
  misc_feature (359)..(359): n is a, c, g, or t
  misc_feature (361)..(361): n is a, c, g, or t
  misc_feature (364)..(364): n is a, c, g, or t
  misc_feature (366)..(366): n is a, c, g, or t
  misc_feature (369)..(369): n is a, c, g, or t
  misc_feature (374)..(378): n is a, c, g, or t
  misc_feature (380)..(380): n is a, c, g, or t
  misc_feature (382)..(382): n is a, c, g, or t
  misc_feature (385)..(390): n is a, c, g, or t
  misc_feature (392)..(393): n is a, c, g, or t
  misc_feature (396)..(396): n is a, c, g, or t
  misc_feature (398)..(398): n is a, c, g, or t
  misc_feature (401)..(401): n is a, c, g, or t
  misc_feature (403)..(403): n is a, c, g, or t
  misc_feature (408)..(409): n is a, c, g, or t
  misc_feature (414)..(415): n is a, c, g, or t
  misc_feature (417)..(417): n is a, c, g, or t
  misc_feature (419)..(420): n is a, c, g, or t
  misc_feature (423)..(423): n is a, c, g, or t
  misc_feature (429)..(429): n is a, c, g, or t
  misc_feature (431)..(432): n is a, c, g, or t
  misc_feature (434)..(435): n is a, c, g, or t
  misc_feature (437)..(438): n is a, c, g, or t
  misc_feature (442)..(445): n is a, c, g, or t
  misc_feature (448)..(448): n is a, c, g, or t
  misc_feature (450)..(451): n is a, c, g, or t
  misc_feature (453)..(458): n is a, c, g, or t
  misc_feature (462)..(462): n is a, c, g, or t
  misc_feature (464)..(464): n is a, c, g, or t
  misc_feature (467)..(467): n is a, c, g, or t
  misc_feature (469)..(470): n is a, c, g, or t
  misc_feature (473)..(474): n is a, c, g, or t
  misc_feature (476)..(477): n is a, c, g, or t
  misc_feature (480)..(482): n is a, c, g, or t
  misc_feature (484)..(484): n is a, c, g, or t
  misc_feature (488)..(488): n is a, c, g, or t
  misc_feature (494)..(494): n is a, c, g, or t
  misc_feature (496)..(498): n is a, c, g, or t
  misc_feature (500)..(500): n is a, c, g, or t
  misc_feature (505)..(505): n is a, c, g, or t
  misc_feature (509)..(510): n is a, c, g, or t
  misc_feature (512)..(512): n is a, c, g, or t
  misc_feature (515)..(515): n is a, c, g, or t
  misc_feature (517)..(518): n is a, c, g, or t
  misc_feature (520)..(520): n is a, c, g, or t
  misc_feature (523)..(525): n is a, c, g, or t
  misc_feature (528)..(529): n is a, c, g, or t
  misc_feature (531)..(531): n is a, c, g, or t
  misc_feature (533)..(534): n is a, c, g, or t
  misc_feature (536)..(536): n is a, c, g, or t
  misc_feature (541)..(541): n is a, c, g, or t
  misc_feature (543)..(547): n is a, c, g, or t
  misc_feature (549)..(549): n is a, c, g, or t
  misc_feature (551)..(551): n is a, c, g, or t
  misc_feature (555)..(555): n is a, c, g, or t
  misc_feature (557)..(557): n is a, c, g, or t
  misc_feature (559)..(559): n is a, c, g, or t
  misc_feature (563)..(563): n is a, c, g, or t
  misc_feature (568)..(568): n is a, c, g, or t
  misc_feature (573)..(573): n is a, c, g, or t
  misc_feature (575)..(576): n is a, c, g, or t
  misc_feature (578)..(580): n is a, c, g, or t
  misc_feature (584)..(586): n is a, c, g, or t
  misc_feature (588)..(589): n is a, c, g, or t
  misc_feature (592)..(592): n is a, c, g, or t
  misc_feature (594)..(595): n is a, c, g, or t
  misc_feature (597)..(600): n is a, c, g, or t
  misc_feature (602)..(603): n is a, c, g, or t
  misc_feature (606)..(607): n is a, c, g, or t
  misc_feature (609)..(612): n is a, c, g, or t
  misc_feature (616)..(618): n is a, c, g, or t
  misc_feature (620)..(620): n is a, c, g, or t
  misc_feature (623)..(624): n is a, c, g, or t
  misc_feature (628)..(628): n is a, c, g, or t
  misc_feature (632)..(633): n is a, c, g, or t
  misc_feature (635)..(636): n is a, c, g, or t
  misc_feature (640)..(641): n is a, c, g, or t
  misc_feature (643)..(649): n is a, c, g, or t
  misc_feature (651)..(654): n is a, c, g, or t
  misc_feature (656)..(656): n is a, c, g, or t
  misc_feature (663)..(667): n is a, c, g, or t
  misc_feature (669)..(670): n is a, c, g, or t
  misc_feature (672)..(672): n is a, c, g, or t
  misc_feature (674)..(675): n is a, c, g, or t
  misc_feature (677)..(678): n is a, c, g, or t
  misc_feature (683)..(686): n is a, c, g, or t
  misc_feature (689)..(692): n is a, c, g, or t
  misc_feature (696)..(696): n is a, c, g, or t
  misc_feature (698)..(700): n is a, c, g, or t
  misc_feature (702)..(702): n is a, c, g, or t
  misc_feature (704)..(704): n is a, c, g, or t
  misc_feature (707)..(708): n is a, c, g, or t
  misc_feature (712)..(712): n is a, c, g, or t
  misc_feature (716)..(717): n is a, c, g, or t
  misc_feature (723)..(730): n is a, c, g, or t
  misc_feature (732)..(732): n is a, c, g, or t
  misc_feature (734)..(738): n is a, c, g, or t
  misc_feature (742)..(743): n is a, c, g, or t
  misc_feature (745)..(745): n is a, c, g, or t
  misc_feature (750)..(750): n is a, c, g, or t
  misc_feature (752)..(754): n is a, c, g, or t
  misc_feature (757)..(757): n is a, c, g, or t
  misc_feature (759)..(760): n is a, c, g, or t
  misc_feature (763)..(767): n is a, c, g, or t
  misc_feature (770)..(771): n is a, c, g, or t
  misc_feature (773)..(773): n is a, c, g, or t
  misc_feature (775)..(779): n is a, c, g, or t
  misc_feature (781)..(781): n is a, c, g, or t
  misc_feature (783)..(783): n is a, c, g, or t
  misc_feature (789)..(790): n is a, c, g, or t
  misc_feature (792)..(792): n is a, c, g, or t
  misc_feature (794)..(799): n is a, c, g, or t
  misc_feature (804)..(806): n is a, c, g, or t
  misc_feature (811)..(811): n is a, c, g, or t
  misc_feature (813)..(814): n is a, c, g, or t
  misc_feature (817)..(817): n is a, c, g, or t
  misc_feature (823)..(828): n is a, c, g, or t
  misc_feature (833)..(835): n is a, c, g, or t
  misc_feature (837)..(838): n is a, c, g, or t
  misc_feature (842)..(843): n is a, c, g, or t
  misc_feature (845)..(845): n is a, c, g, or t
  misc_feature (848)..(848): n is a, c, g, or t
  misc_feature (851)..(851): n is a, c, g, or t
  misc_feature (854)..(855): n is a, c, g, or t
  misc_feature (857)..(857): n is a, c, g, or t
  misc_feature (859)..(859): n is a, c, g, or t
  misc_feature (862)..(867): n is a, c, g, or t
  misc_feature (869)..(869): n is a, c, g, or t
  misc_feature (872)..(872): n is a, c, g, or t
  misc_feature (876)..(876): n is a, c, g, or t
  misc_feature (878)..(888): n is a, c, g, or t
  misc_feature (890)..(891): n is a, c, g, or t
  misc_feature (897)..(900): n is a, c, g, or t
  misc_feature (902)..(905): n is a, c, g, or t
  misc_feature (908)..(913): n is a, c, g, or t
  misc_feature (916)..(917): n is a, c, g, or t
  misc_feature (919)..(919): n is a, c, g, or t
  misc_feature (924)..(926): n is a, c, g, or t
  misc_feature (928)..(931): n is a, c, g, or t
  misc_feature (933)..(934): n is a, c, g, or t
  misc_feature (936)..(937): n is a, c, g, or t
  misc_feature (948)..(950): n is a, c, g, or t
  misc_feature (953)..(953): n is a, c, g, or t
  misc_feature (955)..(957): n is a, c, g, or t
  misc_feature (959)..(960): n is a, c, g, or t
  misc_feature (963)..(963): n is a, c, g, or t
  misc_feature (965)..(965): n is a, c, g, or t
  misc_feature (968)..(969): n is a, c, g, or t
  misc_feature (971)..(971): n is a, c, g, or t
  misc_feature (973)..(973): n is a, c, g, or t
  misc_feature (975)..(975): n is a, c, g, or t
  misc_feature (977)..(978): n is a, c, g, or t
  misc_feature (983)..(983): n is a, c, g, or t
  misc_feature (986)..(988): n is a, c, g, or t
  misc_feature (990)..(992): n is a, c, g, or t
  misc_feature (994)..(994): n is a, c, g, or t
  misc_feature (997)..(998): n is a, c, g, or t
  misc_feature (1001)..(1006): n is a, c, g, or t
  misc_feature (1010)..(1010): n is a, c, g, or t
  misc_feature (1012)..(1013): n is a, c, g, or t
  misc_feature (1016)..(1016): n is a, c, g, or t
  misc_feature (1018)..(1018): n is a, c, g, or t
  misc_feature (1022)..(1022): n is a, c, g, or t
  misc_feature (1024)..(1026): n is a, c, g, or t
  misc_feature (1028)..(1031): n is a, c, g, or t
  misc_feature (1033)..(1034): n is a, c, g, or t
  misc_feature (1037)..(1037): n is a, c, g, or t
  misc_feature (1040)..(1041): n is a, c, g, or t
  misc_feature (1044)..(1044): n is a, c, g, or t
  misc_feature (1046)..(1046): n is a, c, g, or t
  misc_feature (1048)..(1051): n is a, c, g, or t
  misc_feature (1053)..(1055): n is a, c, g, or t
  misc_feature (1058)..(1059): n is a, c, g, or t
  misc_feature (1062)..(1067): n is a, c, g, or t
  misc_feature (1069)..(1071): n is a, c, g, or t
  misc_feature (1074)..(1075): n is a, c, g, or t
  misc_feature (1078)..(1079): n is a, c, g, or t
  misc_feature (1081)..(1083): n is a, c, g, or t
  misc_feature (1089)..(1092): n is a, c, g, or t
  misc_feature (1094)..(1096): n is a, c, g, or t
  misc_feature (1099)..(1099): n is a, c, g, or t
  misc_feature (1102)..(1103): n is a, c, g, or t
  misc_feature (1106)..(1106): n is a, c, g, or t
  misc_feature (1108)..(1108): n is a, c, g, or t
  misc_feature (1111)..(1111): n is a, c, g, or t
  misc_feature (1114)..(1121): n is a, c, g, or t
  misc_feature (1123)..(1126): n is a, c, g, or t
  misc_feature (1129)..(1130): n is a, c, g, or t
  misc_feature (1133)..(1133): n is a, c, g, or t
  misc_feature (1135)..(1135): n is a, c, g, or t
  misc_feature (1140)..(1141): n is a, c, g, or t
  misc_feature (1145)..(1146): n is a, c, g, or t
  misc_feature (1148)..(1150): n is a, c, g, or t
  misc_feature (1153)..(1153): n is a, c, g, or t
  misc_feature (1156)..(1167): n is a, c, g, or t
  misc_feature (1169)..(1169): n is a, c, g, or t
  misc_feature (1173)..(1175): n is a, c, g, or t
  misc_feature (1178)..(1182): n is a, c, g, or t
  misc_feature (1185)..(1185): n is a, c, g, or t
  misc_feature (1187)..(1193): n is a, c, g, or t
  misc_feature (1195)..(1195): n is a, c, g, or t
  misc_feature (1197)..(1199): n is a, c, g, or t
  misc_feature (1202)..(1202): n is a, c, g, or t
  misc_feature (1204)..(1204): n is a, c, g, or t
  misc_feature (1206)..(1207): n is a, c, g, or t
  misc_feature (1209)..(1209): n is a, c, g, or t
  misc_feature (1214)..(1217): n is a, c, g, or t
  misc_feature (1220)..(1220): n is a, c, g, or t
  misc_feature (1224)..(1224): n is a, c, g, or t
  misc_feature (1226)..(1226): n is a, c, g, or t
  misc_feature (1228)..(1230): n is a, c, g, or t
  misc_feature (1232)..(1233): n is a, c, g, or t
  misc_feature (1240)..(1242): n is a, c, g, or t
  misc_feature (1245)..(1249): n is a, c, g, or t
  misc_feature (1253)..(1255): n is a, c, g, or t
  misc_feature (1257)..(1257): n is a, c, g, or t
  misc_feature (1262)..(1265): n is a, c, g, or t
  misc_feature (1267)..(1269): n is a, c, g, or t
  misc_feature (1274)..(1276): n is a, c, g, or t
  misc_feature (1278)..(1278): n is a, c, g, or t
  misc_feature (1281)..(1281): n is a, c, g, or t
  misc_feature (1283)..(1283): n is a, c, g, or t
  misc_feature (1285)..(1287): n is a, c, g, or t
  misc_feature (1290)..(1290): n is a, c, g, or t
  misc_feature (1292)..(1295): n is a, c, g, or t
  misc_feature (1297)..(1299): n is a, c, g, or t
  misc_feature (1301)..(1301): n is a, c, g, or t
  misc_feature (1306)..(1307): n is a, c, g, or t
  misc_feature (1312)..(1312): n is a, c, g, or t
  misc_feature (1315)..(1315): n is a, c, g, or t
  misc_feature (1318)..(1318): n is a, c, g, or t
  misc_feature (1320)..(1323): n is a, c, g, or t
  misc_feature (1329)..(1332): n is a, c, g, or t
  misc_feature (1334)..(1337): n is a, c, g, or t
  misc_feature (1339)..(1340): n is a, c, g, or t
  misc_feature (1344)..(1345): n is a, c, g, or t
  misc_feature (1349)..(1356): n is a, c, g, or t
  misc_feature (1359)..(1359): n is a, c, g, or t
  misc_feature (1362)..(1362): n is a, c, g, or t
  misc_feature (1371)..(1371): n is a, c, g, or t
  misc_feature (1375)..(1377): n is a, c, g, or t
  misc_feature (1379)..(1381): n is a, c, g, or t
  misc_feature (1386)..(1387): n is a, c, g, or t
  misc_feature (1389)..(1390): n is a, c, g, or t
  misc_feature (1392)..(1394): n is a, c, g, or t
  misc_feature (1405)..(1405): n is a, c, g, or t
  misc_feature (1419)..(1419): n is a, c, g, or t
  misc_feature (1422)..(1423): n is a, c, g, or t
  misc_feature (1425)..(1425): n is a, c, g, or t
  misc_feature (1434)..(1434): n is a, c, g, or t
  misc_feature (1436)..(1437): n is a, c, g, or t
  misc_feature (1463)..(1463): n is a, c, g, or t
  misc_feature (1466)..(1466): n is a, c, g, or t
  misc_feature (1518)..(1518): n is a, c, g, or t
  misc_feature (1522)..(1522): n is a, c, g, or t
  misc_feature (3063)..(3063): n is a, c, g, or t
  misc_feature (3085)..(3085): n is a, c, g, or t
  misc_feature (3277)..(3277): n is a, c, g, or t
  misc_feature (3544)..(3544): n is a, c, g, or t
  misc_feature (3580)..(3580): n is a, c, g, or t
  misc_feature (3598)..(3598): n is a, c, g, or t
  misc_feature (3607)..(3607): n is a, c, g, or t
  misc_feature (3664)..(3664): n is a, c, g, or t
  misc_feature (3691)..(3691): n is a, c, g, or t
  misc_feature (3901)..(3901): n is a, c, g, or t
  misc_feature (3916)..(3916): n is a, c, g, or t
  misc_feature (3925)..(3925): n is a, c, g, or t
  misc_feature (3997)..(3997): n is a, c, g, or t
aaanncnatnnttanaaaaannattngnnnaannannnnnncgnnnnnnnnnaannngnnggnnaannnnnnnnntaaaanaacgcnttngnanancnnnnnnnnaanncgnaagcntnanangnnaantnnaannngcnnnngnaaannnnnnnngaaaannannanagnannnaaaaannnnngnaaaantnaccgnannttnnnaannantnanngnnnnnaaaancnnnctttncnaaaaannaaancnntttnnnnaannnnnannnnnnantgnnnnanccnaannannantnngnnnnnnantncnaaatnnnnntnancnnnntttngaannaaaaanncnanncnttaancnaancnatnaaacnnnnntngnaannnnnntnnaancnttncntgaannaattnnangnnttnaaaaangnntnnannaaannnnttnannannnnnnaaangnaangnnggnntnnaannngnaatnaaaaangnnntngaaantggnntnaananntngcnnnaanntnannanttaancnnnnnantnaaangngnaaanaaaancttangnnannngggnnnannacnanntnnnngnncanntnnnntggnnngnttnnttgnaaanntnnattnnannnnnnnannnnantttaaannnnnannangnngnngaaannnnccnnnntttntnnncnanttnnccgntgannaaaacnnnnnnnntnannnnnaaanntnattgnannnttncnnaannnnngtnnantnnnnngntnaatttnnangnnnnnntttannnagggngnntantaaagnnnnnnaaaannncnntgannanttncancgnnangnttnnnnnnanttnattngnnnnnnnnnnncnnattttnnnntnnnnttnnnnnntgnngnacccnnntnnnntnnanncttaaaattannnccnannntnnttnantanngntntnannaaaangtnnntnnngnttnncannnnnncctnannccnantttncnnncnnnngnnaanttnnggngnannnnannnggnnatnnnnnngnnnaannaanngnnnaaaaannnngnnnaanttnnaancnaanttnnnnnnnngnnnnacnnttnancaaanngggnnannnccnttnnnnnnnnnnnnancaannnaannnnnccntnnnnnnncntnnnggncnannangtttnnnnggnaaantngnnngnnttaaagnnntgnnnnnaaannntnacaannnnannncaaannntnaantnannnatnannnngnnnanttaanncgtcnatntcntnnnnctaacnnnnannnngnnaaannaagnnnnnnnnttnaanttttctttnaaannngnnnttttnntnncnnnttttttatttnaatttttatttgtnggnnantttatggcnanngaacaaaaagaaatcacggatccatntgnaaaatataacgaacaaaccagttttctaagcaaaacaatttttgcaagtcgntggntacaagtgcctatttacttaggtttaattgtcgtgcaaggcatctatgcttacaagtttatgaaaaacttgtggtaccttttaaccaatgttaatgaaatggatgcggataccattatgctcgctgtactcaatctcattgatgtagtgatgattgctaacttattagtaatggtaacattaggtggttatgagattttcgtttcaaaacttcgtacgaaaaatcatcccgatcaacctgaatggatgagtcatgtgaatgcaactgtgctgaaagttaaactttccatgtcaattatcagtatttcgtcgattcacttattgcaaacctttgtgaatgcctcaaaaattcctgaaaaaacgattatgtgggaagtgattattcatttttctttcttgatttcggcaattgcaatggcttataccgacaaaattctctacagtacaagtcataaaaatcattagtacacaaagtgcggtcaaaattgaccgcactttttgtatttaaacctataaaaatattcactttatacttacaataaaatctgataacctgagcaaatcactatattattatcacgtatcttttaataaggaaatatatctcataataaggaaatatatctcatgttatctcataagattaagctaatttttctagttgcgtttacactctttttaacaagttgctcaacaatgtataacccattagacactttatactggcatggtaaagaagactatgagttttttgctcgaaaacgtttaccggatgaatcttatcaatgctttaaagacaatgaaagaagttatattcacgcttatcgacttgctctttatgatttacaaacctatgaagttggcagaaacgctagaacaatctttctaacaacagaaaaagtatatactggtggccatacatggacttatgtatttacggatgcaagccataaaatcacatctattagagatgccacagggtttggagacattgaaaaagaatttggttgtggtgagtatcaagaagcagtaaaaattgctacaccagaagaactaaaaaaacgcaaaattaaacctagattatgggctgcaattgttcgcactccagaaataaatcaaatgatgtgggcttctgatgcagcttatagtactcttgagcaagccaaacaagattcactaaaacaatgtcaagagtatggtggcaaagactgccaattagtgattggtataagtaatatgtgtttagggctagctagtggtcgagatagtagtggtatgagagattacttcggaaatagcatcattcctgagcacgctaaagaaatggcggttgaaaattgccaagcgaaaggaggttcatcttgtaagcctagcccagccccttcgctttgcgccctaccgtgtgatatgcttaaagataaaacttgtaacttcgatagccctcaggtcatcattccaggagttaaaggcggaaaagcatttaacgtagcattagatggtaatgtacttaaatagtaaataatattttcaaagtgcggtcanatttgaccgcacttttgttttntaaaactcatcttgatgtttaaatttcaataaatctcgacgttcttttttatttggacgacgatcaggatgtggcattgaaagcgcattattttttcttgcccacgccatttcttcccgttttttcacactctgtgctgtttcttggtaaagcagttgagcctcaggtgcaccacgacgttgatcgctcaangcaatcacttcaatttctttttcatcgctgccttggcgaagtttaatcatcgccccgatttctacatttttacttactttggcacgctgaccgttgtaatggactttgcccccttcaatcatcgctttcgcaatgctacgagttttataaaaacgcgccgcccaaagccatttatctaaacgcacttcgttattttcagccataactcttcctatttctctcactttgcgtatgatgagccaatgacaagataatagggctaatatnatgaaaaaacaacttccacacattctctccctttcnacggtggcaaaatcccgnttgtttganattcaagctgttgatctcaaattctctaatggaattgaccgcacttatgaacgtttncgccctttcaatcgagattcagtgatngtgattgccattgatggtgaagatttactcctggttcgtgaatacgcagtcggaacagaacaatatgagttaggctttgtaaaaggtggaatggatacgggagaaacacccgaacaaagtgcgaatcgtgaattacaggaagaaattggcttgggggcaaaaaaatggacatttttacgcacgatgaagatcaatccacaaattatgggncataaaatgcacgtnttattaggngaagatctgtatccaaatcaactagaaggcgatgagcctgaaccattagaaatcgtgcgttatcctttatcncaa

SEQ ID NO: 384 - DNA, 4000 bp, Escherichia coli
  misc_feature (1989)..(1989): n is a, c, g, or t
  misc_feature (1994)..(1994): n is a, c, g, or t
ctgatctcgcacgaacgagacgagcatggtgatcgtgaagtcgccgcgcagtcgcgccatgcgactctcctcgacgtttcctcgcgccgccgacaccgcggccgtgacttcgttcacgatgcccttgcgatctcgaccgaacgacgtgatgacgtatcgcgacaccgcgccgtgcgccggtttgcgcgcgcgcgcggcgtacgacgcggacggcgtcgtcgtcgccgcgagcgtgtcgagcggtcgcgggaacgccgcgttcgcgggcggcgcggcgcgagacgcgcgcgaagcgaggaacgggagcgaacgcgcgatgcgcgcgatcgcgagcgggtcgacggcgcgcgacatgacgcgtgcgcggtcgaacgcgcgcgctgtgggtgtcggagtgcggcgaacgcgcccagagcggcgcggggtcggcggccatcgacaatctacgagctaatggtggtttacaagtgcgcagtgcgcgtgaacccaaagttatcttcgtccgcttgagtttcgttcgcggctgggccgagcggatcgtaggaacccgtgttcttctcaaactgggacgcgagattcggttagtcgtcatcggagcggattgaaagtgccgttgttcttctcgaactacgggcgatcgcgacgtcagtcgtgtcgtaaaacgcgcacgtccgcatacgatcgcgcgcgcgtcacgagacgtacctgcgttgcgattcctgggtttctgcgaagcgtccagcacggatcccctccaaacgtttgccgcaagtcctcgagaagcatctcgatgtccataaacagcaacgacggaaagtcactgagcatcagatctattctacagtctttcggcatcgcctttcgcagcgcggagacggcgatggccgccctggagtacgctcgatcctcgagacacagcgccggccgccctcggagcagtttgacgatgtccgcgtccggcatcagcgctcgtaaacccgtcacacgctccaagatcccgtccaactcttcctgcgacgcgagcaaacacgacggaatcgtcgcgaacaacccatcggcgtcgcacgcgtctcctaatcgctccctcgtcgacgccgcgcgttcccgcaccccctcgagcgcttcctctcgaagacgcagcaatctcggctcgcgcgcgcacacgtctcccgcgtccacgtccgcgctcgcgaaagtatttttaatcgccaacatggccgccatcgtctccctcagatccaccgcgagctccgccgcgagcgctcgcttcacctcgcctctcgccactctttccccgagccccgggcacagcgcgaacaaccgatcgacgtcgcgcgccagcgcgtccgcgtccacgccccgcgcgtccgcgacgacgtccgcggccaatcgcccgagcgcgtcgtccgcgcgtccctccaggatgtgtttcaccttcaccgttcgcccgagcaggttcagcgccggccgcgtcggcgtcgcgcgcgcgtcgtcctccgccgcgcgtctcgcgccgcgcgcgcgtcgcgatgcgcgcgtcgcgatgcgcgcgtcgcgcggcgccgcgcgcgccgtcgcgcgcgacatcgcgcgtctcgcagtcgcgcgtcgccactcgatggcgcgcgcgacgcctcgcgcggcgcgcgccgtcgacgcgcgaccgcgcgcgcgcgcgacgaggcgcgcgtcgaccgcgcgcgggtcgaacttcgacgccctcgtgttcgacctggacggcgtgctgtacgacggcgcgaacgggtacctcgcgcacgtgcgcgcgcgacagcgcgcgtacctgcgcgaacgcttcggcatgacggcggcggaggcggcggcgacgcggaaaacggcgttcgcgaaggcgagtcagtgctacaagggcctgcgcgatctcgggctggacgtcgagtcgcaggaggcgttcacggcgtactgccgcgcgggcgcggagacgtttctgaagccggacgcggcgctcgcggngtgcntgcgagcgatgccgtatcggaaggtggtgatgacgaacacgagcgagacggaagggatgaaagcgctgacggcgctgggactggacgcgtcgtcgagcgatgcgttcgagaaggtgtacggggggattttcacggcgccggcgtgcaagccgcagcgcgaggcgttcgagaaggtgttcgcagatctgggacgcgacgtggacccgcggcggtgcgtgatgtttgaggattcgatgaagaatgtaaaggcggcgaagtcgttcggcatgacgacggtgttcgtgcgcacgcgaggcgagagcgtgctcgacgacgacgtcgaagcgtgttgcgacgccgtcgtcgacgagatcgagttcgaacaactgcgccggcaactgcccgagctgttcgattaggcgcgagtcgcgatgcgcgcgacgagcgaattagtgtaccgccgcgcttcaaccggcgaaacgcggtggaattatttaaatgaagattgagactgttgtaaaatgttacacggcgcccgccgactaaaataaaacgagacgcgcgcgcgtccctaccacgtgtacgccgccaacgccgcgctcgccgccgcgctcaccccgaatatcgccaacgagctcgcgttcgcgctttcgttatcgatccccttcgtcgtcgagtcccacaccaagtgtcgaaacccgccgagcgtgtgaaacacgaacggaaaactcagcgcaaacttcaccggcaccaccgccagcggcgcgttcgctttaaacatttccatcgtcatcggcaccgcctccgcgcctccgacgagcgctatgatcccccccgcgctcatcgctcccgtgagcgcgacgcccgtgacgcgattcgtgatcgagctcagcgccaccgccggaaacttatagtgcgcgcgccagctcccgtccgccgcgaacacgtccggcgacatcggtcgcttctccagcagcgcgcggtggttcttcggcgtgcccaggaacccggtgccgcccgtcgccggttgtccgtagtcgtccgggacaccgcgcgatccgatcgcgcgcgtcgccgtcgccgcgcgcgtcgcctcgacgatcgcgcgcgccgtcgacgcgcgcctcgcgcgatccgcgatcgcgcgcgccgcggacatgaccgccgtcgtcgcgtcgcgtcgcgctctcgcgcgtcggcgtcgggcgatcgcgacgccgcgcgggacaccatggcgctcgcgcgcgcgcgaatcgcgcccgtcgcgcgcgacgcgcgggcgacgcgcgcgacgacgtcgaggcgcgagctcgcgggcgcggtcgcgctcgtcgcgacgctcgggcgatgcgacggcgcgcgcgcatcgcgcgatgcgatggattacgacgccgacacgctcgacgcgctcgacgcggcgacgcgggtggtgcgagggaaggcgagggagggcgatcgcgagcggatcgacggatggtacgagcggaacaagcggcggtacgataacgcgacgcgagggaagtcgttcttgatgacgacgaagacgctgcgatacgccgcgggacgcgagcggagcgagacgttcgacgaggcgaagtttgatgaatgggtgaagctttcgcgagcgctcaccgatgggtcgatgagcgtgaaagagcagcgcgaggcgtacggcgcggcggtttgggcgaataacgataagagcgacgcgaagaatcgaatcgggctctgcgcgttcggcgcgacggggccgacgcgagcgctcggtatcgattgttcgggcttttagattgtgattgatttattgtttttgcgagctgcgatgcgtgagatataaaaaatgtgtgcgcggtgtatctaacggcctctttggagactcggagttcgtcccgggatggggaacttgctcaaatcgtctcgcgtgcgctcggcgagacgctgctggaatttttctataaacttgttcgacatgcgttgaacgcctggcgcaaccgtgggaaggatggcgcgaatcgagtcggtttcga

SEQ ID NO: 385 - DNA, 4000 bp, Escherichia coli
  misc_feature (1635)..(1635): n is a, c, g, or t
  misc_feature (1988)..(1988): n is a, c, g, or t
  misc_feature (1991)..(1991): n is a, c, g, or t
  misc_feature (3646)..(3646): n is a, c, g, or t
  misc_feature (3995)..(3995): n is a, c, g, or t
aggaggtaaacgcatgattaagacattgcaaagacgttttgcattatcaagacagggggctgtcgatttgataaaaggctgtattgcctgcgtcgtacaggatatatcctttatgctccctgtgggattgctctattactttgtcattgacaccatgaatgggaacttgaatggaagccgcattgctttttatgcggttggttctttggtttgcttatgccttatatttattgcgacttggtttcaatataacgccacttacttagcgacttatgtggaaagcggggtaaggcgtatatccttagcggaacggctacgcaaaatcccgttgtccttttttggcaaaaaagaccttgcggatttaaccaattctattatgggagactgtgctacgcttgaaactgcattctcccattatgtacccgcattggcaggctccctcatttcaacaacactaattgcaatctgcctttttgcttacgactggcgaatggctcttgcggcggtgtgggttttaccgattgcatttacaatcacattcttttcagctcgcatacaggaatacttcaactgtaaatctgtagcggcaaatgtcgcgcttgaaagcggtgtacaagagtgtatcgaaagtttacaggacttgaaatcaaacaatgcggaagaaagttatctgaaaggacttgacaaaaaaattgactatgtagaaaaacggcacattataacagaacttggaacagcactttttgttgtttcttcaacactaatattaaagtttggaattgctacggttgcgcttgtaggctctacgctgcttattcgtggagaaattgatattccgctgttttttatgttcttgcttgtagcttcaaggctttatgccccgcttgaaggcgcattgcaaaatcttgctgcggtaatctctacgaaaacgaacatagaccgcatgaacgaaatccttgaccaacctattcagacaggggaaaatcaactgataaataaaggttatgacattgtattcgaccatgtaggatttgcttataatactggggaaaccgtattgaaagatgtgtcttttacggcaaaacagggagaagttaccgctttagtcggaccgtccggcggcggaaaaactacggtgtcgcgtcttgcctcgcggttttgggacataaacaaagggaagattactgtcggtggtatggatatatcgaaaatagagccggaaaccttgctgtctctgtactctatcgtatttcaagatgtgacgctgtttaacaacacaatcatggagaatatcagaataggcagaaaggacgcgaccgacgaagaagtaattgcggcggcaagactagcaaattgtgaagaatttgcagaaaagctcccagacgggtataacagtatgattggtgaaaatggttgcgaattgtctggcggggaaaggcagagaatttcaatcgcccgcgcttttctcaaaaattcccctattatcttacttgatgaagcaacggcaagtcttgatgtggaaaatgaaacattgatacaggctgctttgtcaagactgataaaggacaagaccgtacttgttatcgcccaccgtatgcgtaccgtaagcggcgcagataaagtggttgtgctttnaaacggtacggttgccgaacagggaacgccggaaaaactgatgaacacaggcaaaatttatccgcatatggtaaagctgcaaatgattagtcaggattggggaatttagatttctaactgaaattgaatgatatagatttcatattttcccattagtgagaaacgcaaagaggtcgacattatgaaaacagaatggatactttgccctgtctgcggcaataaaacccgaacaatgatacaggaaaatactgagatgagaaactttcctctctactgtccgaagtgcaaaaaagaaacaatcatcaatgttcaggatatgaaaatcacgcttgcagtcagcaaataattatgtnccnccgccgctatgggtaacaccataacggcggtttttccatatctatcggctatctctgtcaatggattttttgcgctgtctttggggtggtttctgcctatttttatcctgtatctcccgcaaatgttttaatacgctctgcttttcgggtggtctgcgctgctctttggcggcggctgacggtttcctgctggtctgacgctcccactcggcaaggtcacggctgtactgttccacaacgctttccatttctcggaaagtacgcatgaacgcctgcacatcgggataaccgtcctctttcagaatatcgggcagcatatccagttttgcagcgatttccttttccgtctgctgtatctgctcggacagggctttacgctccttgcctttgaaaagcccctttgtgtctgcaagctgcgctttcagtttcgggagaacatcgtcctgcaaacggcggatttcccttgcgccctcctgcgcctttatcatcagatttttcatgcgtcgaaattccgccatatccatatccagcgtaggcttgggcggcatatccttttctcggataaggctttgcagaagctcctttgccctgccgataatgctgcggaacaaggtaggcagccagcccttttctttaatggactgacttgccttttggtggatttcctctttcttgatttccagtatctttgtttcctcaatccccgataacaatgccatatccgccgtcctgttccattcctgccttgcggcgttgtcggcttcaatctcggcggctttgggattgttcttaccgattttcttggtaggaagataaacgctgttcttatcaaatacctttaactgctgttcgggatcagcaatatggcgattgataaggtcagtgtaaatctcttttacctcccgaagaaaaggctcgcttttgaatttatcatctttcacggtaaagaggtggctttcgtaaacctcgccctttttaatgacggtgcagccttttcgtatctgtccgtcctcccctgtgatttctttcttggtgcgtacccttttgcctgtttcatcatagaacacgctgcgtgtggctatcttgatgtcaggttcaggaagcagctttctttcgctgaagataaggtggatatgatagtttgtcttgcgtttgttgtggtggagggctgacacgcactctacaccataccgcctgtggaactcctccgtaaaatcttcaaggacttcctgcggctcgtattttgtatatacttcgggcagggcgataatcaattcccttgcttcaatacatttgccctccgtaccgcttcgcttaaattcctgctggctttcccttgcaaggttactccaaaattcattgtcggcggtgcggtaggtggcatagagattttcctgtcttgcgtggcttgtgatataggatattcttcccttgacattgggtagctttgacatctgtataaaactgtgtcttgccatatactccttcctcccgtgacgggcatactctttttgcaaccgagaaatcggttgctgctgtttcggcagcgtaagcagacggacagcgaagaaaacagcgtgctgttttcttctgtatcatagcggcggtgcattgtccgaagctgtgatacatagccccctgcaagggcgaaatanccagagtacaactcgaagatttgtgcgaggggtgtatttcgctctcaaacgccgagggcttggagaatggttattctactttgcgaacatcgttttcattgagcaggtttcttccctgattgacgctcataaatcgctctaaagtatccctgcggataatcgcttttcttccgaccttgaggacgggaagtttgccccagtctaccaacttacgcattgtatttcttccgatacccgtacattctgcggcttcttctatggttaaacccattttgatgttgctcattttatcaacctcctttcaaaatacgcattttgcaactatgtatctgtaattatacttattttnctatc

SEQ ID NO: 386 - DNA, 4000 bp, Escherichia coli
  misc_feature (1)..(18): n is a, c, g, or t
  misc_feature (21)..(24): n is a, c, g, or t
  misc_feature (26)..(31): n is a, c, g, or t
  misc_feature (34)..(43): n is a, c, g, or t
  misc_feature (45)..(50): n is a, c, g, or t
  misc_feature (52)..(54): n is a, c, g, or t
  misc_feature (58)..(63): n is a, c, g, or t
  misc_feature (65)..(67): n is a, c, g, or t
  misc_feature (69)..(82): n is a, c, g, or t
  misc_feature (84)..(105): n is a, c, g, or t
  misc_feature (108)..(115): n is a, c, g, or t
  misc_feature (118)..(118): n is a, c, g, or t
  misc_feature (120)..(120): n is a, c, g, or t
  misc_feature (123)..(127): n is a, c, g, or t
  misc_feature (130)..(131): n is a, c, g, or t
  misc_feature (133)..(134): n is a, c, g, or t
  misc_feature (137)..(138): n is a, c, g, or t
  misc_feature (140)..(142): n is a, c, g, or t
  misc_feature (144)..(155): n is a, c, g, or t
  misc_feature (158)..(186): n is a, c, g, or t
  misc_feature (189)..(192): n is a, c, g, or t
  misc_feature (202)..(202): n is a, c, g, or t
  misc_feature (220)..(220): n is a, c, g, or t
  misc_feature (226)..(226): n is a, c, g, or t
  misc_feature (229)..(229): n is a, c, g, or t
  misc_feature (232)..(232): n is a, c, g, or t
  misc_feature (235)..(235): n is a, c, g, or t
  misc_feature (238)..(241): n is a, c, g, or t
  misc_feature (245)..(248): n is a, c, g, or t
  misc_feature (251)..(251): n is a, c, g, or t
  misc_feature (253)..(253): n is a, c, g, or t
  misc_feature (255)..(270): n is a, c, g, or t
  misc_feature (272)..(286): n is a, c, g, or t
  misc_feature (293)..(294): n is a, c, g, or t
  misc_feature (297)..(322): n is a, c, g, or t
  misc_feature (324)..(340): n is a, c, g, or t
  misc_feature (343)..(343): n is a, c, g, or t
  misc_feature (347)..(371): n is a, c, g, or t
  misc_feature (373)..(375): n is a, c, g, or t
  misc_feature (377)..(383): n is a, c, g, or t
  misc_feature (385)..(386): n is a, c, g, or t
  misc_feature (388)..(389): n is a, c, g, or t
  misc_feature (392)..(392): n is a, c, g, or t
  misc_feature (395)..(395): n is a, c, g, or t
  misc_feature (398)..(404): n is a, c, g, or t
  misc_feature (406)..(407): n is a, c, g, or t
  misc_feature (409)..(410): n is a, c, g, or t
  misc_feature (412)..(420): n is a, c, g, or t
  misc_feature (422)..(428): n is a, c, g, or t
  misc_feature (431)..(434): n is a, c, g, or t
  misc_feature (436)..(440): n is a, c, g, or t
  misc_feature (442)..(451): n is a, c, g, or t
  misc_feature (453)..(466): n is a, c, g, or t
  misc_feature (468)..(492): n is a, c, g, or t
  misc_feature (494)..(495): n is a, c, g, or t
  misc_feature (497)..(499): n is a, c, g, or t
  misc_feature (501)..(501): n is a, c, g, or t
  misc_feature (503)..(503): n is a, c, g, or t
  misc_feature (505)..(506): n is a, c, g, or t
  misc_feature (508)..(509): n is a, c, g, or t
  misc_feature (514)..(515): n is a, c, g, or t
  misc_feature (517)..(519): n is a, c, g, or t
  misc_feature (521)..(539): n is a, c, g, or t
  misc_feature (541)..(548): n is a, c, g, or t
  misc_feature (551)..(552): n is a, c, g, or t
  misc_feature (554)..(555): n is a, c, g, or t
  misc_feature (557)..(557): n is a, c, g, or t
  misc_feature (559)..(560): n is a, c, g, or t
  misc_feature (563)..(563): n is a, c, g, or t
  misc_feature (565)..(566): n is a, c, g, or t
  misc_feature (569)..(599): n is a, c, g, or t
  misc_feature (609)..(610): n is a, c, g, or t
  misc_feature (612)..(621): n is a, c, g, or t
  misc_feature (623)..(623): n is a, c, g, or t
  misc_feature (625)..(626): n is a, c, g, or t
  misc_feature (628)..(634): n is a, c, g, or t
  misc_feature (636)..(640): n is a, c, g, or t
  misc_feature (642)..(642): n is a, c, g, or t
  misc_feature (644)..(645): n is a, c, g, or t
  misc_feature (647)..(647): n is a, c, g, or t
  misc_feature (652)..(652): n is a, c, g, or t
  misc_feature (654)..(656): n is a, c, g, or t
  misc_feature (658)..(659): n is a, c, g, or t
  misc_feature (661)..(662): n is a, c, g, or t
  misc_feature (664)..(666): n is a, c, g, or t
  misc_feature (668)..(669): n is a, c, g, or t
  misc_feature (671)..(671): n is a, c, g, or t
  misc_feature (674)..(674): n is a, c, g, or t
  misc_feature (676)..(676): n is a, c, g, or t
  misc_feature (678)..(680): n is a, c, g, or t
  misc_feature (683)..(683): n is a, c, g, or t
  misc_feature (685)..(687): n is a, c, g, or t
  misc_feature (690)..(699): n is a, c, g, or t
  misc_feature (701)..(709): n is a, c, g, or t
  misc_feature (711)..(712): n is a, c, g, or t
  misc_feature (714)..(714): n is a, c, g, or t
  misc_feature (718)..(727): n is a, c, g, or t
  misc_feature (729)..(755): n is a, c, g, or t
  misc_feature (766)..(766): n is a, c, g, or t
  misc_feature (775)..(778): n is a, c, g, or t
  misc_feature (780)..(784): n is a, c, g, or t
  misc_feature (791)..(791): n is a, c, g, or t
  misc_feature (794)..(799): n is a, c, g, or t
  misc_feature (801)..(801): n is a, c, g, or t
  misc_feature (804)..(804): n is a, c, g, or t
  misc_feature (806)..(810): n is a, c, g, or t
  misc_feature (813)..(814): n is a, c, g, or t
  misc_feature (816)..(816): n is a, c, g, or t
  misc_feature (819)..(822): n is a, c, g, or t
  misc_feature (824)..(831): n is a, c, g, or t
  misc_feature (833)..(834): n is a, c, g, or t
  misc_feature (837)..(838): n is a, c, g, or t
  misc_feature (840)..(840): n is a, c, g, or t
  misc_feature (842)..(844): n is a, c, g, or t
  misc_feature (849)..(849): n is a, c, g, or t
  misc_feature (851)..(853): n is a, c, g, or t
  misc_feature (855)..(858): n is a, c, g, or t
  misc_feature (860)..(862): n is a, c, g, or t
  misc_feature (864)..(869): n is a, c, g, or t
  misc_feature (871)..(887): n is a, c, g, or t
  misc_feature (889)..(890): n is a, c, g, or t
  misc_feature (892)..(892): n is a, c, g, or t
  misc_feature (894)..(897): n is a, c, g, or t
  misc_feature (899)..(901): n is a, c, g, or t
  misc_feature (903)..(903): n is a, c, g, or t
  misc_feature (905)..(908): n is a, c, g, or t
  misc_feature (911)..(915): n is a, c, g, or t
  misc_feature (917)..(919): n is a, c, g, or t
  misc_feature (921)..(921): n is a, c, g, or t
  misc_feature (923)..(924): n is a, c, g, or t
  misc_feature (926)..(927): n is a, c, g, or t
  misc_feature (929)..(929): n is a, c, g, or t
  misc_feature (932)..(932): n is a, c, g, or t
  misc_feature (934)..(935): n is a, c, g, or t
  misc_feature (937)..(937): n is a, c, g, or t
  misc_feature (939)..(939): n is a, c, g, or t
  misc_feature (942)..(947): n is a, c, g, or t
  misc_feature (949)..(950): n is a, c, g, or t
  misc_feature (952)..(952): n is a, c, g, or t
  misc_feature (954)..(957): n is a, c, g, or t
  misc_feature (959)..(963): n is a, c, g, or t
  misc_feature (965)..(977): n is a, c, g, or t
  misc_feature (979)..(989): n is a, c, g, or t
  misc_feature (991)..(994): n is a, c, g, or t
  misc_feature (996)..(999): n is a, c, g, or t
  misc_feature (1001)..(1003): n is a, c, g, or t
  misc_feature (1005)..(1008): n is a, c, g, or t
  misc_feature (1013)..(1013): n is a, c, g, or t
  misc_feature (1015)..(1018): n is a, c, g, or t
  misc_feature (1020)..(1024): n is a, c, g, or t
  misc_feature (1026)..(1028): n is a, c, g, or t
  misc_feature (1030)..(1041): n is a, c, g, or t
  misc_feature (1043)..(1044): n is a, c, g, or t
  misc_feature (1046)..(1047): n is a, c, g, or t
  misc_feature (1049)..(1051): n is a, c, g, or t
  misc_feature (1053)..(1055): n is a, c, g, or t
  misc_feature (1057)..(1084): n is a, c, g, or t
  misc_feature (1086)..(1089): n is a, c, g, or t
  misc_feature (1092)..(1095): n is a, c, g, or t
  misc_feature (1097)..(1100): n is a, c, g, or t
  misc_feature (1102)..(1102): n is a, c, g, or t
  misc_feature (1104)..(1105): n is a, c, g, or t
  misc_feature (1107)..(1119): n is a, c, g, or t
  misc_feature (1121)..(1121): n is a, c, g, or t
  misc_feature (1123)..(1135): n is a, c, g, or t
  misc_feature (1137)..(1138): n is a, c, g, or t
  misc_feature (1140)..(1152): n is a, c, g, or t
  misc_feature (1154)..(1154): n is a, c, g, or t
  misc_feature (1156)..(1158): n is a, c, g, or t
  misc_feature (1160)..(1171): n is a, c, g, or t
  misc_feature (1174)..(1178): n is a, c, g, or t
  misc_feature (1180)..(1183): n is a, c, g, or t
  misc_feature (1185)..(1185): n is a, c, g, or t
  misc_feature (1187)..(1190): n is a, c, g, or t
  misc_feature (1192)..(1205): n is a, c, g, or t
  misc_feature (1207)..(1207): n is a, c, g, or t
  misc_feature (1209)..(1212): n is a, c, g, or t
  misc_feature (1214)..(1214): n is a, c, g, or t
  misc_feature (1216)..(1222): n is a, c, g, or t
  misc_feature (1225)..(1232): n is a, c, g, or t
  misc_feature (1236)..(1250): n is a, c, g, or t
  misc_feature (1252)..(1262): n is a, c, g, or t
  misc_feature (1264)..(1273): n is a, c, g, or t
  misc_feature (1275)..(1279): n is a, c, g, or t
  misc_feature (1281)..(1281): n is a, c, g, or t
  misc_feature (1285)..(1285): n is a, c, g, or t
  misc_feature (1287)..(1291): n is a, c, g, or t
  misc_feature (1295)..(1299): n is a, c, g, or t
  misc_feature (1301)..(1305): n is a, c, g, or t
  misc_feature (1307)..(1307): n is a, c, g, or t
  misc_feature (1313)..(1315): n is a, c, g, or t
  misc_feature (1317)..(1326): n is a, c, g, or t
  misc_feature (1329)..(1329): n is a, c, g, or t
  misc_feature (1331)..(1336): n is a, c, g, or t
  misc_feature (1338)..(1341): n is a, c, g, or t
  misc_feature (1343)..(1343): n is a, c, g, or t
  misc_feature (1345)..(1345): n is a, c, g, or t
  misc_feature (1347)..(1347): n is a, c, g, or t
  misc_feature (1349)..(1349): n is a, c, g, or t
  misc_feature (1351)..(1359): n is a, c, g, or t
  misc_feature (1364)..(1364): n is a, c, g, or t
  misc_feature (1367)..(1380): n is a, c, g, or t
  misc_feature (1382)..(1388): n is a, c, g, or t
  misc_feature (1390)..(1391): n is a, c, g, or t
  misc_feature (1393)..(1393): n is a, c, g, or t
  misc_feature (1395)..(1397): n is a, c, g, or t
  misc_feature (1400)..(1405): n is a, c, g, or t
  misc_feature (1407)..(1409): n is a, c, g, or t
  misc_feature (1411)..(1414): n is a, c, g, or t
  misc_feature (1417)..(1418): n is a, c, g, or t
  misc_feature (1423)..(1441): n is a, c, g, or t
  misc_feature (1443)..(1446): n is a, c, g, or t
  misc_feature (1448)..(1448): n is a, c, g, or t
  misc_feature (1450)..(1459): n is a, c, g, or t
  misc_feature (1461)..(1462): n is a, c, g, or t
  misc_feature (1464)..(1464): n is a, c, g, or t
  misc_feature (1466)..(1469): n is a, c, g, or t
  misc_feature (1471)..(1471): n is a, c, g, or t
  misc_feature (1473)..(1474): n is a, c, g, or t
  misc_feature (1476)..(1476): n is a, c, g, or t
  misc_feature (1479)..(1485): n is a, c, g, or t
  misc_feature (1491)..(1491): n is a, c, g, or t
  misc_feature (1493)..(1513): n is a, c, g, or t
  misc_feature (1515)..(1517): n is a, c, g, or t
  misc_feature (1521)..(1522): n is a, c, g, or t
  misc_feature (1524)..(1527): n is a, c, g, or t
  misc_feature (1529)..(1535): n is a, c, g, or t
  misc_feature (1537)..(1541): n is a, c, g, or t
  misc_feature (1544)..(1547): n is a, c, g, or t
  misc_feature (1557)..(1557): n is a, c, g, or t
  misc_feature (1559)..(1561): n is a, c, g, or t
  misc_feature (1563)..(1575): n is a, c, g, or t
  misc_feature (1577)..(1578): n is a, c, g, or t
  misc_feature (1582)..(1584): n is a, c, g, or t
  misc_feature (1586)..(1587): n is a, c, g, or t
  misc_feature (1589)..(1589): n is a, c, g, or t
  misc_feature (1989)..(1989): n is a, c, g, or t
  misc_feature (1995)..(1995): n is a, c, g, or t
  misc_feature (1998)..(1998): n is a, c, g, or t
nnnnnnnnnnnnnnnnnnttnnnntnnnnnnttnnnnnnnnnntnnnnnntnnntttnnnnnntnnntnnnnnnnnnnnnnngnnnnnnnnnnnnnnnnnnnnnnttnnnnnnnnttntnttnnnnnttnntnnttnntnnntnnnnnnnnnnnnaannnnnnnnnnnnnnnnnnnnnnnnnnnnnttnnnntttttttttntttttttttttttttttntttttnttnttnttnttnnnntttnnnnttntncnnnnnnnnnnnnnnnngnnnnnnnnnnnnnnnttttttnnttnnnnnnnnnnnnnnnnnnnnnnnnnnannnnnnnnnnnnnnnnnttntttnnnnnnnnnnnnnnnnnnnnnnnnnannnannnnnnntnntnnttnttnttnnnnnnntnntnntnnnnnnnnntnnnnnnnaannnntnnnnngnnnnnnnnnntnnnnnnnnnnnnnntnnnnnnnnnnnnnnnnnnnnnnnnntnntnnnananannannattannannnannnnnnnnnnnnnnnnnnnannnnnnnntannannanannaanannaannnnnnnnnnnnnnnnnnnnnnnnnnnnnnntttttttttnntnnnnnnnnnnanannannnnnnntnnnnngngnngnggtgntnnntnntnntnnntnntnttntntnnnaanannnggnnnnnnnnnntnnnnnnnnntnntntttnnnnnnnnnntnnnnnnnnnnnnnnnnnnnnnnnnnnnatcatcatcancaacaacannnntnnnnnaaaaaanaannnnnntnttntnnnnngtnntntannnnannnnnnnntnnttnntnannnttttntnnntnnnntnnnannnnnntnnnnnnnnnnnnnnnnntnntntnnnntnnnanannnntannnnntnnngnannannangangnngntnttnnnnnntnntntnnnntnnnnntnnnnnnnnnnnnnannnnnnnnnnntnnnntnnnntnnnannnnttttntnnnnannnnntnnntnnnnnnnnnnnnannannannntnnngnnnnnnnnnnnnnnnnnnnnnnnnnnnnannnnaannnnannnngngnngnnnnnnnnnnnnntnannnnnnnnnnnnntnntnnnnnnnnnnnnntntnnngnnnnnnnnnnnnttnnnnnannnnanannnntnnnnnnnnnnnnnntnannnnanannnnnnnttnnnnnnnntaannnnnnnnnnnnnnntnnnnnnnnnnntnnnnnnnnnnannnnnanaaanannnnntttnnnnnannnnnanaaaaannnannnnnnnnnnaanannnnnntnnnntntntntntnnnnnnnnnttttnttnnnnnnnnnnnnnngnnnnnnntnntntnnnttnnnnnnannntnnnnttnnttttnnnnnnnnnnnnnnnnnnnannnnanannnnnnnnnnannanannnnanannanaannnnnnntttttntnnnnnnnnnnnnnnnnnnnnntnnntttnntnnnntnnnnnnntnnnnngannnntttttttttntnnngnnnnnnnnnnnnngnntggnnntnntntttttttcttgtctaaaaataagaagaagaagaagaatcagtcaatataaacggttttgtcgtaattacagctgttgaaataatcggaaagcaactcttttactctttctttaacaatataatttaataaggtgatatgaacatcagtttttgaatgagtggttgtattccatctgacatttattttccagttgcaagggatattagcttcaaaaaacagtgtatccacacgttgttggacagtatgggcaatacttttaagtttcaaaagttcaaatccacggagatgtattttctgtggttgggttagaaggtcatgtagatgtccaagacgtgattgcagatcataaatggtataatttatagttttggtatttttttttctttcttcttcttcttntttttnttnttcttcttcttcttcttcttcttgagacgatgaagacagaggaaaagatgtatcatcgcattttggaatcatctgaaatcaatttatatttaatggtagactaccagcaggacatacaaaatatctttttataggtacataattagaaaacaaatctttattcataaatgttttatatatagcaaagtcaggtgatttaaacatgatgtggtaactaatacaaggagttttatacggatcaatgttttcatctacaaattttttttgaaacatactatttagacctttcatatgagtcagggtatgattttcattggacaatttataacttttttcaccaatgtattctcctgaattaaaaaacccttccacgacccagataccacttattttgtttccagtttcaaaatgtttgtcatataaagcggaaaattgtgcttttagattttcatcaacattatcttcaaatcgtttatgtttcactaaaaagtgggcactgtctgtgtccatatacagcagctgagcttttgtaggatttagaaatactaataaataacaaagtcttttttctaaaataattttgctgtggaataggattgaacatccaacatgaccgagcatggtttcaaatggattttgaatttgtgatgttttgtattcggctagaaaaacattttcacttaactgtacacacgattgtattttttgtttcagttttttcatattaggacaggtttttaagtttttgaacgttttaaattttgaagatgttaaattgcatagagtaaatccatagcaagaatttaacatgagttttattagttctgcttttatttcaaggatttgttttctttctaaatttttttcatttttgatttcctttttaagttggtttctgacttccaatttgaaattaatatgttgacgtaaataatgagcctgttgaaagagaagggcgtggtatatgtcaggggttttttcaaatccaaatttgttatgcagccatataaaatagtctgtgctgataaccataaacgatgaacttttattgagactgacaactttttgacccacattaaatttcgtaagttgttttcgagtataatcggacaaatgttttgtttcatactcagctttttgaatgataaatccaaaacaaggattttgattatctttttttatttctaaattttttacgagtatcagtccagtgagttttttatccaatatattttgcaagaatcctttgtaagagtaggtttttttgtatggaggtaaaaactgtttatcttgatactgtggtattttgtggtggtggtaatcacaatcgaaaatctctacatattcccattcaatatgatgtagttgaaaatgttccacaaagtgttgcagcagtaattttattttcattttgacatctaaagttttatcggccaattcctgttgattttcattattcttgatccaacacgagctatgatgtccatgtctaaatactgattggtattgaataattttaataaatagtttctgacaattttttttcttaaacgctaggaaaccatcaattggatatgtagccaaatataattgacccattgcggtaaaactggattgaaatcttatgattgtttcaatgtcgtcctttggcaatgatgcaagataatgattcaaagcgtgaaattcattgtaaaagcgagggggatcattaattaaatgaaaacgatcagtattaaaatcaccccttttgcggacatctgtgcaaaaactgtttatatttgtacttgaactttttgtttttcttttcatttcgccagagctatctttggtagatctggtgaagaacagaggtgaattaacaggcattttttttacagcggcacttgggtaaagagaacgaatgtcaattgtagtaattccagctggggtgtttgtgaatgcatttttccatggatcaatgttgtgaaaattaggccatgtctcagcgtttaaacaaggattt

SEQ ID NO: 387 - DNA, 4000 bp, Escherichia coli
  misc_feature (1987)..(1987): n is a, c, g, or t
  misc_feature (2415)..(2415): n is a, c, g, or t
  misc_feature (2434)..(2434): n is a, c, g, or t
  misc_feature (2494)..(2494): n is a, c, g, or t
  misc_feature (2515)..(2515): n is a, c, g, or t
  misc_feature (2863)..(2863): n is a, c, g, or t
  misc_feature (3097)..(3097): n is a, c, g, or t
  misc_feature (3409)..(3409): n is a, c, g, or t
  misc_feature (3413)..(3414): n is a, c, g, or t
  misc_feature (3517)..(3517): n is a, c, g, or t
  misc_feature (3994)..(3994): n is a, c, g, or t
aaaccttagttgggtccaactgaatttgttcaggcctaattgaagctagccagccagcggctgctgtgttacggaatatttctggtggattttgaccagaacaatttcggctgagcgtgctcacttcaacgaagttatttccaccaacaaaggaagccacaaaaaaatttgcaggattttggtaaatttcaattggtgacccagtttgttgaacctgcccctcattcagcacgcaaatcaagtctgagactgcgagagcttcttcctgatcgtgagtaacataaatggttgtgatgccgagctgtctctggatcctccgaatttcagaacgaagctcttcacgaagttgggcatctaaatttgagagaggttcgtccatcaaaatcacccttgggctcataattaacgaacgagctagcccaactcgctgctgctgtcctccactcaattcatgtggcattcttttacgaagtgattccaattgaacaacctgcaggatgtccagcattcgcttctgatattccttgttggagagcctaagtctcttcaagccgaaaccaacgttgtcttccacactcaggtgaggaaagacggcatagtcctgaaaaaccatgcctatgtttcgttgatgtggggagagtgtgcgaatagaagctctgtcgatttttaaatcaccagagtcaacgtcatggaaaccagctagagcccggagtagagtcgttttaccgcatccacttgggccaagtagagtaaagaaagccccactaggtatctccagtgagacctgattcaaggcttggaagctaccgtattttttgacggcagcttctacttcaacatgagacaaggaaggtactccgaggaagtttaatcattgaacttctaacagagtgtcgttccagcgttccacaagtctcttcttgttttctactgcccagagtagatcgtactggattgtcttgatctggtttagaggtgtaagctcctttacagactctacatctaaacgtacaggccgtcggccgattgctgcaacagaactttgagcttccttagaaatcatataatccaagaattgcttccctgcacttggattgggaccatttgcaactagggccattgcgtctggaaccaaggaagtcccatcagatggataaacaatctgtacaggtccgccacctaatttgtatcgcagcgcggcatcttccagggtgatcccaacggcagcttctccatcattaacaaaccgtggcactgctcccgaactatttgagagaaccatgtttgccatgaggtttttataggtgtcccagcctttgtcattatcaccatatatctgcagcacggttgctagctggatgtaggatgaaccagacttgtctgctcgagcggaagaaatttttcctttgtaggcggacttagttaggtctgaccaagacattgggacatcagctcccttcatctgttgattgttgaccaagaagacagagacgattgctgtaaatggcagccaagtttggctcggtctaagttgtggattgattttatcatcatccttgggtgtgtagttgacgaataattccttgttaaaatccactaattcaccaccgacactccaaatcacatctgcagtttggcgtcctttttcagctctgagtcggtttagtaactcacccgagccagccttgacgatttcaaccttaattccagattgtttttcaaatgcagggactaaggtgtcaatgagctcttgtggtgccgccgtataaactgcaacagtaccatttgctaaagccacagcagaagccaaggctataaacgtggatgtgagcaaaaaaactcttgaaaacaacgaggctttcttcatttgggctccttaatggaggatgaaaaatatttccaacaaaaattgtcagaacaaatcccaatgatgggcggcattacactggaggagcatgactctaatttcaagagaattgtgatgttnggtgatcactaaaatctgcaaggagtcattgtgaaattggtcgcagttcaaaaaagagagggctgttggacaggagcgagttcttctggttgcaaagccaaggacaacaatggggctttgagcaggggttctagctttggaagtggcccattcagccaggttgtgacttcatcaggaggcaggagcagtggcatacgatgatgaatctgggcgcattgtggggtgggatgagtagtcagagtcaccagacgattggttgaatccgtctctggaaaccagatgccagccataaacaatggcgattcatctggggcatgaaagcggaatttctgcttctgaccactctccaaaatcttccattcataccaaccactgcaagggattacgcaacgtcgtgatcgaaacgcctcacggaatgtcatcttggnagcaacggtctcggcctgngcgttgatcagcagttgcttgctccaggaaggttgaatgccccattgcaaacggacctgngtgaagccttgggactcagcntgcagcgtatccacctgttgtgtgggtcgtagatcacgattctctctactctcccactcgacgccaaagcctgccttgacagcatcactgattttgttgggcagaatgtcgattcgtccacacatgattcagattgcttggagttatgccgcaatcaactcaaagctgatttggtggctgcctgcgttaatcaggtgtccttctgaaggaacagaaacaggatttccattcagttgaacatgctgatgaagagcattgggcatcaaccttccctggcatcctgcaggcagcgtgacgcgataatcgacttgttgctctttcttttcccaacgtgcttcaatccgtccntgacggcaatcgtgccacattgagataggattgaggtttggaagaatttgggggttcaattgaacctcatcaaagcctggcttttcagcagtcgggctgattccggccacctgctcaaatagccattggcaaactgccccatacgcatagtggttgtagctgttcatctcaggagaataaattgttccatctggggccatcgcatcccagcgctcccaaatggttgtggctccncgttccacctgatagagccaacctggaacctcacgattcaaaaagaccttttcagcaagatccaacaatccaacttttgtcagtgcgggtaagagggctggagtgccaatgaaacctgtgccaatcagataattggcgttctctatcgactttctgaagtaccccttcgctgattcaaaatgagcatctggtacaagatcatagagaaaagcaagggcgtaggaggtctggtcgttatgggccaatcgtccggatagactgaagtactcccgctcaaaagctgtgcggatttcctcaagtttcccagttagntttnnggcagcttcatcttcccctaggacttgagcaattttcttggccagctgtgtggaaatgaagtggtaaagggtcgctgcacagtcatcggcaatcgtgggtctnggttttcgattatcaccgctgggttggagccaatcgccaaaggtaaacccttcaccaaaccatttgttggcaggatggatgatgggtccgtctgaaatgttccagagataatcaagccagcggagcattgcagggaaacactctttcagtacggtggcatctccatagtggagatagtgttgccagggaataacggtgatggcatccccccaaccagtggagccagcccaatcactgcgatattgctcgggatggagtcgggttgggtcaggagtaaaatgtggcagtgcgccgttgctgcgttgatcatgcatcaaatcacgcaggtattttctcaggaattggttacagtccgccaaccaacaggccgttcctgaaaaaacctgagcatctcccgtccagccaaggcgttcatctcgttgtgggcaatcggtagggacttctatgaagttgccacgttgtgaccagatggtgttnagcacc

SEQ ID NO: 388 - DNA, 4000 bp, Escherichia coli
  misc_feature (5)..(5): n is a, c, g, or t
  misc_feature (89)..(89): n is a, c, g, or t
  misc_feature (95)..(95): n is a, c, g, or t
  misc_feature (101)..(101): n is a, c, g, or t
  misc_feature (167)..(167): n is a, c, g, or t
  misc_feature (179)..(179): n is a, c, g, or t
  misc_feature (197)..(197): n is a, c, g, or t
  misc_feature (210)..(210): n is a, c, g, or t
  misc_feature (251)..(251): n is a, c, g, or t
  misc_feature (254)..(254): n is a, c, g, or t
  misc_feature (299)..(299): n is a, c, g, or t
  misc_feature (317)..(317): n is a, c, g, or t
  misc_feature (350)..(350): n is a, c, g, or t
  misc_feature (356)..(356): n is a, c, g, or t
  misc_feature (383)..(383): n is a, c, g, or t
  misc_feature (410)..(410): n is a, c, g, or t
  misc_feature (426)..(426): n is a, c, g, or t
  misc_feature (428)..(428): n is a, c, g, or t
  misc_feature (446)..(446): n is a, c, g, or t
  misc_feature (494)..(494): n is a, c, g, or t
  misc_feature (518)..(518): n is a, c, g, or t
  misc_feature (521)..(521): n is a, c, g, or t
  misc_feature (554)..(554): n is a, c, g, or t
  misc_feature (557)..(557): n is a, c, g, or t
  misc_feature (590)..(590): n is a, c, g, or t
  misc_feature (632)..(632): n is a, c, g, or t
  misc_feature (635)..(635): n is a, c, g, or t
  misc_feature (650)..(650): n is a, c, g, or t
  misc_feature (662)..(662): n is a, c, g, or t
  misc_feature (674)..(674): n is a, c, g, or t
  misc_feature (676)..(676): n is a, c, g, or t
  misc_feature (815)..(815): n is a, c, g, or t
  misc_feature (821)..(821): n is a, c, g, or t
  misc_feature (836)..(836): n is a, c, g, or t
  misc_feature (866)..(866): n is a, c, g, or t
  misc_feature (912)..(912): n is a, c, g, or t
  misc_feature (1008)..(1008): n is a, c, g, or t
  misc_feature (1052)..(1053): n is a, c, g, or t
  misc_feature (1055)..(1055): n is a, c, g, or t
  misc_feature (1064)..(1064): n is a, c, g, or t
  misc_feature (1068)..(1068): n is a, c, g, or t
  misc_feature (1070)..(1070): n is a, c, g, or t
  misc_feature (1106)..(1106): n is a, c, g, or t
  misc_feature (1183)..(1183): n is a, c, g, or t
  misc_feature (1253)..(1253): n is a, c, g, or t
  misc_feature (1262)..(1262): n is a, c, g, or t
  misc_feature (1286)..(1286): n is a, c, g, or t
  misc_feature (1292)..(1292): n is a, c, g, or t
  misc_feature (1310)..(1310): n is a, c, g, or t
  misc_feature (1322)..(1322): n is a, c, g, or t
  misc_feature (1346)..(1347): n is a, c, g, or t
  misc_feature (1358)..(1358): n is a, c, g, or t
  misc_feature (1545)..(1545): n is a, c, g, or t
  misc_feature (1599)..(1599): n is a, c, g, or t
  misc_feature (1719)..(1719): n is a, c, g, or t
  misc_feature (1791)..(1791): n is a, c, g, or t
  misc_feature (2503)..(2503): n is a, c, g, or t
  misc_feature (3159)..(3159): n is a, c, g, or t
  misc_feature (3171)..(3171): n is a, c, g, or t
  misc_feature (3186)..(3186): n is a, c, g, or t
  misc_feature (3303)..(3303): n is a, c, g, or t
  misc_feature (3516)..(3516): n is a, c, g, or t
  misc_feature (3535)..(3535): n is a, c, g, or t
  misc_feature (3555)..(3555): n is a, c, g, or t
  misc_feature (3609)..(3609): n is a, c, g, or t
  misc_feature (3759)..(3759): n is a, c, g, or t
  misc_feature (3933)..(3933): n is a, c, g, or t
cgacnggggcttatggcggtatcgggtcggtcatctcgcagcgccccgatagcacgatcatcatcaacgaccccatggagggtatgccngctgcncaggcnggtctgcgtgctggtgacgtcatcctcgaggtcgacggtcaggacttccgtaagtcgaccagcganaaggtgagtgcngccctcaagggtacgccngggagcaagatcntgctcctcatccagcgtccaggggagtcgaagcctcgccgnatngagttccgccgtcagaagattcaggtcagccccgtgccttactanggtgtcatcgggaagganatgggctatatctccctcacgggcttccccaanacggcngccgctgaggtgaagaaggccttcctngacctcaagtccaagcaccagctccgngggctcatccttgacntncgcgacaatggtggtggnctcatcgacgaagccatcaagatcgtcaacttcttcgtccccgcaggngaggaggtcgtgacgacgcgtggncgnaatgcccgccgtcaggaggtcgtctatcgcacnacngacaagcctctcgacacgcagatccccatcgcngtgctcatcaatgggcagtcggcctcggcctccgagatcgtnagnggtgctctgcagganctcgatcgcgcngtcgtcatgggngncaagagctatggtaagggccttgtgcagacgacgatgcagctcccctacgacgggacgatcaagctcacgacggcgaagtactacatccccagcggtcgctgtatccagcgcatcaactaccagtcgctgcgtgagggnaagggngctacgatcctgccngacagcctgacgaaggtcttccacacgcgngcaggccgtgaggtccgtgatgctggtggtatcctccccgacatcnctctcacgaatgactcgctgcccacgatggtgtactacctgcgtgtcaataacgatgccttcgactggatcaccgactatgtgcgcagccaccgcncgatcgcttcgccccgtgacttcaagctcacggatgcagactanncntccttctcnaatnanatgatcgagaagaagttcgactacgaccgccagagnggcaaggagctgaagaagctggaggacttggcgaagttcgagggctattacaacaagagtcgtgaggccttcgaggngctgaagaagctcctcgtccccgacctcaagcacgacctcgaggagcatcgtcccttcatcgagcagtanctgacgggngctatcctcacccgctactattanaatagnggggcgctggagcgcagngtcgccgagganaagatggtgcgtgccgcagagganntcctcgcagancccgcacgctacacgaaggtcctgagccgccccgaggctaagaccgccgctacccctacagcgaagtagtgcgatgaagaaaatcttttgccccaagtgcgatacggcgatccctctgaggagggagcgtatcgaggagctgcaggcctcgggagaggatcgcctctcgatcatctgcccgcagtgnacgcatcagctcaacctgcgtctgcgcttgccttcggctaagagcacgaagcgncaagagcagcgcacctccgtcgggcatatcatcgtggtagagaatgtcttcggctataagcagctcttccccctctacgtcggggtgaatgccatcggccgtcgcaacaaggataccgcnacggatatccctatcatcacctccgaccccagcatggaccgccatcatgcgatcatcaaggtcaccgagggncgcacggggaagctccgcttcgctgtggcagatgacgatagccgtgtggggaccttcctcgcaggcgagcttctcgccccgaaggagtggcgctacctccagcctggagacgtgctcacgctcggcgctacctccatcatcttcagcgacgaacccctccccgaagatcccaccatcgaggagtcgtagcttgcgccttccctctccactcgcggggccagcgagctacgctcaccgctctcgtcgtggtggacgattttttacgtctgcatagtatagtgggttgcttatgtgcgtattttttgcttactttgcagaccgattgtagagtcctcctgagggaggtgaagatacaagtcgctgattacgttagaaataacaaactaaaatataagagtaatgtcaaagatttgtcagattacaggtaagaaagccctggtcggcaacaatgtctcgcactccaatcgcaagacaaagcgccgcttcgaagtcaacctgtttaccaagaagttcttctggccagaagaagggtgctggatcgtcctgaaggtgtctgccgcaggcctccgcctcatcaacaagatcggtctcgatgccgctgtgcgtcaggctgcaaacaatggctacctaagtgaaatcaaagtaaagtagtaggaagatcatggcaaagaaagctaaaggaaacagagtacaggtcatcctcgagtgcacngagcacaaggagagtggtatgccagggacgtcccgctacatcacgaccaagaacagaaagaatacgaccgagcgtcttgagctgagaaagtacaaccccatcctcaagcgtatgacggtccataaggaaatcaagtaatcacgaggagacaagacaatggcaaagaaagcagtcgcatcattcaagaaggccgacggtcgtacctactctaaggtcatcaagatggtcaagtcccctaagacgggtgcttacatcttccaggaagagatggtccccaacgaagccgtcaaggagttcttctcttaatcgaacgaacttcgtcgggtgctctgccctcgctatagaggtcgcacccaccgccgctacccgagtgtagcaaacacctacaagaggctgccccatgcaatgcaagcgggcagcctcttatcttttcgagacctccgagttaactcccctcaccgcgcctctatcagctgcggtgccgaccctataaagcagagatcttcatgtctacgcaggtagaaaaaaacaccgagcgcatcgagcgcttagctcacgagagcatcccacgcctccttattcactatggtgtcccagctattgtggggacgatggtcaacgcgctctacagcgtcgtcgaccgcatcttcatcggncagggcgtcagngaatttgctatcacngggcttgctctgaccttccctatcctgatcttcatccaagccttcggtatgcttatcggtgtcggggcttcatctcgtgtgtccatcctcctcggcgagaacaagcacgatcaggcngagcgtatcctgagtaatgccctcctgctgactctggtcacgcaggtgctgaccttagtgccggtgatgatctggctcgacgatatcctccgtgctctgggggctaacgaccgcacgctccccttcgcttacgactatctgaagatcatgatcccggggaatatcttctcgacgctctgcttcagcttcaatgcgatcatgcgtgcttcgggntatccctacaaggcgatgntcacgatgctcatcggggcngggctcaatacgctcctcgatgcgctcttcatctatggctttgactggggtatngagggggctgcttgggctacggtgatcgctatggctgtgtcgtcagcgtttgtgatgcagcacttcctcagcagcaagagcgaggtgcagttccgccgacgcaatatgcgcctctcctccgagcagatcctggcgatcctctctatcggnatgtcgcccttcttcctgcagctcctcagtagtggcatcgccttcctcatcaactctaccttggctcgctatgcggagaactctctgatggctgaccgagcggtgggggcttatgggatcatcaatagcgcggcccttgtgggctttatgttcatgctcggtatcgctcagggnatgcagcccatcgtgggctacaactacggagcccgtgcgatggaccgtgtgcgtcaggccttcaaga

SEQ ID NO: 389 - DNA, 4000 bp, Escherichia coli
  misc_feature (1)..(4): n is a, c, g, or t
  misc_feature (6)..(9): n is a, c, g, or t
  misc_feature (12)..(14): n is a, c, g, or t
  misc_feature (16)..(16): n is a, c, g, or t
  misc_feature (18)..(44): n is a, c, g, or t
  misc_feature (46)..(55): n is a, c, g, or t
  misc_feature (59)..(75): n is a, c, g, or t
  misc_feature (77)..(78): n is a, c, g, or t
  misc_feature (80)..(81): n is a, c, g, or t
  misc_feature (83)..(97): n is a, c, g, or t
  misc_feature (99)..(103): n is a, c, g, or t
  misc_feature (106)..(121): n is a, c, g, or t
  misc_feature (123)..(128): n is a, c, g, or t
  misc_feature (130)..(143): n is a, c, g, or t
  misc_feature (145)..(149): n is a, c, g, or t
  misc_feature (151)..(156): n is a, c, g, or t
  misc_feature (158)..(158): n is a, c, g, or t
  misc_feature (160)..(162): n is a, c, g, or t
  misc_feature (164)..(176): n is a, c, g, or t
  misc_feature (178)..(194): n is a, c, g, or t
  misc_feature (196)..(231): n is a, c, g, or t
  misc_feature (233)..(242): n is a, c, g, or t
  misc_feature (244)..(247): n is a, c, g, or t
  misc_feature (249)..(261): n is a, c, g, or t
  misc_feature (263)..(269): n is a, c, g, or t
  misc_feature (271)..(271): n is a, c, g, or t
  misc_feature (273)..(276): n is a, c, g, or t
  misc_feature (278)..(309): n is a, c, g, or t
  misc_feature (311)..(311): n is a, c, g, or t
  misc_feature (314)..(343): n is a, c, g, or t
  misc_feature (345)..(349): n is a, c, g, or t
  misc_feature (351)..(360): n is a, c, g, or t
  misc_feature (362)..(402): n is a, c, g, or t
  misc_feature (404)..(415): n is a, c, g, or t
  misc_feature (417)..(457): n is a, c, g, or t
  misc_feature (459)..(470): n is a, c, g, or t
  misc_feature (472)..(478): n is a, c, g, or t
  misc_feature (480)..(493): n is a, c, g, or t
  misc_feature (495)..(499): n is a, c, g, or t
  misc_feature (501)..(520): n is a, c, g, or t
  misc_feature (522)..(526): n is a, c, g, or t
  misc_feature (528)..(538): n is a, c, g, or t
  misc_feature (540)..(546): n is a, c, g, or t
  misc_feature (548)..(549): n is a, c, g, or t
  misc_feature (551)..(554): n is a, c, g, or t
  misc_feature (556)..(567): n is a, c, g, or t
  misc_feature (569)..(571): n is a, c, g, or t
  misc_feature (573)..(590): n is a, c, g, or t
  misc_feature (592)..(629): n is a, c, g, or t
  misc_feature (631)..(635): n is a, c, g, or t
  misc_feature (637)..(648): n is a, c, g, or t
  misc_feature (650)..(664): n is a, c, g, or t
  misc_feature (666)..(681): n is a, c, g, or t
  misc_feature (683)..(684): n is a, c, g, or t
  misc_feature (686)..(689): n is a, c, g, or t
  misc_feature (691)..(704): n is a, c, g, or t
  misc_feature (706)..(738): n is a, c, g, or t
  misc_feature (740)..(750): n is a, c, g, or t
  misc_feature (752)..(774): n is a, c, g, or t
  misc_feature (777)..(780): n is a, c, g, or t
  misc_feature (783)..(797): n is a, c, g, or t
  misc_feature (800)..(817): n is a, c, g, or t
  misc_feature (819)..(831): n is a, c, g, or t
  misc_feature (833)..(876): n is a, c, g, or t
  misc_feature (878)..(881): n is a, c, g, or t
  misc_feature (884)..(888): n is a, c, g, or t
  misc_feature (890)..(895): n is a, c, g, or t
  misc_feature (898)..(924): n is a, c, g, or t
  misc_feature (926)..(928): n is a, c, g, or t
  misc_feature (930)..(951): n is a, c, g, or t
  misc_feature (953)..(957): n is a, c, g, or t
  misc_feature (959)..(976): n is a, c, g, or t
  misc_feature (978)..(994): n is a, c, g, or t
  misc_feature (996)..(996): n is a, c, g, or t
  misc_feature (998)..(1024): n is a, c, g, or t
  misc_feature (1026)..(1064): n is a, c, g, or t
  misc_feature (1066)..(1073): n is a, c, g, or t
  misc_feature (1075)..(1102): n is a, c, g, or t
  misc_feature (1104)..(1140): n is a, c, g, or t
  misc_feature (1142)..(1160): n is a, c, g, or t
  misc_feature (1162)..(1178): n is a, c, g, or t
  misc_feature (1180)..(1182): n is a, c, g, or t
  misc_feature (1184)..(1208): n is a, c, g, or t
  misc_feature (1210)..(1229): n is a, c, g, or t
  misc_feature (1231)..(1241): n is a, c, g, or t
  misc_feature (1243)..(1259): n is a, c, g, or t
  misc_feature (1261)..(1265): n is a, c, g, or t
  misc_feature (1267)..(1277): n is a, c, g, or t
  misc_feature (1279)..(1281): n is a, c, g, or t
  misc_feature (1283)..(1304): n is a, c, g, or t
  misc_feature (1306)..(1307): n is a, c, g, or t
  misc_feature (1309)..(1315): n is a, c, g, or t
  misc_feature (1317)..(1317): n is a, c, g, or t
  misc_feature (1319)..(1333): n is a, c, g, or t
  misc_feature (1335)..(1341): n is a, c, g, or t
  misc_feature (1345)..(1345): n is a, c, g, or t
  misc_feature (1348)..(1348): n is a, c, g, or t
  misc_feature (1350)..(1350): n is a, c, g, or t
  misc_feature (1357)..(1358): n is a, c, g, or t
  misc_feature (1361)..(1361): n is a, c, g, or t
  misc_feature (1365)..(1366): n is a, c, g, or t
  misc_feature (1368)..(1370): n is a, c, g, or t
  misc_feature (1374)..(1379): n is a, c, g, or t
  misc_feature (1382)..(1384): n is a, c, g, or t
  misc_feature (1388)..(1388): n is a, c, g, or t
  misc_feature (1390)..(1391): n is a, c, g, or t
  misc_feature (1393)..(1393): n is a, c, g, or t
  misc_feature (1396)..(1396): n is a, c, g, or t
  misc_feature (1399)..(1399): n is a, c, g, or t
  misc_feature (1402)..(1402): n is a, c, g, or t
  misc_feature (1410)..(1410): n is a, c, g, or t
  misc_feature (1417)..(1417): n is a, c, g, or t
  misc_feature (1420)..(1421): n is a, c, g, or t
  misc_feature (1427)..(1427): n is a, c, g, or t
  misc_feature (1430)..(1431): n is a, c, g, or t
  misc_feature (1437)..(1437): n is a, c, g, or t
  misc_feature (1442)..(1442): n is a, c, g, or t
  misc_feature (1446)..(1447): n is a, c, g, or t
  misc_feature (1450)..(1450): n is a, c, g, or t
  misc_feature (1453)..(1453): n is a, c, g, or t
  misc_feature (1455)..(1456): n is a, c, g, or t
  misc_feature (1459)..(1459): n is a, c, g, or t
  misc_feature (1465)..(1468): n is a, c, g, or t
  misc_feature (1473)..(1473): n is a, c, g, or t
  misc_feature (1475)..(1475): n is a, c, g, or t
  misc_feature (1479)..(1479): n is a, c, g, or t
  misc_feature (1481)..(1482): n is a, c, g, or t
  misc_feature (1485)..(1491): n is a, c, g, or t
  misc_feature (1496)..(1497): n is a, c, g, or t
  misc_feature (1499)..(1503): n is a, c, g, or t
  misc_feature (1505)..(1505): n is a, c, g, or t
  misc_feature (1508)..(1508): n is a, c, g, or t
  misc_feature (1510)..(1512): n is a, c, g, or t
  misc_feature (1518)..(1525): n is a, c, g, or t
  misc_feature (1527)..(1529): n is a, c, g, or t
  misc_feature (1531)..(1531): n is a, c, g, or t
  misc_feature (1534)..(1534): n is a, c, g, or t
  misc_feature (1537)..(1546): n is a, c, g, or t
  misc_feature (1548)..(1550): n is a, c, g, or t
  misc_feature (1552)..(1552): n is a, c, g, or t
  misc_feature (1554)..(1556): n is a, c, g, or t
  misc_feature (1558)..(1561): n is a, c, g, or t
  misc_feature (1563)..(1563): n is a, c, g, or t
  misc_feature (1565)..(1569): n is a, c, g, or t
  misc_feature (1571)..(1574): n is a, c, g, or t
  misc_feature (1577)..(1577): n is a, c, g, or t
  misc_feature (1595)..(1596): n is a, c, g, or t
  misc_feature (1601)..(1601): n is a, c, g, or t
  misc_feature (1776)..(1776): n is a, c, g, or t
  misc_feature (1987)..(1987): n is a, c, g, or t
  misc_feature (2598)..(2598): n is a, c, g, or t
  misc_feature (2679)..(2679): n is a, c, g, or t
  misc_feature (3226)..(3226): n is a, c, g, or t
  misc_feature (3263)..(3263): n is a, c, g, or t
  misc_feature (3319)..(3319): n is a, c, g, or t
  misc_feature (3419)..(3419): n is a, c, g, or t
  misc_feature (3433)..(3433): n is a, c, g, or t
  misc_feature (3483)..(3483): n is a, c, g, or t
nnnnannnngtnnnanannnnnnnnnnnnnnnnnnnnnnnnnnnannnnnnnnnnagannnnnnnnnnnnnnnnnannannannnnnnnnnnnnnnnannnnnttnnnnnnnnnnnnnnnnannnnnntnnnnnnnnnnnnnntnnnnntnnnnnntntnnnannnnnnnnnnnnntnnnnnnnnnnnnnnnnngnnnnnnnnnnnnnnnnnnnnnnnnnnnnnnnnnnnnannnnnnnnnntnnnnannnnnnnnnnnnnannnnnnnanannnnannnnnnnnnnnnnnnnnnnnnnnnnnnnnnnngnaannnnnnnnnnnnnnnnnnnnnnnnnnnnnntnnnnncnnnnnnnnnnannnnnnnnnnnnnnnnnnnnnnnnnnnnnnnnnnnnnnnnnannnnnnnnnnnnannnnnnnnnnnnnnnnnnnnnnnnnnnnnnnnnnnnnnnnnannnnnnnnnnnnannnnnnntnnnnnnnnnnnnnnannnnncnnnnnnnnnnnnnnnnnnnncnnnnnannnnnnnnnnnannnnnnnannannnnannnnnnnnnnnnannnannnnnnnnnnnnnnnnnnannnnnnnnnnnnnnnnnnnnnnnnnnnnnnnnnnnnnntnnnnnannnnnnnnnnnnannnnnnnnnnnnnnntnnnnnnnnnnnnnnnnannannnntnnnnnnnnnnnnnnannnnnnnnnnnnnnnnnnnnnnnnnnnnnnnnncnnnnnnnnnnnannnnnnnnnnnnnnnnnnnnnnnaannnngtnnnnnnnnnnnnnnntannnnnnnnnnnnnnnnnnannnnnnnnnnnnnannnnnnnnnnnnnnnnnnnnnnnnnnnnnnnnnnnnnnnnnnnncnnnnaannnnngnnnnnngtnnnnnnnnnnnnnnnnnnnnnnnnnnnannnannnnnnnnnnnnnnnnnnnnnnannnnngnnnnnnnnnnnnnnnnnnannnnnnnnnnnnnnnnnancnnnnnnnnnnnnnnnnnnnnnnnnnnnannnnnnnnnnnnnnnnnnnnnnnnnnnnnnnnnnnnnnnannnnnnnntnnnnnnnnnnnnnnnnnnnnnnnnnnnnannnnnnnnnnnnnnnnnnnnnnnnnnnnnnnnnnnnnannnnnnnnnnnnnnnnnnntnnnnnnnnnnnnnnnnntnnntnnnnnnnnnnnnnnnnnnnnnnnnntnnnnnnnnnnnnnnnnnnnntnnnnnnnnnnnannnnnnnnnnnnnnnnnannnnnannnnnnnnnnntnnnannnnnnnnnnnnnnnnnnnnnngnntnnnnnnngngnnnnnnnnnnnnnnnannnnnnntaanttntnataattnnatnattnnannntctnnnnnncannnttgngnngntgnttntgnattataanatagatnaanntaaatnagnntgatangaagnattnntanttntnnacnctcctnnnntatancnaganannacnnnnnnngttgnntnnnnnangtngnnnaaacannnnnnnncnnnantanatnnnnnnnnnntnnnanannnannnntnannnnntnnnnttntatttatactattacttnncctancacctttcagtttcttgcctctatacaaaataagtgaggctattttaaacagcaaatacagcatctacactaactaaatagaacaccgctaatacgcataaaagtctgtactatattgttacttttctttcagatatctgtgagttgcgtctcagatatctgtaacgttcgtttnagatatctgtcagttgcgttttagacgtcataaaaaatacgatatttatagtcgtgtattatttcctgctgagacactcttaacttcagattaaataggaataagaatgcacttattttagtgataagaaactgtttagacgaagtggtaagaaacactactctaccttacacggacatattgtcagacgatagcgacagtatgacactcncattgtattggtacgagtattgtattatacgaggtataaacataaaaaataaacaaataaaataggagataaaattatgatgtataagaattcatggttaccagaagtatttaacgacttcttttataacaacaatatgcccaaaacaaatgcaacagcaccagctatcaacgtattagagaacgaaaacgaatacattgtagagttggctgcaccaggcttaagaaaggaagactttgacattagtattaataacgatggcgacttagttattaagatggagaagaagaacgaagtgaaagatgagaaagcacactacttacgcagagagtttgcatacagcaaatatgaacaaacacttattttgccagacgatgtaaacaaagacgaggttggtgcaagaatgagtgatggtgtgttgaacattacactgccaaaactaaacaagacagttcagaaagtagcaagacaaattgaagttggttaattccatctcataatacgatttctacaatcactttaatgcttcggaatagaagcttccctaaatagaatgaatgaatagtgatgataatagtttattcataatataatgagaaataattgttagnaataaaagaatccccgaatgcgtgagcactcggggattttctatttcttttttccttccacttctatgctattggtgattngcaaaacgaactgcagccaattcttcatatttagtgttgggttttccatagtttgcatacggataaatactaataccgccacgaggagtgaagattcctgttacttctatatacttaggttgcattagttttataaggtctttcattataatgttaacgcaatcttcgtggaaatcgccatgattgcgaaagctaaacaaatagagtttcaggctcttgctttctaccatacgtacatcggggacgtatgatatacgaatttctgcaaagtctggttgtcccgtaataggacacaaactcgtaaattccggacagttaaagcgcacccagtagtcgttatcctgatgcttattttcaaacgtttccaacacttctggtgcataatccattctatatttggttgcagaacctaacgactgcaagccctcttcgtttcgttccataatagttttgtttatttttgttctatgtgcaaaggtaatatattgttagaaaacagcaaacaccatcacgatatattatacgcgaagagtctcttctctattcnctttaatgctgatggcagtattcggatagactacaancaggaatttctttcatatatttataaaaaagcaggtaatacacaaggcagaaagcnactttacaattagtatcgtaggtataaacaaaaataggagatagactcattataaacgcctatctcctattcttaacacttacattagattagacctaantcaaagagaatatnctccaaatgctgtagtttacaccttcatcataaacgtcttcgccttcatnttgctttagcttcttcaccacacgaatggtaagtggtagagcaatcacctcgtaaagtgtctttaacactacctgccaaagcattagtttcggcaattcgggagtaggaacaacaccgcctaatgccagtggaaagaaaattagagaatcgagactttctcctgcaatggtactcaagatggcacgccatgagaaatgtcgtccaccatcacgtagcttcatcttactcattacgtaggcattagcaaatgaacccacaatgaaagctacgaaagaagctgctgctacacgtggagcaagaccaaagacagcatggaatccagcttcattagtccaataaggagcacccggtatccagtcgcacagtgcacccattgccacaaagaagaagttcattgcaaagcccgtccatatcaacagacgtgcttttttaaatccccacacttcacaaacacaatcgtttataatgtaagagatagggaatacgatgagtccacccgtcaatgagatacctaat

SEQ ID NO: 390 - DNA, 4000 bp, Escherichia coli
  misc_feature (16)..(16): n is a, c, g, or t
  misc_feature (21)..(21): n is a, c, g, or t
  misc_feature (24)..(24): n is a, c, g, or t
  misc_feature (26)..(28): n is a, c, g, or t
  misc_feature (31)..(31): n is a, c, g, or t
  misc_feature (36)..(37): n is a, c, g, or t
  misc_feature (40)..(40): n is a, c, g, or t
  misc_feature (42)..(42): n is a, c, g, or t
  misc_feature (45)..(46): n is a, c, g, or t
  misc_feature (49)..(53): n is a, c, g, or t
  misc_feature (55)..(55): n is a, c, g, or t
  misc_feature (57)..(57): n is a, c, g, or t
  misc_feature (59)..(61): n is a, c, g, or t
  misc_feature (65)..(65): n is a, c, g, or t
  misc_feature (74)..(74): n is a, c, g, or t
  misc_feature (80)..(83): n is a, c, g, or t
  misc_feature (86)..(86): n is a, c, g, or t
  misc_feature (90)..(93): n is a, c, g, or t
  misc_feature (98)..(98): n is a, c, g, or t
  misc_feature (102)..(102): n is a, c, g, or t
  misc_feature (104)..(106): n is a, c, g, or t
  misc_feature (109)..(109): n is a, c, g, or t
  misc_feature (111)..(111): n is a, c, g, or t
  misc_feature (113)..(113): n is a, c, g, or t
  misc_feature (115)..(115): n is a, c, g, or t
  misc_feature (117)..(117): n is a, c, g, or t
  misc_feature (122)..(123): n is a, c, g, or t
  misc_feature (128)..(130): n is a, c, g, or t
  misc_feature (136)..(137): n is a, c, g, or t
  misc_feature (143)..(143): n is a, c, g, or t
  misc_feature (147)..(149): n is a, c, g, or t
  misc_feature (153)..(154): n is a, c, g, or t
  misc_feature (156)..(158): n is a, c, g, or t
  misc_feature (160)..(160): n is a, c, g, or t
  misc_feature (163)..(163): n is a, c, g, or t
  misc_feature (165)..(165): n is a, c, g, or t
  misc_feature (169)..(170): n is a, c, g, or t
  misc_feature (172)..(173): n is a, c, g, or t
  misc_feature (176)..(176): n is a, c, g, or t
  misc_feature (178)..(178): n is a, c, g, or t
  misc_feature (185)..(185): n is a, c, g, or t
  misc_feature (187)..(187): n is a, c, g, or t
  misc_feature (193)..(193): n is a, c, g, or t
  misc_feature (195)..(195): n is a, c, g, or t
  misc_feature (207)..(211): n is a, c, g, or t
  misc_feature (213)..(213): n is a, c, g, or t
  misc_feature (218)..(219): n is a, c, g, or t
  misc_feature (221)..(221): n is a, c, g, or t
  misc_feature (233)..(233): n is a, c, g, or t
  misc_feature (236)..(236): n is a, c, g, or t
  misc_feature (238)..(239): n is a, c, g, or t
  misc_feature (243)..(244): n is a, c, g, or t
  misc_feature (247)..(247): n is a, c, g, or t
  misc_feature (249)..(249): n is a, c, g, or t
  misc_feature (251)..(254): n is a, c, g, or t
  misc_feature (256)..(256): n is a, c, g, or t
  misc_feature (259)..(259): n is a, c, g, or t
  misc_feature (263)..(263): n is a, c, g, or t
  misc_feature (265)..(265): n is a, c, g, or t
  misc_feature (267)..(268): n is a, c, g, or t
  misc_feature (271)..(271): n is a, c, g, or t
  misc_feature (273)..(273): n is a, c, g, or t
  misc_feature (276)..(277): n is a, c, g, or t
  misc_feature (279)..(279): n is a, c, g, or t
  misc_feature (282)..(282): n is a, c, g, or t
  misc_feature (284)..(284): n is a, c, g, or t
  misc_feature (287)..(288): n is a, c, g, or t
  misc_feature (290)..(290): n is a, c, g, or t
  misc_feature (292)..(293): n is a, c, g, or t
  misc_feature (296)..(296): n is a, c, g, or t
  misc_feature (298)..(299): n is a, c, g, or t
  misc_feature (308)..(308): n is a, c, g, or t
  misc_feature (310)..(310): n is a, c, g, or t
  misc_feature (312)..(313): n is a, c, g, or t
  misc_feature (315)..(315): n is a, c, g, or t
  misc_feature (319)..(320): n is a, c, g, or t
  misc_feature (328)..(328): n is a, c, g, or t
  misc_feature (335)..(335): n is a, c, g, or t
  misc_feature (337)..(337): n is a, c, g, or t
  misc_feature (344)..(344): n is a, c, g, or t
  misc_feature (347)..(347): n is a, c, g, or t
  misc_feature (355)..(358): n is a, c, g, or t
  misc_feature (361)..(361): n is a, c, g, or t
  misc_feature (363)..(364): n is a, c, g, or t
  misc_feature (371)..(371): n is a, c, g, or t
  misc_feature (375)..(377): n is a, c, g, or t
  misc_feature (379)..(379): n is a, c, g, or t
  misc_feature (381)..(381): n is a, c, g, or t
  misc_feature (385)..(385): n is a, c, g, or t
  misc_feature (387)..(387): n is a, c, g, or t
  misc_feature (389)..(390): n is a, c, g, or t
  misc_feature (392)..(392): n is a, c, g, or t
  misc_feature (394)..(394): n is a, c, g, or t
  misc_feature (398)..(400): n is a, c, g, or t
  misc_feature (404)..(404): n is a, c, g, or t
  misc_feature (407)..(407): n is a, c, g, or t
  misc_feature (412)..(414): n is a, c, g, or t
  misc_feature (416)..(418): n is a, c, g, or t
  misc_feature (422)..(422): n is a, c, g, or t
  misc_feature (424)..(424): n is a, c, g, or t
  misc_feature (431)..(431): n is a, c, g, or t
  misc_feature (433)..(433): n is a, c, g, or t
  misc_feature (438)..(439): n is a, c, g, or t
  misc_feature (442)..(442): n is a, c, g, or t
  misc_feature (444)..(446): n is a, c, g, or t
  misc_feature (451)..(451): n is a, c, g, or t
  misc_feature (453)..(455): n is a, c, g, or t
  misc_feature (457)..(461): n is a, c, g, or t
  misc_feature (466)..(467): n is a, c, g, or t
  misc_feature (469)..(471): n is a, c, g, or t
  misc_feature (473)..(474): n is a, c, g, or t
  misc_feature (476)..(480): n is a, c, g, or t
  misc_feature (483)..(487): n is a, c, g, or t
  misc_feature (489)..(491): n is a, c, g, or t
  misc_feature (498)..(498): n is a, c, g, or t
  misc_feature (500)..(501): n is a, c, g, or t
  misc_feature (505)..(506): n is a, c, g, or t
  misc_feature (510)..(512): n is a, c, g, or t
  misc_feature (514)..(516): n is a, c, g, or t
  misc_feature (519)..(520): n is a, c, g, or t
  misc_feature (522)..(526): n is a, c, g, or t
  misc_feature (528)..(528): n is a, c, g, or t
  misc_feature (530)..(533): n is a, c, g, or t
  misc_feature (535)..(535): n is a, c, g, or t
  misc_feature (537)..(537): n is a, c, g, or t
  misc_feature (540)..(540): n is a, c, g, or t
  misc_feature (542)..(543): n is a, c, g, or t
  misc_feature (546)..(546): n is a, c, g, or t
  misc_feature (548)..(548): n is a, c, g, or t
  misc_feature (557)..(557): n is a, c, g, or t
  misc_feature (560)..(562): n is a, c, g, or t
  misc_feature (564)..(566): n is a, c, g, or t
  misc_feature (568)..(568): n is a, c, g, or t
  misc_feature (572)..(574): n is a, c, g, or t
  misc_feature (578)..(578): n is a, c, g, or t
  misc_feature (580)..(580): n is a, c, g, or t
  misc_feature (589)..(589): n is a, c, g, or t
  misc_feature (593)..(593): n is a, c, g, or t
  misc_feature (595)..(595): n is a, c, g, or t
  misc_feature (597)..(599): n is a, c, g, or t
  misc_feature (601)..(601): n is a, c, g, or t
  misc_feature (604)..(605): n is a, c, g, or t
  misc_feature (612)..(612): n is a, c, g, or t
  misc_feature (619)..(619): n is a, c, g, or t
  misc_feature (622)..(623): n is a, c, g, or t
  misc_feature (630)..(630): n is a, c, g, or t
  misc_feature (632)..(633): n is a, c, g, or t
  misc_feature (636)..(637): n is a, c, g, or t
  misc_feature (640)..(642): n is a, c, g, or t
  misc_feature (645)..(645): n is a, c, g, or t
  misc_feature (649)..(649): n is a, c, g, or t
  misc_feature (651)..(651): n is a, c, g, or t
  misc_feature (654)..(654): n is a, c, g, or t
  misc_feature (656)..(658): n is a, c, g, or t
  misc_feature (660)..(660): n is a, c, g, or t
  misc_feature (662)..(665): n is a, c, g, or t
  misc_feature (672)..(672): n is a, c, g, or t
  misc_feature (674)..(675): n is a, c, g, or t
  misc_feature (679)..(680): n is a, c, g, or t
  misc_feature (683)..(683): n is a, c, g, or t
  misc_feature (686)..(686): n is a, c, g, or t
  misc_feature (688)..(688): n is a, c, g, or t
  misc_feature (691)..(691): n is a, c, g, or t
  misc_feature (695)..(696): n is a, c, g, or t
  misc_feature (699)..(699): n is a, c, g, or t
  misc_feature (704)..(704): n is a, c, g, or t
  misc_feature (707)..(707): n is a, c, g, or t
  misc_feature (718)..(719): n is a, c, g, or t
  misc_feature (723)..(723): n is a, c, g, or t
  misc_feature (725)..(725): n is a, c, g, or t
  misc_feature (727)..(731): n is a, c, g, or t
  misc_feature (734)..(735): n is a, c, g, or t
  misc_feature (739)..(739): n is a, c, g, or t
  misc_feature (741)..(741): n is a, c, g, or t
  misc_feature (744)..(744): n is a, c, g, or t
  misc_feature (747)..(747): n is a, c, g, or t
  misc_feature (749)..(749): n is a, c, g, or t
  misc_feature (752)..(752): n is a, c, g, or t
  misc_feature (755)..(755): n is a, c, g, or t
  misc_feature (762)..(764): n is a, c, g, or t
  misc_feature (766)..(766): n is a, c, g, or t
  misc_feature (769)..(769): n is a, c, g, or t
  misc_feature (771)..(771): n is a, c, g, or t
  misc_feature (779)..(779): n is a, c, g, or t
  misc_feature (783)..(784): n is a, c, g, or t
  misc_feature (787)..(788): n is a, c, g, or t
  misc_feature (790)..(790): n is a, c, g, or t
  misc_feature (792)..(792): n is a, c, g, or t
  misc_feature (795)..(796): n is a, c, g, or t
  misc_feature (801)..(803): n is a, c, g, or t
  misc_feature (806)..(807): n is a, c, g, or t
  misc_feature (810)..(814): n is a, c, g, or t
  misc_feature (816)..(816): n is a, c, g, or t
  misc_feature (820)..(820): n is a, c, g, or t
  misc_feature (824)..(825): n is a, c, g, or t
  misc_feature (827)..(827): n is a, c, g, or t
  misc_feature (829)..(829): n is a, c, g, or t
  misc_feature (832)..(832): n is a, c, g, or t
  misc_feature (835)..(835): n is a, c, g, or t
  misc_feature (841)..(841): n is a, c, g, or t
  misc_feature (845)..(845): n is a, c, g, or t
  misc_feature (848)..(848): n is a, c, g, or t
  misc_feature (852)..(852): n is a, c, g, or t
  misc_feature (856)..(856): n is a, c, g, or t
  misc_feature (860)..(860): n is a, c, g, or t
  misc_feature (864)..(864): n is a, c, g, or t
  misc_feature (870)..(871): n is a, c, g, or t
  misc_feature (877)..(877): n is a, c, g, or t
  misc_feature (880)..(880): n is a, c, g, or t
  misc_feature (884)..(884): n is a, c, g, or t
  misc_feature (888)..(888): n is a, c, g, or t
  misc_feature (895)..(895): n is a, c, g, or t
  misc_feature (897)..(898): n is a, c, g, or t
  misc_feature (908)..(908): n is a, c, g, or t
  misc_feature (910)..(910): n is a, c, g, or t
  misc_feature (912)..(912): n is a, c, g, or t
  misc_feature (916)..(916): n is a, c, g, or t
  misc_feature (918)..(919): n is a, c, g, or t
  misc_feature (927)..(931): n is a, c, g, or t
  misc_feature (935)..(935): n is a, c, g, or t
  misc_feature (937)..(938): n is a, c, g, or t
  misc_feature (940)..(940): n is a, c, g, or t
  misc_feature (943)..(943): n is a, c, g, or t
  misc_feature (946)..(946): n is a, c, g, or t
  misc_feature (955)..(956): n is a, c, g, or t
  misc_feature (958)..(958): n is a, c, g, or t
  misc_feature (962)..(963): n is a, c, g, or t
  misc_feature (969)..(970): n is a, c, g, or t
  misc_feature (973)..(976): n is a, c, g, or t
  misc_feature (979)..(979): n is a, c, g, or t
  misc_feature (987)..(987): n is a, c, g, or t
  misc_feature (993)..(993): n is a, c, g, or t
  misc_feature (995)..(995): n is a, c, g, or t
  misc_feature (999)..(999): n is a, c, g, or t
  misc_feature (1002)..(1003): n is a, c, g, or t
  misc_feature (1007)..(1007): n is a, c, g, or t
  misc_feature (1009)..(1009): n is a, c, g, or t
  misc_feature (1011)..(1011): n is a, c, g, or t
  misc_feature (1016)..(1019): n is a, c, g, or t
  misc_feature (1023)..(1023): n is a, c, g, or t
  misc_feature (1026)..(1026): n is a, c, g, or t
  misc_feature (1031)..(1032): n is a, c, g, or t
  misc_feature (1037)..(1037): n is a, c, g, or t
  misc_feature (1039)..(1039): n is a, c, g, or t
  misc_feature (1043)..(1043): n is a, c, g, or t
  misc_feature (1050)..(1051): n is a, c, g, or t
  misc_feature (1053)..(1053): n is a, c, g, or t
  misc_feature (1057)..(1057): n is a, c, g, or t
  misc_feature (1063)..(1063): n is a, c, g, or t
  misc_feature (1068)..(1068): n is a, c, g, or t
  misc_feature (1071)..(1072): n is a, c, g, or t
  misc_feature (1076)..(1076): n is a, c, g, or t
  misc_feature (1080)..(1080): n is a, c, g, or t
  misc_feature (1082)..(1082): n is a, c, g, or t
  misc_feature (1092)..(1092): n is a, c, g, or t
  misc_feature (1095)..(1095): n is a, c, g, or t
  misc_feature (1099)..(1099): n is a, c, g, or t
  misc_feature (1104)..(1104): n is a, c, g, or t
  misc_feature (1112)..(1114): n is a, c, g, or t
  misc_feature (1118)..(1118): n is a, c, g, or t
  misc_feature (1120)..(1120): n is a, c, g, or t
  misc_feature (1129)..(1129): n is a, c, g, or t
  misc_feature (1131)..(1132): n is a, c, g, or t
  misc_feature (1134)..(1136): n is a, c, g, or t
  misc_feature (1139)..(1139): n is a, c, g, or t
  misc_feature (1144)..(1144): n is a, c, g, or t
  misc_feature (1149)..(1150): n is a, c, g, or t
  misc_feature (1157)..(1158): n is a, c, g, or t
  misc_feature (1160)..(1160): n is a, c, g, or t
  misc_feature (1162)..(1162): n is a, c, g, or t
  misc_feature (1165)..(1165): n is a, c, g, or t
  misc_feature (1167)..(1167): n is a, c, g, or t
  misc_feature (1169)..(1171): n is a, c, g, or t
  misc_feature (1173)..(1175): n is a, c, g, or t
  misc_feature (1178)..(1178): n is a, c, g, or t
  misc_feature (1181)..(1182): n is a, c, g, or t
  misc_feature (1184)..(1184): n is a, c, g, or t
  misc_feature (1190)..(1190): n is a, c, g, or t
  misc_feature (1193)..(1194): n is a, c, g, or t
  misc_feature (1196)..(1196): n is a, c, g, or t
  misc_feature (1210)..(1210): n is a, c, g, or t
  misc_feature (1218)..(1218): n is a, c, g, or t
  misc_feature (1220)..(1220): n is a, c, g, or t
  misc_feature (1222)..(1222): n is a, c, g, or t
  misc_feature (1224)..(1224): n is a, c, g, or t
  misc_feature (1226)..(1226): n is a, c, g, or t
  misc_feature (1243)..(1243): n is a, c, g, or t
tttttacaattatatnaaaanttnannnatntattnnaananttnnttnnnnntntnannnattnttatatatnttaatnnnntantttnnnnatatnaatnannnttngnanantntattnnatttnnnaataannatttanaatnnntttnnannntnctntntatnntnntanantattttnanttattntntattaatatatnnnnnantttannanaatataattaantanannttannatntntnnnnanttnattnantnntantnaanntnttnanttnntnannttnannttatttttntntnntntatnntaatattnattttantntattttnatntattttannnnaantnnaaaaaantttnnntntntttntntnnantntatnnntatnatnaatannntnnnatantnataaatntnattannaanannnaagantnnnannnnnaacannannnannannnnngannnnnannnatcatanannatannaatnnntnnnatnntnnnnnantnnnntnantantnnaantnatataatanaannntnnnanaaannnaaantnatattaatnatananannntnaannaaatatnttaatantannaaaaaantnnatnntannnttntaantnaancnnnanannnnataatananntatnnatnaancnatnaatnnaanaattnaantattaatatanntatnanannnnnaannaaantntantantnaanaanaaaatannntnaanantaataaanttcnnttnnananaannaatannnaannaannnnnanaaanaaannananatnttnaagganaaanaanaaanatanaaanaaanaaaaannaaaaanaanaaanaaanaaaaaanannaaaaaaaatnananaaanannaaaaaaannnnnatananntnaanaanaataaatannantaannataaannaannnntanaataatanaaaaananatanatnnattnananataannnnatanaanaaaannttatntnaaanaaaaaanntntatntataanattanatnnattntttnanaataattaanttntttnaattnaatttatnnnattnantatatattnanntnnnaantaatnaattnnaataaannantnttnantnnnannnaanaannanaaatanatnnanaaaatatataaaanatttatanantnananaaatattttttttaganattaaaaaaaaaaaaaaaaaactattcataaataatcatgaatataaagaatgaaagttaaatgcataatttttttatttttattaattgacattactttctttataatatttatcaagtagtatataattataattattgaaaagtatattgaatatttatatatattttacattccatttttattggagtattatgtaattttaactttattactaatacttttaataaaaatattatttaatttcttaactcttatttaatttactttattcatttatttatttagatacatagatagttaataagttttagatagttattaatatatttattcattgatttattgatttattgctttatatagagattatttattgatttattaaattatagaattattggattatttataggaaatattaaaattaacttataaaatgttaatagttataataattaaatattaaacgctataccatttttagataaaagttttttatataaaaatttaacttaatagttcattaattttggaataatgatttattcatttacattacaaattaattaaaaaccaataattttggtttaacgtgtgctcacatgctcatgattaatgagttattataatagtttagtaatgttaattgaaacgttacacatacaatacagaattcttagtatttatttatcaatacttcatagcttttgttaaacgttgaataaaacgtttttttaaagtattttttttttttttttttttttaaaaaaaaaaaatactataatttgctactgttctaatttgagtaaattttctattattaatacatgtccttcaaaaattttctttaatacataattcaaaaatatgacataaattaggtgttcatttaataaacttattaaaatataacattaaagaaaaaataaatatatataattaaaactattgctataatatattattagctgattaaatatatataatagtatagcttaatatacattagtatatgtaataataaaaaaaaatataaaaattaaaaatattttataataaacttttaaagaattttaaaaaataatatatattgttaagcataattcataatatatgtaatatattttaaatatatttatataaacaattttttaaaagttataaactgactgaagattcgttgttttttattattttcaatttaccaatataaatttacattaaattcaaataaataaataaaattctgtttcctgttactcaaaaaatatatatataattttattataatatattttattgaatatatgtttaatatatgtataatataatatattgcaatatattgaaataaaattaatggcattacttagaattgattattaaaaaggaaattttgtaaatacatgaaaagaatgaaatggtacaaagagttttcatatcaaataaaaaaatttttttaatctatataagcatatagtatatgatagtcacatcataaataataaaattatgttgataattcatataactatgatgctgtttcattaaaattttatcacaataatttccaataaaaaattcataaaacatttaaaaaaatactaatctatttatattagaatctagtgtgtttagcaatagtgcattcacaacgtggcgtattttttgtatgtggcttactttttatataattaaataaataattaatattctttttatatatatataatttattaatattcaattgtaaaaataattttttataaaaaaaaatgatattttataattcttttttaatagaatatattattattacccattttcatattaacatattctaacctagtatttctattctaaattagataatttagaatgaataaaataatttatacattacattaattctttaaattcgacttaaatattgtaaagataatttcttaaatgtatttgtaatctaataatttcctcattttatttccggtgagtaccgctattggtttcagcccaccttcaggggcaatgggaatattgaagttagtcacgcatttacatataggcataattttccctactagacgatcttaccaagcattcagcattggggctctgatattcatattattgctgtaaattttcaagtaccctttttctcggagtgctctcctaacttccctttgtaacgagaggttagtataacctaacccatggagatctgtactagctagattggtaattacattaacgtcagaaaaattgcaatttagtagaataaccaagtagaatatttcttaaatagacacatgaaatcatatatccgaatgataattcccttgcaatatattagatgacagtacttgcgcaactctctcaggcccacagttaggacagtatcttgtctatattatttgaatacttttcctcacaaaactaattctttaatattacatcactaatattggatgtatctaagatatcttttataatataacggtttatatataccatttatatgacggaagcctttctcttgaaaggtgatattataccattttaattagtgtgctgttttttatattactttcaattataattctctttgaagattgatgttcgtttgttttgtagttttaacgataactattaaaattaagtcataatcttaaggtattaaaattgattacatttgtagctaattatattattctagtcatttaaacttattagtaaatagtataaattgtttc

SEQ ID NO: 391 - DNA, 4000 bp, Escherichia coli
  misc_feature (28)..(28): n is a, c, g, or t
  misc_feature (42)..(42): n is a, c, g, or t
  misc_feature (50)..(50): n is a, c, g, or t
  misc_feature (70)..(70): n is a, c, g, or t
  misc_feature (81)..(81): n is a, c, g, or t
  misc_feature (97)..(97): n is a, c, g, or t
  misc_feature (121)..(121): n is a, c, g, or t
  misc_feature (124)..(124): n is a, c, g, or t
  misc_feature (156)..(156): n is a, c, g, or t
  misc_feature (199)..(199): n is a, c, g, or t
  misc_feature (309)..(310): n is a, c, g, or t
  misc_feature (367)..(367): n is a, c, g, or t
  misc_feature (412)..(412): n is a, c, g, or t
  misc_feature (520)..(520): n is a, c, g, or t
  misc_feature (553)..(553): n is a, c, g, or t
  misc_feature (571)..(571): n is a, c, g, or t
  misc_feature (592)..(592): n is a, c, g, or t
  misc_feature (640)..(640): n is a, c, g, or t
  misc_feature (646)..(646): n is a, c, g, or t
  misc_feature (649)..(649): n is a, c, g, or t
  misc_feature (910)..(910): n is a, c, g, or t
  misc_feature (936)..(936): n is a, c, g, or t
  misc_feature (1003)..(1003): n is a, c, g, or t
  misc_feature (1066)..(1066): n is a, c, g, or t
  misc_feature (1129)..(1129): n is a, c, g, or t
  misc_feature (1438)..(1438): n is a, c, g, or t
  misc_feature (1567)..(1567): n is a, c, g, or t
  misc_feature (2274)..(2274): n is a, c, g, or t
  misc_feature (2473)..(2473): n is a, c, g, or t
  misc_feature (2584)..(2584): n is a, c, g, or t
  misc_feature (2907)..(2907): n is a, c, g, or t
  misc_feature (2913)..(2913): n is a, c, g, or t
  misc_feature (2916)..(2916): n is a, c, g, or t
  misc_feature (3114)..(3114): n is a, c, g, or t
  misc_feature (3135)..(3135): n is a, c, g, or t
  misc_feature (3404)..(3404): n is a, c, g, or t
  misc_feature (3580)..(3580): n is a, c, g, or t
  misc_feature (3618)..(3618): n is a, c, g, or t
  misc_feature (3759)..(3759): n is a, c, g, or t
  misc_feature (3800)..(3800): n is a, c, g, or t
ttctttagatccgctagcagtaaatgcnataaaatttaaatnatctttanctactaatgtataaaaatcntttatctgagncattaacttttcatcntctttggtttcgtttaaatcatangcnatcaaccaaaagctataatttttatcatttanaacagaatctgttaaattaacatcatccaaagagtttaccatnaaatcagttatttttggaggattaatcgcatcatgtattaatttattatttgttgcttcccatttccaatttaaagtatcttcccatattttagatttcatataatcagnntgattaaactcttttaactcatcagtttttaagtttttataaactaacattgattcntaaactgcatctttataatctgcagcttttttcatattttctttnatgttcattcctggggcatatgctctaaaatctaaaggcggtaaatttcggtaagcataaattgggaaccaaaaagctaaaaccacagctaatgtaaataaagcaccngatgccattggagcgaaagtttcttttatattntctttaccagaaaataanagtgtaattaatactaataangcaatgtctttccaaaaactttcccaaggttttaattttaaaaaatcnccaaancanccacaatgggttactttattataacatgcagaataaaaagttaaaaaggtaaaaaaagcaatttgagcaaataaaagccataaagttaaatcacgtttgaaaccaattaataacataatgcctaaaataatttcactggcacaaataattattgccaaaggcaaagcgatatgagcaaacatctcaaaaaaagccatacccgtatcggcctgaaatacttcgaagtattcctttaatttataactaaaacctaaaggatcnttagctttaataaagcctgaaaaaanaaataaagctccaactaaaattctagatatatgtgttagaagagttatttttcctatatatccagangcattgattaaaaataattgaataatcaataaaacagataaaataattttactaaaacaaggngggcatagaaaataaaataatgctgctaatccggcagaccaaatgaaccgaaataatttagangataaaatttttttcatatattataatttacaatcttaataaaaaaattaaacttactaatttttacatttaatcaaggcgaaaacagaataatttatcatatccatataattagcatcaacgccctcactaataatggttttaccttcattgtcttctatttgtttaacacgaaaaactttcattaaaattaaatcagttatagaactcatcctcatgtccctccacgcttctccataatcatgatttttatcttccattaattgcttagtttgtttaatatatttattgtataggccttcgacttcnttgtaaggaatatcaatacgcgcatcatcatacagctctatttgaataagagcaattacacaataattaataatgccaacatattctccatttatagcgtcgctaattttttgaattcctttttcttcnatacttttaatgcgttgagctttaataaaaatttgatcggttaaagattttggtcttaaatttcgccaagcggttccatagtcgttcattttctttaaaaagatatctttgcatatcgcaattgcttcgtcgtaatgttgagatgtactttgcataatttatatgaacactaaaattaacgaaaaaaaaacaattgaatattcttgtaatgggaaaattataaaatttaataagccattaataatgagtattgttaatattaccccagatagcttttatgacggtggcaaatatgactcagaatctgatgtattaaaagatgttgaagaaaaaataaattctggggccaatattattgatattggagcatcttcaacgaggccgaattcagacgaaataactgaaaaagaagaatggaagagattaaaagatgttttaatttcggttcgtgctaattttcctgatattttattaagtgtagatacttatcgagcatctgttgcaaaaaaaagtgccgaacatggtatagatattattaatgatattagtgggggtaatttagattcattaatgtttaaaactgttgctgatttaaacattccatatattttaatgcacattcagggcaagcctaaaacaatgcaaaacaatcccaaatatttaaacgtagtggaagaagttaaaaaagattttgaatcaaaaattantcaattaataaatttaggattcaataaaataattttagacccaggatttggatttggaaaatcacttgaaaataattatcaattattaaaaagtcttaatatttttagcagttttaattaccctatactagctggagtttctcgaaaaagtatgattaatcgtgttattggcaccaatcctgttactgccttaaacggnacaactgtcttaaataccattgccttgcaaaatggcgcgtctatattaagagttcacgatgctttcgaagctaaacaagctattgaattagttgagttttataaatcttgntaagaggattaattttaaaactttgagcctataaaaaaataaattaattttataaaatgtataaaaaaatatttttttctttcttgttactttcttttacaattattatattttcttttaaatcaaaaactacttacgcttatcaaattgccttattaaaatataatggtggtggagattggtatgccaatttagaaacatcgctccctaacctaataaaattttgtaatgataatttaaaaacggcaattaatcctgaacaagctattgccgatgcaggaagtattgaaatttttaattatccatttattcatatgactggncatggnaangttattttttcgaatcaagaggctgaaaatttaagaaattatatgcttgccgggggattcttacatataagtgataattatggcatggatagttttatacgtattcaattaaaaaaaatatttcctgaattagatttaatagaattaccttttagccatcccatttatcatcaaaaatatgagtttccaaaaggcctncctaaaattcatgaacatganaaaaaggctccacaaggatttggattaatatataaaggtaaattaatttgcttttatgattttgaatgcgatttaggtgatggctgggaaagtcaagaaattcataatgatagccaagaggcaagaaataatgccttaaaaatgggcgctaatattatttcttatgcctttatgaattttgaaaaaaaataatttatacgtttatattcgtgatcaaatttttaaaacaattaaatttattaaaaataactctaggcatacttttattntttttattcacaaacaccatcgctcaaaactatatcgtgagtgggataataaaaggcggtcatgaaaatcttgcttttgcaacgatctatttaaaaggaactactaaaggagtaaatagtaatgatgccggaaattattctttaaaattagaaaaaggaatacacacacttgtatntaaatatataggttattcaaaacaagaaatcgaaatanatttaaccgaaaataaaatattaaatgttaatttaatccccgaaggagttctgcttcaagaagtaaccattaaatctggcgaagacccctcttacgccataattcgaaaagctatcaaaaaacgtaaattttattttaatnaagttaaagaatatagttgccagtcatacattaaaggactncaacgcttaaatcacgtgcctgaaaaaattaaaaagctgattaaatttactaccggcgaaaaaatagattcttctcaacttggcgtaatttatttaagtgaaagtgaaagtaattacttttttcaaaaaccaaataaagaaaaagaaataatgtttagtagtaaaataagtggcgaaaacaaaaattttagctttaatca

SEQ ID NO: 392 - DNA, 4000 bp, Escherichia coli
  misc_feature (12)..(13): n is a, c, g, or t
  misc_feature (19)..(20): n is a, c, g, or t
  misc_feature (26)..(27): n is a, c, g, or t
  misc_feature (29)..(30): n is a, c, g, or t
  misc_feature (34)..(34): n is a, c, g, or t
  misc_feature (37)..(37): n is a, c, g, or t
  misc_feature (43)..(43): n is a, c, g, or t
  misc_feature (46)..(46): n is a, c, g, or t
  misc_feature (48)..(48): n is a, c, g, or t
  misc_feature (50)..(50): n is a, c, g, or t
  misc_feature (56)..(56): n is a, c, g, or t
  misc_feature (64)..(64): n is a, c, g, or t
  misc_feature (69)..(71): n is a, c, g, or t
  misc_feature (73)..(74): n is a, c, g, or t
  misc_feature (80)..(80): n is a, c, g, or t
  misc_feature (82)..(82): n is a, c, g, or t
  misc_feature (84)..(85): n is a, c, g, or t
  misc_feature (89)..(89): n is a, c, g, or t
  misc_feature (115)..(115): n is a, c, g, or t
  misc_feature (119)..(120): n is a, c, g, or t
  misc_feature (128)..(130): n is a, c, g, or t
  misc_feature (135)..(135): n is a, c, g, or t
  misc_feature (137)..(138): n is a, c, g, or t
  misc_feature (143)..(143): n is a, c, g, or t
  misc_feature (146)..(146): n is a, c, g, or t
  misc_feature (150)..(150): n is a, c, g, or t
  misc_feature (152)..(154): n is a, c, g, or t
  misc_feature (158)..(162): n is a, c, g, or t
  misc_feature (169)..(171): n is a, c, g, or t
  misc_feature (174)..(174): n is a, c, g, or t
  misc_feature (176)..(177): n is a, c, g, or t
  misc_feature (185)..(186): n is a, c, g, or t
  misc_feature (196)..(197): n is a, c, g, or t
  misc_feature (199)..(199): n is a, c, g, or t
  misc_feature (205)..(205): n is a, c, g, or t
  misc_feature (207)..(207): n is a, c, g, or t
  misc_feature (220)..(220): n is a, c, g, or t
  misc_feature (222)..(223): n is a, c, g, or t
  misc_feature (229)..(229): n is a, c, g, or t
  misc_feature (233)..(233): n is a, c, g, or t
  misc_feature (236)..(236): n is a, c, g, or t
  misc_feature (238)..(238): n is a, c, g, or t
  misc_feature (242)..(242): n is a, c, g, or t
  misc_feature (249)..(249): n is a, c, g, or t
  misc_feature (261)..(261): n is a, c, g, or t
  misc_feature (263)..(263): n is a, c, g, or t
  misc_feature (265)..(265): n is a, c, g, or t
  misc_feature (272)..(272): n is a, c, g, or t
  misc_feature (276)..(276): n is a, c, g, or t
  misc_feature (284)..(284): n is a, c, g, or t
  misc_feature (288)..(288): n is a, c, g, or t
  misc_feature (293)..(293): n is a, c, g, or t
  misc_feature (295)..(295): n is a, c, g, or t
  misc_feature (305)..(306): n is a, c, g, or t
  misc_feature (309)..(309): n is a, c, g, or t
  misc_feature (316)..(316): n is a, c, g, or t
  misc_feature (321)..(321): n is a, c, g, or t
  misc_feature (328)..(328): n is a, c, g, or t
  misc_feature (330)..(330): n is a, c, g, or t
  misc_feature (337)..(337): n is a, c, g, or t
  misc_feature (340)..(340): n is a, c, g, or t
  misc_feature (344)..(344): n is a, c, g, or t
  misc_feature (348)..(348): n is a, c, g, or t
  misc_feature (350)..(350): n is a, c, g, or t
  misc_feature (352)..(352): n is a, c, g, or t
  misc_feature (354)..(354): n is a, c, g, or t
  misc_feature (356)..(358): n is a, c, g, or t
  misc_feature (363)..(363): n is a, c, g, or t
  misc_feature (367)..(371): n is a, c, g, or t
  misc_feature (373)..(373): n is a, c, g, or t
  misc_feature (380)..(380): n is a, c, g, or t
  misc_feature (383)..(383): n is a, c, g, or t
  misc_feature (385)..(385): n is a, c, g, or t
  misc_feature (401)..(401): n is a, c, g, or t
  misc_feature (403)..(403): n is a, c, g, or t
  misc_feature (417)..(417): n is a, c, g, or t
  misc_feature (422)..(422): n is a, c, g, or t
  misc_feature (428)..(428): n is a, c, g, or t
  misc_feature (430)..(430): n is a, c, g, or t
  misc_feature (432)..(432): n is a, c, g, or t
  misc_feature (435)..(436): n is a, c, g, or t
  misc_feature (439)..(441): n is a, c, g, or t
  misc_feature (444)..(444): n is a, c, g, or t
  misc_feature (446)..(446): n is a, c, g, or t
  misc_feature (450)..(450): n is a, c, g, or t
  misc_feature (452)..(455): n is a, c, g, or t
  misc_feature (457)..(457): n is a, c, g, or t
  misc_feature (464)..(469): n is a, c, g, or t
  misc_feature (471)..(472): n is a, c, g, or t
  misc_feature (475)..(477): n is a, c, g, or t
  misc_feature (479)..(481): n is a, c, g, or t
  misc_feature (483)..(485): n is a, c, g, or t
  misc_feature (488)..(491): n is a, c, g, or t
  misc_feature (493)..(496): n is a, c, g, or t
  misc_feature (499)..(503): n is a, c, g, or t
  misc_feature (508)..(508): n is a, c, g, or t
  misc_feature (511)..(513): n is a, c, g, or t
  misc_feature (517)..(520): n is a, c, g, or t
  misc_feature (524)..(524): n is a, c, g, or t
  misc_feature (528)..(530): n is a, c, g, or t
  misc_feature (532)..(533): n is a, c, g, or t
  misc_feature (539)..(545): n is a, c, g, or t
  misc_feature (547)..(547): n is a, c, g, or t
  misc_feature (551)..(561): n is a, c, g, or t
  misc_feature (563)..(563): n is a, c, g, or t
  misc_feature (565)..(566): n is a, c, g, or t
  misc_feature (568)..(569): n is a, c, g, or t
  misc_feature (571)..(571): n is a, c, g, or t
  misc_feature (573)..(574): n is a, c, g, or t
  misc_feature (576)..(576): n is a, c, g, or t
  misc_feature (578)..(579): n is a, c, g, or t
  misc_feature (581)..(582): n is a, c, g, or t
  misc_feature (584)..(585): n is a, c, g, or t
  misc_feature (588)..(588): n is a, c, g, or t
  misc_feature (591)..(591): n is a, c, g, or t
  misc_feature (593)..(593): n is a, c, g, or t
  misc_feature (595)..(595): n is a, c, g, or t
  misc_feature (597)..(597): n is a, c, g, or t
  misc_feature (599)..(599): n is a, c, g, or t
  misc_feature (601)..(601): n is a, c, g, or t
  misc_feature (603)..(603): n is a, c, g, or t
  misc_feature (606)..(606): n is a, c, g, or t
  misc_feature (610)..(610): n is a, c, g, or t
  misc_feature (612)..(612): n is a, c, g, or t
  misc_feature (614)..(614): n is a, c, g, or t
  misc_feature (616)..(616): n is a, c, g, or t
  misc_feature (618)..(619): n is a, c, g, or t
  misc_feature (625)..(625): n is a, c, g, or t
  misc_feature (628)..(630): n is a, c, g, or t
  misc_feature (632)..(634): n is a, c, g, or t
  misc_feature (636)..(643): n is a, c, g, or t
  misc_feature (646)..(647): n is a, c, g, or t
  misc_feature (649)..(651): n is a, c, g, or t
  misc_feature (653)..(656): n is a, c, g, or t
  misc_feature (658)..(659): n is a, c, g, or t
  misc_feature (662)..(667): n is a, c, g, or t
  misc_feature (669)..(669): n is a, c, g, or t
  misc_feature (671)..(671): n is a, c, g, or t
  misc_feature (673)..(673): n is a, c, g, or t
  misc_feature (675)..(678): n is a, c, g, or t
  misc_feature (680)..(680): n is a, c, g, or t
  misc_feature (682)..(684): n is a, c, g, or t
  misc_feature (686)..(686): n is a, c, g, or t
  misc_feature (688)..(688): n is a, c, g, or t
  misc_feature (692)..(692): n is a, c, g, or t
  misc_feature (694)..(695): n is a, c, g, or t
  misc_feature (697)..(697): n is a, c, g, or t
  misc_feature (704)..(705): n is a, c, g, or t
  misc_feature (707)..(713): n is a, c, g, or t
  misc_feature (715)..(716): n is a, c, g, or t
  misc_feature (719)..(719): n is a, c, g, or t
  misc_feature (721)..(722): n is a, c, g, or t
  misc_feature (725)..(728): n is a, c, g, or t
  misc_feature (730)..(730): n is a, c, g, or t
  misc_feature (732)..(743): n is a, c, g, or t
  misc_feature (745)..(756): n is a, c, g, or t
  misc_feature (758)..(758): n is a, c, g, or t
  misc_feature (760)..(761): n is a, c, g, or t
  misc_feature (763)..(764): n is a, c, g, or t
  misc_feature (766)..(767): n is a, c, g, or t
  misc_feature (769)..(771): n is a, c, g, or t
  misc_feature (775)..(777): n is a, c, g, or t
  misc_feature (779)..(781): n is a, c, g, or t
  misc_feature (784)..(789): n is a, c, g, or t
  misc_feature (793)..(796): n is a, c, g, or t
  misc_feature (798)..(798): n is a, c, g, or t
  misc_feature (800)..(805): n is a, c, g, or t
  misc_feature (807)..(819): n is a, c, g, or t
  misc_feature (822)..(823): n is a, c, g, or t
  misc_feature (825)..(832): n is a, c, g, or t
  misc_feature (834)..(865): n is a, c, g, or t
  misc_feature (867)..(874): n is a, c, g, or t
  misc_feature (876)..(882): n is a, c, g, or t
  misc_feature (884)..(898): n is a, c, g, or t
  misc_feature (900)..(902): n is a, c, g, or t
  misc_feature (905)..(905): n is a, c, g, or t
  misc_feature (909)..(911): n is a, c, g, or t
  misc_feature (914)..(914): n is a, c, g, or t
  misc_feature (917)..(920): n is a, c, g, or t
  misc_feature (1992)..(1992): n is a, c, g, or t
tctcgcacgcgnngcgcgnntcccgnnanncgcncgngtgcgnggngngngggcgnggggcgcnccgcnnncnngtgtcncntnncgcngcggcgcgccgcgcgcgccgcgcgcncgcnncgcgcggnnngcggncnngcgcncancgcncnnncccnnnnncgtctcnnntcntnntgtctccnnttcgcccccnngngtcgcncngcgctcgggcgcncnngtgcgncgcncgngncccncgcgcgnggcgcgggcgtncngngggcgcntctngggggcgngagnggcgngngggaggcgcnngcngcgcgcnggcgnggggcgngncgcgcgngtntcgngagngncncngnnncgcgncgcnnnnncnccgcgcngcngncgccggggcgcgccgngngcgcgccccgggcncgcanccgggncncncannggnnntcngngcgngnnnngngcgcggnnnnnncnncgnnngnnncnnnggnnnngnnnnggnnnnncgcgngcnnngcgnnnncccngcgnnncnnccgcgnnnnnnncncgcnnnnnnnnnnngngnngnngncnngngnngnngnngcngcngngngncncncncgnggcncncncncnncgcggngcnnncnnngnnnnnnnncgnngnnncnnnngnngcnnnnnngngncncnnnngngnnngngngcgngnngngcgcgcnngnnnnnnncnnggngnngcnnnngngnnnnnnnnnnnngnnnnnnnnnnnngngnngnngnncnnngcgnnngnnncgnnnnnngcgnnnngngnnnnnntnnnnnnnnnnnnnaannannnnnnnnannnnnnnnnnnnnnnnnnnnnnnnnnnnnnnntnnnnnnnngnnnnnnncnnnnnnnnnnnnnnncnnnccnagannnccnctnnnnaacgaaaacggcggacgacaacggctcttccgacgcgagcctttcccactgacgctcgcgcggcggagacgcgtgcgtcgcgtgggcgtatcggcggaccccgcgcgaggttttgcgcggtgcgcgacgtagacgtgtccgagcgacgttcgcgcgggcgaacatggcgcggtgactcgggacgtcacccgtggctcgatccctccgacgaaaagacggtgccaagatcttctcgccgtgagcgaacatggcgagcgtgggtccgtccccgtccaaccccgccgggggtgaatcagaaacccccccgggggtgcgcatgatcatcggcggctacgacgtgcgcttcccgttcaagccgtacgcctcgcagatcggcatcgccagccgcgtcttgaaggcgctcgacacgggaacgaacgcgttgttagaatcgcccaccgggtctgggaaatcgctcgcgctgctgtgcgcggcgatggcgtggcaggagcgctggaaggccacgcgagaagccgcggacgcgcacggtgacgcgcgcgacgtggagaggcacgaccggtgcgcagaggccgagcccactgatcgagcgtcaaagccctccggcggcggcaaaaaggaaaaggtgcctcgcgtctactacgcgactcgcacgcactcgcagatcgcgcaggtcgtgcgcgagctgaaacgcaccgcgtaccggcccacgatgaccgtcctggggtcgagggagcactactgcgtgaaccagaaagcccggaacgcggcgatgaagggcgggaacctgggcgaggagtgtaagtccctgcttgaagccgccgggcgccgcaagcgcggtggcttcgaggaggacgaagacgaaaccgaaaacgacgctccggcgcgctccggcgggtgcgggtacagccacggcgctctgaagctcgcgggcaaggcgtcacgtccgggtgccgagcccttggacatcgaggacctggtgacgctcgggaagaagacgcgcgggtgtccttacttcgcggcgaaacacgcgcacgaaaccgccgagctcgtgttttgcccgtacaactacctnctggacccgtccgtccgcgcggcgatggacgtggacgtcgccggcgcgctggtcatcctggacgaggcgcacaacgtcgaggacactgcccgggaggctgcgagctgcgacgtgcacttgcacgacctgcgagcggcggcggaggagttcgagcgcgtcgcggcggcggaagccgccgacgcggcttccccccgcgggcccgacgtttccgccgccgacggcgccgcggcgacttcgcccgacgtttccgggcatcgcgcgcgagactcgggccacgcgcttttggcgcgcgtcgcgggctccgtcgcgcggtggctgcacggcgcgtccgaccaggacaacccgcggtgccccctgcgcccgcacggcttcgagcggtggatggcggtgtggtcggggggcgccaacgtccagaggcagctccgcgacgcgggcctcgccgtcgagacgctcgcgtccgtcgagcgcgcgcggagcgccgccgtgaaagccgcgaacgactccagcacgcccggcgctctgcgcgtgagcggccacgcgctgaagacggtggaggtgctgctgacgtccgcgcggtacgcgctggccggcggcggcggaaacgtcgggcggagcgcggatgacttccggctcgccgtgcagaaacggttcgacgagccggttccgcggaagcgcggaagcgtctcgtccgacgaaacgcttctgcgtgacggaggcgtctcgttcgacgccgcgaaggtcaccctttccctgtgggccttgaacccggctctggcgttcgcggacatcgccggagcgcgggacgagcgcgggacgaacgcactcgcgcgctcggtggttctcacctccgggacgctcgcgccgctggactcgttcgcctccgagctgggcgcgccgtttccgatccgcatggaggcgccgcactgcgtggacgtgcagacgcaggtgtggtgcggcgcggtggccgcgggcgcgagcggcacgcgcctcagcggcacgttcaagacctccgtggagttttcgtaccaggacgacctcgggggctcgctcgagaagtggtgcctcgagatcccgcacggcgtgctggtgtttttccccagctactcgctgctggaccgcgtcgcgcagcgatggaagagcacgggcgcctggcgccgcctcgagcaggccacggggaagaagctgttccaggagcccagggggggcggcggaggcggaggcggcgggcgaggcaaaggccggggcagccgcgggggccgaggcggcggcggcgagaaaaacgccctcgaatcgcttttgtccaagtattaccgcgcggtgcggatgagcgcggcggcggcgccgcacgcgcacgcggcggcgcccgtcggttcgccgtgccgcggtgccgtgctcctggcggtgtgccgcgggaaggtctccgagggcatcgacttcgcggacgcgaacgcgcgcggcgtggtggtggtgggcatcccctaccccaacctgaaggacaagcaggtggagctcaagcgcaagtacaacgacgagaaaaacgccaagaaccgcgccggcgtcttgtccggcgaccagtggtactcgcagcaggcgtttcgcgcgctcaaccaggcggtgggcaggtgcttgaggcacaggaacgaccacggcgccgtgctgctggtcgacgagaggtacgcgcacggcgcgaacgacgcgctcgtgcggaacctccccaagtggctcaggccggcgacgcggaagtgcgcggacttcgacgcgtccgtcgcggggttgcgcgcgtttttcagcctcaaagcgaaacacgcgccgccggaagccgcgcgcgcgccgccaccggcgaagctgctcccctcggtgggcgcggagaaggacgcgaaggagagggacggcgggggcgggaaagggggcggcaagccgaaggacagcaaggaagccgcggcggatgcgagacagcgcgacataaagcggttcttccagccggcggcggcggcgacggacgcgctcg

SEQ ID NO: 393 - DNA, 4000 bp, Escherichia coli
  misc_feature (1)..(15): n is a, c, g, or t
  misc_feature (17)..(20): n is a, c, g, or t
  misc_feature (22)..(22): n is a, c, g, or t
  misc_feature (24)..(25): n is a, c, g, or t
  misc_feature (27)..(30): n is a, c, g, or t
  misc_feature (32)..(35): n is a, c, g, or t
  misc_feature (37)..(43): n is a, c, g, or t
  misc_feature (45)..(45): n is a, c, g, or t
  misc_feature (48)..(48): n is a, c, g, or t
  misc_feature (50)..(54): n is a, c, g, or t
  misc_feature (58)..(62): n is a, c, g, or t
  misc_feature (64)..(64): n is a, c, g, or t
  misc_feature (66)..(66): n is a, c, g, or t
  misc_feature (68)..(69): n is a, c, g, or t
  misc_feature (71)..(72): n is a, c, g, or t
  misc_feature (76)..(77): n is a, c, g, or t
  misc_feature (79)..(83): n is a, c, g, or t
  misc_feature (85)..(89): n is a, c, g, or t
  misc_feature (91)..(91): n is a, c, g, or t
  misc_feature (94)..(95): n is a, c, g, or t
  misc_feature (98)..(101): n is a, c, g, or t
  misc_feature (103)..(103): n is a, c, g, or t
  misc_feature (105)..(109): n is a, c, g, or t
  misc_feature (111)..(115): n is a, c, g, or t
  misc_feature (118)..(121): n is a, c, g, or t
  misc_feature (125)..(126): n is a, c, g, or t
  misc_feature (128)..(132): n is a, c, g, or t
  misc_feature (134)..(137): n is a, c, g, or t
  misc_feature (139)..(140): n is a, c, g, or t
  misc_feature (142)..(148): n is a, c, g, or t
  misc_feature (150)..(151): n is a, c, g, or t
  misc_feature (153)..(154): n is a, c, g, or t
  misc_feature (157)..(163): n is a, c, g, or t
  misc_feature (165)..(167): n is a, c, g, or t
  misc_feature (170)..(171): n is a, c, g, or t
  misc_feature (175)..(176): n is a, c, g, or t
  misc_feature (179)..(179): n is a, c, g, or t
  misc_feature (181)..(182): n is a, c, g, or t
  misc_feature (184)..(186): n is a, c, g, or t
  misc_feature (188)..(190): n is a, c, g, or t
  misc_feature (193)..(193): n is a, c, g, or t
  misc_feature (195)..(195): n is a, c, g, or t
  misc_feature (197)..(200): n is a, c, g, or t
  misc_feature (203)..(205): n is a, c, g, or t
  misc_feature (208)..(211): n is a, c, g, or t
  misc_feature (213)..(215): n is a, c, g, or t
  misc_feature (219)..(224): n is a, c, g, or t
  misc_feature (226)..(229): n is a, c, g, or t
  misc_feature (232)..(234): n is a, c, g, or t
  misc_feature (236)..(236): n is a, c, g, or t
  misc_feature (238)..(239): n is a, c, g, or t
  misc_feature (241)..(245): n is a, c, g, or t
  misc_feature (247)..(253): n is a, c, g, or t
  misc_feature (256)..(260): n is a, c, g, or t
  misc_feature (262)..(262): n is a, c, g, or t
  misc_feature (264)..(264): n is a, c, g, or t
  misc_feature (266)..(267): n is a, c, g, or t
  misc_feature (269)..(270): n is a, c, g, or t
  misc_feature (272)..(274): n is a, c, g, or t
  misc_feature (276)..(277): n is a, c, g, or t
  misc_feature (280)..(280): n is a, c, g, or t
  misc_feature (282)..(282): n is a, c, g, or t
  misc_feature (284)..(287): n is a, c, g, or t
  misc_feature (290)..(290): n is a, c, g, or t
  misc_feature (292)..(297): n is a, c, g, or t
  misc_feature (299)..(299): n is a, c, g, or t
  misc_feature (301)..(307): n is a, c, g, or t
  misc_feature (309)..(309): n is a, c, g, or t
  misc_feature (311)..(313): n is a, c, g, or t
  misc_feature (315)..(319): n is a, c, g, or t
  misc_feature (321)..(321): n is a, c, g, or t
  misc_feature (324)..(325): n is a, c, g, or t
  misc_feature (327)..(328): n is a, c, g, or t
  misc_feature (330)..(331): n is a, c, g, or t
  misc_feature (333)..(337): n is a, c, g, or t
  misc_feature (340)..(340): n is a, c, g, or t
  misc_feature (342)..(342): n is a, c, g, or t
  misc_feature (344)..(344): n is a, c, g, or t
  misc_feature (346)..(347): n is a, c, g, or t
  misc_feature (349)..(349): n is a, c, g, or t
  misc_feature (354)..(360): n is a, c, g, or t
  misc_feature (365)..(368): n is a, c, g, or t
  misc_feature (371)..(373): n is a, c, g, or t
  misc_feature (375)..(381): n is a, c, g, or t
  misc_feature (383)..(386): n is a, c, g, or t
  misc_feature (388)..(389): n is a, c, g, or t
  misc_feature (391)..(391): n is a, c, g, or t
  misc_feature (395)..(400): n is a, c, g, or t
  misc_feature (403)..(408): n is a, c, g, or t
  misc_feature (410)..(412): n is a, c, g, or t
  misc_feature (414)..(416): n is a, c, g, or t
  misc_feature (420)..(421): n is a, c, g, or t
  misc_feature (423)..(426): n is a, c, g, or t
  misc_feature (429)..(429): n is a, c, g, or t
  misc_feature (432)..(433): n is a, c, g, or t
  misc_feature (436)..(439): n is a, c, g, or t
  misc_feature (441)..(441): n is a, c, g, or t
  misc_feature (448)..(450): n is a, c, g, or t
  misc_feature (452)..(455): n is a, c, g, or t
  misc_feature (460)..(460): n is a, c, g, or t
  misc_feature (467)..(467): n is a, c, g, or t
  misc_feature (596)..(597): n is a, c, g, or t
  misc_feature (599)..(599): n is a, c, g, or t
  misc_feature (1242)..(1242): n is a, c, g, or t
  misc_feature (1245)..(1245): n is a, c, g, or t
  misc_feature (1263)..(1263): n is a, c, g, or t
  misc_feature (1269)..(1269): n is a, c, g, or t
  misc_feature (1284)..(1284): n is a, c, g, or t
  misc_feature (1323)..(1323): n is a, c, g, or t
  misc_feature (1339)..(1339): n is a, c, g, or t
  misc_feature (1341)..(1341): n is a, c, g, or t
  misc_feature (1449)..(1449): n is a, c, g, or t
  misc_feature (1514)..(1514): n is a, c, g, or t
  misc_feature (1987)..(1987): n is a, c, g, or t
  misc_feature (1990)..(1990): n is a, c, g, or t
  misc_feature (1997)..(1998): n is a, c, g, or t
  misc_feature (2207)..(2207): n is a, c, g, or t
  misc_feature (2447)..(2447): n is a, c, g, or t
  misc_feature (2483)..(2483): n is a, c, g, or t
  misc_feature (2494)..(2494): n is a, c, g, or t
  misc_feature (2690)..(2691): n is a, c, g, or t
  misc_feature (2696)..(2696): n is a, c, g, or t
  misc_feature (2698)..(2700): n is a, c, g, or t
  misc_feature (2702)..(2702): n is a, c, g, or t
  misc_feature (2709)..(2709): n is a, c, g, or t
  misc_feature (2712)..(2715): n is a, c, g, or t
  misc_feature (2717)..(2720): n is a, c, g, or t
  misc_feature (2722)..(2723): n is a, c, g, or t
  misc_feature (2725)..(2726): n is a, c, g, or t
  misc_feature (2729)..(2737): n is a, c, g, or t
  misc_feature (2740)..(2751): n is a, c, g, or t
  misc_feature (2753)..(2755): n is a, c, g, or t
  misc_feature (2758)..(2758): n is a, c, g, or t
  misc_feature (2760)..(2766): n is a, c, g, or t
  misc_feature (2768)..(2775): n is a, c, g, or t
  misc_feature (2777)..(2777): n is a, c, g, or t
  misc_feature (2781)..(2790): n is a, c, g, or t
  misc_feature (2792)..(2794): n is a, c, g, or t
  misc_feature (2796)..(2796): n is a, c, g, or t
  misc_feature (2798)..(2800): n is a, c, g, or t
  misc_feature (2802)..(2802): n is a, c, g, or t
  misc_feature (2804)..(2807): n is a, c, g, or t
  misc_feature (2811)..(2811): n is a, c, g, or t
  misc_feature (2813)..(2813): n is a, c, g, or t
  misc_feature (2816)..(2816): n is a, c, g, or t
  misc_feature (2819)..(2819): n is a, c, g, or t
  misc_feature (2821)..(2821): n is a, c, g, or t
  misc_feature (2823)..(2824): n is a, c, g, or t
  misc_feature (2831)..(2832): n is a, c, g, or t
  misc_feature (2834)..(2834): n is a, c, g, or t
  misc_feature (2838)..(2839): n is a, c, g, or t
  misc_feature (2842)..(2842): n is a, c, g, or t
  misc_feature (2849)..(2850): n is a, c, g, or t
  misc_feature (2852)..(2855): n is a, c, g, or t
  misc_feature (2858)..(2862): n is a, c, g, or t
  misc_feature (2865)..(2866): n is a, c, g, or t
  misc_feature (2869)..(2871): n is a, c, g, or t
  misc_feature (2873)..(2873): n is a, c, g, or t
  misc_feature (2876)..(2877): n is a, c, g, or t
  misc_feature (2880)..(2882): n is a, c, g, or t
  misc_feature (2884)..(2888): n is a, c, g, or t
  misc_feature (2890)..(2890): n is a, c, g, or t
  misc_feature (2892)..(2893): n is a, c, g, or t
  misc_feature (2895)..(2896): n is a, c, g, or t
  misc_feature (2898)..(2898): n is a, c, g, or t
  misc_feature (2901)..(2904): n is a, c, g, or t
  misc_feature (2908)..(2917): n is a, c, g, or t
  misc_feature (2919)..(2919): n is a, c, g, or t
  misc_feature (2921)..(2924): n is a, c, g, or t
  misc_feature (2927)..(2936): n is a, c, g, or t
  misc_feature (2939)..(2939): n is a, c, g, or t
  misc_feature (2941)..(2942): n is a, c, g, or t
  misc_feature (2945)..(2950): n is a, c, g, or t
  misc_feature (2952)..(2960): n is a, c, g, or t
  misc_feature (2962)..(2963): n is a, c, g, or t
  misc_feature (2965)..(2965): n is a, c, g, or t
  misc_feature (2967)..(2969): n is a, c, g, or t
  misc_feature (2973)..(2974): n is a, c, g, or t
  misc_feature (2977)..(2979): n is a, c, g, or t
  misc_feature (2981)..(2985): n is a, c, g, or t
  misc_feature (2987)..(2989): n is a, c, g, or t
  misc_feature (2991)..(2991): n is a, c, g, or t
  misc_feature (2993)..(2996): n is a, c, g, or t
  misc_feature (2999)..(2999): n is a, c, g, or t
  misc_feature (3001)..(3001): n is a, c, g, or t
  misc_feature (3005)..(3005): n is a, c, g, or t
  misc_feature (3007)..(3008): n is a, c, g, or t
  misc_feature (3011)..(3015): n is a, c, g, or t
  misc_feature (3017)..(3017): n is a, c, g, or t
  misc_feature (3019)..(3021): n is a, c, g, or t
  misc_feature (3023)..(3024): n is a, c, g, or t
  misc_feature (3026)..(3027): n is a, c, g, or t
  misc_feature (3031)..(3034): n is a, c, g, or t
  misc_feature (3038)..(3046): n is a, c, g, or t
  misc_feature (3048)..(3048): n is a, c, g, or t
  misc_feature (3050)..(3052): n is a, c, g, or t
  misc_feature (3054)..(3058): n is a, c, g, or t
  misc_feature (3060)..(3060): n is a, c, g, or t
  misc_feature (3062)..(3063): n is a, c, g, or t
  misc_feature (3065)..(3067): n is a, c, g, or t
  misc_feature (3069)..(3069): n is a, c, g, or t
  misc_feature (3071)..(3072): n is a, c, g, or t
  misc_feature (3074)..(3076): n is a, c, g, or t
  misc_feature (3078)..(3078): n is a, c, g, or t
  misc_feature (3080)..(3085): n is a, c, g, or t
  misc_feature (3091)..(3110): n is a, c, g, or t
  misc_feature (3112)..(3115): n is a, c, g, or t
  misc_feature (3119)..(3120): n is a, c, g, or t
  misc_feature (3122)..(3122): n is a, c, g, or t
  misc_feature (3125)..(3130): n is a, c, g, or t
  misc_feature (3133)..(3134): n is a, c, g, or t
  misc_feature (3136)..(3136): n is a, c, g, or t
  misc_feature (3139)..(3140): n is a, c, g, or t
  misc_feature (3142)..(3142): n is a, c, g, or t
  misc_feature (3144)..(3148): n is a, c, g, or t
  misc_feature (3150)..(3155): n is a, c, g, or t
  misc_feature (3157)..(3157): n is a, c, g, or t
  misc_feature (3159)..(3161): n is a, c, g, or t
  misc_feature (3163)..(3165): n is a, c, g, or t
  misc_feature (3168)..(3170): n is a, c, g, or t
  misc_feature (3172)..(3172): n is a, c, g, or t
  misc_feature (3175)..(3175): n is a, c, g, or t
  misc_feature (3177)..(3178): n is a, c, g, or t
  misc_feature (3180)..(3180): n is a, c, g, or t
  misc_feature (3182)..(3186): n is a, c, g, or t
  misc_feature (3189)..(3190): n is a, c, g, or t
  misc_feature (3192)..(3194): n is a, c, g, or t
  misc_feature (3196)..(3197): n is a, c, g, or t
  misc_feature (3199)..(3202): n is a, c, g, or t
  misc_feature (3204)..(3204): n is a, c, g, or t
  misc_feature (3206)..(3206): n is a, c, g, or t
  misc_feature (3208)..(3208): n is a, c, g, or t
  misc_feature (3210)..(3210): n is a, c, g, or t
  misc_feature (3214)..(3220): n is a, c, g, or t
  misc_feature (3222)..(3223): n is a, c, g, or t
  misc_feature (3225)..(3225): n is a, c, g, or t
  misc_feature (3228)..(3229): n is a, c, g, or t
  misc_feature (3233)..(3236): n is a, c, g, or t
  misc_feature (3241)..(3246): n is a, c, g, or t
  misc_feature (3249)..(3252): n is a, c, g, or t
  misc_feature (3254)..(3262): n is a, c, g, or t
  misc_feature (3264)..(3264): n is a, c, g, or t
  misc_feature (3268)..(3271): n is a, c, g, or t
  misc_feature (3273)..(3273): n is a, c, g, or t
  misc_feature (3275)..(3277): n is a, c, g, or t
  misc_feature (3280)..(3280): n is a, c, g, or t
  misc_feature (3282)..(3283): n is a, c, g, or t
  misc_feature (3285)..(3292): n is a, c, g, or t
  misc_feature (3294)..(3295): n is a, c, g, or t
  misc_feature (3299)..(3300): n is a, c, g, or t
  misc_feature (3302)..(3309): n is a, c, g, or t
  misc_feature (3312)..(3317): n is a, c, g, or t
  misc_feature (3319)..(3319): n is a, c, g, or t
  misc_feature (3321)..(3322): n is a, c, g, or t
  misc_feature (3327)..(3327): n is a, c, g, or t
  misc_feature (3329)..(3329): n is a, c, g, or t
  misc_feature (3331)..(3331): n is a, c, g, or t
  misc_feature (3333)..(3336): n is a, c, g, or t
  misc_feature (3338)..(3339): n is a, c, g, or t
  misc_feature (3343)..(3343): n is a, c, g, or t
  misc_feature (3347)..(3347): n is a, c, g, or t
  misc_feature (3349)..(3351): n is a, c, g, or t
  misc_feature (3353)..(3358): n is a, c, g, or t
  misc_feature (3360)..(3360): n is a, c, g, or t
  misc_feature (3362)..(3364): n is a, c, g, or t
  misc_feature (3367)..(3368): n is a, c, g, or t
  misc_feature (3370)..(3370): n is a, c, g, or t
  misc_feature (3374)..(3374): n is a, c, g, or t
  misc_feature (3377)..(3379): n is a, c, g, or t
  misc_feature (3384)..(3384): n is a, c, g, or t
  misc_feature (3386)..(3387): n is a, c, g, or t
  misc_feature (3389)..(3391): n is a, c, g, or t
  misc_feature (3393)..(3396): n is a, c, g, or t
  misc_feature (3398)..(3401): n is a, c, g, or t
  misc_feature (3403)..(3407): n is a, c, g, or t
  misc_feature (3409)..(3414): n is a, c, g, or t
  misc_feature (3418)..(3425): n is a, c, g, or t
  misc_feature (3427)..(3427): n is a, c, g, or t
  misc_feature (3429)..(3429): n is a, c, g, or t
  misc_feature (3431)..(3433): n is a, c, g, or t
  misc_feature (3435)..(3437): n is a, c, g, or t
  misc_feature (3439)..(3448): n is a, c, g, or t
  misc_feature (3451)..(3453): n is a, c, g, or t
  misc_feature (3456)..(3456): n is a, c, g, or t
  misc_feature (3458)..(3459): n is a, c, g, or t
  misc_feature (3461)..(3461): n is a, c, g, or t
  misc_feature (3463)..(3463): n is a, c, g, or t
  misc_feature (3466)..(3467): n is a, c, g, or t
  misc_feature (3471)..(3475): n is a, c, g, or t
  misc_feature (3477)..(3477): n is a, c, g, or t
  misc_feature (3481)..(3484): n is a, c, g, or t
  misc_feature (3486)..(3487): n is a, c, g, or t
  misc_feature (3489)..(3490): n is a, c, g, or t
  misc_feature (3493)..(3494): n is a, c, g, or t
  misc_feature (3496)..(3497): n is a, c, g, or t
  misc_feature (3500)..(3505): n is a, c, g, or t
  misc_feature (3508)..(3517): n is a, c, g, or t
  misc_feature (3519)..(3519): n is a, c, g, or t
  misc_feature (3521)..(3522): n is a, c, g, or t
  misc_feature (3524)..(3524): n is a, c, g, or t
  misc_feature (3527)..(3530): n is a, c, g, or t
  misc_feature (3532)..(3534): n is a, c, g, or t
  misc_feature (3536)..(3536): n is a, c, g, or t
  misc_feature (3538)..(3539): n is a, c, g, or t
  misc_feature (3541)..(3560): n is a, c, g, or t
  misc_feature (3562)..(3563): n is a, c, g, or t
  misc_feature (3565)..(3574): n is a, c, g, or t
  misc_feature (3578)..(3579): n is a, c, g, or t
  misc_feature (3581)..(3581): n is a, c, g, or t
  misc_feature (3583)..(3584): n is a, c, g, or t
  misc_feature (3587)..(3587): n is a, c, g, or t
  misc_feature (3589)..(3593): n is a, c, g, or t
  misc_feature (3595)..(3596): n is a, c, g, or t
  misc_feature (3598)..(3599): n is a, c, g, or t
  misc_feature (3601)..(3601): n is a, c, g, or t
  misc_feature (3603)..(3606): n is a, c, g, or t
  misc_feature (3609)..(3616): n is a, c, g, or t
  misc_feature (3618)..(3619): n is a, c, g, or t
  misc_feature (3621)..(3625): n is a, c, g, or t
  misc_feature (3627)..(3628): n is a, c, g, or t
  misc_feature (3630)..(3639): n is a, c, g, or t
  misc_feature (3641)..(3653): n is a, c, g, or t
  misc_feature (3655)..(3662): n is a, c, g, or t
  misc_feature (3664)..(3664): n is a, c, g, or t
  misc_feature (3666)..(3669): n is a, c, g, or t
  misc_feature (3671)..(3672): n is a, c, g, or t
  misc_feature (3674)..(3677): n is a, c, g, or t
  misc_feature (3679)..(3681): n is a, c, g, or t
  misc_feature (3686)..(3692): n is a, c, g, or t
  misc_feature (3694)..(3695): n is a, c, g, or t
  misc_feature (3697)..(3697): n is a, c, g, or t
  misc_feature (3699)..(3709): n is a, c, g, or t
  misc_feature (3711)..(3717): n is a, c, g, or t
  misc_feature (3719)..(3719): n is a, c, g, or t
  misc_feature (3721)..(3729): n is a, c, g, or t
  misc_feature (3731)..(3732): n is a, c, g, or t
  misc_feature (3734)..(3734): n is a, c, g, or t
  misc_feature (3737)..(3737): n is a, c, g, or t
  misc_feature (3739)..(3741): n is a, c, g, or t
  misc_feature (3743)..(3755): n is a, c, g, or t
  misc_feature (3757)..(3758): n is a, c, g, or t
  misc_feature (3760)..(3763): n is a, c, g, or t
  misc_feature (3765)..(3765): n is a, c, g, or t
  misc_feature (3767)..(3768): n is a, c, g, or t
  misc_feature (3770)..(3772): n is a, c, g, or t
  misc_feature (3774)..(3780): n is a, c, g, or t
  misc_feature (3782)..(3784): n is a, c, g, or t
  misc_feature (3786)..(3786): n is a, c, g, or t
  misc_feature (3789)..(3791): n is a, c, g, or t
  misc_feature (3793)..(3806): n is a, c, g, or t
  misc_feature (3809)..(3809): n is a, c, g, or t
  misc_feature (3811)..(3818): n is a, c, g, or t
  misc_feature (3820)..(3823): n is a, c, g, or t
  misc_feature (3825)..(3825): n is a, c, g, or t
  misc_feature (3828)..(3828): n is a, c, g, or t
  misc_feature (3832)..(3832): n is a, c, g, or t
  misc_feature (3834)..(3835): n is a, c, g, or t
  misc_feature (3838)..(3843): n is a, c, g, or t
  misc_feature (3845)..(3858): n is a, c, g, or t
  misc_feature (3861)..(3863): n is a, c, g, or t
  misc_feature (3865)..(3865): n is a, c, g, or t
  misc_feature (3867)..(3872): n is a, c, g, or t
  misc_feature (3874)..(3874): n is a, c, g, or t
  misc_feature (3876)..(3876): n is a, c, g, or t
  misc_feature (3878)..(3879): n is a, c, g, or t
  misc_feature (3881)..(3882): n is a, c, g, or t
  misc_feature (3884)..(3884): n is a, c, g, or t
  misc_feature (3886)..(3888): n is a, c, g, or t
  misc_feature (3890)..(3891): n is a, c, g, or t
  misc_feature (3894)..(3906): n is a, c, g, or t
  misc_feature (3908)..(3912): n is a, c, g, or t
  misc_feature (3914)..(3914): n is a, c, g, or t
  misc_feature (3916)..(3934): n is a, c, g, or t
  misc_feature (3936)..(3941): n is a, c, g, or t
  misc_feature (3943)..(3943): n is a, c, g, or t
  misc_feature (3945)..(3948): n is a, c, g, or t
  misc_feature (3950)..(3954): n is a, c, g, or t
  misc_feature (3956)..(3959): n is a, c, g, or t
  misc_feature (3961)..(3963): n is a, c, g, or t
  misc_feature (3965)..(3969): n is a, c, g, or t
  misc_feature (3971)..(3972): n is a, c, g, or t
  misc_feature (3975)..(3979): n is a, c, g, or t
  misc_feature (3984)..(3987): n is a, c, g, or t
  misc_feature (3989)..(3989): n is a, c, g, or t
  misc_feature (3991)..(3992): n is a, c, g, or t
  misc_feature (3994)..(3995): n is a, c, g, or t
  misc_feature (3997)..(3997): n is a, c, g, or t
nnnnnnnnnnnnnnnannnnantnnannnnannnnannnnnnnanaanannnnnagannnnntncnannannattnnannnnntnnnnnanaanntannnngnannnnnannnnnaannnnatanntnnnnnannnntnnannnnnnngnngnnaannnnnnnannnatnntttnnctntnncnnnannnctnancnnnnaannnaannnntnnnacannnnnntnnnnagnnntnanncnnnnngnnnnnnnacnnnnntncngnncnngnnngnnatntnannnnatncnnnnnncnannnnnnnancnnncnnnnntntgnngnnanntnnnnntanangnanntncaatnnnnnnnggctnnnntgnnntnnnnnnntnnnncnntncttnnnnnncannnnnnannnannncacnntnnnntgntannttnnnntnacgaaannnannnnaaagnaattgancctataccggtcataagagaattgataagaaacaaagccgatgttatcaagtcaacaaaagtagttgatttttattgtagaaataaaaaagataaaggtagattatacattgtcattctatacgaatannanaacgatgaaataatcggtatagatgtattttttgacaagtacaaacaaaaaaagggaggaacccaatgccgaaagaaaaagaaaccttattcgacattgcagcgcagaagagagaagctgaagagcttgctcggtcgcttgcagaactagacctcaacgcagaagacgttgagcaacaattggcagaaatccaagccaagctaataaagaagataaatagtttggatttcgtgtatattaaacttgatgctgaaattgaacagctgaaaatctataaggaactgtatcaagatgagctcaagaaaatcaatagcaagatggaaagtattgagaagagcaaagaccgccttcttcagatgttggcagacgcaaagctagttgatgtgaataagcccctgcgtactcagtatcacacttattcgcttaccaaaacttatggtggtgtagaaatagtagatgaagagctacttccaagtgactacattaaaacaaagattgagcagtatattgatactgcagccttgcggaatgacctcatggctggaaaagaaattccaggcgcagttcttccggtgaagatgaaggtaaggcgtcggtgagaatacttcgacaaatgatgctgaagaccgagtccctgatgtcncanaccatgacgtatgcaatnatgctnttcgaatcgatattntttggaataggagtctcttgctcaattattgttccgaanctgattaaagagtatntngatgacgaaaacaaagaatgcttcgtgtatcaaataatgtttcttggaatatttaacattgtctatatcataatagacgtagaaggagcatacaaatcatatagtttnggaatcggacttaccccgattacgccaatcttcacaataggatggagaaaatgagtgatacaaanatgtcaaagcgtgagaagcgctttcagaatattcttaacacgagaaaggatatgttctcggatgaagaaatcgagtttttgcaaaagaactttcgcagagtaattcctcaagaagagttactatcactccgagacaaagtcaatgtatatacttttgagaattgggtaatgacacatgagtctctcggaataaacgacttcatgaaaagtctttactatgcaattcagagtgatgaatcccaagaattacttatatcaaccgtttttgttctagctctggaatggagcagaggaaaaggagaaaaagatggcaacgaagacaaataagaaaccgagtgtcccaaaaagaaaggtgctatccttcgaaaagtttgtggacaccataaacaacgctccattgctcatgcaagcagtggatgatatgtttaacaagttcgcagatgaacttgatgagaaggaaataatcacaccanacnagcttgnntacaagatatatgaagagattgagaagaataacaatactcttatagctgtggtagctgcagtaacgatattcatgtctagcagaccacataaaggagaaagtaaaaatgacagtaattgatttcaactccgaaaacggaagaaagattcttacattgaatgaattcagtgatctacttaatgatggagaaacaattaaaggtgcactgnatcaattcgataaagacctttcgaaagaattaaacggacaaaagcttccaattgaagaattttgttaccgtgtgtatgaagagatcgaaaagaaaggtaacaccgccttcgaagtattcattataacgatggctgttttgtatggaaagataggaaaatgagtagcatcgttggtgttataataatcattctgcttctgatagtaatctacttctgtggaagaaaacttcagaagcttgnagaagcgaagagacgtcttaagaacttcaatgacgntctctgtattnaagtcagtcagtaccgggaacatttcttaaaagagaagaagaaaggcgatatgtatgacaagataataaaaaagtataagtacgctctcttctcttgtgcggactgtaagaagatagtctctaagaagaatacgcattggctggaagagaagccatattgcggaaagtgttatagaaaaaggaaagactcatgaannaaganannntnataatcngannnnannnngnnannaannnnnnnnntgnnnnnnnnnnnntnnngangnnnnnnntnnnnnnnntnattnnnnnnnnnntnnntngnnncnannnngatnanganganantnnaaggttnntngaanngtntaaaaannannnngcnnnnnttnncannnanaannttnnntnnnnngnannanntnctnnnncttnnnnnnnnnnantnnnntannnnnnnnnnatncnntannnnnngnnnnnnnnnanngngnnnaatnnctnnntnnnnncnnnangnnnntgnanggcnannatnnnnntncnnntnntnngaannnngagnnnnnnnnngnannnannnnngnannannngnanncnnntntnnnnnngaatgnnnnnnnnnnnnnnnnnnnnannnnaaanncnatnnnnnntgnntntgnnangnnnnngnnnnnnanannngnnnagnnncngcntnntnannnnnaanngnnngnnannnngntngnanactnnnnnnnanngntanngcannnnggaannnnnnctnnnnannnnnnnnnantttnnnnangnnnatnanngnnnnnnnngnnattnnannnnnnnnagnnnnnnananngaaangngngnnnnanngaangctngnnncnnnnnnantnnnganntnaaanagnnngctanannannntnnnnannnntnnnnnannnnnnaaannnnnnnntnanannngnnnannnnnnnnnnacnnntgnannancnganncaannnnnanttcnnnntnntnnatnnanntannnnnnacnnnnnnnnnngntnnanaannnntnnnantnngnnnnnnnnnnnnnnnnnnnntnntnnnnnnnnnnaagnnanannaangnnnnngnnanntntnnnnaannnnnnnnannannnnnanntnnnnnnnnnntnnnnnnnnnnnnnannnnnnnnancnnnntnncnnnntnnnaaagnnnnnnnannantnnnnnnnnnnngnnnnnnnantnnnnnnnnngnnanaanannngnnnnnnnnnnnnnanntnnnnananntnnntnnnnnnncnnngntannnannnnnnnnnnnnnnagntnnnnnnnntnnnncngtnctgnannttnnnnnncnnnnnnnnnnnnnntgnnntntnnnnnngnancnnannanannnannaannnnnnnnnnnnngnnnnntncnnnnnnnnnnnnnnnnnnntnnnnnngntnnnncnnnnnannnncnnntnnnnntnntgnnnnnatatnnnnananntnngnaag

SEQ ID NO: 394 - DNA, 4000 bp, Escherichia coli
  misc_feature (1967)..(1995): n is a, c, g, or t
  misc_feature (2043)..(2072): n is a, c, g, or t
  misc_feature (2120)..(2122): n is a, c, g, or t
  misc_feature (2124)..(2149): n is a, c, g, or t
  misc_feature (2197)..(2201): n is a, c, g, or t
  misc_feature (2203)..(2210): n is a, c, g, or t
  misc_feature (2212)..(2218): n is a, c, g, or t
  misc_feature (2220)..(2220): n is a, c, g, or t
  misc_feature (2223)..(2224): n is a, c, g, or t
  misc_feature (2226)..(2227): n is a, c, g, or t
  misc_feature (2229)..(2230): n is a, c, g, or t
  misc_feature (2232)..(2234): n is a, c, g, or t
  misc_feature (2237)..(2243): n is a, c, g, or t
  misc_feature (2246)..(2247): n is a, c, g, or t
  misc_feature (2249)..(2251): n is a, c, g, or t
  misc_feature (2256)..(2259): n is a, c, g, or t
  misc_feature (2261)..(2265): n is a, c, g, or t
  misc_feature (2267)..(2270): n is a, c, g, or t
  misc_feature (2272)..(2304): n is a, c, g, or t
  misc_feature (2306)..(2307): n is a, c, g, or t
  misc_feature (2309)..(2311): n is a, c, g, or t
  misc_feature (2314)..(2320): n is a, c, g, or t
  misc_feature (2323)..(2324): n is a, c, g, or t
  misc_feature (2326)..(2328): n is a, c, g, or t
  misc_feature (2333)..(2336): n is a, c, g, or t
  misc_feature (2338)..(2342): n is a, c, g, or t
  misc_feature (2344)..(2347): n is a, c, g, or t
  misc_feature (2349)..(2379): n is a, c, g, or t
  misc_feature (2381)..(2388): n is a, c, g, or t
  misc_feature (2390)..(2397): n is a, c, g, or t
  misc_feature (2400)..(2401): n is a, c, g, or t
  misc_feature (2403)..(2405): n is a, c, g, or t
  misc_feature (2409)..(2410): n is a, c, g, or t
  misc_feature (2412)..(2412): n is a, c, g, or t
  misc_feature (2414)..(2418): n is a, c, g, or t
  misc_feature (2420)..(2424): n is a, c, g, or t
  misc_feature (2426)..(2457): n is a, c, g, or t
  misc_feature (2459)..(2460): n is a, c, g, or t
  misc_feature (2462)..(2464): n is a, c, g, or t
  misc_feature (2467)..(2473): n is a, c, g, or t
  misc_feature (2476)..(2477): n is a, c, g, or t
  misc_feature (2480)..(2481): n is a, c, g, or t
  misc_feature (2486)..(2489): n is a, c, g, or t
  misc_feature (2491)..(2495): n is a, c, g, or t
  misc_feature (2497)..(2500): n is a, c, g, or t
  misc_feature (2502)..(2520): n is a, c, g, or t
  misc_feature (2522)..(2529): n is a, c, g, or t
  misc_feature (2531)..(2534): n is a, c, g, or t
  misc_feature (2536)..(2537): n is a, c, g, or t
  misc_feature (2539)..(2541): n is a, c, g, or t
  misc_feature (2544)..(2550): n is a, c, g, or t
  misc_feature (2553)..(2554): n is a, c, g, or t
  misc_feature (2556)..(2558): n is a, c, g, or t
  misc_feature (2563)..(2566): n is a, c, g, or t
  misc_feature (2568)..(2572): n is a, c, g, or t
  misc_feature (2574)..(2577): n is a, c, g, or t
  misc_feature (2579)..(2579): n is a, c, g, or t
  misc_feature (2581)..(2611): n is a, c, g, or t
  misc_feature (2614)..(2614): n is a, c, g, or t
  misc_feature (2616)..(2618): n is a, c, g, or t
  misc_feature (2621)..(2623): n is a, c, g, or t
  misc_feature (2625)..(2627): n is a, c, g, or t
  misc_feature (2630)..(2631): n is a, c, g, or t
  misc_feature (2633)..(2635): n is a, c, g, or t
  misc_feature (2640)..(2640): n is a, c, g, or t
  misc_feature (2642)..(2643): n is a, c, g, or t
  misc_feature (2645)..(2649): n is a, c, g, or t
  misc_feature (2651)..(2652): n is a, c, g, or t
  misc_feature (2654)..(2654): n is a, c, g, or t
  misc_feature (2656)..(2656): n is a, c, g, or t
  misc_feature (2658)..(2661): n is a, c, g, or t
  misc_feature (2663)..(2688): n is a, c, g, or t
  misc_feature (2690)..(2690): n is a, c, g, or t
  misc_feature (2693)..(2694): n is a, c, g, or t
  misc_feature (2698)..(2704): n is a, c, g, or t
  misc_feature (2707)..(2707): n is a, c, g, or t
  misc_feature (2710)..(2712): n is a, c, g, or t
  misc_feature (2717)..(2719): n is a, c, g, or t
  misc_feature (2722)..(2726): n is a, c, g, or t
  misc_feature (2728)..(2730): n is a, c, g, or t
  misc_feature (2733)..(2733): n is a, c, g, or t
  misc_feature (2735)..(2737): n is a, c, g, or t
  misc_feature (2739)..(2740): n is a, c, g, or t
  misc_feature (2743)..(2743): n is a, c, g, or t
  misc_feature (2745)..(2746): n is a, c, g, or t
  misc_feature (2748)..(2750): n is a, c, g, or t
  misc_feature (2753)..(2753): n is a, c, g, or t
  misc_feature (2755)..(2765): n is a, c, g, or t
  misc_feature (2767)..(2767): n is a, c, g, or t
  misc_feature (2770)..(2772): n is a, c, g, or t
  misc_feature (2775)..(2781): n is a, c, g, or t
  misc_feature (2784)..(2785): n is a, c, g, or t
  misc_feature (2787)..(2789): n is a, c, g, or t
  misc_feature (2794)..(2797): n is a, c, g, or t
  misc_feature (2799)..(2803): n is a, c, g, or t
  misc_feature (2805)..(2807): n is a, c, g, or t
  misc_feature (2810)..(2822): n is a, c, g, or t
  misc_feature (2824)..(2825): n is a, c, g, or t
  misc_feature (2827)..(2835): n is a, c, g, or t
  misc_feature (2837)..(2838): n is a, c, g, or t
  misc_feature (2840)..(2842): n is a, c, g, or t
  misc_feature (2844)..(2845): n is a, c, g, or t
  misc_feature (2847)..(2848): n is a, c, g, or t
  misc_feature (2851)..(2853): n is a, c, g, or t
  misc_feature (2855)..(2858): n is a, c, g, or t
  misc_feature (2860)..(2866): n is a, c, g, or t
  misc_feature (2871)..(2871): n is a, c, g, or t
  misc_feature (2873)..(2876): n is a, c, g, or t
  misc_feature (2878)..(2879): n is a, c, g, or t
  misc_feature (2881)..(2883): n is a, c, g, or t
  misc_feature (2885)..(2887): n is a, c, g, or t
  misc_feature (2889)..(2893): n is a, c, g, or t
  misc_feature (2895)..(2897): n is a, c, g, or t
  misc_feature (2899)..(2899): n is a, c, g, or t
  misc_feature (2901)..(2901): n is a, c, g, or t
  misc_feature (2904)..(2908): n is a, c, g, or t
  misc_feature (2910)..(2918): n is a, c, g, or t
  misc_feature (2920)..(2920): n is a, c, g, or t
  misc_feature (2923)..(2925): n is a, c, g, or t
  misc_feature (2928)..(2934): n is a, c, g, or t
  misc_feature (2937)..(2937): n is a, c, g, or t
  misc_feature (2940)..(2941): n is a, c, g, or t
  misc_feature (2948)..(2948): n is a, c, g, or t
  misc_feature (2950)..(2950): n is a, c, g, or t
  misc_feature (2953)..(2956): n is a, c, g, or t
  misc_feature (2959)..(2961): n is a, c, g, or t
  misc_feature (2963)..(2963): n is a, c, g, or t
  misc_feature (2965)..(2971): n is a, c, g, or t
  misc_feature (2973)..(2979): n is a, c, g, or t
  misc_feature (2981)..(2981): n is a, c, g, or t
  misc_feature (2983)..(2995): n is a, c, g, or t
  misc_feature (2997)..(2997): n is a, c, g, or t
  misc_feature (3000)..(3002): n is a, c, g, or t
  misc_feature (3007)..(3007): n is a, c, g, or t
  misc_feature (3009)..(3011): n is a, c, g, or t
  misc_feature (3014)..(3015): n is a, c, g, or t
  misc_feature (3019)..(3019): n is a, c, g, or t
  misc_feature (3024)..(3027): n is a, c, g, or t
  misc_feature (3029)..(3030): n is a, c, g, or t
  misc_feature (3032)..(3033): n is a, c, g, or t
  misc_feature (3036)..(3038): n is a, c, g, or t
  misc_feature (3040)..(3053): n is a, c, g, or t
  misc_feature (3055)..(3071): n is a, c, g, or t
  misc_feature (3074)..(3074): n is a, c, g, or t
  misc_feature (3077)..(3078): n is a, c, g, or t
  misc_feature (3083)..(3083): n is a, c, g, or t
  misc_feature (3085)..(3087): n is a, c, g, or t
  misc_feature (3091)..(3091): n is a, c, g, or t
  misc_feature (3094)..(3095): n is a, c, g, or t
  misc_feature (3101)..(3101): n is a, c, g, or t
  misc_feature (3103)..(3103): n is a, c, g, or t
  misc_feature (3106)..(3108): n is a, c, g, or t
  misc_feature (3113)..(3114): n is a, c, g, or t
  misc_feature (3117)..(3117): n is a, c, g, or t
  misc_feature (3119)..(3121): n is a, c, g, or t
  misc_feature (3123)..(3145): n is a, c, g, or t
  misc_feature (3147)..(3148): n is a, c, g, or t
  misc_feature (3150)..(3151): n is a, c, g, or t
  misc_feature (3154)..(3155): n is a, c, g, or t
  misc_feature (3158)..(3164): n is a, c, g, or t
  misc_feature (3167)..(3168): n is a, c, g, or t
  misc_feature (3170)..(3172): n is a, c, g, or t
  misc_feature (3177)..(3180): n is a, c, g, or t
  misc_feature (3182)..(3186): n is a, c, g, or t
  misc_feature (3188)..(3191): n is a, c, g, or t
  misc_feature (3193)..(3206): n is a, c, g, or t
  misc_feature (3208)..(3225): n is a, c, g, or t
  misc_feature (3228)..(3228): n is a, c, g, or t
  misc_feature (3230)..(3232): n is a, c, g, or t
  misc_feature (3235)..(3236): n is a, c, g, or t
  misc_feature (3239)..(3240): n is a, c, g, or t
  misc_feature (3244)..(3245): n is a, c, g, or t
  misc_feature (3247)..(3248): n is a, c, g, or t
  misc_feature (3254)..(3257): n is a, c, g, or t
  misc_feature (3259)..(3262): n is a, c, g, or t
  misc_feature (3266)..(3268): n is a, c, g, or t
  misc_feature (3270)..(3270): n is a, c, g, or t
  misc_feature (3272)..(3295): n is a, c, g, or t
  misc_feature (3297)..(3302): n is a, c, g, or t
  misc_feature (3304)..(3305): n is a, c, g, or t
  misc_feature (3307)..(3309): n is a, c, g, or t
  misc_feature (3312)..(3318): n is a, c, g, or t
  misc_feature (3321)..(3322): n is a, c, g, or t
  misc_feature (3324)..(3326): n is a, c, g, or t
  misc_feature (3331)..(3334): n is a, c, g, or t
  misc_feature (3336)..(3340): n is a, c, g, or t
  misc_feature (3342)..(3345): n is a, c, g, or t
  misc_feature (3347)..(3350): n is a, c, g, or t
  misc_feature (3352)..(3371): n is a, c, g, or t
  misc_feature (3373)..(3379): n is a, c, g, or t
  misc_feature (3381)..(3382): n is a, c, g, or t
  misc_feature (3384)..(3386): n is a, c, g, or t
  misc_feature (3389)..(3395): n is a, c, g, or t
  misc_feature (3398)..(3399): n is a, c, g, or t
  misc_feature (3401)..(3403): n is a, c, g, or t
  misc_feature (3408)..(3411): n is a, c, g, or t
  misc_feature (3413)..(3417): n is a, c, g, or t
  misc_feature (3419)..(3422): n is a, c, g, or t
  misc_feature (3424)..(3446): n is a, c, g, or t
  misc_feature (3448)..(3454): n is a, c, g, or t
  misc_feature (3502)..(3509): n is a, c, g, or t
  misc_feature (3511)..(3511): n is a, c, g, or t
  misc_feature (3513)..(3519): n is a, c, g, or t
  misc_feature (3521)..(3524): n is a, c, g, or t
  misc_feature (3526)..(3526): n is a, c, g, or t
  misc_feature (3528)..(3535): n is a, c, g, or t
  misc_feature (3537)..(3540): n is a, c, g, or t
  misc_feature (3542)..(3545): n is a, c, g, or t
  misc_feature (3547)..(3548): n is a, c, g, or t
  misc_feature (3552)..(3552): n is a, c, g, or t
  misc_feature (3554)..(3557): n is a, c, g, or t
  misc_feature (3561)..(3565): n is a, c, g, or t
  misc_feature (3567)..(3570): n is a, c, g, or t
  misc_feature (3572)..(3574): n is a, c, g, or t
  misc_feature (3576)..(3593): n is a, c, g, or t
  misc_feature (3595)..(3596): n is a, c, g, or t
  misc_feature (3598)..(3608): n is a, c, g, or t
  misc_feature (3610)..(3615): n is a, c, g, or t
  misc_feature (3618)..(3618): n is a, c, g, or t
  misc_feature (3620)..(3628): n is a, c, g, or t
  misc_feature (3630)..(3634): n is a, c, g, or t
  misc_feature (3637)..(3651): n is a, c, g, or t
  misc_feature (3653)..(3664): n is a, c, g, or t
  misc_feature (3666)..(3671): n is a, c, g, or t
  misc_feature (3673)..(3675): n is a, c, g, or t
  misc_feature (3677)..(3684): n is a, c, g, or t
  misc_feature (3690)..(3698): n is a, c, g, or t
  misc_feature (3700)..(3700): n is a, c, g, or t
  misc_feature (3702)..(3705): n is a, c, g, or t
  misc_feature (3707)..(3709): n is a, c, g, or t
  misc_feature (3711)..(3711): n is a, c, g, or t
  misc_feature (3714)..(3723): n is a, c, g, or t
  misc_feature (3725)..(3728): n is a, c, g, or t
  misc_feature (3731)..(3757): n is a, c, g, or t
  misc_feature (3759)..(3761): n is a, c, g, or t
  misc_feature (3763)..(3764): n is a, c, g, or t
  misc_feature (3767)..(3773): n is a, c, g, or t
  misc_feature (3775)..(3775): n is a, c, g, or t
  misc_feature (3777)..(3781): n is a, c, g, or t
  misc_feature (3783)..(3785): n is a, c, g, or t
  misc_feature (3790)..(3792): n is a, c, g, or t
  misc_feature (3794)..(3794): n is a, c, g, or t
  misc_feature (3796)..(3804): n is a, c, g, or t
  misc_feature (3806)..(3811): n is a, c, g, or t
  misc_feature (3813)..(3828): n is a, c, g, or t
  misc_feature (3830)..(3838): n is a, c, g, or t
  misc_feature (3840)..(3841): n is a, c, g, or t
  misc_feature (3843)..(3845): n is a, c, g, or t
  misc_feature (3848)..(3848): n is a, c, g, or t
  misc_feature (3850)..(3850): n is a, c, g, or t
  misc_feature (3852)..(3853): n is a, c, g, or t
  misc_feature (3857)..(3861): n is a, c, g, or t
  misc_feature (3867)..(3871): n is a, c, g, or t
  misc_feature (3873)..(3874): n is a, c, g, or t
  misc_feature (3876)..(3876): n is a, c, g, or t
  misc_feature (3878)..(3879): n is a, c, g, or t
  misc_feature (3882)..(3889): n is a, c, g, or t
  misc_feature (3891)..(3895): n is a, c, g, or t
  misc_feature (3897)..(3900): n is a, c, g, or t
  misc_feature (3902)..(3912): n is a, c, g, or t
  misc_feature (3915)..(3915): n is a, c, g, or t
  misc_feature (3917)..(3917): n is a, c, g, or t
  misc_feature (3920)..(3922): n is a, c, g, or t
  misc_feature (3926)..(3928): n is a, c, g, or t
  misc_feature (3930)..(3931): n is a, c, g, or t
  misc_feature (3934)..(3935): n is a, c, g, or t
  misc_feature (3937)..(3937): n is a, c, g, or t
  misc_feature (3944)..(3944): n is a, c, g, or t
  misc_feature (3946)..(3946): n is a, c, g, or t
  misc_feature (3950)..(3950): n is a, c, g, or t
  misc_feature (3955)..(3955): n is a, c, g, or t
  misc_feature (3957)..(3958): n is a, c, g, or t
  misc_feature (3960)..(3974): n is a, c, g, or t
  misc_feature (3976)..(3977): n is a, c, g, or t
  misc_feature (3979)..(3993): n is a, c, g, or t
  misc_feature (3995)..(3999): n is a, c, g, or t
ccgaccttgtgggggccgaccttgaaggttttgtgggggctgaccttgaaggttttgaagggtctgaccttgaaggttttgaaaaccttcaaggtcgggaagagggaaaccttcaaggtcggaaggggggagaccttcaaggtcgggcaaggggaaaccttcaaggccgggtatcccggcaattcagcaatttattcaactcatattccaaagcattcaacaaaatgtataacagaaaaggcagtttgtttatgcgaagtatgaaacgaaaagtaatcacttcagaagagtatttgaaaaagataatttgttacattcatcataaccctgttcatcatggacttatcaaatctatggaacaatggaaattttcatcctattcggtattcgtaaatgaaaattttaccttcccgtcggacaaatcgctgccatgggttcccaaaaatgaggtgatcgcttggtttgataacaagagtaatttcatctattgccatcaaaattcactcaacatgaaattatggaacagtttggaataaataatgattaaatttaaaaataatgatcaaacgcattttactttttggcaatcccgcaaaattgcggttggaaaacaaacaactaaaaattattctgaaaaaagaaccgcccgaggaaaagacggtccctatagaggatataggttatgtgatcatagatcatccacaaatcaccatcaccagcggagccatcggagaaatgatgaaaaacaatgtagccatcatttcctgcgatcaaaactatatgccgacggcactcatgttgccctttgaagggcatcacgttcaaacccaacgcatgcgggcacaaattgaagcatccgaacctttgaaaaaaaatctctggatgcaaaccgtcaaagcaaagattctcaaccaggccaatttgatggagaggttgggtatttgtgatcaccctctgcgaaagtatgccaaagatgtcaaaagtggcgatacgaccaatcgcgaagctgctgctgccaatcattactggaatgtgttgtttccatcaatcccaaactttttcagagatccgatgggaccctatcccaacaattttttgaattatgcttacgccatacttcgttcggtgatggcccgagccattgtgggagccggtttgtttccttcttttgggctttttcataaaaacaaatacaatgcgttttgccttgccgacgatttgatggagccctaccgcccttttgccgatctgttggtcatcaacaccatgaaaaaatttcctgaacaggaggtgatcaataccgatataaagaaagaattgctgatgttgccgcatatggatgtcttcattgccggacacaaaagcccgttgatgattgcggcacagcatacggctgcatcattggtgcaatgtttcgagggaaaaaagaaaaaaatgctttatccggtgctacaatgaatcacgaacgtttaaatgcatacagaattatgtgggtaatatgttgctttgatctgccaacagtggagaaaaaagatcaaaaagccgccaaccgttttcgcaaatttctcaacgaagacggatttatcatgatacaattcagcatctatggccgccattgtcccagcagcgaaaatgccaatgtgcacatagaaagaattaaacgtaacctacctcctaaagggtcggtgatcatttttaaaatcaccgacaaacagtttggcgaaagcatcatctatcaaaatgccaaaaaagatgatccgcctaccggatggatacaattggaactattttaaaatccgttggtaaaacagaaataaaaaaatcccggccgaagccgggatttttaatttgcaacaacatttttttaatttgaaaaaatggctgaaatccttgatatacttgctttttgacgtgttctgttgttgcaaatatatcaaagaactaaaaatgtaagcgattcacaactnnnnnnnnnnnnnnnnnnnnnnnnnnnnngttgttgcaaatatatcaaagaactaaaaatgtaagcgattcacaacnnnnnnnnnnnnnnnnnnnnnnnnnnnnnngttgttgcaaatatatcaaagaactaaaaatgtaagcgattcacaacnnnannnnnnnnnnnnnnnnnnnnnnnnnngttgttgcaaatatatcaaagaactaaaaatgtaagcgattcacaacnnnnnannnnnnnntnnnnnnntnaannanntnntnnnaannnnnnnaannannnaaaannnnannnnntnnnnannnnnnnnnnnnnnnnnnnnnnnnnnnnnnnnntnntnnnaannnnnnnaannannnaaaannnnannnnntnnnnannnnnnnnnnnnnnnnnnnnnnnnnnnnnnntnnnnnnnnannnnnnnnaannannnaaanntnannnnntnnnnnannnnnnnnnnnnnnnnnnnnnnnnnnnnnnnntnntnnnaannnnnnnaannaannaaaannnnannnnntnnnnannnnnnnnnnnnnnnnnnntnnnnnnnnannnntnntnnnaannnnnnnaannannnaaaannnnannnnntnnnnancnnnnnnnnnnnnnnnnnnnnnnnnnnnnnnnttntnnnaannntnnnaannannnaaaantnnannnnntnnanancnnnntnnnnnnnnnnnnnnnnnnnnnnnnnntnttnnaaannnnnnnaanaannnaaaannnaannnnntnnnaancnnntnnctntnnannnttntnnnnnnnnnnntnttnnnaannnnnnnaannannnaaaannnnannnnntnnnaannnnnnnnnnnnnannannnnnnnnnanncnnntnntnnaannnannnnannnnnnnaaaantnnnngnntnnnannncnnnnngnnntnanatnnnnnannnnnnnnntnttnnnaannnnnnnaanaannaaaaatntnagnnnntcnnnancnnnnnnngnnnnnnntntnnnnnnnnnnnnntnttnnnaatanannnaannactnaaaannnnanngnntcnnnannnnnnnnnnnnnnannnnnnnnnnnnnnnnnttnttnnaaatntnnnaaanaannaaaaangnaannnattcnnaancnnncnnnnnnnnnnnnnnnnnnnnnnnanntnnttnnaannnnnnnaannannnaaaannnnannnnntnnnnannnnnnnnnnnnnnannnnnnnnnnnnnnnnnnttntnnnaannatnncaannanntaaaannnnannnnattnnnancnnnnnnnnnnnnnnnnnnnnnnnngnnnnnntnntnnnaannnnnnnaannannnaaaannnnannnnntnnnnannnnannnnnnnnnnnnnnnnnnnntnnnnnnntnntnnnaannnnnnnaannannnaaaannnnannnnntnnnnannnnnnnnnnnnnnnnnnnnnnnannnnnnngttgttgcaaatatatcaaagaactaaaaatgtaagcgattcacaacnnnnnnnntntnnnnnnncnnnnantnnnnnnnntnnnnannnntnnaaanannnnaaannnnnannnntnnnannnnnnnnnnnnnnnnnncnnannnnnnnnnnntnnnnnnaanannnnnnnnnannnnnaannnnnnnnnnnnnnnannnnnnnnnnnnannnnnntnnntnnnnnnnnttgttnnnnnnnnntnannnnannnanaannnnnnnnnntnnnnacnnnnnnnnnnnnnnnnnnnnnnnnnnncnnntnnttnnnnnnntntnnnnnannnaaaannntnannnnnnnnnannnnnntnnnnnnnnnnnnnnnnannnnnnnnntnntnnnaananannaaannnnnaaaaannnnngnnantnncannnnnnnnannnnnannnnannnnnnnnnnnagntnttnnnaatnnntnnaannantaaaaangnaagngattnannannnnnnnnnnnnnnnanntnnnnnnnnnnnnnnntnnnnna

SEQ ID NO: 395 - DNA, 4000 bp, Escherichia coli
  misc_feature (41)..(41): n is a, c, g, or t
  misc_feature (2908)..(2908): n is a, c, g, or t
gagatgcattcatagctgaacctggacatttattagtcgcngctgattactctcaaattgaattacgtttgttagctcatactgctaaccttcctactatgaagaaagcattttctgatggtgtagacattcatgcgttaactgcatcggaaatttttaatataaagctatcaaatatggatgcttcaactagaaggcgagctaaagctataaacttcggtattatttatggaatttctgcatttggcttagctaataatttaggaatatcacgtacagaggcgagtgattatatcaaaaattactttatgaaattcccaggcattaaagattatatggaaaatgcaaaagatgaggctagaaagcatggttatgtgcaaactctttttggccgaagatgtcatattaaaggaattaaagatagaaatcccgctgttaggggttttgctgaacgacaggctattaatgccccaattcagggctctgcagccgatataattcgtcgagctatgataaggattccaaatagtataaagcccataggtggctccaaaatgctattacaggttcacgatgaactgatttttgaagttcccgaagcaaatgctaatgaattgattgaaatagttactacaacaatgcaaaatgcggcaatgcctgctgttgatatatctgttccactggttgtcgaagcgcatgcagcaaaaaattggaatgatgcgcactaaggaattaataatatgacgtttgtcgttttagtccgtcacggacaatcggaatggaatcttcagaatcgttttactggatgggtggatgtggatcttaccgatagaggagtaagtgaagctataaaatcgggtgaattaatagctaaagagggtattatatttgaccaagcttttactagtcttcaacgcagagccataaaaacattatggttgtccttagaggcagcaaatcaatttcatttacctgtaataaaagactggagattaaacgaaaggcattatggagatttaactgggtgtaataaacaagaaacaagatctaaatatggtgaagagcaagttcatatttggagaagaagttttgatatacctcctccaaaaattgatagaaaaaataaatatcatccaattcatgatgcaaaatatagtaatttaaaccctgagttattaccaactggtgagagtttgaaaatgacatgcgaccgcgtattaccttacttttcaagttcaattgctcccctaataaacaataagaaaaatctaattatttcagcacatggaaatagtctaagagcgatattaaaatttctttttaaagttaccgacatagaaattcctaattacgaatttccaacaggaaaccctcttttaattgaatttggttctgatattaatgaaatagaaactgctcgatacttggatgctaagcgcgctaaagtgctaccggagatttaaactggttaatcatattaaatggatgaaaattgcgcttgatttatcaaaaaaacagtcaggcagaacagctgataacccttcagtaggttgcattatagtaaaaaaaaataaaataattgcaagcggggtaacatcagatgggggtaggcctcatgctgaaacaaatgctctccagattgctggaagtgaagcaagggggtcgacagtttatgtaactcttgagccttgttctcattacggacagactgaaccttgtgttaatgctttaatacaagcgggtataaaaaactgtgtaattgcaattattgacccagataaaagagtgaactggcggggagcggcgcttcttcaggaggctggaattgatactcttataggagtttgtaaaattgaggcctatgaagttaattcagatttttttaaaagacataatattcataagtttgatgaacttatatattaatgaatactttgtgatttatattataaatcaaaatatatggtagaaatatctttcattaccttgcctttagtaagatattattaacttattaagtgctaagcctttactatgaagacaaaagcaattgagatgctcatagagccaggagctgaaaagctaattgctaaaatgggccgccgtttaaacacaaaggcacgttcaaagataattaatctaatcttaagccatattagagaagagtatcataactctgaaataactgaatggttctctgaaattagattttcagccaataaaagaactactattcgaattaatttagaaaatgcagattatttaaactttatatcccaagtcgtagctcaaggtcgtccttctgtaacattggaactagtctactttgctgcggctaatctttcacgcgaagatttagaaagtttagtttaatgttttgagttatgttgaagttttaagacaatcctaaactttctttaagggcaagctcttgaggcatccctactgaatgaaaaccaccatcaacatgatgagtttcaccggtgcaagataggcctaagtcagaaagaagatacaaagctgcacctgcaacccccattggatcagtgttatcctgaagcgaactagcagctttgttaaacctaaacatatgtctgcctgaaccaatacctgcagcagcgagtgttttaatggggcctgccgatatagcgtttactcgtatttgccttggccctaaatcagcggccatgtaacgtgtacttgcctctaaagcagcttttgctactcccattacattgtagtttggaataactctttcagaaccaagatatgtgagcgttatcatggacccaccatcattcattatttctgcagcacgtcttcctgcatccacaaagctgtaagctgatatgtccaaagctgacttaaagccttcacgcgtagtgttttctatgaaacttcctgctanttgatccttaccagcaaaagcaatagcatgaaccaagaaatcaattttaccccattctgtctctaattttgagaaagtagagtccattgtttcatcatttgtcacatcgcattcacaaagtattgaagaacctatagattctgcaagaggtttaacacgtcgtaaaagagcttctccttgataagtgaaggcgagctctgccccttgcgaggatagctgacgcgcaattgcccatgcaattgagtttttgttagcaactcccatcacaaggccgcgtttgcccttcattaaagtaccagttggaaaatgttgatctgccattacagtatcctttgtaatatgtgctgctaaataattaaaaatagcagtattttaaattatttattattcaactttagtaaatattacactaccattcgtgccaccaaacccaaaactgtttgacattactgaggttaaattggtttcgatcattttagttacgatattaactttgggaagttcaggatctagctctgttatgtttattgatggtgcaataaaccctttatccatcattattaaactataaatggcctcttgaactccagcagcgcctaagctgtgtccagttaaacatttagtagctgatatatatggacaatactctttaaaaactcgatcaattgcacctgtttcagcaacgtcccctactggtgtcgaagttgcgtgagggttaatatagtcaatttttgatattcctcttgttttagcatcatctaatgccattcgcatcgctctttccgcaccttcaccagacggtgcaaccatgtcatacccatcagatgtagcggcataacctgttacttcagcatatattttagcacctcttgcaatggcatggtcataatcctctaaaactaccattcctgctccacctgctataacaaagccatcgcgacttatatcgaatgctcttgaagcagtttctggagtgtcattatatttgctactcatggcacccatcgcatcaaaaagtgacgacattgcccattcaacttcttcgcctcctcccgcaaacattatatcttgtttcccccattgtatttgttc

SEQ ID NO: 396 - DNA, 4000 bp, Escherichia coli
  misc_feature (1662)..(1662): n is a, c, g, or t
  misc_feature (1665)..(1665): n is a, c, g, or t
  misc_feature (1962)..(1962): n is a, c, g, or t
  misc_feature (1965)..(1965): n is a, c, g, or t
  misc_feature (1968)..(1968): n is a, c, g, or t
  misc_feature (1971)..(1971): n is a, c, g, or t
  misc_feature (1974)..(1974): n is a, c, g, or t
  misc_feature (1977)..(1977): n is a, c, g, or t
  misc_feature (1986)..(1986): n is a, c, g, or t
  misc_feature (1998)..(1998): n is a, c, g, or t
  misc_feature (2378)..(2378): n is a, c, g, or t
  misc_feature (2672)..(2672): n is a, c, g, or t
  misc_feature (2744)..(2744): n is a, c, g, or t
  misc_feature (2750)..(2750): n is a, c, g, or t
  misc_feature (2765)..(2765): n is a, c, g, or t
  misc_feature (2774)..(2774): n is a, c, g, or t
  misc_feature (3023)..(3023): n is a, c, g, or t
  misc_feature (3030)..(3032): n is a, c, g, or t
  misc_feature (3039)..(3039): n is a, c, g, or t
  misc_feature (3043)..(3043): n is a, c, g, or t
  misc_feature (3045)..(3045): n is a, c, g, or t
  misc_feature (3047)..(3048): n is a, c, g, or t
  misc_feature (3051)..(3051): n is a, c, g, or t
  misc_feature (3053)..(3053): n is a, c, g, or t
  misc_feature (3055)..(3055): n is a, c, g, or t
  misc_feature (3058)..(3058): n is a, c, g, or t
  misc_feature (3061)..(3062): n is a, c, g, or t
  misc_feature (3065)..(3067): n is a, c, g, or t
  misc_feature (3075)..(3075): n is a, c, g, or t
  misc_feature (3078)..(3078): n is a, c, g, or t
  misc_feature (3081)..(3081): n is a, c, g, or t
  misc_feature (3084)..(3084): n is a, c, g, or t
  misc_feature (3086)..(3086): n is a, c, g, or t
  misc_feature (3089)..(3089): n is a, c, g, or t
  misc_feature (3091)..(3095): n is a, c, g, or t
  misc_feature (3099)..(3099): n is a, c, g, or t
  misc_feature (3104)..(3104): n is a, c, g, or t
  misc_feature (3110)..(3110): n is a, c, g, or t
  misc_feature (3114)..(3114): n is a, c, g, or t
  misc_feature (3116)..(3117): n is a, c, g, or t
  misc_feature (3120)..(3121): n is a, c, g, or t
  misc_feature (3123)..(3126): n is a, c, g, or t
  misc_feature (3128)..(3130): n is a, c, g, or t
  misc_feature (3133)..(3133): n is a, c, g, or t
  misc_feature (3135)..(3135): n is a, c, g, or t
  misc_feature (3137)..(3138): n is a, c, g, or t
  misc_feature (3140)..(3140): n is a, c, g, or t
  misc_feature (3144)..(3144): n is a, c, g, or t
  misc_feature (3146)..(3147): n is a, c, g, or t
  misc_feature (3151)..(3153): n is a, c, g, or t
  misc_feature (3158)..(3160): n is a, c, g, or t
  misc_feature (3162)..(3162): n is a, c, g, or t
  misc_feature (3164)..(3165): n is a, c, g, or t
  misc_feature (3171)..(3171): n is a, c, g, or t
  misc_feature (3173)..(3173): n is a, c, g, or t
  misc_feature (3175)..(3176): n is a, c, g, or t
  misc_feature (3178)..(3178): n is a, c, g, or t
  misc_feature (3180)..(3180): n is a, c, g, or t
  misc_feature (3182)..(3182): n is a, c, g, or t
  misc_feature (3188)..(3188): n is a, c, g, or t
  misc_feature (3191)..(3194): n is a, c, g, or t
  misc_feature (3198)..(3199): n is a, c, g, or t
  misc_feature (3202)..(3204): n is a, c, g, or t
  misc_feature (3206)..(3207): n is a, c, g, or t
  misc_feature (3211)..(3211): n is a, c, g, or t
  misc_feature (3214)..(3214): n is a, c, g, or t
  misc_feature (3218)..(3219): n is a, c, g, or t
  misc_feature (3222)..(3222): n is a, c, g, or t
  misc_feature (3224)..(3224): n is a, c, g, or t
  misc_feature (3226)..(3226): n is a, c, g, or t
  misc_feature (3228)..(3230): n is a, c, g, or t
  misc_feature (3233)..(3233): n is a, c, g, or t
  misc_feature (3237)..(3237): n is a, c, g, or t
  misc_feature (3240)..(3240): n is a, c, g, or t
  misc_feature (3246)..(3247): n is a, c, g, or t
  misc_feature (3251)..(3251): n is a, c, g, or t
  misc_feature (3257)..(3257): n is a, c, g, or t
  misc_feature (3264)..(3266): n is a, c, g, or t
  misc_feature (3268)..(3268): n is a, c, g, or t
  misc_feature (3270)..(3270): n is a, c, g, or t
  misc_feature (3273)..(3274): n is a, c, g, or t
  misc_feature (3276)..(3278): n is a, c, g, or t
  misc_feature (3281)..(3282): n is a, c, g, or t
  misc_feature (3285)..(3286): n is a, c, g, or t
  misc_feature (3289)..(3292): n is a, c, g, or t
  misc_feature (3296)..(3296): n is a, c, g, or t
  misc_feature (3303)..(3303): n is a, c, g, or t
  misc_feature (3306)..(3306): n is a, c, g, or t
  misc_feature (3309)..(3312): n is a, c, g, or t
  misc_feature (3317)..(3322): n is a, c, g, or t
  misc_feature (3324)..(3327): n is a, c, g, or t
  misc_feature (3332)..(3335): n is a, c, g, or t
  misc_feature (3338)..(3340): n is a, c, g, or t
  misc_feature (3342)..(3342): n is a, c, g, or t
  misc_feature (3344)..(3345): n is a, c, g, or t
  misc_feature (3347)..(3348): n is a, c, g, or t
  misc_feature (3353)..(3360): n is a, c, g, or t
  misc_feature (3362)..(3366): n is a, c, g, or t
  misc_feature (3369)..(3369): n is a, c, g, or t
  misc_feature (3371)..(3374): n is a, c, g, or t
  misc_feature (3378)..(3380): n is a, c, g, or t
  misc_feature (3383)..(3383): n is a, c, g, or t
  misc_feature (3386)..(3386): n is a, c, g, or t
  misc_feature (3390)..(3390): n is a, c, g, or t
  misc_feature (3392)..(3396): n is a, c, g, or t
  misc_feature (3399)..(3400): n is a, c, g, or t
  misc_feature (3402)..(3405): n is a, c, g, or t
  misc_feature (3412)..(3415): n is a, c, g, or t
  misc_feature (3417)..(3419): n is a, c, g, or t
  misc_feature (3426)..(3426): n is a, c, g, or t
  misc_feature (3429)..(3431): n is a, c, g, or t
  misc_feature (3433)..(3435): n is a, c, g, or t
  misc_feature (3437)..(3437): n is a, c, g, or t
  misc_feature (3439)..(3439): n is a, c, g, or t
  misc_feature (3442)..(3443): n is a, c, g, or t
  misc_feature (3445)..(3448): n is a, c, g, or t
  misc_feature (3450)..(3451): n is a, c, g, or t
  misc_feature (3459)..(3459): n is a, c, g, or t
  misc_feature (3461)..(3462): n is a, c, g, or t
  misc_feature (3465)..(3465): n is a, c, g, or t
  misc_feature (3467)..(3472): n is a, c, g, or t
  misc_feature (3474)..(3474): n is a, c, g, or t
  misc_feature (3476)..(3477): n is a, c, g, or t
  misc_feature (3483)..(3486): n is a, c, g, or t
  misc_feature (3489)..(3489): n is a, c, g, or t
  misc_feature (3491)..(3491): n is a, c, g, or t
  misc_feature (3493)..(3495): n is a, c, g, or t
  misc_feature (3498)..(3498): n is a, c, g, or t
  misc_feature (3500)..(3500): n is a, c, g, or t
  misc_feature (3502)..(3503): n is a, c, g, or t
  misc_feature (3508)..(3508): n is a, c, g, or t
  misc_feature (3510)..(3510): n is a, c, g, or t
  misc_feature (3512)..(3516): n is a, c, g, or t
  misc_feature (3522)..(3522): n is a, c, g, or t
  misc_feature (3524)..(3525): n is a, c, g, or t
  misc_feature (3528)..(3530): n is a, c, g, or t
  misc_feature (3532)..(3533): n is a, c, g, or t
  misc_feature (3536)..(3537): n is a, c, g, or t
  misc_feature (3540)..(3540): n is a, c, g, or t
  misc_feature (3542)..(3542): n is a, c, g, or t
  misc_feature (3544)..(3544): n is a, c, g, or t
  misc_feature (3547)..(3547): n is a, c, g, or t
  misc_feature (3550)..(3550): n is a, c, g, or t
  misc_feature (3552)..(3552): n is a, c, g, or t
  misc_feature (3555)..(3556): n is a, c, g, or t
  misc_feature (3560)..(3561): n is a, c, g, or t
  misc_feature (3564)..(3565): n is a, c, g, or t
  misc_feature (3568)..(3568): n is a, c, g, or t
  misc_feature (3571)..(3573): n is a, c, g, or t
  misc_feature (3575)..(3575): n is a, c, g, or t
  misc_feature (3577)..(3578): n is a, c, g, or t
  misc_feature (3580)..(3580): n is a, c, g, or t
  misc_feature (3582)..(3582): n is a, c, g, or t
  misc_feature (3584)..(3585): n is a, c, g, or t
  misc_feature (3589)..(3590): n is a, c, g, or t
  misc_feature (3592)..(3595): n is a, c, g, or t
  misc_feature (3598)..(3598): n is a, c, g, or t
  misc_feature (3601)..(3604): n is a, c, g, or t
  misc_feature (3606)..(3607): n is a, c, g, or t
  misc_feature (3610)..(3610): n is a, c, g, or t
  misc_feature (3613)..(3613): n is a, c, g, or t
  misc_feature (3617)..(3618): n is a, c, g, or t
  misc_feature (3623)..(3623): n is a, c, g, or t
  misc_feature (3626)..(3627): n is a, c, g, or t
  misc_feature (3630)..(3630): n is a, c, g, or t
  misc_feature (3639)..(3640): n is a, c, g, or t
  misc_feature (3642)..(3642): n is a, c, g, or t
  misc_feature (3644)..(3644): n is a, c, g, or t
  misc_feature (3651)..(3651): n is a, c, g, or t
  misc_feature (3654)..(3654): n is a, c, g, or t
  misc_feature (3659)..(3659): n is a, c, g, or t
  misc_feature (3662)..(3662): n is a, c, g, or t
  misc_feature (3664)..(3664): n is a, c, g, or t
  misc_feature (3666)..(3668): n is a, c, g, or t
  misc_feature (3672)..(3674): n is a, c, g, or t
  misc_feature (3676)..(3676): n is a, c, g, or t
  misc_feature (3678)..(3678): n is a, c, g, or t
  misc_feature (3680)..(3681): n is a, c, g, or t
  misc_feature (3683)..(3683): n is a, c, g, or t
  misc_feature (3687)..(3687): n is a, c, g, or t
  misc_feature (3690)..(3690): n is a, c, g, or t
  misc_feature (3694)..(3696): n is a, c, g, or t
  misc_feature (3699)..(3700): n is a, c, g, or t
  misc_feature (3703)..(3703): n is a, c, g, or t
  misc_feature (3707)..(3707): n is a, c, g, or t
  misc_feature (3710)..(3711): n is a, c, g, or t
  misc_feature (3713)..(3718): n is a, c, g, or t
  misc_feature (3720)..(3720): n is a, c, g, or t
  misc_feature (3726)..(3734): n is a, c, g, or t
  misc_feature (3736)..(3736): n is a, c, g, or t
  misc_feature (3738)..(3738): n is a, c, g, or t
  misc_feature (3740)..(3741): n is a, c, g, or t
  misc_feature (3745)..(3749): n is a, c, g, or t
  misc_feature (3755)..(3756): n is a, c, g, or t
  misc_feature (3761)..(3761): n is a, c, g, or t
  misc_feature (3763)..(3763): n is a, c, g, or t
  misc_feature (3765)..(3765): n is a, c, g, or t
  misc_feature (3769)..(3769): n is a, c, g, or t
  misc_feature (3773)..(3773): n is a, c, g, or t
  misc_feature (3776)..(3776): n is a, c, g, or t
  misc_feature (3778)..(3778): n is a, c, g, or t
  misc_feature (3780)..(3783): n is a, c, g, or t
  misc_feature (3785)..(3786): n is a, c, g, or t
  misc_feature (3791)..(3792): n is a, c, g, or t
  misc_feature (3795)..(3795): n is a, c, g, or t
  misc_feature (3801)..(3801): n is a, c, g, or t
  misc_feature (3804)..(3804): n is a, c, g, or t
  misc_feature (3807)..(3807): n is a, c, g, or t
  misc_feature (3809)..(3809): n is a, c, g, or t
  misc_feature (3812)..(3812): n is a, c, g, or t
  misc_feature (3814)..(3814): n is a, c, g, or t
  misc_feature (3820)..(3821): n is a, c, g, or t
  misc_feature (3825)..(3826): n is a, c, g, or t
  misc_feature (3830)..(3830): n is a, c, g, or t
  misc_feature (3840)..(3840): n is a, c, g, or t
  misc_feature (3844)..(3845): n is a, c, g, or t
  misc_feature (3847)..(3848): n is a, c, g, or t
  misc_feature (3850)..(3851): n is a, c, g, or t
  misc_feature (3856)..(3857): n is a, c, g, or t
  misc_feature (3865)..(3866): n is a, c, g, or t
  misc_feature (3872)..(3872): n is a, c, g, or t
  misc_feature (3874)..(3874): n is a, c, g, or t
  misc_feature (3876)..(3879): n is a, c, g, or t
  misc_feature (3881)..(3885): n is a, c, g, or t
  misc_feature (3890)..(3890): n is a, c, g, or t
  misc_feature (3896)..(3898): n is a, c, g, or t
  misc_feature (3907)..(3909): n is a, c, g, or t
  misc_feature (3916)..(3916): n is a, c, g, or t
  misc_feature (3921)..(3921): n is a, c, g, or t
  misc_feature (3924)..(3926): n is a, c, g, or t
  misc_feature (3930)..(3931): n is a, c, g, or t
  misc_feature (3933)..(3933): n is a, c, g, or t
  misc_feature (3937)..(3937): n is a, c, g, or t
  misc_feature (3940)..(3940): n is a, c, g, or t
  misc_feature (3946)..(3946): n is a, c, g, or t
  misc_feature (3952)..(3952): n is a, c, g, or t
  misc_feature (3955)..(3955): n is a, c, g, or t
  misc_feature (3957)..(3957): n is a, c, g, or t
  misc_feature (3961)..(3961): n is a, c, g, or t
  misc_feature (3966)..(3966): n is a, c, g, or t
  misc_feature (3968)..(3970): n is a, c, g, or t
  misc_feature (3972)..(3972): n is a, c, g, or t
  misc_feature (3980)..(3980): n is a, c, g, or t
  misc_feature (3982)..(3982): n is a, c, g, or t
  misc_feature (3988)..(3988): n is a, c, g, or t
  misc_feature (3991)..(3991): n is a, c, g, or t
  misc_feature (3994)..(3995): n is a, c, g, or t
  misc_feature (3998)..(3998): n is a, c, g, or t
ctttcaacattgattatgacatcaatatttttaattttttttcctgttggtggatttggtatatctttcaaatcaacctggttaatatcaatcaattctttatttttaatatcaaaaaaatgggaatgggtacctgtgttagtatcaaaatagcttttatcagttgctataacaatttcttttaaataaccattttttttaaaagcatgcactgtgttgtaaactgttgctagagaaattttttcatctaatttttcttcaattattttactaaggtcattaattgtaaaatgaaaagtttcctttggtgaaaataaggcctcacatatttttaatctttgtctagttggtcttaaaccagattctcttaacttttctttatatatatttaaattgttcattattgtttataattgttctaaactattactatattataatctctttaaatcaagtattaaggagtttattttttatgaaaaaaaattcatacacatataatgaactaattaattgtggaaatggagagctttttggccccggtaatgcaaaattacctcttccgccaatgctcatgtttgatagaataaccgaaatcagtgataatagtggtacttttaaaaaaggatctttaaaggctgaattagatatcaaagatgatctttggttctttgagtgtcattttaaagaagaccctgttatgccaggttgtcttggcttagatgctatgtggcaactagttggtttttatcttgggtggcttggtaacccaggtaaagggagagctttaggagtgagtacagtaaaattcactggtgaagttttaaaaaatgttaaaaatgtaagatatgaaattgatatgaaaaaaattatggctccaggtggaacaacagttggtcttgcaaatggcttagtatttgcagatgacaaaaaaatatattcagcagaaagcttgaaagtaggattatttaaataatgagaagagtagttatcacaggtttaggaattgtatcttgtttgggaaacaatcaagaagaggttcatcagtcactattaaagtctaaatcaggaatttcatatgctgaggaatataaagaacataatcttaaaagccatgttcatggtaaaccaaatataaaacttgaggatcatattgatagaaaaacaattagattcatgggttcagggtcagcctataattatattgcaatgaaagaggcgattgaagactctggattagaagaaagtgaagttagtaattttaaaactggtattgttatgggttcaggaggaccttcaattgaaaatgtaattttagcagcagataaaactagagccaaaactccaaaattaatgggtcctttcattgttccaagaacaatggcaagtacagcttcagctactttagcagtgccatttaaaattaaaggaaccaactacacaatgagctctgcatgtgctactagcggacactgcattggaaattcaatggaattaatccaaatgggcaaacaagatgttgtttttgcaggtggaagtgaagaagttcactgggcaatgacagcaatgtttgatgcaatgacagcgttatcttcaaaatacaacgatacacctgagactgcatcaagagcttatgataaaactagagacggtttcgtaatngcnggtggtggtggagttttagttcttgaagaatacgaacatgctaaagcaagaggagctaaaatatacgcagaattaactggttatggagcaacatcagacggatatgatatggtagccccatcaggagaaggagcaatcagatgtatgcaaatggctatggcaactgctaaaaataaaattgattatataaatacccacggaacatcaacaccagttggtgatattacagaattaaatgctgttaaaggagtttttggagatacaattccaaaaattagttcaaccaaatctttatcnggncanccnttnggngctgcatcngttcatgaagcnatctattgtttaattatgatgaaaaataatttcattgctggttctgcaaatattggtgaaatggatgaagaggctaaaaaatttccaatagttgctaaaacagaaactggagcaactttaaatactgttatgtctaatagttttggttttggtggaaccaatgctgctttaatttttgagaaaatataatcatgagtttgatgaagggtaaaaaaggattaatcatgggcgttgccaatgaaagatcaattgcttggggcatttcacaaaagcttgctgaagctggagctgaacttgcattcacttaccttggagatgcactaaagaaaagagtaattcctttagctgaaaaattaaattcaaaaacaacattcagttgngatgttgaaaacaaagaagaagttataaaattatttgaagatattaaatcagagtggggtcaaattgattttgttgtccacgcagtagcattctcagataaatcagaactatcaggtgaatatttaaatacatcaagagagaattttttaagaagcatgttgatttcatgtttttcatttactgaagttgcaaaagaagcttcaaaaataatgaaagaaggtggcagtatgttaactctaacgtacgaatctactaaagctattccaaattataatgtaatgggtgtttgtaantcagcgttagaggcaagtgttaaatatcttgcaagagatttaggtgctaaaggcatgagagtaaatgcaatnagtgcnggaccgattaaaacnttagcagcntctgctataggagatgcaaaattcctatataagtggaatgaagaccattctttccttaaaagaaacgtagatatccatgatgttggaaattcagcattatatctattaagcgaccttgcaaacggtgtaacgggtgaaattcactacgtagatgccggatataataaagttggaatgccagatcctaagaatattacttaaaatatagttaaatttagttaaaaatattaggggcgttctgttgccagntgccccnnnaaaaaancccngnannttnantncanggnnttnnnaatttaanttnaantantnttnannnnnttgnttcanagaaantttnannttnncnnnntnnnaancnannantttnanntttnnntcgtnnncntnnttaacnanannantnantttttntannnntttnngannnanntctnagntatnnacnangncnnnttntttnccnaaaaanntaanaaatgncccaaannncntnatnntnnntannttnnctnnnnaaantttattnaanttnnnnttttnnnnnnannnntttannnnttnnnanannanngtttnnnnnnnntnnnnntgnannnncaannnttncanctcntnnnnnatnnannnnaactttnnnncnnnatttttnaannntnnntntnatnntnnnncnnccttttcnannaanannnnnnananntttttnnnnaanantnnnttntncnnttttngnannnnnttgccnannatnnncnnttnnttnantnaangcntnatnnattnnacnnaanatnnnantnntncnanntttnncnnnnttnaannnntnntcnatnattnnaaaantannacnagtaatttnnananccatttnaantgaantantncnnncttnnntncnannancttnaangtcnnnatnnccnaaanganntnnnnnncntaaaannnnnnnnngnanannaaannnnncacctnntttantnantccnattncantncnnnnanntggtnnttnatttgnaanacntnctncnataaannaaannaggnaacaaaaaanattnncnntnnagaannaacaatanntttcantnannnntnnnnnaattntaaaannntaagaaatnnnttttttngaagnaannnaaanntnaatnccnctcaangtaaanttncnttgnccaantnnngntttcctgntncaaatnttncannttnaa

SEQ ID NO: 397 - DNA, 4000 bp, Escherichia coli
  misc_feature (3)..(6): n is a, c, g, or t
  misc_feature (8)..(27): n is a, c, g, or t
  misc_feature (30)..(33): n is a, c, g, or t
  misc_feature (35)..(37): n is a, c, g, or t
  misc_feature (39)..(39): n is a, c, g, or t
  misc_feature (41)..(46): n is a, c, g, or t
  misc_feature (50)..(51): n is a, c, g, or t
  misc_feature (53)..(53): n is a, c, g, or t
  misc_feature (56)..(56): n is a, c, g, or t
  misc_feature (58)..(58): n is a, c, g, or t
  misc_feature (60)..(61): n is a, c, g, or t
  misc_feature (63)..(64): n is a, c, g, or t
  misc_feature (66)..(67): n is a, c, g, or t
  misc_feature (69)..(70): n is a, c, g, or t
  misc_feature (73)..(84): n is a, c, g, or t
  misc_feature (86)..(91): n is a, c, g, or t
  misc_feature (93)..(95): n is a, c, g, or t
  misc_feature (97)..(98): n is a, c, g, or t
  misc_feature (100)..(103): n is a, c, g, or t
  misc_feature (105)..(122): n is a, c, g, or t
  misc_feature (124)..(125): n is a, c, g, or t
  misc_feature (127)..(128): n is a, c, g, or t
  misc_feature (130)..(135): n is a, c, g, or t
  misc_feature (138)..(140): n is a, c, g, or t
  misc_feature (142)..(158): n is a, c, g, or t
  misc_feature (160)..(161): n is a, c, g, or t
  misc_feature (163)..(163): n is a, c, g, or t
  misc_feature (166)..(167): n is a, c, g, or t
  misc_feature (169)..(174): n is a, c, g, or t
  misc_feature (176)..(188): n is a, c, g, or t
  misc_feature (190)..(194): n is a, c, g, or t
  misc_feature (196)..(196): n is a, c, g, or t
  misc_feature (198)..(203): n is a, c, g, or t
  misc_feature (205)..(206): n is a, c, g, or t
  misc_feature (208)..(208): n is a, c, g, or t
  misc_feature (210)..(218): n is a, c, g, or t
  misc_feature (220)..(224): n is a, c, g, or t
  misc_feature (226)..(229): n is a, c, g, or t
  misc_feature (231)..(232): n is a, c, g, or t
  misc_feature (234)..(240): n is a, c, g, or t
  misc_feature (242)..(243): n is a, c, g, or t
  misc_feature (245)..(247): n is a, c, g, or t
  misc_feature (249)..(254): n is a, c, g, or t
  misc_feature (256)..(266): n is a, c, g, or t
  misc_feature (268)..(268): n is a, c, g, or t
  misc_feature (271)..(271): n is a, c, g, or t
  misc_feature (273)..(283): n is a, c, g, or t
  misc_feature (285)..(290): n is a, c, g, or t
  misc_feature (292)..(293): n is a, c, g, or t
  misc_feature (295)..(302): n is a, c, g, or t
  misc_feature (304)..(310): n is a, c, g, or t
  misc_feature (312)..(313): n is a, c, g, or t
  misc_feature (315)..(316): n is a, c, g, or t
  misc_feature (318)..(323): n is a, c, g, or t
  misc_feature (326)..(329): n is a, c, g, or t
  misc_feature (332)..(335): n is a, c, g, or t
  misc_feature (337)..(340): n is a, c, g, or t
  misc_feature (342)..(349): n is a, c, g, or t
  misc_feature (351)..(356): n is a, c, g, or t
  misc_feature (358)..(370): n is a, c, g, or t
  misc_feature (372)..(379): n is a, c, g, or t
  misc_feature (381)..(383): n is a, c, g, or t
  misc_feature (385)..(385): n is a, c, g, or t
  misc_feature (387)..(389): n is a, c, g, or t
  misc_feature (391)..(392): n is a, c, g, or t
  misc_feature (394)..(394): n is a, c, g, or t
  misc_feature (397)..(397): n is a, c, g, or t
  misc_feature (399)..(399): n is a, c, g, or t
  misc_feature (401)..(402): n is a, c, g, or t
  misc_feature (404)..(421): n is a, c, g, or t
  misc_feature (423)..(427): n is a, c, g, or t
  misc_feature (429)..(431): n is a, c, g, or t
  misc_feature (435)..(436): n is a, c, g, or t
  misc_feature (438)..(458): n is a, c, g, or t
  misc_feature (460)..(472): n is a, c, g, or t
  misc_feature (474)..(486): n is a, c, g, or t
  misc_feature (488)..(489): n is a, c, g, or t
  misc_feature (491)..(493): n is a, c, g, or t
  misc_feature (495)..(503): n is a, c, g, or t
  misc_feature (505)..(508): n is a, c, g, or t
  misc_feature (510)..(510): n is a, c, g, or t
  misc_feature (513)..(513): n is a, c, g, or t
  misc_feature (516)..(516): n is a, c, g, or t
  misc_feature (519)..(519): n is a, c, g, or t
  misc_feature (521)..(522): n is a, c, g, or t
  misc_feature (525)..(525): n is a, c, g, or t
  misc_feature (528)..(528): n is a, c, g, or t
  misc_feature (531)..(538): n is a, c, g, or t
  misc_feature (540)..(541): n is a, c, g, or t
  misc_feature (544)..(545): n is a, c, g, or t
  misc_feature (547)..(548): n is a, c, g, or t
  misc_feature (550)..(562): n is a, c, g, or t
  misc_feature (564)..(565): n is a, c, g, or t
  misc_feature (567)..(568): n is a, c, g, or t
  misc_feature (570)..(571): n is a, c, g, or t
  misc_feature (573)..(581): n is a, c, g, or t
  misc_feature (583)..(583): n is a, c, g, or t
  misc_feature (586)..(587): n is a, c, g, or t
  misc_feature (589)..(596): n is a, c, g, or t
  misc_feature (598)..(599): n is a, c, g, or t
  misc_feature (601)..(602): n is a, c, g, or t
  misc_feature (604)..(610): n is a, c, g, or t
  misc_feature (613)..(613): n is a, c, g, or t
  misc_feature (616)..(616): n is a, c, g, or t
  misc_feature (619)..(619): n is a, c, g, or t
  misc_feature (622)..(623): n is a, c, g, or t
  misc_feature (625)..(626): n is a, c, g, or t
  misc_feature (629)..(632): n is a, c, g, or t
  misc_feature (637)..(637): n is a, c, g, or t
  misc_feature (640)..(668): n is a, c, g, or t
  misc_feature (671)..(671): n is a, c, g, or t
  misc_feature (673)..(674): n is a, c, g, or t
  misc_feature (680)..(680): n is a, c, g, or t
  misc_feature (682)..(682): n is a, c, g, or t
  misc_feature (686)..(686): n is a, c, g, or t
  misc_feature (688)..(688): n is a, c, g, or t
  misc_feature (695)..(695): n is a, c, g, or t
  misc_feature (698)..(698): n is a, c, g, or t
  misc_feature (700)..(704): n is a, c, g, or t
  misc_feature (706)..(708): n is a, c, g, or t
  misc_feature (711)..(711): n is a, c, g, or t
  misc_feature (713)..(714): n is a, c, g, or t
  misc_feature (718)..(721): n is a, c, g, or t
  misc_feature (724)..(726): n is a, c, g, or t
  misc_feature (728)..(728): n is a, c, g, or t
  misc_feature (730)..(742): n is a, c, g, or t
  misc_feature (744)..(751): n is a, c, g, or t
  misc_feature (753)..(771): n is a, c, g, or t
  misc_feature (773)..(774): n is a, c, g, or t
  misc_feature (776)..(777): n is a, c, g, or t
  misc_feature (779)..(785): n is a, c, g, or t
  misc_feature (788)..(789): n is a, c, g, or t
  misc_feature (795)..(795): n is a, c, g, or t
  misc_feature (797)..(798): n is a, c, g, or t
  misc_feature (800)..(805): n is a, c, g, or t
  misc_feature (807)..(811): n is a, c, g, or t
  misc_feature (813)..(816): n is a, c, g, or t
  misc_feature (819)..(819): n is a, c, g, or t
  misc_feature (822)..(822): n is a, c, g, or t
  misc_feature (824)..(826): n is a, c, g, or t
  misc_feature (828)..(829): n is a, c, g, or t
  misc_feature (833)..(834): n is a, c, g, or t
  misc_feature (836)..(837): n is a, c, g, or t
  misc_feature (839)..(847): n is a, c, g, or t
  misc_feature (850)..(850): n is a, c, g, or t
  misc_feature (852)..(852): n is a, c, g, or t
  misc_feature (854)..(856): n is a, c, g, or t
  misc_feature (858)..(859): n is a, c, g, or t
  misc_feature (862)..(867): n is a, c, g, or t
  misc_feature (869)..(870): n is a, c, g, or t
  misc_feature (873)..(873): n is a, c, g, or t
  misc_feature (876)..(876): n is a, c, g, or t
  misc_feature (879)..(880): n is a, c, g, or t
  misc_feature (882)..(883): n is a, c, g, or t
  misc_feature (885)..(885): n is a, c, g, or t
  misc_feature (888)..(889): n is a, c, g, or t
  misc_feature (892)..(894): n is a, c, g, or t
  misc_feature (896)..(896): n is a, c, g, or t
  misc_feature (898)..(898): n is a, c, g, or t
  misc_feature (900)..(900): n is a, c, g, or t
  misc_feature (903)..(904): n is a, c, g, or t
  misc_feature (906)..(907): n is a, c, g, or t
  misc_feature (909)..(910): n is a, c, g, or t
  misc_feature (913)..(914): n is a, c, g, or t
  misc_feature (916)..(920): n is a, c, g, or t
  misc_feature (923)..(925): n is a, c, g, or t
  misc_feature (928)..(928): n is a, c, g, or t
  misc_feature (932)..(932): n is a, c, g, or t
  misc_feature (936)..(936): n is a, c, g, or t
  misc_feature (939)..(943): n is a, c, g, or t
  misc_feature (946)..(947): n is a, c, g, or t
  misc_feature (950)..(950): n is a, c, g, or t
  misc_feature (953)..(953): n is a, c, g, or t
  misc_feature (956)..(956): n is a, c, g, or t
  misc_feature (958)..(959): n is a, c, g, or t
  misc_feature (961)..(964): n is a, c, g, or t
  misc_feature (966)..(967): n is a, c, g, or t
  misc_feature (969)..(970): n is a, c, g, or t
  misc_feature (972)..(973): n is a, c, g, or t
  misc_feature (976)..(976): n is a, c, g, or t
  misc_feature (978)..(979): n is a, c, g, or t
  misc_feature (981)..(987): n is a, c, g, or t
  misc_feature (989)..(990): n is a, c, g, or t
  misc_feature (992)..(993): n is a, c, g, or t
  misc_feature (995)..(995): n is a, c, g, or t
  misc_feature (997)..(998): n is a, c, g, or t
  misc_feature (1000)..(1002): n is a, c, g, or t
  misc_feature (1004)..(1007): n is a, c, g, or t
  misc_feature (1009)..(1009): n is a, c, g, or t
  misc_feature (1012)..(1025): n is a, c, g, or t
  misc_feature (1027)..(1028): n is a, c, g, or t
  misc_feature (1031)..(1031): n is a, c, g, or t
  misc_feature (1033)..(1033): n is a, c, g, or t
  misc_feature (1036)..(1037): n is a, c, g, or t
  misc_feature (1039)..(1049): n is a, c, g, or t
  misc_feature (1051)..(1052): n is a, c, g, or t
  misc_feature (1054)..(1054): n is a, c, g, or t
  misc_feature (1057)..(1057): n is a, c, g, or t
  misc_feature (1060)..(1061): n is a, c, g, or t
  misc_feature (1063)..(1063): n is a, c, g, or t
  misc_feature (1066)..(1066): n is a, c, g, or t
  misc_feature (1071)..(1071): n is a, c, g, or t
  misc_feature (1073)..(1079): n is a, c, g, or t
  misc_feature (1082)..(1082): n is a, c, g, or t
  misc_feature (1085)..(1086): n is a, c, g, or t
  misc_feature (1088)..(1089): n is a, c, g, or t
  misc_feature (1091)..(1092): n is a, c, g, or t
  misc_feature (1095)..(1095): n is a, c, g, or t
  misc_feature (1098)..(1098): n is a, c, g, or t
  misc_feature (1100)..(1101): n is a, c, g, or t
  misc_feature (1104)..(1104): n is a, c, g, or t
  misc_feature (1109)..(1109): n is a, c, g, or t
  misc_feature (1111)..(1111): n is a, c, g, or t
  misc_feature (1113)..(1116): n is a, c, g, or t
  misc_feature (1123)..(1125): n is a, c, g, or t
  misc_feature (1133)..(1133): n is a, c, g, or t
  misc_feature (1139)..(1139): n is a, c, g, or t
  misc_feature (1151)..(1151): n is a, c, g, or t
  misc_feature (1158)..(1162): n is a, c, g, or t
  misc_feature (1169)..(1169): n is a, c, g, or t
  misc_feature (1229)..(1229): n is a, c, g, or t
  misc_feature (1250)..(1250): n is a, c, g, or t
  misc_feature (1256)..(1256): n is a, c, g, or t
  misc_feature (1258)..(1258): n is a, c, g, or t
  misc_feature (1261)..(1261): n is a, c, g, or t
  misc_feature (1265)..(1267): n is a, c, g, or t
  misc_feature (1271)..(1271): n is a, c, g, or t
  misc_feature (1278)..(1278): n is a, c, g, or t
  misc_feature (1286)..(1286): n is a, c, g, or t
  misc_feature (1291)..(1292): n is a, c, g, or t
  misc_feature (1295)..(1295): n is a, c, g, or t
  misc_feature (1304)..(1306): n is a, c, g, or t
  misc_feature (1316)..(1316): n is a, c, g, or t
  misc_feature (1343)..(1343): n is a, c, g, or t
  misc_feature (1361)..(1361): n is a, c, g, or t
  misc_feature (1364)..(1364): n is a, c, g, or t
  misc_feature (1367)..(1367): n is a, c, g, or t
  misc_feature (1373)..(1373): n is a, c, g, or t
  misc_feature (1379)..(1379): n is a, c, g, or t
  misc_feature (1448)..(1448): n is a, c, g, or t
  misc_feature (1464)..(1464): n is a, c, g, or t
  misc_feature (1469)..(1469): n is a, c, g, or t
  misc_feature (1929)..(1929): n is a, c, g, or t
  misc_feature (1932)..(1932): n is a, c, g, or t
  misc_feature (1953)..(1953): n is a, c, g, or t
  misc_feature (1992)..(1993): n is a, c, g, or t
  misc_feature (1995)..(1996): n is a, c, g, or t
  misc_feature (2001)..(2001): n is a, c, g, or t
  misc_feature (2004)..(2005): n is a, c, g, or t
  misc_feature (2020)..(2020): n is a, c, g, or t
  misc_feature (2025)..(2026): n is a, c, g, or t
  misc_feature (2034)..(2034): n is a, c, g, or t
  misc_feature (2049)..(2049): n is a, c, g, or t
  misc_feature (2056)..(2056): n is a, c, g, or t
  misc_feature (2059)..(2059): n is a, c, g, or t
ttnnnncnnnnnnnnnnnnnnnnnnnnacnnnncnnnanannnnnnaccnncnacnancnncnncnncnnccnnnnnnnnnnnncnnnnnncnnngnngnnnntnnnnnnnnnnnnnnnnnnannannannnnnnaannngnnnnnnnnnnnnnnnnnannangannannnnnnannnnnnnnnnnnngnnnnngntnnnnnngnngncnnnnnnnnnannnnngnnnnanntnnnnnnncnncnnncnnnnnngnnnnnnnnnnnancancnnnnnnnnnnntnnnnnnannannnnnnnnannnnnnncnncnncnnnnnnttnnnnatnnnncnnnngnnnnnnnncnnnnnngnnnnnnnnnnnnntnnnnnnnncnnngntnnnannanaanancnncnnnnnnnnnnnnnnnnnnannnnnannnacannannnnnnnnnnnnnnnnnnnnnannnnnnnnnnnnngnnnnnnnnnnnnncnncnnncnnnnnnnnngnnnncnacnacnacnanncancancannnnnnnncnncannannannnnnnnnnnnnntnntnntnntnnnnnnnnngnagnngnnnnnnnngnngnngnnnnnnntgntgntgntgnngnnacnnnnaccancannnnnnnnnnnnnnnnnnnnnnnnnnnnnaangnnaacggngntggngntgctgcngcngnnnnngnnnctncnnctannnncannnangnnnnnnnnnnnnnannnnnnnncnnnnnnnnnnnnnnnnnnncnncnncnnnnnnngcnnctgctncnncnnnnnncnnnnntnnnnacnacnannntnntgcnncnncnnnnnnnnncancncnnncnnttnnnnnntnnctnctnctnntnntnatnntcnnntncntnttnntnntnntannannnnnaannntantaanaatnatnnnnnttnnaanacnacnannannnntnntnntnntcntnntnnnnnnnannannancnncnnnannnnantannnnnnnnnnnnnnannaanancannannnnnnnnnnnannantgntgnngnaanaatantnnnnnnngangannannannttnttncnnctnctacnantnnnnacgatgnnngcggcganggttanttagacttcgangttaagnnnnncgacatnaagagtggcaacgccgttgtagctgttaccaaaggtggcactgtagtttggtcttggcanttatggtttgctcctaagagngcactnanaanaatnnntgtnaccaacnatcaaggnaaaanntanaacttcacnnnagagacactnggttggaagcctaaaggcgaagttacnacctacaatgctcctcgnacngtnaaagtnaaggtngaacaaaccattgctaatggtggagcaaaactatttaccgttatcaatatcactcaaaataatggtggnaagaaggaaggtattnctacnctttatcaattcggtcgtaaagatgcactccctggtaccgatactttctacccaacaaatagttactctttcgataacaccactggtggtcgttctttaggttacgcaatccagcatccagagaatatgtttatttacgcacagactggcacatactactacgactggtgcaatgcaacttactacaacctttggtctgctgataacaccactactggtttcaacgacaacgctgtagttaaaaccgtttacgatccttgtcctgttggttttaagatgcctgcctctaatgcctttactggttttaccagcaatggtcagtatcaaagtggcgctgccaatatcaacgctaacggcacagccgactcttgggacaagttctctgcagcctacggtcataacttctataccaatggtagcaagactgcaacaatcttctttcctgcttcgggtttccgcnacnacagcgatgggtcgttgagcnatgttgggagctacggttactattggtcggcagttccgnncnncacgnacnncggttgcagcctgancttcnnctggagcnacgtgaaccctcagngcaacancanccgttcgtacgggtttgcggcacggccagtctcagaatagattgtttcatttgattaatttgattaatttgcaggcggcttttaaagccagccgcctgcacacaaaaccggctttggcggtcgaaattttttgaaaaatgggcgggtttcttatcagtattatttcatgctgagatatttttttagacttttgggagttcccgccttttaatataactatataatttaaacaaataaataacagaaattaattatgacctacaaagaaattaaaaaattagagagtgataaccttacaaagataatcctttataaggaaggtttgtttttgcgtgcctacgaaaagtctgcattttcgttgtgtaccctatatggttttaagccaattagacgtaaagtgaagtcgttaggcaatcaagatatagtttatgctggtttccctgcctcacagttgcataagtatattggtaaggaactacttgaagaacaaaatgatggaacctttgtgttagattttggtgtacctatcgaagtggagtattacgaggagtgggtaaacagaataccttacagcgaaccatctgttaagacaaagccaagcgcagacaatatgccaaaagatatagttggtaagttgcgttcattcaatttagcagatagcacaccactgcaatgtatgtcgttggtgcaagaattgcaaagtatggtgtgatatagagagagtaatgattagctattagagtttaagatagataactgatgttgttgatattccgttaaatgtaatacacaaatatggcacaatatgagaatcttcctgtgtttaaggctacatacgatttgttgcttgacttatataaaacattgaataatgttccacgcgaccttcgttacacgttggtacaagatttgaaaaacgagcttacacagttgatggtgcttatatacaaagccaatagccaacgtgaaaagacagccacattgcgcaaatgtttagatttgtttctaagtgtgcgccttcgtataaggcttttgaaagatatgcactttttgagcgttgcgcgttttgccgaactttcgctgaaaacagagattatatcgaagcaactaacaggctggcacaaccacagtgtaaagttggcaaccaaagaaggacacagcacaacgatatgagccttgcttttaatgaataacgaaaagactacacacttactaccaatgggaacaacaaaaaaaatatacgtcctgcaaaatgtttgtgggtgcgacaataaggcgatacatctataccataatacgaagaaagtttgtgaatgatgatatctgccatgaaaacatttagtttcagttaatctattttcgtgtgttggcgacgtgagtcgatggcacactttttagaacctaaagaggctattatggttaaacaattgcaataacaataaacaagacactgcttcccctctctcaggcacgcgagaatgtctacacaccacggtggtaggcagagtgtatttgtaaattcagtaacccaccagcacgtgtaaacgcacgcaaaagccctttatggcaatgtgtctcggctggttatggtacaccaatctgacgtatggttatcagtaatgttcccgcacgtcatttagagagtggttactcttacctcctgcttcgggtttccgcaacaacagcgatgggtcgttgaacaatgttgggaacaacggttactattggtcggcagttccgaacaacacgaacaacggttgcaacctgaacttcaactggagcaacgtgaaccctcagaacaacaacaaccgttcgtacgggtttgcggcacggccagtctcagcatttacagcccaatgggggagtatgtgtttttataacctatatttatggacgacacagtattgttatacgacgtatttgatgcttactatgatgcac

SEQ ID NO: 398 - DNA, 4000 bp, Escherichia coli
  misc_feature (1991)..(1992): n is a, c, g, or t
gctttttgcgggcattggcctcttcgtcgtttgtctcaagtgcaaaacctgcaagtatctgtcccggctttttgatacggcccaggtctgcagctatatctgggtttggtaccagcttgagcaccaactcatctcccgacctttttatcttttgttcctcagcttttgcgggacgatagtcacttactgcagccgacataacagcaccatctgccccttgaaaatgcgcaaggcattccctatgcatctcaagagctgagtgaacatctatacgattgatattgggattctttgtcttcagacttaccgggccacagacaaggtcaaccagagcaccacgcgatgccagctcctcagctattgcaaaacccatcttaccagaggagtagtttccaacaaacctcacagggtctattgcttcataagttggtcctgcgctcacaaggaagcgtttgcccgacagtatgccggaactttccttagcggcaaagtatgacttaagcctttcgacgatagcctcaggttcctccatcctacctttacccaacaatccacttgcaagttcaccaacccccggttcgataacctcacaaccatatgttttaagcttttcaatattgttgaccgtcgaagggtggctgaacatgtcaaggtccatcgcaggggctataaataccttacaacgtgcagaaagataggtagccaccaaaagattatcggccagaccattgaccatcttggcgagtgtcgaggccgtggccggtgcaatcagcatggcgtcagcccagattccaaaatccacatggctgtgccaggtcccgtcgttggctccgaaaaattcggatagtactggtttacctgataaggccgaaagggtaaccggcgtaataaactccttgcctgcaggggtaatgataacctgtacctctgcaccctccttaacaagaagccggagcagtaatgcagccttgtaggctgcaatgcttccggtcactccaagtactattttcttcccttttagcatcttcaggtatagaagtgataaggggacttattcggctgattctgccttttcgcccttaccgggtttgcggtaataaatcttaccttcgagaaattcctcaacacctatagcagaaggcttgggcaatctctcataaaagcgtgatatttctatttgctccctgttttcaaacacctcttcgaggttgtcggtataggaggcaaactcctggagcttacggttaagctcttccttcatatcaaccccgatctggttagcacgtctggcaataatattgattgtctcatagatattgcctgtttgctcgcttagcttgcgggtgtcgtaggtaatggtgtttcccggagcttttgactttttaaaatccatatctgcaaactataattaagactattgattactacttgttgttgatttaagcaatttgtttatgtcctgaaagattttgttggcattgctaagatacgcactttcagggtattcgtttataaaagaataatattcatcaagagtatcccttagacgctcatccttcttggcctcaacactgttgacagcctctttgtacttggcatcaaggatcaggaaataaagctcttccctgtattttgtatcgggaaaatcatcaagagtgttacgggctgtaattactgctgacagataattgttacccagatatgatcccaaatcataatacatctttgcatttagataagccttgtatgccagtttgtcacgcaactcatccataaaagctgtcgcttccttaacccttttgcttgtgggataaagattgataaacagctgaaaaccttcaagtgctttatttgtctcagtctgatccagacgggctgtaggtgaaagcatgtaactacagtatgctgcattaaactgagcctcttctgcatatgcactgctgggatagctttgaacaaagactgtaaaataatgaccagcaagcacatannccctggtcttgagaaggcaatctgcatagatatagtgagataactcacccctctcagtagcccggtagctcctcatcacatcattgaaaagagttgcagcccttttataatccccattgttatagtattccattgccttctcaaacttcaaatcggtatcattgctctttaaaagcttttgataattactgcatgaagtgctcaggattagcaaggtaaaaaagagtactccccttacaagctgacttttattcatagttattttctgtagtttttcaacaggagccatacctggaaacatcctgcaaaaatagataattccacgtaattccccaataaatgatttctttaatttatagcactatgaccatagcgggtcatagcgctacaaggataagcaaaattcagaccatcttttaaggcatatgcaggcaaataccgaaaaaaataaaaaacccttggcgactaaggtgaatatataaaaaaacttacctttgccttagaaataattaaaaccttattaacgtggatatttttgataagatacacacaagtatgggccctttgggccaatatggtaaagaagcccatggttatttcatgttccccaaacttgaaggggaaattcatcctagaatgaagttccgcggtaaggaagttcttacctggagtttgaacaactaccttggattggccaaccatcctgaagtgcgcaaggctgatgctgatgctgcaaaggaatacggactgggctatcctatgggtgccaggatgatgtcaggacataccagcaagcacgaggaactggaagctcagctcgctgattttgtcggaaaggaagatgcttatcttctcaacttcggttatcagggtatgatttcaattatcgacactctggtaaatcgaaatgatgtcatcgtatacgactctgagtcgcatgcttgtatcatcgacggtctgaggttgcatatgggtaaacgcttcgttttcccacacaataacattgagaacctacacaaacagctacaaagggcaacagaactagcagaaaaacaaggtggtggagtactcgtaatcactgaaggtgtattcggtatggccggtgaccttggtaagcttgatgaaatcgtagccctcaagaaggaatttaacttccgcattctggttgacgatgctcacggttttggtaccatgggtaagaccggtgccggtactgcagaacacttcggcgttgctgatcagatagaccttatcttcggaaccttcgccaaatcaatggctagcataggagctttcgttgccggtcgtgaagatgtaatcagctacctgcgctataatatgcgctcacagatctttgccaagtcactgccaatgccattggttatcggtgctctgaagcgtctggaactggttcgcacacaacctgaactgcgtgaaaacctgtggaatgtagtacacaacctgcaaaagggtctgcgcgaacaaggcttcgaccttggccacactcaaagtccggttactccggtgtacctcaacggtactattccagaggctaccgaacttactatggacctgagggaaaactacagcatcttctgctctattgttgtttatcccgttgttccaaagggtgttatcatgcttcgtattatcccgacagcagttcacactctcgaagacgtggattacactatcaaagcatttgctgagattaaggaaaagcttgctgccggtaagtacaaagccgacaagatcgcaagcatctgataatattgcgagtcatcctgattagggtaatgtttattcattatatctgaattaggttgatgagacttttaaagaaaaagaggttgtccccaccgggacagcctctttttctttaccggagcctattgaccggaatctcgtatttgttgtacctttacccttgaattaaccaaaaaaggaacaccatgaaaaggattgttagtacactatttcttagcattttaatcactacccttggaat

SEQ ID NO: 399 - DNA, 4000 bp, Escherichia coli
  misc_feature (12)..(12): n is a, c, g, or t
  misc_feature (48)..(48): n is a, c, g, or t
  misc_feature (92)..(92): n is a, c, g, or t
  misc_feature (94)..(94): n is a, c, g, or t
  misc_feature (154)..(154): n is a, c, g, or t
  misc_feature (344)..(344): n is a, c, g, or t
  misc_feature (371)..(371): n is a, c, g, or t
  misc_feature (383)..(383): n is a, c, g, or t
  misc_feature (554)..(554): n is a, c, g, or t
  misc_feature (1989)..(1989): n is a, c, g, or t
  misc_feature (3293)..(3294): n is a, c, g, or t
  misc_feature (3680)..(3680): n is a, c, g, or t
  misc_feature (3884)..(3884): n is a, c, g, or t
ttagattaagtnatttagttaaaggatttgatatgaaaatattagtanattccaaatcacttgaatcaagaaaaaaagattttccacatgtnancaatgtaagttttgatgaactaattggcgctagcgatataattagctttcattgtaaagnagcagctgatggcaaacctttaataacaaaagaacattataaaaaaatgaaaccgactgcttatataattaatgcggcacgcggtaatatagttgatgaaaaagatttaaatgatgctttaaataaaaacttaatagccggggccgcagtagatgttttttcaaaagaaccaaccaaagaaaatattttntttaataacccaaaagctatattaacncctcatatagcngcctcaacaacagaagcttcaataactgtagctgaaatgatagcaaaccaaatatcaaatttcttaataaaaggtgttaaaattaatacggtatagttcgattatttaatggtagatttaagtattgtgatgagtgcagaaatctatagttgtcaaataatcagttaaganttatccataagaaaaattaagaaaataatgaaaaatctttaacttattaactattttgggttaaattttgagtttaatctttttaaactagagtttattatttagactagagtttgttttataaaaaattttatgtttgaaaaattagaagaattagcaaagaataataaaaaaatttcagattttcatataagaagtggctcgccattagcatataggcaaactggtgaaatttataaagtaaaagaagttgtggttaaatcacaagatcttatggatcttatgtctaccaactgcaatgaggtagaaacaaaaaggtttcaagaaactcacgaattagactcttctgttacattaagtggattaagatttagagcaaacttttacaaaacaattaatggacctgctgccgttcttagaagagtggaaactgtaatgcccgaaatggctcaatttgatttgccacaagtgctttatgacatcgttgatatgcacaaaggattagttttagtaaccggaccaactggctctggaaaatcgacaacactcgctgcaattgttaatgagataaataaaacaagaacttcgaacataattacagttgaagatccagtagaatttattcataaagatattaaaagtattgtatctcatagagaagttggaaaacaaacacaaacctttgcaagtgctttaaaagcagcattaagagaagatccagatgtcatacttgttggagagatgcgagatttagaaacagttggacttgcattaacggcagctgagacaggacacctagtttttggaacactgcatacaagtggtgccccaagtacaataaatagaattatagacgtatttccacctgagcaacaagcacagatacgtgcacagatctcaacatctttaaaaatggttgtgacacaaagattgttaaaaacaaaagacggccaaggtcgtgttggtgcttttgaagtgatgaaatgtactgcccctattcaaaacttaattagagaatctaaaattcatcaaattccaagcatcatgcaaacttcagtcaaagatggtatgataaccatgacaaagacattagaagaacttgttaaagcaggcaaaatagatgcagcagctggaaaagaacattaaaggttttaatatattagaactattggtagtagttgcaattataggaattgtatctgctgttgcatatcctaatttttctgactggagaaaagaaagagaagctagagctgcaacacttaaagtaaaaaatttaattcaagggattaatgcacaagttcaaagaggtctatacgcatttgttcaggttcatgtagaagctcaagctgataatttaactataatttcaaagggaatgaaaatggctacacttactccaaaaataaatgatggagaaagtgattggtacaancattatgaatcaagatgcgatatcgattcagatacttactgggatgatgatggatctatagatgataagttagaagttattcaaattgaattagatgaagttacaaccacttttgccagtggaattggtgctgtttgtttttcaaaaaatgtaagatggtatagtggtggaggcaactttgttactaccagcggaggagagacgagcgttgatagtatattatttctttgcacaagaaactcagattttgcaacttgtgatattaacaacgctaatggtgaacctaatagagatcatgataatttatttttagttgaatggacaagatttggagaagtgacaatggaaaaatggagcattagagaagacgaatggatactacaataacaaatgataaaaaaaattaaaaatattttaggtttaactatacttgagtctcttgtttctactgcaatagtgggaatagggtttattgcaatcctacaaatgactaatttttcagttcaatcaattgatagttccggagagagaacaaaagcaaattatttagtaagcatgttggcagaagatgttattggacacagaaatactatttatggagcaagctctcaggcagaaggaattaccatgggtgttgatggcacaattaaacttgtaaatactgatggaagtatgacagaagtagacaaatttgttgaccatttagtgggtcaagattttattgctaatgaaggtgcaggagcatgcggtgatggcactacatcaggcataatatcttcagagtcaaatatttacgaaacccaagaagttgatgcaccaagaaataaagaatctaagtggaaagcaatatttaatgataatcgatatttaaaatgcaggggagacaaagacatcaaaaaaatgaaagtttataaaatatgcaaatgggccggagtatgttctcatataaataacgatgttactgatgatggaatgtacattggtagaattcaaattaacttaaacaatggcagaaaaagaaaatatctgtatttccaagcagattataaaattagaaaataatgaaaaaaaatactcttaaaaatattgctggattaactttaatagaaattcttataggtgttgtaatctcatcgattatgatggcagcgatgtacacaacctactcagttgtaaataatagttatggacaagttactgatcgagcaaaaataagtcgttcaggaagagatatagttgaaatgctgatgagagacataagaatggcaggatttaaatatatgcttggaacgaataaccttggnntttcaacaagaagttatttagaatttaaaggtggacatacttcgttatccgaaagccacgatccaataataattgtcaaaagtgaattaggttatacaagagcagatttgggaacggatcctacaccacctcctaaacataatgcagccgatttatgctgtgataaaatacatattgtttatgatgactttaaccaaaatgatgaagaacaaccttacaaaaggtacaaaattacctactttgctgcaccagcagattattatcccgatggtgaaatagattttgaagatccaagatatgcagtttacaaaactttagaaagttggaagcaagttataggctctgatggagtaccaaatgaaacaggaagttggattgatgattgnaccgagtgctataaggcacaaaaaattcgtgaccatgtagttgatatggaattcattgccttcaatcatgaaggaagaataattaacccaaacgatgcaaggccagacaacgctgatgcagacagaagagcaaaaatttatgatacaagggcagtagatgtaagattgacatttagatcaaaaaatgaattttttagatttgcnccatctgccagtaaaccaagattagtaaaaggacttagcgatagaactatagaatttttggataaatatttaagagattcggttgtagttacaattcatacaagaaacattggtga

SEQ ID NO: 400 - DNA, 4000 bp, Escherichia coli
  misc_feature (54)..(54): n is a, c, g, or t
  misc_feature (111)..(111): n is a, c, g, or t
  misc_feature (1195)..(1195): n is a, c, g, or t
  misc_feature (1224)..(1224): n is a, c, g, or t
  misc_feature (1245)..(1245): n is a, c, g, or t
  misc_feature (1278)..(1278): n is a, c, g, or t
  misc_feature (1308)..(1308): n is a, c, g, or t
  misc_feature (1344)..(1344): n is a, c, g, or t
  misc_feature (1365)..(1365): n is a, c, g, or t
  misc_feature (1407)..(1407): n is a, c, g, or t
  misc_feature (1422)..(1422): n is a, c, g, or t
  misc_feature (1964)..(1964): n is a, c, g, or t
  misc_feature (1966)..(1969): n is a, c, g, or t
  misc_feature (1971)..(1974): n is a, c, g, or t
  misc_feature (1976)..(1982): n is a, c, g, or t
  misc_feature (1984)..(1992): n is a, c, g, or t
  misc_feature (2041)..(2047): n is a, c, g, or t
  misc_feature (2049)..(2052): n is a, c, g, or t
  misc_feature (2054)..(2054): n is a, c, g, or t
  misc_feature (2056)..(2063): n is a, c, g, or t
  misc_feature (2065)..(2067): n is a, c, g, or t
  misc_feature (2120)..(2124): n is a, c, g, or t
  misc_feature (2126)..(2135): n is a, c, g, or t
  misc_feature (2137)..(2138): n is a, c, g, or t
  misc_feature (2140)..(2140): n is a, c, g, or t
  misc_feature (2142)..(2147): n is a, c, g, or t
  misc_feature (2195)..(2196): n is a, c, g, or t
  misc_feature (2198)..(2209): n is a, c, g, or t
  misc_feature (2211)..(2225): n is a, c, g, or t
  misc_feature (2227)..(2228): n is a, c, g, or t
  misc_feature (2230)..(2231): n is a, c, g, or t
  misc_feature (2233)..(2237): n is a, c, g, or t
  misc_feature (2239)..(2241): n is a, c, g, or t
  misc_feature (2244)..(2244): n is a, c, g, or t
  misc_feature (2246)..(2252): n is a, c, g, or t
  misc_feature (2256)..(2257): n is a, c, g, or t
  misc_feature (2259)..(2261): n is a, c, g, or t
  misc_feature (2264)..(2268): n is a, c, g, or t
  misc_feature (2270)..(2277): n is a, c, g, or t
  misc_feature (2279)..(2297): n is a, c, g, or t
  misc_feature (2299)..(2302): n is a, c, g, or t
  misc_feature (2305)..(2305): n is a, c, g, or t
  misc_feature (2308)..(2308): n is a, c, g, or t
  misc_feature (2349)..(2349): n is a, c, g, or t
  misc_feature (2351)..(2351): n is a, c, g, or t
  misc_feature (2353)..(2357): n is a, c, g, or t
  misc_feature (2359)..(2359): n is a, c, g, or t
  misc_feature (2361)..(2363): n is a, c, g, or t
  misc_feature (2365)..(2366): n is a, c, g, or t
  misc_feature (2368)..(2368): n is a, c, g, or t
  misc_feature (2371)..(2371): n is a, c, g, or t
  misc_feature (2373)..(2375): n is a, c, g, or t
  misc_feature (2379)..(2379): n is a, c, g, or t
  misc_feature (2382)..(2382): n is a, c, g, or t
  misc_feature (2385)..(2385): n is a, c, g, or t
  misc_feature (2387)..(2391): n is a, c, g, or t
  misc_feature (2395)..(2395): n is a, c, g, or t
  misc_feature (2398)..(2398): n is a, c, g, or t
  misc_feature (2400)..(2404): n is a, c, g, or t
  misc_feature (2406)..(2406): n is a, c, g, or t
  misc_feature (2410)..(2411): n is a, c, g, or t
  misc_feature (2413)..(2415): n is a, c, g, or t
  misc_feature (2418)..(2419): n is a, c, g, or t
  misc_feature (2422)..(2422): n is a, c, g, or t
  misc_feature (2426)..(2428): n is a, c, g, or t
  misc_feature (2430)..(2432): n is a, c, g, or t
  misc_feature (2436)..(2437): n is a, c, g, or t
  misc_feature (2440)..(2441): n is a, c, g, or t
  misc_feature (2443)..(2443): n is a, c, g, or t
  misc_feature (2445)..(2449): n is a, c, g, or t
  misc_feature (2451)..(2451): n is a, c, g, or t
  misc_feature (2453)..(2454): n is a, c, g, or t
  misc_feature (2456)..(2456): n is a, c, g, or t
  misc_feature (2459)..(2459): n is a, c, g, or t
  misc_feature (2462)..(2462): n is a, c, g, or t
  misc_feature (2464)..(2468): n is a, c, g, or t
  misc_feature (2472)..(2472): n is a, c, g, or t
  misc_feature (2475)..(2475): n is a, c, g, or t
  misc_feature (2477)..(2481): n is a, c, g, or t
  misc_feature (2483)..(2483): n is a, c, g, or t
  misc_feature (2487)..(2488): n is a, c, g, or t
  misc_feature (2490)..(2492): n is a, c, g, or t
  misc_feature (2495)..(2496): n is a, c, g, or t
  misc_feature (2499)..(2499): n is a, c, g, or t
  misc_feature (2502)..(2509): n is a, c, g, or t
  misc_feature (2511)..(2511): n is a, c, g, or t
  misc_feature (2515)..(2515): n is a, c, g, or t
  misc_feature (2519)..(2522): n is a, c, g, or t
  misc_feature (2526)..(2526): n is a, c, g, or t
  misc_feature (2530)..(2532): n is a, c, g, or t
  misc_feature (2542)..(2542): n is a, c, g, or t
  misc_feature (2544)..(2544): n is a, c, g, or t
  misc_feature (2549)..(2549): n is a, c, g, or t
  misc_feature (2552)..(2552): n is a, c, g, or t
  misc_feature (2554)..(2558): n is a, c, g, or t
  misc_feature (2560)..(2560): n is a, c, g, or t
  misc_feature (2564)..(2565): n is a, c, g, or t
  misc_feature (2568)..(2569): n is a, c, g, or t
  misc_feature (2573)..(2573): n is a, c, g, or t
  misc_feature (2579)..(2586): n is a, c, g, or t
  misc_feature (2588)..(2589): n is a, c, g, or t
  misc_feature (2591)..(2591): n is a, c, g, or t
  misc_feature (2593)..(2594): n is a, c, g, or t
  misc_feature (2596)..(2596): n is a, c, g, or t
  misc_feature (2598)..(2599): n is a, c, g, or t
  misc_feature (2601)..(2605): n is a, c, g, or t
  misc_feature (2607)..(2608): n is a, c, g, or t
  misc_feature (2619)..(2619): n is a, c, g, or t
  misc_feature (2621)..(2621): n is a, c, g, or t
  misc_feature (2626)..(2626): n is a, c, g, or t
  misc_feature (2628)..(2628): n is a, c, g, or t
  misc_feature (2630)..(2630): n is a, c, g, or t
  misc_feature (2634)..(2635): n is a, c, g, or t
  misc_feature (2637)..(2637): n is a, c, g, or t
  misc_feature (2640)..(2641): n is a, c, g, or t
  misc_feature (2645)..(2646): n is a, c, g, or t
  misc_feature (2650)..(2650): n is a, c, g, or t
  misc_feature (2654)..(2654): n is a, c, g, or t
  misc_feature (2656)..(2660): n is a, c, g, or t
  misc_feature (2662)..(2663): n is a, c, g, or t
  misc_feature (2665)..(2666): n is a, c, g, or t
  misc_feature (2668)..(2668): n is a, c, g, or t
  misc_feature (2670)..(2681): n is a, c, g, or t
  misc_feature (2683)..(2683): n is a, c, g, or t
  misc_feature (2687)..(2687): n is a, c, g, or t
  misc_feature (2690)..(2690): n is a, c, g, or t
  misc_feature (2693)..(2693): n is a, c, g, or t
  misc_feature (2695)..(2696): n is a, c, g, or t
  misc_feature (2698)..(2700): n is a, c, g, or t
  misc_feature (2703)..(2703): n is a, c, g, or t
  misc_feature (2705)..(2705): n is a, c, g, or t
  misc_feature (2707)..(2707): n is a, c, g, or t
  misc_feature (2711)..(2712): n is a, c, g, or t
  misc_feature (2714)..(2714): n is a, c, g, or t
  misc_feature (2717)..(2718): n is a, c, g, or t
  misc_feature (2722)..(2723): n is a, c, g, or t
  misc_feature (2726)..(2727): n is a, c, g, or t
  misc_feature (2733)..(2734): n is a, c, g, or t
  misc_feature (2737)..(2738): n is a, c, g, or t
  misc_feature (2740)..(2746): n is a, c, g, or t
  misc_feature (2748)..(2749): n is a, c, g, or t
  misc_feature (2751)..(2752): n is a, c, g, or t
  misc_feature (2754)..(2757): n is a, c, g, or t
  misc_feature (2759)..(2760): n is a, c, g, or t
  misc_feature (2762)..(2762): n is a, c, g, or t
  misc_feature (2764)..(2764): n is a, c, g, or t
  misc_feature (2767)..(2767): n is a, c, g, or t
  misc_feature (2770)..(2770): n is a, c, g, or t
  misc_feature (2772)..(2773): n is a, c, g, or t
  misc_feature (2775)..(2777): n is a, c, g, or t
  misc_feature (2780)..(2780): n is a, c, g, or t
  misc_feature (2782)..(2782): n is a, c, g, or t
  misc_feature (2784)..(2784): n is a, c, g, or t
  misc_feature (2788)..(2789): n is a, c, g, or t
  misc_feature (2791)..(2791): n is a, c, g, or t
  misc_feature (2794)..(2795): n is a, c, g, or t
  misc_feature (2799)..(2800): n is a, c, g, or t
  misc_feature (2803)..(2804): n is a, c, g, or t
  misc_feature (2809)..(2812): n is a, c, g, or t
  misc_feature (2815)..(2823): n is a, c, g, or t
  misc_feature (2826)..(2826): n is a, c, g, or t
  misc_feature (2829)..(2829): n is a, c, g, or t
  misc_feature (2831)..(2831): n is a, c, g, or t
  misc_feature (2833)..(2833): n is a, c, g, or t
  misc_feature (2835)..(2836): n is a, c, g, or t
  misc_feature (2839)..(2841): n is a, c, g, or t
  misc_feature (2844)..(2844): n is a, c, g, or t
  misc_feature (2846)..(2847): n is a, c, g, or t
  misc_feature (2849)..(2850): n is a, c, g, or t
  misc_feature (2852)..(2852): n is a, c, g, or t
  misc_feature (2857)..(2858): n is a, c, g, or t
  misc_feature (2860)..(2860): n is a, c, g, or t
  misc_feature (2862)..(2865): n is a, c, g, or t
  misc_feature (2868)..(2868): n is a, c, g, or t
  misc_feature (2870)..(2873): n is a, c, g, or t
  misc_feature (2876)..(2877): n is a, c, g, or t
  misc_feature (2881)..(2882): n is a, c, g, or t
  misc_feature (2884)..(2884): n is a, c, g, or t
  misc_feature (2887)..(2889): n is a, c, g, or t
  misc_feature (2891)..(2894): n is a, c, g, or t
  misc_feature (2896)..(2896): n is a, c, g, or t
  misc_feature (2898)..(2900): n is a, c, g, or t
  misc_feature (2902)..(2908): n is a, c, g, or t
  misc_feature (2910)..(2914): n is a, c, g, or t
  misc_feature (2923)..(2924): n is a, c, g, or t
  misc_feature (2926)..(2927): n is a, c, g, or t
  misc_feature (2929)..(2930): n is a, c, g, or t
  misc_feature (2932)..(2932): n is a, c, g, or t
  misc_feature (2934)..(2936): n is a, c, g, or t
  misc_feature (2938)..(2938): n is a, c, g, or t
  misc_feature (2943)..(2943): n is a, c, g, or t
  misc_feature (2945)..(2949): n is a, c, g, or t
  misc_feature (2953)..(2954): n is a, c, g, or t
  misc_feature (2957)..(2957): n is a, c, g, or t
  misc_feature (2961)..(2961): n is a, c, g, or t
  misc_feature (2963)..(2967): n is a, c, g, or t
  misc_feature (2970)..(2977): n is a, c, g, or t
  misc_feature (2979)..(2983): n is a, c, g, or t
  misc_feature (2985)..(2987): n is a, c, g, or t
  misc_feature (2990)..(2991): n is a, c, g, or t
  misc_feature (3003)..(3003): n is a, c, g, or t
  misc_feature (3005)..(3005): n is a, c, g, or t
  misc_feature (3010)..(3018): n is a, c, g, or t
  misc_feature (3023)..(3026): n is a, c, g, or t
  misc_feature (3029)..(3031): n is a, c, g, or t
  misc_feature (3034)..(3034): n is a, c, g, or t
  misc_feature (3039)..(3040): n is a, c, g, or t
  misc_feature (3042)..(3043): n is a, c, g, or t
  misc_feature (3045)..(3045): n is a, c, g, or t
  misc_feature (3047)..(3049): n is a, c, g, or t
  misc_feature (3051)..(3051): n is a, c, g, or t
  misc_feature (3053)..(3055): n is a, c, g, or t
  misc_feature (3057)..(3061): n is a, c, g, or t
  misc_feature (3067)..(3070): n is a, c, g, or t
  misc_feature (3072)..(3072): n is a, c, g, or t
  misc_feature (3074)..(3074): n is a, c, g, or t
  misc_feature (3078)..(3079): n is a, c, g, or t
  misc_feature (3081)..(3084): n is a, c, g, or t
  misc_feature (3089)..(3089): n is a, c, g, or t
  misc_feature (3091)..(3092): n is a, c, g, or t
  misc_feature (3098)..(3101): n is a, c, g, or t
  misc_feature (3103)..(3103): n is a, c, g, or t
  misc_feature (3105)..(3105): n is a, c, g, or t
  misc_feature (3107)..(3113): n is a, c, g, or t
  misc_feature (3115)..(3115): n is a, c, g, or t
  misc_feature (3118)..(3123): n is a, c, g, or t
  misc_feature (3125)..(3129): n is a, c, g, or t
  misc_feature (3132)..(3137): n is a, c, g, or t
  misc_feature (3139)..(3140): n is a, c, g, or t
  misc_feature (3142)..(3144): n is a, c, g, or t
  misc_feature (3148)..(3148): n is a, c, g, or t
  misc_feature (3151)..(3155): n is a, c, g, or t
  misc_feature (3157)..(3158): n is a, c, g, or t
  misc_feature (3160)..(3160): n is a, c, g, or t
  misc_feature (3162)..(3163): n is a, c, g, or t
  misc_feature (3165)..(3167): n is a, c, g, or t
  misc_feature (3169)..(3169): n is a, c, g, or t
  misc_feature (3171)..(3173): n is a, c, g, or t
  misc_feature (3175)..(3175): n is a, c, g, or t
  misc_feature (3178)..(3178): n is a, c, g, or t
  misc_feature (3181)..(3185): n is a, c, g, or t
  misc_feature (3187)..(3187): n is a, c, g, or t
  misc_feature (3190)..(3192): n is a, c, g, or t
  misc_feature (3194)..(3198): n is a, c, g, or t
  misc_feature (3200)..(3200): n is a, c, g, or t
  misc_feature (3203)..(3205): n is a, c, g, or t
  misc_feature (3207)..(3210): n is a, c, g, or t
  misc_feature (3212)..(3212): n is a, c, g, or t
  misc_feature (3214)..(3214): n is a, c, g, or t
  misc_feature (3216)..(3216): n is a, c, g, or t
  misc_feature (3218)..(3218): n is a, c, g, or t
  misc_feature (3220)..(3220): n is a, c, g, or t
  misc_feature (3222)..(3223): n is a, c, g, or t
  misc_feature (3225)..(3226): n is a, c, g, or t
  misc_feature (3229)..(3230): n is a, c, g, or t
  misc_feature (3232)..(3233): n is a, c, g, or t
  misc_feature (3238)..(3245): n is a, c, g, or t
  misc_feature (3247)..(3247): n is a, c, g, or t
  misc_feature (3249)..(3249): n is a, c, g, or t
  misc_feature (3251)..(3251): n is a, c, g, or t
  misc_feature (3254)..(3255): n is a, c, g, or t
  misc_feature (3257)..(3258): n is a, c, g, or t
  misc_feature (3260)..(3275): n is a, c, g, or t
  misc_feature (3278)..(3278): n is a, c, g, or t
  misc_feature (3280)..(3280): n is a, c, g, or t
  misc_feature (3282)..(3284): n is a, c, g, or t
  misc_feature (3286)..(3287): n is a, c, g, or t
  misc_feature (3289)..(3290): n is a, c, g, or t
  misc_feature (3292)..(3296): n is a, c, g, or t
  misc_feature (3299)..(3300): n is a, c, g, or t
  misc_feature (3303)..(3303): n is a, c, g, or t
  misc_feature (3305)..(3315): n is a, c, g, or t
  misc_feature (3317)..(3322): n is a, c, g, or t
  misc_feature (3324)..(3325): n is a, c, g, or t
  misc_feature (3327)..(3329): n is a, c, g, or t
  misc_feature (3331)..(3333): n is a, c, g, or t
  misc_feature (3335)..(3335): n is a, c, g, or t
  misc_feature (3338)..(3338): n is a, c, g, or t
  misc_feature (3340)..(3340): n is a, c, g, or t
  misc_feature (3342)..(3342): n is a, c, g, or t
  misc_feature (3345)..(3347): n is a, c, g, or t
  misc_feature (3349)..(3350): n is a, c, g, or t
  misc_feature (3352)..(3361): n is a, c, g, or t
  misc_feature (3364)..(3367): n is a, c, g, or t
  misc_feature (3369)..(3371): n is a, c, g, or t
  misc_feature (3373)..(3374): n is a, c, g, or t
  misc_feature (3376)..(3381): n is a, c, g, or t
  misc_feature (3385)..(3387): n is a, c, g, or t
  misc_feature (3390)..(3390): n is a, c, g, or t
  misc_feature (3394)..(3394): n is a, c, g, or t
  misc_feature (3396)..(3405): n is a, c, g, or t
  misc_feature (3407)..(3407): n is a, c, g, or t
  misc_feature (3409)..(3413): n is a, c, g, or t
  misc_feature (3415)..(3421): n is a, c, g, or t
  misc_feature (3423)..(3423): n is a, c, g, or t
  misc_feature (3425)..(3426): n is a, c, g, or t
  misc_feature (3428)..(3429): n is a, c, g, or t
  misc_feature (3431)..(3432): n is a, c, g, or t
  misc_feature (3434)..(3438): n is a, c, g, or t
  misc_feature (3440)..(3448): n is a, c, g, or t
  misc_feature (3450)..(3454): n is a, c, g, or t
  misc_feature (3457)..(3463): n is a, c, g, or t
  misc_feature (3468)..(3469): n is a, c, g, or t
  misc_feature (3472)..(3472): n is a, c, g, or t
  misc_feature (3474)..(3474): n is a, c, g, or t
  misc_feature (3476)..(3482): n is a, c, g, or t
  misc_feature (3485)..(3486): n is a, c, g, or t
  misc_feature (3488)..(3489): n is a, c, g, or t
  misc_feature (3491)..(3500): n is a, c, g, or t
  misc_feature (3502)..(3509): n is a, c, g, or t
  misc_feature (3513)..(3520): n is a, c, g, or t
  misc_feature (3523)..(3531): n is a, c, g, or t
  misc_feature (3533)..(3534): n is a, c, g, or t
  misc_feature (3536)..(3537): n is a, c, g, or t
  misc_feature (3540)..(3541): n is a, c, g, or t
  misc_feature (3543)..(3544): n is a, c, g, or t
  misc_feature (3546)..(3556): n is a, c, g, or t
  misc_feature (3559)..(3565): n is a, c, g, or t
  misc_feature (3567)..(3569): n is a, c, g, or t
  misc_feature (3571)..(3575): n is a, c, g, or t
  misc_feature (3577)..(3577): n is a, c, g, or t
  misc_feature (3580)..(3586): n is a, c, g, or t
  misc_feature (3589)..(3598): n is a, c, g, or t
  misc_feature (3600)..(3608): n is a, c, g, or t
  misc_feature (3610)..(3611): n is a, c, g, or t
  misc_feature (3614)..(3625): n is a, c, g, or t
  misc_feature (3627)..(3629): n is a, c, g, or t
  misc_feature (3631)..(3636): n is a, c, g, or t
  misc_feature (3639)..(3640): n is a, c, g, or t
  misc_feature (3642)..(3644): n is a, c, g, or t
  misc_feature (3647)..(3649): n is a, c, g, or t
  misc_feature (3651)..(3651): n is a, c, g, or t
  misc_feature (3653)..(3658): n is a, c, g, or t
  misc_feature (3660)..(3678): n is a, c, g, or t
  misc_feature (3680)..(3683): n is a, c, g, or t
  misc_feature (3685)..(3686): n is a, c, g, or t
  misc_feature (3689)..(3706): n is a, c, g, or t
  misc_feature (3708)..(3712): n is a, c, g, or t
  misc_feature (3715)..(3722): n is a, c, g, or t
  misc_feature (3725)..(3726): n is a, c, g, or t
  misc_feature (3729)..(3730): n is a, c, g, or t
  misc_feature (3732)..(3735): n is a, c, g, or t
  misc_feature (3739)..(3739): n is a, c, g, or t
  misc_feature (3743)..(3743): n is a, c, g, or t
  misc_feature (3745)..(3745): n is a, c, g, or t
  misc_feature (3749)..(3750): n is a, c, g, or t
  misc_feature (3753)..(3753): n is a, c, g, or t
  misc_feature (3759)..(3760): n is a, c, g, or t
  misc_feature (3763)..(3765): n is a, c, g, or t
  misc_feature (3768)..(3768): n is a, c, g, or t
  misc_feature (3770)..(3770): n is a, c, g, or t
  misc_feature (3773)..(3774): n is a, c, g, or t
  misc_feature (3776)..(3776): n is a, c, g, or t
  misc_feature (3778)..(3779): n is a, c, g, or t
  misc_feature (3781)..(3782): n is a, c, g, or t
  misc_feature (3784)..(3786): n is a, c, g, or t
  misc_feature (3788)..(3791): n is a, c, g, or t
  misc_feature (3794)..(3796): n is a, c, g, or t
  misc_feature (3799)..(3803): n is a, c, g, or t
  misc_feature (3805)..(3809): n is a, c, g, or t
  misc_feature (3811)..(3813): n is a, c, g, or t
  misc_feature (3815)..(3818): n is a, c, g, or t
  misc_feature (3820)..(3820): n is a, c, g, or t
  misc_feature (3823)..(3823): n is a, c, g, or t
  misc_feature (3825)..(3825): n is a, c, g, or t
  misc_feature (3828)..(3828): n is a, c, g, or t
  misc_feature (3830)..(3832): n is a, c, g, or t
  misc_feature (3836)..(3836): n is a, c, g, or t
  misc_feature (3839)..(3840): n is a, c, g, or t
  misc_feature (3842)..(3848): n is a, c, g, or t
  misc_feature (3850)..(3858): n is a, c, g, or t
  misc_feature (3860)..(3861): n is a, c, g, or t
  misc_feature (3864)..(3865): n is a, c, g, or t
  misc_feature (3868)..(3872): n is a, c, g, or t
  misc_feature (3876)..(3876): n is a, c, g, or t
  misc_feature (3878)..(3878): n is a, c, g, or t
  misc_feature (3881)..(3882): n is a, c, g, or t
  misc_feature (3884)..(3892): n is a, c, g, or t
  misc_feature (3894)..(3894): n is a, c, g, or t
  misc_feature (3898)..(3898): n is a, c, g, or t
  misc_feature (3901)..(3903): n is a, c, g, or t
  misc_feature (3906)..(3906): n is a, c, g, or t
  misc_feature (3909)..(3912): n is a, c, g, or t
  misc_feature (3916)..(3916): n is a, c, g, or t
  misc_feature (3919)..(3920): n is a, c, g, or t
  misc_feature (3923)..(3924): n is a, c, g, or t
  misc_feature (3927)..(3929): n is a, c, g, or t
  misc_feature (3931)..(3935): n is a, c, g, or t
  misc_feature (3937)..(3942): n is a, c, g, or t
  misc_feature (3944)..(3944): n is a, c, g, or t
  misc_feature (3948)..(3949): n is a, c, g, or t
  misc_feature (3952)..(3952): n is a, c, g, or t
  misc_feature (3954)..(3954): n is a, c, g, or t
  misc_feature (3956)..(3956): n is a, c, g, or t
  misc_feature (3959)..(3959): n is a, c, g, or t
  misc_feature (3961)..(3962): n is a, c, g, or t
  misc_feature (3964)..(3965): n is a, c, g, or t
  misc_feature (3971)..(3974): n is a, c, g, or t
  misc_feature (3978)..(3980): n is a, c, g, or t
  misc_feature (3984)..(3985): n is a, c, g, or t
  misc_feature (3988)..(3991): n is a, c, g, or t
  misc_feature (3994)..(3995): n is a, c, g, or t
  misc_feature (3997)..(3997): n is a, c, g, or t
  misc_feature (3999)..(4000): n is a, c, g, or t
aaatcagctaagtatgttgaagctcaaaaaggaacaaatctttattttgcaatntatgaagatgaagaaggtaaacgcagttatgaaacaatacctctaaatgaagttgtngaacgtttgaaacaaggccttagccctgtcccagaaaagaataaagcacaagttccacttaagttttatctttctcctaatgatttggtatatgtacctgatacaggcgatgtaaatgaaattaaaaaggaacaaatatataagtttgttgattctagtgggacaacagcaaattttattcctcatagagcatctgatctcatctataatgtggataagaagttcgctacaagtttttgcaatcgcgaagtaattcagaatgaatatggtgtaggtagtccacaatcaaagaatcagaaggcaattactggtgaaatggttaaggctatttgttggaaacttgttgtagatcgcttaggtaatattattaaaattataaagtagtgaactttctagcctatgataaagaaaacgctttgttttagtaacccaatctatttgagtcttcgtaatgctcagttagtattgcatttaccagaggtagaaacaaatgatatgttgccagagatgatgaagaaggaagccgagcgcactatcccaattgaagatattgggatagttgtacttgacaaccgacgtatcacagtcacttctggtgtccttgatgcccttttggagaataattgtgccgtaataacatgtgatcagaagagtatgcccgttggcttacttctccctttgagtggtcataagacacaaaatgaacgtttccgatctcaacttgattcttcagttccgttacgtaaacagttgtggcaacagactgtgaagcaaaagattctaaatcaagaatgtgttttacgaacaaatacagataaggaaacaaattgtatgcgtgtatggtcaaatgacgtgcgtagtggtgaccctgataatcttgaggcaagagctgcagcttattactggcgtaatctttttgctgattatcctgattttgttcgtgatagggaggggggaccgcccaataacctcttaaattatggctatgccattttacgtgctgtaattgctcgcgctttagtaggaagtggtctgttacctactttgggtatacaccatcataatcgttacaacgcttattgtntggctgatgacatcatggagccatatcgnccttatgtagatcaacttgtnatagatattcttcataaatcggaggaagtaacntctctatctaaagagttgaaaatggagttnttaagtattccgatgattgatgtcgtcgtgaatggnaaacgtagtccattgatggtngcagctcagcaaaccacagcttcacttgcaaagtgttttgcnggggagatacgtcgnattagttatccagaaatgtaaaatctatcatgtccaacttttaccgtctcagtgaatatcgtattatgtggattctagtattctttgatttaccgacagaaacaaagaaggaaaagaaggcatatcttgatttccgtaaatctttgatgaaggacggttttacaatgttccagttctccatttatgttcggcactgtgcaagcattgaaaatgctgaggttcatatgaagcgtgtgaaggcttgccttcctaaacatggaaaagttggtatattgtgtattacggataagcagtttgctaacattcagctgttttatggtgagaaacctaaagctcctaatgcaccggggcagcaattagaacttttctaattcaaaccttatagaaaacgaaaatcccactcacttagagtgggattttgttttgtggcatctttttaattttcttctaacaacgctatatcatgttgataaccagagtcttgcatgtaatgagttgttgttgctaccacaaaggtacgtattttcaagcaaatcacaacnannnnannnnannnnnnnannnnnnnnnagttgttgttgctaccacaaaggtacgtattttcaagcaaatcacaacnnnnnnnannnnanannnnnnnntnnntaagttgttgttgctaccacaaaggtacgtattttcaagcaaatcacaactannnnnannnnnnnnnntnntnannnnnngttgttgttgctaccacaaaggtacgtattttcaagcaaatcacaacnntnnnnnnnnnnnntnnnnnnnnnnnnnnntnntnntnnnnncnnnaangnnnnnnntttnnannnaannnnnannnnnnnncnnnnnnnnnnnnnnnnnnntnnnnttnttnttgctaccacaaaggtacgtattttcaagcaaatcacaacngnannnnntntnnntnnanatngnnntggnttnttntnnnnnccanaangnnnnntntttnnannnaanncanaacnnntnnnttgnnaannangnnnnncncnntnttnttntnnnnnccanaangnnnnntntttnnannnaanncanaannnnnnnnantaantttnnnnattngttnnngttgttgttncnaccanaangnnnnntntttnnaannaaancacaannnnnnnncnngngnngntnnannnnntnntgttgttgttncnaccananangtanntnttnncaannaaancacnannnnntnnannantnnnnnnnnnnnntnttgnttnttntnncnnncananangtanntnttnncaannaanncacaanncgnngnnnnnnntnntnntnnnntnntngnttnttntnncnnncananangtanntnttnncaannaanncacannnntgnnnnnnnnnctnctncntntnnttnnnttntnntnncnacaannangnnnnttntnnnnaannaaannanaannngnnnnanannntnnnnnnntnnnnnttttttttnntnncnnanannnangtatntnnnnncaannaanacanannnnnaannnnnnnncnnnnntnnntcnnttgttgttgttncnacaannnnnnnnnttttnnnnaannnaanaacanngnngntnnnantnnnannnnntttaannnngntntttnnannnnaaagntnnatattnnnnananannnnnnnancannnnnnannnnnatnnnnnngnnannnggtngtnnnnncnncnannannnangnnntntcnaannnnncnacnnntnnnnntnttnnntnnnntntntntntntnntnnttnntnntacannnnnnnnantntntannannannnnnnnnnnnnnnnnaanantnnntnntnntnnnnnatnnttntnnnnnnnnnnnannnnnnannannnannnanatnanancannnanngnnnnnnnnnnttnnnngnnntnntnnnnnntttnnnaanaaanannnnnnnnnntncnnnnnannnnnnncntnnanntnntnnnnntnnnnnnnnnannnnnttnnnnnnnctacnncanangnnnnnnnttnnanncnnnnnnnnnntnnnnnnnnttcnnnnnnnngtnnnnnnnnntnntnnttnntnncnnnnnnnnnnntannnnnnngnnnannnnnantgnnnnnnncannnnnnnnnnannnnnnnnntnnttnnnnnnnnnnnnannntnnnnnnttnnannnaannncnannnnnncnnnnnnnnnnnnnnnnnnntnnnntnnttnnnnnnnnnnnnnnnnnntnnnnnttnnnnnnnntannaanncnnnnttantttnanctgnntcnttcatnnttnnnacntnaanntnanngnnannntnnnncannnctnnnnnannnnnannnannnnantcntnttntnnncttntanncnnnnnnncnnnnnnnnnannaanntgnnnnnaaananctnntnnnnnnnnntnatcnttnnnttnttnnnnttgnttnnggnnatnnngnnnnnannnnnntncttnnaancnanatntnntnnctatgnnnntacnnntgtnnttnnnncanntnann

SEQ ID NO: 401 - DNA, 4000 bp, Escherichia coli
  misc_feature (641)..(641): n is a, c, g, or t
  misc_feature (1353)..(1353): n is a, c, g, or t
  misc_feature (1938)..(1939): n is a, c, g, or t
  misc_feature (1950)..(1951): n is a, c, g, or t
  misc_feature (1956)..(1956): n is a, c, g, or t
  misc_feature (1968)..(1968): n is a, c, g, or t
  misc_feature (1990)..(1990): n is a, c, g, or t
  misc_feature (2010)..(2010): n is a, c, g, or t
  misc_feature (2019)..(2019): n is a, c, g, or t
  misc_feature (2025)..(2025): n is a, c, g, or t
tacgcaagacatagtatttaatattaataagagataccctaatagacatattgttatctaccctgatgcttcaggttatgcaggcaagactaatgctagcttatcagatatagacatacttagaaatgctgggttcaagattaatgcacctagaaagaatggtagagttaaagacagagtcaatacggttaataacttacttagcaagaataaactgcttataaacactactaaatgccctgaaactactaaagcattagaacaacaagcatatgacaagaatggcgagcctgagaagtttaatggagcttcaacagtggatgattggaatgatgcccttgggtatttcttagtaagacaattccataaacctaagaatgttgatttacgaatgagaattggctaaaatataagagatattaaaacaaaggataaatatgagcttattagctaaagaccataacggcaaagaaatacaagggtttgcccctactaggattgtaacggcttcaagtattgatgtatcagatgcagttgctattagagtttttgaacctactcaataccagattaatggtgctggtactattggtactatgacaggggttacagttgtaaatgttggggtttcaagctttaantttacagagtctgtaactttcgaagtaatggattagaaatgtttgatttatcttgtagctttggggttacaaaagtatttcaaacttggtgggctttattttttgagcctaattatatagacagcgattacattctaggagaataatatggcatcagtaacaacaagaagtggcaaggggtcagctctaactcactcagagatggatagcaaccttaacaatttaaacacagacaaattagagtctacagactttaagactattaatggcgagagtattgttggtagtggggacattgtactaatacaagacatagagccgtatggggttacttggaatcaagataacgatacatatgcaagagttggtggaagtgactttactcacatccaaagaaagatgagaagagtaacgctactggcaaatggtacagtaaactactacttaggtgctaatgacagtactaagaaagcaaatggtacagacgcagtacttacgggtgcagatggtaatgtaatggtagagataccaaagttctaccataagtatacgtacagtaatgggacacataatcatatgattaacttagagccatttgaaggtgctagtgtacatccagcgttcgttaagaatggtgtagaagtaagtaatagatacattggtgcttatggtgcatctgtaagtggaagtacacttatttcagcaagtgggntatatcctgctggttcaatgactagaggttcgtttagaactaaagctgctgcaattggttcaggttgggcattgcaagattggaatttaattagtgcagttcaattgctaatgctagttgaatttggaacttttaatagtcaagctgcaatcggtcaaggaagaactcaattatcaggtggagcttggtcaaatggttcgtatattggaattaatggtagaagtgatacttctggtaatgctactggaaatcatgaatattcaggtgatgcagatgatgcagctgctgatttagctttcatgtcttatagaggaattgaagacttctttggaaatatttggaactgggtagatggtattaatattcaagataatgtgccatttattaataataatccatcaacttttgcagatgatgtatttagtggggactatgtgaatgctggaattactatggcaaatgctaatggttggcaaaatactttagagcaagttgggactggattcttccctgcttcggttggtgcgggttcaagtactaaaattacagattactattatcaagctgcaggaaatagggtcgtgnngctcggtggtnntgcgnataatggttcgnctgctggtgctttctatctgantgcgtctaattcttcgggtnattcgtctncgaatntcggctcggtcttgtcattttagtatggcaaggttagtttaatatgacaaagggcagtttattagtcgtgaaactcagtagtaatgcgaataatggttcgaatactggtactttctatctgaatacgaataattcttcaggtaattcgaatacgaatatcgactcagaatcttgtataaaaataaagaatataaactgtccttaccaacatggtaaaatacactactatactccattacatattggtactttaggggaagatttgggagcgacaagactgtgaaaagatatggcaatctatttcataatatatataatttagaaaatattaaactagcccaccaaaatgcaagaaaaggcaaaacattttacaaagaagttaaaatggttgatgcagatatagaaaaatatgctttaaaaattcaagcaatgctaagagataaaacatttaaaaatagcgactatactgtctttaataaagtagacaaaggtaaggttagagagatctataaactaccttacttcccagacagaataatacatcattgtattatgcaagtcttagaacctgtatggcataaagtattaattaaagatactttccagtctataaaaggtagaggaatacataaagctaaaagtagagtagagccaactatcagaaaagagaaattaaaatactctttaaagatagatattaaaaagttttatcctagtattgacaatgagatattaaaacaaatagttcgtaaaaagattaaatgtagtgatactttgtggttattagatgaaattattgactcaactaaaggtgtaccaattggtaactatatgagtcaatattttggaaatctttatttggggtattttgaccattggatgaaagaagttaaaagagtaaagtactattacagatattgtgatgatgttgttattcttagtagtgataagaaatatttacactatcttcttgaagagatgagaatgtatttaagaactaatttaaaactaactattaaagaaaattatcaaatatctcctataaaaataagaggtgttgattttttgggctttagattcttttttaaatatactttacttagaaagaagatagtaaaaggctttaaaagaggtatagcattgatattaaaattctatgctatacttaaaatagaaaaagtacaaggagtagtgatgagctactatggttggattaagcacagtagtgggcttcatctttggagcaaatatgtaacttatgaagttaagaaaatatttgtacaattaaaaataaaaaacaagatactaggagtataaaatgttagtaaaatcagatacaagaccagaggcaacagagttgctacaaggtaagaaactaatcaattttgacattaaagaagttgaaattaaagatgaaaatagtgaagatattagagttgggtttgaatatctacaagcaaaagtagaattaaatactacaagaagtgatattatagaagcaattatagcgactaaatattcagctggtgcagaaattgcattaactaatgacaaagatactaaacaagatgagtataaagcatatcaagagtttagagctactgctaaagaattagcagaatagagaataactattaaattcataggtgtcattttaaatggcacttattgagtttataaacttaaaacaaaacaataggaaataaaatgggattattaggagtaacaaatgattaatatagcattcgtattattaaaagagatactgctgtctatggtagctaaggttgcatttaaagcagtagcagagaggtttgctacaaggcttgtagtatatggactagagaagctagaaagctactcaactaactatgttgttaaagacacagttaatgatattaaaaatcagctgaaaggcaaaggtttaaaagtaatagatggataatgacctgacagatctaaaagtttcaatagc

SEQ ID NO: 402 - DNA, 4000 bp, Escherichia coli
  misc_feature (3969)..(3969): n is a, c, g, or t
ctcggcgaccgcgtacgaggcggagcccgcgagcaccggagtcgccagcaacccggtgccgatcagaccgaccgcgaacagcagataggcgccgtcaccggccaggggccgcagcgcctcggccgcctgacggctcgtctcgatgtcgttccggcccgcgcggaagagcgtggcggccgtggcgagaatgatgaagtacatcaccacgttcgagaaggccatgccggtgaagacgtcctggcgcgcgtcgcgcagctcgtggtcgctggcgccgcggcgctcggccaccgtgcggcgtcccttggcgcgctcctcctcgacctcctgcgaggcctgccagaagaacaggtacggcgagatcgtcgtgccgaggatgccgacgagcgtcggcacggcgcgggcgtcccagggcacgtgcgggacgagcgtgtcgcgaagggccgccgaccagttcggctgcgcgaggacggcggacaggatgtacgcgaagagcacggcggtgagccacttgagccaggcggcgaacctggcgtagctcgtgtacacggtggccacgatcacgccgagcccgaacagcggcacccagaactccgacggcacgcccgtcagcatctccgcggcgtccgccatgccggcgagatcggcggcgatattgaagacgttcgccgcgagcagcagcaggcaggcgccgtacaggaaccagcgcggatagtggcggcgcgtggcgccggcgagcccgcggcccgagacgagcccgatgcgggcgcacgtcagctggatcgcggccatcagcggcagggtgacgacggccgtccacagcatccccgtcccgaacgtcgcgcccgccaccgcgtaggtcgtgacgccgctcgggtcgtcgtcggaggcgccggtgacgagacccggcccgagcgtccggaagtagcggacgagggggttgtgactatgccgctcgtcgggcccgctcatagagcacgagggcggcggctccgcgcatggtgagccgcttgtcgcccggcacgatcgtgatccgcgtcgccgccagcgcgcgcgcgaacgcgtgctcggccgccgcggcgaggatccgcttctccagcgcggcgagcgagccggccacgccgccggtgacgacgacgacctcggggttgagcccgttcacgatcgtcgcgagcatggcgccgagcgcgcggcatgcctcgtccaccaccgccgccgcgacgggctcgccgtccgtggccatccggaaaacgagctcggccgtgatccgctgcgcgtcgccgccggccgcctgcagcagcgccgcgcccgcctcgcgggcgacgcgcgcgcgcgccgcctcggtgatgccccgcccgctcgcgtagacggcgagacagccgcggccgccgcaccagcagggcgggccgtcgaacttcacgggcgcgtggccgaactcgccgccgaagccggcgacgccgcgcaccaggcggccgtcgaggatcacacccccgccgaacccggtgcccgccgccagcaccacgagcgagcgcgcgccccgcccggcgccgaagcgccactcgcccagcgccagcgcattgacgtcgttgtcgacgaaggcggggatgccgaagcgcgcggcgaggcgctgcgccaggggcacgtcgacgagatcgggcgcgtgcggcgcggggtcgccgacgacgccggcctccgcgtccaccgggcccggcacgccgacgccgatgcccgcgaccgtcagcccgcgcgcggcgaccgcggcacgcacgcgctcgacgagcgcctcgatcgcggccggcgtgccgacggccttggcgtcgcgcgtcgccacccgctcgtcgagcaggacttcgccgtcgggcgtgaccgcgccggcggcgatcgtcgtcccccctacgtcaaggcctatcaggatggggggccccgaaatggccccccatacccccccgcgctcggggcgccccggggaacccgtggcgcccctcgacatccccactagatctccgcgaaactacacagcgtgatcccgagtgccgcgacggcggtgcgggccgagggcgtgccgagaccgatcatctccgtctcgcgctggcgcccatagcggctgtacgcgaggtccgcgtcgaaccagccgggatgcgtcatgaattccgagaggccctcgggcagcgcgcgcagattggcgagcgtggtggccggcgaccagtaggcgcccggccccgactcgccgaagaagtgatccggcgtgcggagcccagccgagcgcgcgcggccgcgcgcggcggcgtcctggctgcgcaccggcacgcccagcccgcgcgcgacgtccagcacgacctcgcgcaccggcggatgcaggccgacgtgatggtgcgtgtccaggtgcgtgggcgcgcggcgaaagacccggcggaacttcgcgacctgcgcctcgatctcggcccgcacgtcgccggcgcgggcccgcgccgccgcatggcgcgcgtcccgcacgaagcggccgccgccggccacgagcgacttccctcgcgtcagcggcgagccgagcgtgaggttgacgtggagcccgacgccgagcccgctgtcgaggaggcgggccacgaggccccgctcgaggtcggcggtcacgagcaccgtcgtgctcgtgacgatgccgtggcgatgcgcggccaggatgccctcgctcacgccgcgcgtgaggccccagtcgtcggcgttgacgatgaggcggcggctcaccgcgcgcgtccctcgatcatcaggcgctcgacggtcgccggccgcccgggcggcagcgccgcctcgcggtccatcgcgcgcaggtgcgcgatgcgctcgtggccgatccgcgggaacgactgcgtctcgcgcgcgagcaccgagggcacgagcccggccgcctccaccttcgccagggcggtcttgatgccgaggaagtcgaagatcgtgaacacgagccggccgcgcggcgccaggtgcgcgggcgcgcccgcgatgatgcggtcgagcagcgcccagccgtcggagccgccgttgtcggccgccgcctgcgcgtcctcgcggtcggcgcccggcggcgtcggcatctgcggcgggttgctgcacacgaggtcgaagcgctcgcccgccaccggcgcgtagcagtcgcccagccgcgcgtcgacctcgacgccgttcagcgcggcgttcacgcgcacggccgtcaccgccgccggcacgacgtcggtggcgacgacggccgcgcccgccctggccgcgagcacggcggccaggccgagaccggcgccgatctcgagcacgcgctcgcccgcgcggacgctcaggtgatggcagaagaacctcgagccggctttcggcggctgcacgatgtcggggacgcggaagaggcagtcgcgccaggcgtagaagaggacgccgtcgtccactacgtgccttgcacgcgccggaagtagaggcggatcgcctccttcagctgcgcgcgcgcgccggccgaggactgtgcgtcctccagctggtcgatctcgatctggagcggcacgccctcgcgcttgacgccgtccagctcggcggtcagcgcgcagcgctcgtcggactcggtgaacacgagcttcgcgcgcttgaagctggcctcctcgcgcgcgagctgctcgacggtctcgacgatcacgcgcttgaacgcctcctgctcgccggccggcaccgtcgagaaggcggcggtcaggttcacctcactcattccagaccttgaggatgtccgcgtgggtcttcgccgcgttggcgcggatggcgaaggagatcgcctcgcgcagctcgtcctcggtcgcgccgctctgcctggcgcccgccaggtcgcgcttcgctcagtgggtgttgccggcggcgaggttggcggcgagataacagaggtaggcggttttgggatcgagcacgcccttcttgaacttccacgacgcgatcacccgctcttccatnacgcacctcccacggttttccgcccgaccgt

SEQ ID NO: 403 - DNA, 4000 bp, Escherichia coli
  misc_feature (383)..(383): n is a, c, g, or t
  misc_feature (385)..(385): n is a, c, g, or t
  misc_feature (1953)..(1953): n is a, c, g, or t
  misc_feature (2021)..(2021): n is a, c, g, or t
  misc_feature (2029)..(2029): n is a, c, g, or t
  misc_feature (2301)..(2301): n is a, c, g, or t
  misc_feature (2304)..(2304): n is a, c, g, or t
  misc_feature (2307)..(2308): n is a, c, g, or t
  misc_feature (2313)..(2313): n is a, c, g, or t
  misc_feature (2315)..(2315): n is a, c, g, or t
  misc_feature (2322)..(2322): n is a, c, g, or t
  misc_feature (2325)..(2326): n is a, c, g, or t
  misc_feature (2333)..(2333): n is a, c, g, or t
  misc_feature (2337)..(2338): n is a, c, g, or t
  misc_feature (2346)..(2346): n is a, c, g, or t
  misc_feature (2349)..(2349): n is a, c, g, or t
  misc_feature (2355)..(2355): n is a, c, g, or t
  misc_feature (2361)..(2361): n is a, c, g, or t
  misc_feature (2364)..(2364): n is a, c, g, or t
  misc_feature (2367)..(2367): n is a, c, g, or t
  misc_feature (2369)..(2370): n is a, c, g, or t
  misc_feature (2373)..(2373): n is a, c, g, or t
  misc_feature (2376)..(2376): n is a, c, g, or t
  misc_feature (2378)..(2378): n is a, c, g, or t
  misc_feature (2380)..(2381): n is a, c, g, or t
  misc_feature (2384)..(2384): n is a, c, g, or t
  misc_feature (2388)..(2388): n is a, c, g, or t
  misc_feature (2400)..(2400): n is a, c, g, or t
  misc_feature (2403)..(2403): n is a, c, g, or t
  misc_feature (2406)..(2406): n is a, c, g, or t
  misc_feature (2421)..(2421): n is a, c, g, or t
  misc_feature (2447)..(2447): n is a, c, g, or t
  misc_feature (2449)..(2449): n is a, c, g, or t
  misc_feature (2454)..(2454): n is a, c, g, or t
  misc_feature (2463)..(2463): n is a, c, g, or t
  misc_feature (2478)..(2478): n is a, c, g, or t
  misc_feature (2508)..(2508): n is a, c, g, or t
  misc_feature (2511)..(2511): n is a, c, g, or t
  misc_feature (2522)..(2522): n is a, c, g, or t
  misc_feature (2524)..(2524): n is a, c, g, or t
  misc_feature (2526)..(2526): n is a, c, g, or t
  misc_feature (2532)..(2532): n is a, c, g, or t
  misc_feature (2534)..(2534): n is a, c, g, or t
  misc_feature (2546)..(2547): n is a, c, g, or t
  misc_feature (2557)..(2557): n is a, c, g, or t
  misc_feature (2559)..(2559): n is a, c, g, or t
  misc_feature (2564)..(2564): n is a, c, g, or t
  misc_feature (2571)..(2571): n is a, c, g, or t
  misc_feature (2574)..(2574): n is a, c, g, or t
  misc_feature (2580)..(2583): n is a, c, g, or t
  misc_feature (2586)..(2586): n is a, c, g, or t
  misc_feature (2589)..(2589): n is a, c, g, or t
  misc_feature (2592)..(2592): n is a, c, g, or t
  misc_feature (2595)..(2595): n is a, c, g, or t
  misc_feature (2598)..(2598): n is a, c, g, or t
  misc_feature (2600)..(2601): n is a, c, g, or t
  misc_feature (2631)..(2631): n is a, c, g, or t
  misc_feature (2634)..(2634): n is a, c, g, or t
  misc_feature (2636)..(2636): n is a, c, g, or t
  misc_feature (3068)..(3068): n is a, c, g, or t
  misc_feature (3265)..(3265): n is a, c, g, or t
  misc_feature (3300)..(3300): n is a, c, g, or t
  misc_feature (3324)..(3324): n is a, c, g, or t
  misc_feature (3402)..(3402): n is a, c, g, or t
  misc_feature (3418)..(3418): n is a, c, g, or t
  misc_feature (3424)..(3424): n is a, c, g, or t
  misc_feature (3471)..(3471): n is a, c, g, or t
  misc_feature (3478)..(3478): n is a, c, g, or t
  misc_feature (3503)..(3504): n is a, c, g, or t
  misc_feature (3515)..(3515): n is a, c, g, or t
  misc_feature (3547)..(3547): n is a, c, g, or t
  misc_feature (3577)..(3577): n is a, c, g, or t
  misc_feature (3614)..(3614): n is a, c, g, or t
  misc_feature (3624)..(3624): n is a, c, g, or t
  misc_feature (3652)..(3652): n is a, c, g, or t
  misc_feature (3672)..(3672): n is a, c, g, or t
  misc_feature (3807)..(3807): n is a, c, g, or t
ggaataaattgagcagccctcatgcaatccgcgcggggcaaaggttagtggttggataccgtaaagcttcaaacagtaatctaccccgcgaagcaagtgtgattcgtgttccgcgaaatactacactgtctcacttagctattcgctacaaaacatctgcgagaaaactgatgacctggaacggtttaactaattccaggcaacttcggacgggaatgaggctttatgtaaaagcacctgaaaaaattaaacgaaaacagcaaaaaagaattgttgcaaaaaagaattcaagaagattaattaaagtccggcacaagattattcgtgtacgtaatggcgacactctgtggggaattgccagaatttaccgaaccacagttaangngttggttgcacttaacgagctgaagtctgaaagccacctgagactcaatcaaaaattgattgttccttacccctcataaatcattcgtccccttgtttttgcagacatttttgcattttaatcaaaatccaacattatctttatttcagaaatataaattcaaaacggctttttaatggcagtctttaccgaggaaaagaaaaaattacttatcgaagctctttcttacataaagagcttcaatggtaaaatagtggtcatcaaatatggaggtgctgccatgattgaggagcatctcaaacatgactttgcccaggatattgttttgctccagtcattgggaatgctgcctgtaattgttcatggaggaggtccggaagtttcaaaggcaatggaacgattaggccagaaagtctcctttattgatggtctgagagttacaagttcggaaaatatgaaagttgcagaaatggtactctctggaactataaacaaagaaataattacacacctgaatacttttggcggtaaggctgtaggagtcagcggtaaagatgggcacttgattgaggctataaaaaagcctcaaaaaagcggcattgatttgggctttgttggtgaaattaaaaacgttaatccggaactgctgctggtcttgctaaagcagggttttttacccgttgtctcaccgattggtcttggaaaagatggtattacatacaatataaatgcagatacaactgcatcccgcatagctgtttctttggcggcacacaaaataatcttcatgactgacgtagacggtgtccttaaaaaaggaaagttaattgctcaactcaccgcaagcgaagccgaaaaattgatccagcaaaaggtgatcagcggcggaatggcaccaaaaattgaagccgggcttttctgcgtaaataatggggtggaatctgctcaaataatcaacggtacagattctcactctgtcattgcagaattatttaccgacaaaggtattggtacaaagattgtcctttaataattttaaaaagaattattgttgctctgcaaagtaaaacaatttcacagaaagactttaatcaggtacaacggttttatttttaaaatctatccaagaaataatcccatctgtcgcatgaaaaacagttgtataatgttctttttggtctagaaagttagcaacaatcctacttcttctgccacttctacaaattataattacagggtctttattacttgctattttcttcagttttgacatccattctttaacattgtaatttccatctttatcaaaaaatgttagaagattactttttttaatcactcccgtttcgtaccactcccttttagttcgtatgtctattaatggaaccccactttccattagaattattattttattattattaacctcatatatatcagcaaacagctgtggattgaataaaaagacaacaagagttatagagagaatttttatttttattttcattatttaacaaatttatacatttagtttgatgtgctcagattgttttatttctgactcgttnccatagtaaaaaccttttggtctgtccatgcaccaaccagcaggaaaaggaaaatttccaggaccgcnatcagggncagtgcaatcattggatccagagtatttgtaaaaaaattcattgtgtttttattagaataattcaacccgtttaatgaacgcctttgagtgacgtccatttactttctcagtagtttgcacatcaacctctatcccaagagccgttacaggcaactgtttcttaccaaataattcaaagaattttgctgagagatcaatttctgtgatatatgtttttccaatactcccgtcacagggtatgcagagataacgacctccctcttgccagtanttnccnnaatananttgatcnggnntttcatntttnncaagaaanaanctgatnaaatanggnagntnnggngcnanannaantccnctgtccagtttngtntcnccaaaaaagaccatnaaggaaattgcttcacgtgtgtttcnantcttntctttgggnccgctccagtctgcnccaagcggatattgatctactccccattcnatncgtatttttgntncnccatgnanatagtccttttnntcaaactccngnatcancacaccnaantcatcnnnngtnggntcnatnacnanntttccgtcttcaaaacggaggttcatatcngtnanatcttcccggaactcccatttgattttttcaaaccagttttgaacattgccggatgcagttgaaaaatccaattcgtaaatcgtttctgccccggcagaaaatgtgagcaataaaaatccgcacagggtaattatttttttataatgtccacggaactttttttctatccccatttattcctgtttaagctgaaaaaggttcgctgaataactgagagtttcttgattaaaaagcagccggaggagcaattgcagtacgtattgctcccaattgcggtatcatataaaaaactatgggctacatcagtagggctcactgaaaaagttttttttgtcatcacggacttgatccgggatcaagatcaccgtccagcttgagtacaaggtttgaaacatttccccttgattcaggttctgcgcttcgctatgccnggaatgacaaagaagaatcgaaagaagtacgactatttttcacgtgggtaaaccttgttgaaacagggactcaaacgacagaagtgcaaagcttttagttttttcaggaaacaccttgcagttatcttcactaattgaataattacttattgatattattgaataatattatttttcagcaagccctaagtaagtgnaagaaaaattagtgataaagttgctgagtacatgngatctgaaaattctagcatcaccntaaacatttgaaatggatgtttcaagatttttttaattacaaaataataatgtttgataaaccagtttataatcaaanttgcatagggctcacngaaaangtttttcttttgtcgtgccggacttgatccgggatcaagatcaccgnccagctngagtacaagatttgaaacatttccnntggattacggntctatgctgcacttcgccgaatgacaaatganaataatctaaagtagcacaactattatttncgtggggctgccttgttgggaaaagagactcaaacgncagaagtgcngggccttcgcgcttttcaggaaacaccntgaagttgtcgtaatcaatngaataattacttatttatattattgagaagtggactgttccacagattcgctagaaatatcttaagagttgtctgaagaaacttcatcttcctcctccattggatttggattgatgaaaaccagctgattaccanctaaagattttgtggcaacctctatttcctggacaagcaagtcactggttattcttctgcggagagtacttttatgcattaaagtattcaattcaatctccagaaaaccaaaagtgtttttcaattcagaaacttttctgaaagcagttgtattttccaggtattccacaatcattatttgactccgtggaga

SEQ ID NO: 404 - DNA, 4000 bp, Escherichia coli
  misc_feature (1)..(9): n is a, c, g, or t
  misc_feature (12)..(14): n is a, c, g, or t
  misc_feature (16)..(20): n is a, c, g, or t
  misc_feature (22)..(25): n is a, c, g, or t
  misc_feature (28)..(32): n is a, c, g, or t
  misc_feature (34)..(42): n is a, c, g, or t
  misc_feature (45)..(51): n is a, c, g, or t
  misc_feature (53)..(56): n is a, c, g, or t
  misc_feature (58)..(60): n is a, c, g, or t
  misc_feature (63)..(67): n is a, c, g, or t
  misc_feature (69)..(70): n is a, c, g, or t
  misc_feature (72)..(73): n is a, c, g, or t
  misc_feature (75)..(83): n is a, c, g, or t
  misc_feature (90)..(90): n is a, c, g, or t
  misc_feature (92)..(93): n is a, c, g, or t
  misc_feature (95)..(98): n is a, c, g, or t
  misc_feature (101)..(103): n is a, c, g, or t
  misc_feature (106)..(108): n is a, c, g, or t
  misc_feature (110)..(110): n is a, c, g, or t
  misc_feature (112)..(118): n is a, c, g, or t
  misc_feature (121)..(121): n is a, c, g, or t
  misc_feature (123)..(135): n is a, c, g, or t
  misc_feature (137)..(143): n is a, c, g, or t
  misc_feature (145)..(147): n is a, c, g, or t
  misc_feature (151)..(151): n is a, c, g, or t
  misc_feature (153)..(156): n is a, c, g, or t
  misc_feature (158)..(166): n is a, c, g, or t
  misc_feature (171)..(172): n is a, c, g, or t
  misc_feature (174)..(178): n is a, c, g, or t
  misc_feature (180)..(180): n is a, c, g, or t
  misc_feature (182)..(190): n is a, c, g, or t
  misc_feature (192)..(202): n is a, c, g, or t
  misc_feature (204)..(209): n is a, c, g, or t
  misc_feature (212)..(219): n is a, c, g, or t
  misc_feature (221)..(234): n is a, c, g, or t
  misc_feature (236)..(239): n is a, c, g, or t
  misc_feature (242)..(244): n is a, c, g, or t
  misc_feature (246)..(252): n is a, c, g, or t
  misc_feature (256)..(257): n is a, c, g, or t
  misc_feature (260)..(266): n is a, c, g, or t
  misc_feature (268)..(271): n is a, c, g, or t
  misc_feature (274)..(274): n is a, c, g, or t
  misc_feature (279)..(284): n is a, c, g, or t
  misc_feature (286)..(294): n is a, c, g, or t
  misc_feature (296)..(296): n is a, c, g, or t
  misc_feature (298)..(299): n is a, c, g, or t
  misc_feature (301)..(302): n is a, c, g, or t
  misc_feature (305)..(308): n is a, c, g, or t
  misc_feature (310)..(313): n is a, c, g, or t
  misc_feature (315)..(319): n is a, c, g, or t
  misc_feature (325)..(334): n is a, c, g, or t
  misc_feature (336)..(338): n is a, c, g, or t
  misc_feature (340)..(340): n is a, c, g, or t
  misc_feature (343)..(355): n is a, c, g, or t
  misc_feature (357)..(357): n is a, c, g, or t
  misc_feature (359)..(362): n is a, c, g, or t
  misc_feature (364)..(364): n is a, c, g, or t
  misc_feature (366)..(369): n is a, c, g, or t
  misc_feature (371)..(371): n is a, c, g, or t
  misc_feature (374)..(374): n is a, c, g, or t
  misc_feature (376)..(377): n is a, c, g, or t
  misc_feature (379)..(379): n is a, c, g, or t
  misc_feature (381)..(382): n is a, c, g, or t
  misc_feature (384)..(392): n is a, c, g, or t
  misc_feature (394)..(402): n is a, c, g, or t
  misc_feature (404)..(407): n is a, c, g, or t
  misc_feature (409)..(410): n is a, c, g, or t
  misc_feature (413)..(415): n is a, c, g, or t
  misc_feature (419)..(421): n is a, c, g, or t
  misc_feature (423)..(425): n is a, c, g, or t
  misc_feature (427)..(427): n is a, c, g, or t
  misc_feature (429)..(429): n is a, c, g, or t
  misc_feature (433)..(445): n is a, c, g, or t
  misc_feature (448)..(450): n is a, c, g, or t
  misc_feature (452)..(453): n is a, c, g, or t
  misc_feature (455)..(455): n is a, c, g, or t
  misc_feature (457)..(459): n is a, c, g, or t
  misc_feature (461)..(464): n is a, c, g, or t
  misc_feature (467)..(470): n is a, c, g, or t
  misc_feature (472)..(482): n is a, c, g, or t
  misc_feature (488)..(489): n is a, c, g, or t
  misc_feature (492)..(501): n is a, c, g, or t
  misc_feature (505)..(513): n is a, c, g, or t
  misc_feature (515)..(515): n is a, c, g, or t
  misc_feature (518)..(527): n is a, c, g, or t
  misc_feature (529)..(530): n is a, c, g, or t
  misc_feature (532)..(539): n is a, c, g, or t
  misc_feature (541)..(542): n is a, c, g, or t
  misc_feature (544)..(544): n is a, c, g, or t
  misc_feature (546)..(550): n is a, c, g, or t
  misc_feature (557)..(562): n is a, c, g, or t
  misc_feature (564)..(570): n is a, c, g, or t
  misc_feature (572)..(578): n is a, c, g, or t
  misc_feature (581)..(588): n is a, c, g, or t
  misc_feature (591)..(592): n is a, c, g, or t
  misc_feature (595)..(597): n is a, c, g, or t
  misc_feature (600)..(600): n is a, c, g, or t
  misc_feature (603)..(605): n is a, c, g, or t
  misc_feature (607)..(607): n is a, c, g, or t
  misc_feature (609)..(619): n is a, c, g, or t
  misc_feature (621)..(624): n is a, c, g, or t
  misc_feature (627)..(638): n is a, c, g, or t
  misc_feature (640)..(641): n is a, c, g, or t
  misc_feature (643)..(646): n is a, c, g, or t
  misc_feature (649)..(650): n is a, c, g, or t
  misc_feature (652)..(655): n is a, c, g, or t
  misc_feature (657)..(657): n is a, c, g, or t
  misc_feature (661)..(664): n is a, c, g, or t
  misc_feature (666)..(671): n is a, c, g, or t
  misc_feature (673)..(674): n is a, c, g, or t
  misc_feature (676)..(679): n is a, c, g, or t
  misc_feature (681)..(684): n is a, c, g, or t
  misc_feature (686)..(688): n is a, c, g, or t
  misc_feature (690)..(692): n is a, c, g, or t
  misc_feature (696)..(699): n is a, c, g, or t
  misc_feature (701)..(710): n is a, c, g, or t
  misc_feature (712)..(713): n is a, c, g, or t
  misc_feature (715)..(715): n is a, c, g, or t
  misc_feature (717)..(719): n is a, c, g, or t
  misc_feature (722)..(724): n is a, c, g, or t
  misc_feature (726)..(728): n is a, c, g, or t
  misc_feature (730)..(731): n is a, c, g, or t
  misc_feature (734)..(735): n is a, c, g, or t
  misc_feature (738)..(739): n is a, c, g, or t
  misc_feature (741)..(744): n is a, c, g, or t
  misc_feature (748)..(763): n is a, c, g, or t
  misc_feature (765)..(766): n is a, c, g, or t
  misc_feature (768)..(768): n is a, c, g, or t
  misc_feature (770)..(773): n is a, c, g, or t
  misc_feature (775)..(778): n is a, c, g, or t
  misc_feature (782)..(783): n is a, c, g, or t
  misc_feature (785)..(792): n is a, c, g, or t
  misc_feature (794)..(802): n is a, c, g, or t
  misc_feature (808)..(808): n is a, c, g, or t
  misc_feature (810)..(814): n is a, c, g, or t
  misc_feature (820)..(833): n is a, c, g, or t
  misc_feature (835)..(838): n is a, c, g, or t
  misc_feature (840)..(840): n is a, c, g, or t
  misc_feature (843)..(851): n is a, c, g, or t
  misc_feature (853)..(862): n is a, c, g, or t
  misc_feature (865)..(865): n is a, c, g, or t
  misc_feature (867)..(871): n is a, c, g, or t
  misc_feature (874)..(893): n is a, c, g, or t
  misc_feature (895)..(896): n is a, c, g, or t
  misc_feature (901)..(903): n is a, c, g, or t
  misc_feature (905)..(913): n is a, c, g, or t
  misc_feature (915)..(920): n is a, c, g, or t
  misc_feature (922)..(924): n is a, c, g, or t
  misc_feature (926)..(928): n is a, c, g, or t
  misc_feature (930)..(937): n is a, c, g, or t
  misc_feature (939)..(940): n is a, c, g, or t
  misc_feature (943)..(944): n is a, c, g, or t
  misc_feature (946)..(957): n is a, c, g, or t
  misc_feature (961)..(961): n is a, c, g, or t
  misc_feature (963)..(963): n is a, c, g, or t
  misc_feature (965)..(967): n is a, c, g, or t
  misc_feature (969)..(972): n is a, c, g, or t
  misc_feature (974)..(978): n is a, c, g, or t
  misc_feature (980)..(986): n is a, c, g, or t
  misc_feature (989)..(990): n is a, c, g, or t
  misc_feature (993)..(994): n is a, c, g, or t
  misc_feature (997)..(998): n is a, c, g, or t
  misc_feature (1000)..(1001): n is a, c, g, or t
  misc_feature (1004)..(1005): n is a, c, g, or t
  misc_feature (1008)..(1014): n is a, c, g, or t
  misc_feature (1016)..(1018): n is a, c, g, or t
  misc_feature (1020)..(1023): n is a, c, g, or t
  misc_feature (1028)..(1029): n is a, c, g, or t
  misc_feature (1031)..(1031): n is a, c, g, or t
  misc_feature (1034)..(1035): n is a, c, g, or t
  misc_feature (1037)..(1038): n is a, c, g, or t
  misc_feature (1041)..(1041): n is a, c, g, or t
  misc_feature (1043)..(1043): n is a, c, g, or t
  misc_feature (1047)..(1050): n is a, c, g, or t
  misc_feature (1053)..(1053): n is a, c, g, or t
  misc_feature (1565)..(1565): n is a, c, g, or t
  misc_feature (3284)..(3284): n is a, c, g, or t
nnnnnnnnnccnnncnnnnnannnnttnnnnnannnnnnnnngannnnnnngnnnnannnaannnnntnnannannnnnnnnnttttttntnngnnnnttnnnctnnncngnnnnnnnaangnnnnnnnnnnnnntnnnnnnnannnaaangnnnncnnnnnnnnnaaaanngnnnnnancnnnnnnnnngnnnnnnnnnnngnnnnnnttnnnnnnnntnnnnnnnnnnnnnntnnnnaannncnnnnnnntttnnagnnnnnnnannnnaanaaaannnnnntnnnnnnnnngnannannccnnnngnnnnannnnnaaaaannnnnnnnnngnnncnggnnnnnnnnnnnnncntnnnntncnnnngnaancnnancnngnnnnnnnnngnnnnnnnnngnnnntnnttnnnaaannngnnngngntttnnnnnnnnnnnnnaannngnncngnnncnnnnggnnnntnnnnnnnnnnnaaaaannaannnnnnnnnnaaannnnnnnnncnaannnnnnnnnncnncnnnnnnnnannantnnnnnaaaaaannnnnncnnnnnnnannnnnnnccnnnnnnnnttnnaannnttnaannnantnnnnnnnnnnngnnnnccnnnnnnnnnnnngnntnnnnccnntnnnncntttnnnnannnnnncnnannnnannnncnnngnnntttnnnntnnnnnnnnnnanncngnnnttnnngnnntnnttnnttnngnnnngggnnnnnnnnnnnnnnnngnnancnnnnannnntttnncnnnnnnnngnnnnnnnnnttcccngnnnnnaaaaannnnnnnnnnnnnncnnnngnaannnnnnnnntnnnnnnnnnnccnannnnnaannnnnnnnnnnnnnnnnnnngnnaaaannncnnnnnnnnngnnnnnntnnngnnnannnnnnnntnnttnncnnnnnnnnnnnntttncnannnannnngnnnnncnnnnnnnaannttnnttnnannaannttnnnnnnngnnngnnnnaaaannanttnnannaangntttnnnnttntatgaaatcatcttactataaatactttgctgcgcttttgttatttggttccaacggcatcgttgccagtaatatcaatctgcccagctacgaaatcgttctgctgcgtctattgcttggcagcctttttcttataactgtttttacggtttccagacaaaggtttactttttaccggaataagcacacttgcctttatcttttcatttcggcgtcagctatgggagcaagctggatgctgctttacgaagcctatcagcaggtcgggatcagcatagcatctttagcctattactgcggtccggtaatcgttatgattctttcaccttttctttttcgtgaaactctgacctggcctaaaatagctggttttttaactgttctggccgggatgtgcctagtgaacttacaggcgctggacgaaggtaaaactatttggggtcttttctgcggcttaatgtctgcgtttatgtatgcactgatggtaacagcaaataaaaaagccaaacctnaatccggtttggaaaattctttgctgcaacttgtcatcggctcttttatcgtcgtcgcatttgtcagtatgcagaaaaactttgttctgtcactgacaacgattgactggataccggttttactgctcggcttgcttaatacaggaatcggctgttatttatatttttcttctattacagacttgccagtccagaccgttgccatatgcggttatctggaaccactgtctgcagttgttttttctgtactctttttacatgaagtcctgttgcctttacaaatgctcggagccgtacttatacttggcggcgccatatttggagaatgcttcaatcctgaaaaacagcagtggctgcagtcaaaataaagctcaaaagcataataaaaaagcaagccgctagcggcttgcttttttattatcactatttaaatcaaatgctttactaaactaaaaatcactatttacatcttatacttaaaatcgcagtgcaccataacggctttccagcttatgcaggtgttcggtaagaactcccggctcaatataagcatattccaatatctgcagtgcattcggtgcataatccctgatagaagcaaaataaggttcccattcgatcgttcccagtcctacaggctgatggctgtctccgctgccatcgttatcatgcacatgtacagccaacagctttttctgcagccgtttcacggtttcaggaagattccagccattaacgtgggcatgtcccgtatccaaaagtgccagagcctgcggataacgttcaaacagtgccagatattcttcaaaatcaaaaagcagtgatccacagggacgcagacccacattttctataacaacttgaacgccgtagctttgtgccaggctgatcacttcagccaagcgctgatagaccagttctttaactgcggcaacctcaccatggtaaatttcattggtatgcacaactacaaattctgctttgatcttttgggcataggtaaaggtttgagcgtaggcttttaaataatattcatcactgctgtctgccagatttacagcaacacagggaccatggatagaaaatgttcttttttccttattattctgcgccagcggcagcaataccgtatcccaataatggtcggtcccgaattcataaaaaaattcgatattataggtcaacggcaaaccgctgagatattttttattgaaaccgccaaaagccagatcactaactgcccattgcatcagtaaaaacctcccctttttctatatagccaatattcctgccgcttgtcacatcaaacagactcacatcgtcccagctgaaacagatcccgctggaattttgtacatccgcattgcggtcacttactgtaacgctgatattctcaccactctcaagctgtaattcaacagtacgctgattacctgtattttctacataagttatacttccctgcacagcagcgtcctcgcttaaacggcaatgctcaggcctgatacccagcagcaggtctctgcgctgtccgatcacctgacgccacagctccggtaccggcagtacggccttgccgatacaaatacaatcacggttaaaacgtgctttgaggatattcattgacggggcgccaataaaaccggcaacaaatgtattagccgggtgacggtagatcgtatccggagcggctatctgctgcagttcgccatctttcancacaacgatacgatcggcgacagtcattgcctctacctgatcatgcgttacataaatcattgtcggtttatagatctcatgaatacgtaccagttctgtcctggcctgctgccgcagctgagcgtccaaattggacagcggttcatccagtaaaaagtagggtgattgctttacaagggcacggcataaggccactctctgtttctgcccgcctgaaagctgtttgggcttatagttttcatagcctcttaaattaagtatttctaaggcttcatcggctctttttttgatttccgcttccggaagcttttggatatgcaggccaaaggtgatattatcccagacagaaagatgcggaaacagcgcatagctttgaaaaaccatggcaatattacgttcaccgggagcaatatcattaactactctgcctcccattttcagctgaccgctggtaatatcttccaaaccagcgatcattcgcagcgtagtagttttgccgcagccggaaggccccagcaaaatcaggcgctcgccttcttttatttccagattcaaagacttgacgattttagcatcgccgtaagatttacagacgttttcaaatacaatactgttcatatattatcctttgacccccgattgcataaaggtattgagtataaatttttggcagacgagatataatgccagcggcggcagactggtcagagtagcga

SEQ ID NO: 405 - DNA, 4000 bp, Escherichia coli
  misc_feature (1)..(1): n is a, c, g, or t
  misc_feature (3)..(6): n is a, c, g, or t
  misc_feature (10)..(22): n is a, c, g, or t
  misc_feature (26)..(30): n is a, c, g, or t
  misc_feature (32)..(34): n is a, c, g, or t
  misc_feature (39)..(40): n is a, c, g, or t
  misc_feature (44)..(44): n is a, c, g, or t
  misc_feature (46)..(46): n is a, c, g, or t
  misc_feature (49)..(50): n is a, c, g, or t
  misc_feature (54)..(54): n is a, c, g, or t
  misc_feature (59)..(59): n is a, c, g, or t
  misc_feature (62)..(63): n is a, c, g, or t
  misc_feature (67)..(67): n is a, c, g, or t
  misc_feature (70)..(70): n is a, c, g, or t
  misc_feature (72)..(72): n is a, c, g, or t
  misc_feature (76)..(79): n is a, c, g, or t
  misc_feature (81)..(81): n is a, c, g, or t
  misc_feature (83)..(83): n is a, c, g, or t
  misc_feature (85)..(86): n is a, c, g, or t
  misc_feature (90)..(90): n is a, c, g, or t
  misc_feature (92)..(95): n is a, c, g, or t
  misc_feature (100)..(100): n is a, c, g, or t
  misc_feature (102)..(102): n is a, c, g, or t
  misc_feature (107)..(109): n is a, c, g, or t
  misc_feature (111)..(116): n is a, c, g, or t
  misc_feature (118)..(120): n is a, c, g, or t
  misc_feature (122)..(125): n is a, c, g, or t
  misc_feature (127)..(128): n is a, c, g, or t
  misc_feature (130)..(130): n is a, c, g, or t
  misc_feature (136)..(136): n is a, c, g, or t
  misc_feature (141)..(141): n is a, c, g, or t
  misc_feature (143)..(148): n is a, c, g, or t
  misc_feature (153)..(155): n is a, c, g, or t
  misc_feature (157)..(158): n is a, c, g, or t
  misc_feature (163)..(163): n is a, c, g, or t
  misc_feature (165)..(165): n is a, c, g, or t
  misc_feature (169)..(169): n is a, c, g, or t
  misc_feature (172)..(173): n is a, c, g, or t
  misc_feature (177)..(179): n is a, c, g, or t
  misc_feature (181)..(181): n is a, c, g, or t
  misc_feature (184)..(187): n is a, c, g, or t
  misc_feature (189)..(189): n is a, c, g, or t
  misc_feature (192)..(193): n is a, c, g, or t
  misc_feature (195)..(196): n is a, c, g, or t
  misc_feature (201)..(203): n is a, c, g, or t
  misc_feature (206)..(206): n is a, c, g, or t
  misc_feature (211)..(212): n is a, c, g, or t
  misc_feature (214)..(218): n is a, c, g, or t
  misc_feature (220)..(220): n is a, c, g, or t
  misc_feature (222)..(225): n is a, c, g, or t
  misc_feature (228)..(228): n is a, c, g, or t
  misc_feature (232)..(232): n is a, c, g, or t
  misc_feature (234)..(234): n is a, c, g, or t
  misc_feature (236)..(236): n is a, c, g, or t
  misc_feature (238)..(238): n is a, c, g, or t
  misc_feature (240)..(240): n is a, c, g, or t
  misc_feature (247)..(247): n is a, c, g, or t
  misc_feature (249)..(249): n is a, c, g, or t
  misc_feature (251)..(254): n is a, c, g, or t
  misc_feature (256)..(261): n is a, c, g, or t
  misc_feature (264)..(265): n is a, c, g, or t
  misc_feature (267)..(269): n is a, c, g, or t
  misc_feature (271)..(272): n is a, c, g, or t
  misc_feature (274)..(276): n is a, c, g, or t
  misc_feature (279)..(279): n is a, c, g, or t
  misc_feature (281)..(281): n is a, c, g, or t
  misc_feature (283)..(284): n is a, c, g, or t
  misc_feature (286)..(286): n is a, c, g, or t
  misc_feature (288)..(289): n is a, c, g, or t
  misc_feature (291)..(291): n is a, c, g, or t
  misc_feature (293)..(293): n is a, c, g, or t
  misc_feature (296)..(296): n is a, c, g, or t
  misc_feature (298)..(299): n is a, c, g, or t
  misc_feature (304)..(304): n is a, c, g, or t
  misc_feature (306)..(308): n is a, c, g, or t
  misc_feature (311)..(311): n is a, c, g, or t
  misc_feature (313)..(316): n is a, c, g, or t
  misc_feature (318)..(319): n is a, c, g, or t
  misc_feature (327)..(328): n is a, c, g, or t
  misc_feature (332)..(339): n is a, c, g, or t
  misc_feature (342)..(345): n is a, c, g, or t
  misc_feature (347)..(351): n is a, c, g, or t
  misc_feature (353)..(354): n is a, c, g, or t
  misc_feature (356)..(356): n is a, c, g, or t
  misc_feature (359)..(360): n is a, c, g, or t
  misc_feature (363)..(363): n is a, c, g, or t
  misc_feature (370)..(373): n is a, c, g, or t
  misc_feature (376)..(376): n is a, c, g, or t
  misc_feature (380)..(381): n is a, c, g, or t
  misc_feature (385)..(386): n is a, c, g, or t
  misc_feature (388)..(388): n is a, c, g, or t
  misc_feature (392)..(393): n is a, c, g, or t
  misc_feature (395)..(395): n is a, c, g, or t
  misc_feature (397)..(397): n is a, c, g, or t
  misc_feature (400)..(400): n is a, c, g, or t
  misc_feature (402)..(405): n is a, c, g, or t
  misc_feature (409)..(409): n is a, c, g, or t
  misc_feature (412)..(412): n is a, c, g, or t
  misc_feature (414)..(418): n is a, c, g, or t
  misc_feature (421)..(426): n is a, c, g, or t
  misc_feature (428)..(428): n is a, c, g, or t
  misc_feature (430)..(432): n is a, c, g, or t
  misc_feature (434)..(434): n is a, c, g, or t
  misc_feature (438)..(438): n is a, c, g, or t
  misc_feature (440)..(443): n is a, c, g, or t
  misc_feature (446)..(447): n is a, c, g, or t
  misc_feature (449)..(450): n is a, c, g, or t
  misc_feature (452)..(452): n is a, c, g, or t
  misc_feature (455)..(456): n is a, c, g, or t
  misc_feature (459)..(460): n is a, c, g, or t
  misc_feature (464)..(464): n is a, c, g, or t
  misc_feature (466)..(466): n is a, c, g, or t
  misc_feature (469)..(470): n is a, c, g, or t
  misc_feature (472)..(474): n is a, c, g, or t
  misc_feature (476)..(477): n is a, c, g, or t
  misc_feature (480)..(481): n is a, c, g, or t
  misc_feature (485)..(489): n is a, c, g, or t
  misc_feature (491)..(491): n is a, c, g, or t
  misc_feature (493)..(494): n is a, c, g, or t
  misc_feature (496)..(496): n is a, c, g, or t
  misc_feature (500)..(500): n is a, c, g, or t
  misc_feature (503)..(504): n is a, c, g, or t
  misc_feature (507)..(509): n is a, c, g, or t
  misc_feature (511)..(511): n is a, c, g, or t
  misc_feature (515)..(515): n is a, c, g, or t
  misc_feature (517)..(517): n is a, c, g, or t
  misc_feature (521)..(523): n is a, c, g, or t
  misc_feature (525)..(526): n is a, c, g, or t
  misc_feature (529)..(533): n is a, c, g, or t
  misc_feature (544)..(544): n is a, c, g, or t
  misc_feature (547)..(547): n is a, c, g, or t
  misc_feature (550)..(550): n is a, c, g, or t
  misc_feature (552)..(552): n is a, c, g, or t
  misc_feature (560)..(561): n is a, c, g, or t
  misc_feature (563)..(563): n is a, c, g, or t
  misc_feature (568)..(570): n is a, c, g, or t
  misc_feature (572)..(579): n is a, c, g, or t
  misc_feature (581)..(584): n is a, c, g, or t
  misc_feature (587)..(594): n is a, c, g, or t
  misc_feature (598)..(602): n is a, c, g, or t
  misc_feature (605)..(607): n is a, c, g, or t
  misc_feature (609)..(609): n is a, c, g, or t
  misc_feature (612)..(613): n is a, c, g, or t
  misc_feature (617)..(621): n is a, c, g, or t
  misc_feature (623)..(623): n is a, c, g, or t
  misc_feature (626)..(629): n is a, c, g, or t
  misc_feature (631)..(631): n is a, c, g, or t
  misc_feature (633)..(635): n is a, c, g, or t
  misc_feature (639)..(641): n is a, c, g, or t
  misc_feature (643)..(643): n is a, c, g, or t
  misc_feature (645)..(648): n is a, c, g, or t
  misc_feature (654)..(655): n is a, c, g, or t
  misc_feature (657)..(657): n is a, c, g, or t
  misc_feature (661)..(661): n is a, c, g, or t
  misc_feature (664)..(664): n is a, c, g, or t
  misc_feature (667)..(671): n is a, c, g, or t
  misc_feature (675)..(679): n is a, c, g, or t
  misc_feature (682)..(685): n is a, c, g, or t
  misc_feature (688)..(688): n is a, c, g, or t
  misc_feature (692)..(696): n is a, c, g, or t
  misc_feature (698)..(698): n is a, c, g, or t
  misc_feature (701)..(702): n is a, c, g, or t
  misc_feature (705)..(705): n is a, c, g, or t
  misc_feature (707)..(707): n is a, c, g, or t
  misc_feature (709)..(719): n is a, c, g, or t
  misc_feature (722)..(725): n is a, c, g, or t
  misc_feature (729)..(729): n is a, c, g, or t
  misc_feature (731)..(735): n is a, c, g, or t
  misc_feature (737)..(737): n is a, c, g, or t
  misc_feature (739)..(740): n is a, c, g, or t
  misc_feature (742)..(742): n is a, c, g, or t
  misc_feature (744)..(745): n is a, c, g, or t
  misc_feature (747)..(749): n is a, c, g, or t
  misc_feature (751)..(751): n is a, c, g, or t
  misc_feature (753)..(755): n is a, c, g, or t
  misc_feature (757)..(759): n is a, c, g, or t
  misc_feature (763)..(763): n is a, c, g, or t
  misc_feature (765)..(765): n is a, c, g, or t
  misc_feature (769)..(769): n is a, c, g, or t
  misc_feature (771)..(771): n is a, c, g, or t
  misc_feature (773)..(775): n is a, c, g, or t
  misc_feature (778)..(779): n is a, c, g, or t
  misc_feature (781)..(781): n is a, c, g, or t
  misc_feature (783)..(783): n is a, c, g, or t
  misc_feature (786)..(788): n is a, c, g, or t
  misc_feature (790)..(790): n is a, c, g, or t
  misc_feature (795)..(795): n is a, c, g, or t
  misc_feature (798)..(800): n is a, c, g, or t
  misc_feature (802)..(803): n is a, c, g, or t
  misc_feature (805)..(805): n is a, c, g, or t
  misc_feature (808)..(809): n is a, c, g, or t
  misc_feature (812)..(812): n is a, c, g, or t
  misc_feature (816)..(816): n is a, c, g, or t
  misc_feature (820)..(820): n is a, c, g, or t
  misc_feature (822)..(822): n is a, c, g, or t
  misc_feature (827)..(828): n is a, c, g, or t
  misc_feature (830)..(830): n is a, c, g, or t
  misc_feature (836)..(836): n is a, c, g, or t
  misc_feature (838)..(840): n is a, c, g, or t
  misc_feature (842)..(843): n is a, c, g, or t
  misc_feature (845)..(845): n is a, c, g, or t
  misc_feature (848)..(849): n is a, c, g, or t
  misc_feature (852)..(854): n is a, c, g, or t
  misc_feature (856)..(856): n is a, c, g, or t
  misc_feature (859)..(863): n is a, c, g, or t
  misc_feature (865)..(865): n is a, c, g, or t
  misc_feature (867)..(868): n is a, c, g, or t
  misc_feature (871)..(873): n is a, c, g, or t
  misc_feature (877)..(878): n is a, c, g, or t
  misc_feature (880)..(880): n is a, c, g, or t
  misc_feature (882)..(882): n is a, c, g, or t
  misc_feature (885)..(886): n is a, c, g, or t
  misc_feature (889)..(890): n is a, c, g, or t
  misc_feature (892)..(892): n is a, c, g, or t
  misc_feature (895)..(895): n is a, c, g, or t
  misc_feature (897)..(897): n is a, c, g, or t
  misc_feature (900)..(900): n is a, c, g, or t
  misc_feature (903)..(903): n is a, c, g, or t
  misc_feature (907)..(908): n is a, c, g, or t
  misc_feature (910)..(912): n is a, c, g, or t
  misc_feature (919)..(919): n is a, c, g, or t
  misc_feature (921)..(922): n is a, c, g, or t
  misc_feature (925)..(925): n is a, c, g, or t
  misc_feature (927)..(930): n is a, c, g, or t
  misc_feature (932)..(932): n is a, c, g, or t
  misc_feature (940)..(941): n is a, c, g, or t
  misc_feature (943)..(945): n is a, c, g, or t
  misc_feature (947)..(947): n is a, c, g, or t
  misc_feature (949)..(949): n is a, c, g, or t
  misc_feature (952)..(952): n is a, c, g, or t
  misc_feature (955)..(956): n is a, c, g, or t
  misc_feature (958)..(958): n is a, c, g, or t
  misc_feature (963)..(963): n is a, c, g, or t
  misc_feature (966)..(966): n is a, c, g, or t
  misc_feature (969)..(970): n is a, c, g, or t
  misc_feature (974)..(974): n is a, c, g, or t
  misc_feature (977)..(980): n is a, c, g, or t
  misc_feature (982)..(982): n is a, c, g, or t
  misc_feature (984)..(984): n is a, c, g, or t
  misc_feature (987)..(989): n is a, c, g, or t
  misc_feature (992)..(992): n is a, c, g, or t
  misc_feature (995)..(997): n is a, c, g, or t
  misc_feature (1002)..(1002): n is a, c, g, or t
  misc_feature (1007)..(1011): n is a, c, g, or t
  misc_feature (1013)..(1015): n is a, c, g, or t
  misc_feature (1021)..(1023): n is a, c, g, or t
  misc_feature (1026)..(1026): n is a, c, g, or t
  misc_feature (1028)..(1029): n is a, c, g, or t
  misc_feature (1034)..(1034): n is a, c, g, or t
  misc_feature (1036)..(1036): n is a, c, g, or t
  misc_feature (1038)..(1038): n is a, c, g, or t
  misc_feature (1041)..(1041): n is a, c, g, or t
  misc_feature (1048)..(1048): n is a, c, g, or t
  misc_feature (1058)..(1059): n is a, c, g, or t
  misc_feature (1063)..(1068): n is a, c, g, or t
  misc_feature (1071)..(1071): n is a, c, g, or t
  misc_feature (1073)..(1074): n is a, c, g, or t
  misc_feature (1076)..(1077): n is a, c, g, or t
  misc_feature (1080)..(1083): n is a, c, g, or t
  misc_feature (1085)..(1085): n is a, c, g, or t
  misc_feature (1088)..(1090): n is a, c, g, or t
  misc_feature (1092)..(1098): n is a, c, g, or t
  misc_feature (1100)..(1103): n is a, c, g, or t
  misc_feature (1112)..(1112): n is a, c, g, or t
  misc_feature (1379)..(1379): n is a, c, g, or t
  misc_feature (1922)..(1922): n is a, c, g, or t
  misc_feature (1936)..(1936): n is a, c, g, or t
  misc_feature (3103)..(3103): n is a, c, g, or t
  misc_feature (3222)..(3222): n is a, c, g, or t
  misc_feature (3390)..(3390): n is a, c, g, or t
  misc_feature (3402)..(3402): n is a, c, g, or t
  misc_feature (3567)..(3567): n is a, c, g, or t
  misc_feature (3570)..(3570): n is a, c, g, or t
  misc_feature (3609)..(3609): n is a, c, g, or t
  misc_feature (3777)..(3777): n is a, c, g, or t
ngnnnntcannnnnnnnnnnnntatnnnnntnnnaattnnaatntngannacancattnaannatanagnantaannnntnangnngagngnnnnaagcngnagcgnnnannnnnngnnngnnnncnntnaatccnttatncnnnnnnggaannncnnaagtngnaaangcnnaacnnncnaannnnanagnnannaaaannnaanaaagnnannnnnanannnnagnattntncntntnggtacantntnnnnannnnnnatnnannnanncnnnacncnannanannantnatnannttatnannnatnannnnannattgatgnnttannnnnnnntgnnnntnnnnngnntnccnnagncaccaannnncanatcnnctanntncaanncntnaancnnnnacancanannnnnaannnnnncntnnnancttnannnngtnntnntntanngtnncgangnatnncnnntnnccnnttgnnnnngntnnangggngtnnagnnncnaagntngaannncnnacnnnnnaactacgcaanaanatncnacgcaacnngntacannncnnnnnnnnannnntcnnnnnnnnagtnnnnnatnnnantgnngaannnnngnatnnnngngnnngcgnnntngnnnntatcgnncntgcnacnatnnnnnattnnnnnatnnnnaanaaannnnnanatnncantntnnnnnnnnnnnttnnnnatgnannnnnanannanannannnangnnntnnncaangntganancnnnaanntngnatnnnanccttntgnnntnnanccnncanccanaaanangaaanncngaaaangnnnanncnttnnagnnngncannnnncnanntannnagcnnananacnntcnnanttntnaanttntaanntnnntaagtancnnggnannnnanaccatgcnncnnnantncanaanngnaaaanggnaanngganaannnnananggnnnaangcnnnagtanagaannnnnannnataaannnaananngaaanananatnaagtatnaagtattaannattnnnnnngtncnnannctnnnnantannncnnnnnnnannnntaatacttnatacttaatacttgaaaaatacttaatacttatttcaagaatccttgctggcgaagtactttcaatagattttcggacataaattcgttatctttctttgtgtaacgcacgtccgtaaagacttgagccaatgtttcttttttattttcttcgataaactgcttgttttccggcaatgattctttgtaggcatagagtttatctatttcttccggtgtatagtcgtgatatttttcatcgtgcacggcagcttccaaaggcaaacgntctacttgtgcgggaataccatccggatagcctaccgttattgtggtgagagggaataccagttcggggagttggagggtatcaataatcatttgaggattataagtggtagttcccaaataacaaatgccgagtcctgcttcttccgccagcgtacaaaaagtctgcgcaacaagcaaagtatccatagacgcattcataaaagacattaaattatcgtagcccggcactgctttccgctgttcacaccatttgctgaaacgacggaaatcagcacaaaaagtcaatacgaccggagcattttttaccatcggctgattgaaatgagcaggcgaaagtttctccttcatttccgcatcgcgagtcacaatcacactataaagttgcatcccacccatcgtagaagcacggaaagaggtttcaagcaaatcatttaacaaactcggatttatatctttaggcagatatttccggatagttcttctgttctttacggtttcaaacatatcttttttttgcaaagatataaaaagaaaaaaatantccaccacactagnggaatagaatagttttctttttggagaactttaacctttgaacaaaattcaattctaactgtttatcaaatacttagcataaacaaatggaaaacttgcaacctgttaataaattaattcatttttattttgatagatgaaaaaacattcttagctttgcgcctacatttgttaacgataagtaaacttctacatattacttattaaaaacgagatttaacacaaattgaatcgtggaaaaacagatttattcttacgacgaagcctatgaagaatctttacgatattttcaaggcgacgagcttgctgcaagggtttgggtaaacaaatacgcagtaaaggattctttcggtaatatctatgaaaaatccccggaagacatgcattggagaattgcaaatgaagtggcacgcgtagaatcgaagtatccgaatgcgttgacagcaaaagaactgtatgatttactggatcacttcaagtacatcgtcccccaaggtagcccgatgacaggaatcggtaacgactaccaggttgcttcactatccaactgcttcgttatcggagtggacggtgcagccgactcttatggcgctatcatcaaaatcgacgaagaacaggtacaactaatgaaaagacgcggtggtgtaggtcatgacttatcacacatccgtccgaaaggttctcccgttaaaaactcggcgttgacttctaccggtcttgttccgttcatggaacgatattcgaattccactcgtgaagtagctcaagacggacgtcgcggtgcattgatgttgagcgtgtctatcaagcatccggattcggaagcattcattgatgccaagatgaccgaaggtaaagtgaccggagcaaacgtttctgtcaagttggacgacgctttcatgcaggctgccgtagacgaaaagccgtatgtacagcaatatcctatcgactctgcccaacctacattcaccaaggaaatcgacgcttctaccttgtggaagaaaatcgttcacaatgcatggaaatcggcagaaccgggcgttttgttctgggatacgattatccgtgaatctgtgcctgattgttatgcagacctgggttacagaacggtatctaccaacccatgcggagaaattcctctatgtccttacgattcttgccgcttantggctatcaatctatattcttatgtggtaaatccgttcaaaccggatgcttattttgatttcgacctgttccaaaaacacgtggctctcgctcaacggatcatggacgatattatcganctcgaactagagaagatcgaacgtatcatgaccaagattgacgaagatccggaaaacgaagaagtgaaacatgcggaacgtgcactttgggagaaaatctacaagaagagcggacaaggtcgtcgtaccggcgtaggtatcactgcagaaggtgatatgcttgctgcnttaggattgcgntacggaacggaagaagcaacggaattctctgaaaaagtacacaagacagtagctctcggtgcctatcgttcttcagtggaaatggccaaagaacgcggtgccttcgaaatatacaatagcgaacgtgaacagaacaatccgttcatccaacgcctggcagcagcnganccgaaactgtatgaggacatgaagaaatatggtcgccgnaacattgcctgcctgacgattgctccaaccggaacgaccagtttgatgacgcagaccacttcgggtatcgagcctgtattcctgcctgtttacaaacgtagaagaaaggtgaacccgaacgatacgaatgtgcatgtagactttgtagacgaaacaggggacgcattngaagaatacatcgtattccatcataaatttgttacctggatggaagctaacggatacgatccggccagacgttacacccaggaagagattgacgaactggttgccaaatctccttattacaaagcgacttctaacgatgtcgactggttgatgaaggtgaagatgcagggaagaatccagaaatgggtagaccactctatcagcgtaaccatcaatctgccga

SEQ ID NO: 406 - DNA, 4000 bp, Escherichia coli
  misc_feature (38)..(38): n is a, c, g, or t
  misc_feature (59)..(59): n is a, c, g, or t
  misc_feature (891)..(891): n is a, c, g, or t
  misc_feature (1137)..(1137): n is a, c, g, or t
  misc_feature (1304)..(1304): n is a, c, g, or t
  misc_feature (2323)..(2323): n is a, c, g, or t
  misc_feature (2408)..(2408): n is a, c, g, or t
  misc_feature (2568)..(2568): n is a, c, g, or t
  misc_feature (2776)..(2776): n is a, c, g, or t
ttcccggcgcgccgggcgccacgcgcacgctgatgcanctcctgccgcgcacgctctcngcgctgctgatcctcgtcgtcggctggctcgcggcgaacttcctcgggcagggcgtgctgatcgcggcggtcaacgcgggcctgccggaggcgcgcgtcctggcccgcgcggcccggtggctcgtcctgctgttcgcgttcgcgacggcgctcaccgagatcgggatcggccgcgacatggtcgtggtcgccttcggcatcctcttcggcgggctcgtgctcgccctggcggtcgcgttcggcctcggcggccgccacctcgcgcgccatatcctggagcgcgggcggcgccgcgagcgcgaaacccgcgaccgcgagaccatcagccacatctgagacccgtgccgatcccgccgggtcacgtgcgaagattttcgtatggacgagggtctggcgtgagccgctgcgggttggcggtcctcgggctggtgctcgccctctggccccgagccgccgcgggagagaccgccgacgcgcccgtcgagctgatcgacgtgaccgtccagtcccggagtgacggcgtcagggtcgacgtcaagacgtcgggcccgccacggtaccggagcgagctgatggacgggccgtaccgtctcgtcctcgatttcgaggacaccctgtatcactggacggtgggacccctggcgatcgacatcgatccggtcaaaacgatccgcggtgggcagttccgcgcgaacgtcgcccggctggtgatcgagctgacgcgcgaggttccctacagggtcgaggcccatccgcggggggtgcgtgtcctcctgggcgccgggagggcgtcggccccgcctggcgaggcgcgggtcccgcccgccgaggngccgaagccggcgcccccgtggcgtctcgccgggaccgtgttgcgcgccgagggctcgaccgcctacatcgccgacgccgcgacgagccaggtcaagagctaccgtgtcggtgacgcgatcggtgacggcgtcgtcgagacgatcgaggagcgccacgtcgtgctagggaccccgcgcggcccggtcgagctgcgcatggaggagctgcccccggcgcgcgtgccgcgacgataggagcggggccncgcgcgagcgtggcatactgcagtacgcggaggatctggatgtgagcggagtgctcatcacgttcgagggagtcgaggggtcgggcaagacgacccagatgcgacgcctcggacgctggctgcgcgccgaggggcaccgggtcgagtgcacccgcgagcccgacggnacgcgcctcgggctcgccgtgcgccgcctgttcgagcgccccggcgtccggcccgagccgctcgtcgaggtcttcctgttcatggccgcgcgccaccagcacgtcgccgagaaggtccgcccgtggctcgcgcgcggccgcgtcgtgctctccgaccgctacgccgacgcgaccgtggcgtaccagggctacgggcgcgggatcgaccccgacctgatccgtgagctgaacgtccgggcgaccggcggcgtcctgcccgacctcacgctgctcttcgacgtggatcccgccgaggggttccggcggattggcgcccggcggcgcgaccacttcgagcgcgaggcgctcgccttccaccggcgcgtgcgccggggctacctggagatcctgcgcgcggagcccaagcgcgtgcggcttgtgcgcgcggccgagcccccggccgtggtcgccgcggaggtacgcgcgctcgtcgaggacttcctgcgtggcgcttgacgcgatccgcgaccagccgcgtgccgtggccctgctccggcgggcgctcgcgaccgaccgcgtcgcgcacgcgtacgcgttcgtcgggcccacgggcgcgggacggatgacgacggcgctcgcgttcgcccaggcgttgctttgtaccgggggccgcgaggccggtgcagtcggtgggtggcctgagccgaggcgcgaggccggcgttccgccctgcgggcggtgccagggctgccggctcgccgccgcccgcgtgcatcccgatctccacctgatcgcgccgacgccgcccgagacgaacccgaagggcgcccgcgcgatccgcatcgacgcgatccgcgggctggagcgtcaggcggcgctccgacccgtgatggcgccccggaagctgttcgtcctcgacgaggccgagcgcatgacgggcgaggcgccccaggcgtttctcaagaccctcgaggagccgcccgccgcgacggtgctgatcctcgtcctgccgcgggcgcgggcgctgcccgccaccgtcntctcgcgctgtcaggtcgtgcgcttcgagccgcgcagcgcggaggccgccgtggtggcgcgcgctcgggcgcgcacgctcctcgncgaggtgagggccgagggcgccgacctcatgttcagccgaaccgagcgactcgaccgcgagacggcggaggggctcgtcgacgcctactggctcctctgccgtgacctcgtcctggcgaaggcgggagctcccgcctcgctgctggccgacgccgcgcgngccgtggagctcgcccgcgaggccgaggcgtggacgctcgacgagctgctccagtcgatcgacctctgccggcaggcgcggcaggcgctcgcgcgcaacgtggcgccccggctgaccctcgaggtgatcctgagccgcctcgccctgcgggcggcatgaggcgagacccatggaatccgagccagagtacctgatcggggttcggctncacgagagcgcgcaggccgacgactacaagctggtcggcctggacgcccacgtgggcgacctcgtggtcgtcgagacggggcaggacaccgcggtcggcgaggtccggcggcccagacgtgcgctcccggaggccaagcgcgaccgcctgtaccgccgcgtggtgcgcctcgcgatgccggcggaggcccgcgagtaccgcgagcgccgcgagcgcgagcagcgggcgatcgtcacctgccagcagctggcgcgcggacgagggctctcgatgaaggtggtggacgtcgagatgcaaccggcggcgcgccgtgtcaccgtctacttcaacgccgaggaccgcgtcgacttccgcgagctggtccgcgacatcgcgcgcgagttccactcgcggatcgagatgcgccaggtcggcgcgcgcgacacgaccaagctcatggacggcatcgggccgtgcggccgccagctctgctgctcgtcctacctccggcgcttcgagccgatctccgtgaggatggcgaaggcccaggacatgccgctcaccgacaaccggctgctgggcaactgcggacggctgaagtgctgtctcctctacgagttctcgacctaccaggagctccggtcgcgcctgccacgggtcaacacgccgtgccaggcctcgtgcggcggcgggggctgcatggcgggcaaggtgacgtcgatccgcgtgctcaagcagacggtggtggtcggcttccccgatgggacggaggcggaagtgccgctcgaccagctcacctgggaggggcggccccacatccaggcccagctcgaggactcgtgaccgaccgcgcccgcgtcttctacctcacgacgccgatctactacgtcaacgaccgcccccacctcggccacgcctacacgacgatcgcggccgacacgatggcgcgctaccaccggctcgcgggcgacgacgtctggctcctcaccggcaccgacgagcacggcgacaagatcgcgcaagccgcggccaaggcgggcgtgacgccgcaggcgctggccgatcgcaactccgccgcgttccgcgagacctggaacgcgcttggcatcgcgaacgacgatttcatccgcacgacggagccgcgccacacgaaggtcgtccaggcgatcctccagacgctctgggaggcgggcgagatctatctgggcaactacggcggccagtactgcttcgggtgcgagcgct

SEQ ID NO: 407 - DNA, 4000 bp, Escherichia coli
ccggaattcgctgacagcctgtaaaatgtattggtattttcccagcagcagcaggatgaaggcgcctgaaattcccggaagaatcatcgcgcagatggcaacagctcccgaaagcatgataaaccaccagtcgttgggcgtttgcgtcggggaggcgatcgtgatccagaatgccagcgcggtgccgacaagcagtcccagcagcgaagtgaggttccacttccgaatatcccgggcgacgaaagccgccgaagcgacgatcagtccgaaaaagaaggaccagatttcgatcgggtgatgcgccagcaggtaagtcatcaaccgtgccagcgaaaagatggcgataccgatacccagcagtacggagaagagaaagctgccgttgatgtggcgccagaatttcctgaattcgaaccggccgagcaatttcaacgcagtcggattgaaacttttgatcgactcgatcagttcgctgtaaattcccgaaataaaggcgatcgtcccgcccgatactcccgggacaacatccgccattcccattgcgcagcctttcagcgccaacagcacgtatctgaacataatccgctctaataaaaagttaggcaattcatctttcaatgtaccttttgacaattccgagaggtgtctattcgctgttcccggttgtatcggtaatgctcctgcccataaattccttcccggaagggacttaaggcgctttactcccaaagaggtacactaaagtatataatcacgaaaagttatctcgttcgtcgaaaacacgacgtttcgcaaaaacggcattataataacatcgcatgggtattgccgtttccggcgatgttttgcttgtgcaaagatagtatatgcgggaaacatcgcaagattttttcgggataaaaccctgaaaaaatccatcccgaacgaagatttaataattcgttaataataccgttcgaggattccgcctccgacgacccgttcccctcggtacaaaacgacgggctgcccggcggccggggcccacgcgggatcctccagttcgatccgaatccccgaagcggcagggaagaccgctgcgtatccctcggggttgcggccgatgccccggatcaccgcacggatatcgcgggcaccgaatacctcgtcgctctctaccaggcgacattccccgacttccagcgtacgatgcaacaacagcttctcttctccggctacgatccggtttgccgccgtgtcgatagcgaccaccgcccagcccggcggcaggtcgaggccctttttctggccgatggtgtagagggccgccccgtcgtgcgtgccgagccgatgtccggcagagtcgatgatggggccgggccggagcgcttccgttttatcccggcttcgcaggaagtcgcggcacgggcgtccctcgagaaaacagacgcccatactctcccgacggtcggcgagttcttcgacgatatttcgtttgatgaccgttcccatcggagtcagcacccgatcgaggacctcctgcggcaagtcccacaggtagtaggactggtccttgcggttgtcggccgcacgggtgacgtatcgtttgccgcctgcggaggtaatgcggaaatagtgtcccgtagcgatgtagcgaatccccagtgcgtcggcctctgccgcaagacagggccatttgatccgactgttgcagcgcgtgcacggagccggggtacgcccccggaagtaactgtcggtaaaatagtccaccacctcccgttcgaaccgctcccgcaccgaccgcattcgccagggaatcccgagtgccccggcacgcagacgcgccttttccaacaatgcggaatcgcctctcatgtcgagcgtcagagccgttacatgatatccggccgcctgcaacaatccgacggcggcgaagctgtctattccgccgctgaaacccaacaatacccaattatccttcataaaactcctgtcttcatgagaaccggctgccgaaatttcggcagccggttctgtcaagcatattcttccggcttcgggtgttcttcttcgaagaattccggtttttcccgtttgatgaacccgatcacctcttccaagccttcgaggaatttggaaaaatcctctttgtaaaggaatattttatgccggtcgtaactgaccgttccatccggcgccgttttcttccggctctccgtaatggtaagaaaataatcgttcgcacgcgtagcgcgcacgtccagaaaataggtccgccggccggcttttacgactttcgacaggatctgttcgccgaaatcttctccgtccgtgcggaaggtattcagagcagccatacaaggtaatattttgagggttattcgtttgttccatacgtaaatataaaacaaatttcgttttcctgcaaattcttgcccgtgattatatatctttgggcgtgcagcgactcaaacccctttcgggaacgggattcgggcaggccgaattataaactcaatattacgagtcgtgaatacgcgactctcggaaataacgtgatgcaactgcttattgccgctcatgctgcgcttccaggagtggcagcccctctgcctcccagtttttcagcaaattgagcgcccggatgaagtcggcatcatcccttgcgtgcaatatccgcagcagagcttcccggtcgaaaagccgctctgccagcaatgctttgagcaggcgcctggtccccgcttcgacatcggaatcttccgccggaggtgttacgccctgttccagtcccagtccgatcaactcctcatacatttcatcgggaacttcgaaccgctcctcgaacgatgcgaactccggataatcccgttccagggctgcccgggtgcggtccaggtagtgctgcataaattcaggaaagatatttttccgcagcagggcgttcagataagatgcctgcaccgtatcctgtattacgcacacgtcgggcgctatgcctccaccgccgtaaaccgtccggcccgtgcggagtgtccggtaggccggcgacggaatcgtgtcgggcagcgagtgagttcggtaagccgtgcgatccccgcctttgacgtaaggacgttgaatttcccggcccgaaggcgtatgatagcgggcgatgaccagacgcaaagccgacccgtccggaagcagatattgccgctgcaccaatccttttccgaagctgcggcgcccgacgattatcgcgcggtcccagtcctgcagcgctccgctcacgatttcgctggccgatgccgaccgttcgtcgatcagtacgacaagccgcccttcggccggaaataccggattccgacgggcggaatggacgacggacgggacgctgcggccttcggtcgaaacgatccgcgagcctttgggcagaaaaaagccggacaaagcgatcgcctgatccaacagtcctccgccattgccccgaagatcgagaatcagctccttcggacgatccagttcttcgtaggcccgctgcacttcccgcatggtggtctgaccgaaacggatcagtctgatgtatcctaccgcagaatcgacccggtaggccagttcgacggaggggaccggaatttcccgtcggacgatttcgtatagaattggcagacgaattcctcgtcgaatcactaggatttttactttcgatccggcatctccccgcatggcggagatgagctcggaggccggaatctctttcacggcacgtccgtccacccggacgatccggtcgtcgggacggatgcccgcttcttcggcggcccctcccgacaggagggaggttacgaccagcgaatcacggatccattgggtctgaatgcctattcctccgaacttaccccgatagaggctccagaattcagccatctccgcagccgaggcatattcggtatggggatcgagttgctgtaccatgctgcggatcgcctcctcgaccagcggcgccatatcgaccgaatcgacatacatcttacggata

SEQ ID NO: 408 - DNA, 4000 bp, Escherichia coli
  misc_feature (563)..(563): n is a, c, g, or t
  misc_feature (567)..(567): n is a, c, g, or t
  misc_feature (1010)..(1010): n is a, c, g, or t
  misc_feature (1870)..(1870): n is a, c, g, or t
  misc_feature (1987)..(1987): n is a, c, g, or t
  misc_feature (1990)..(1990): n is a, c, g, or t
  misc_feature (2504)..(2504): n is a, c, g, or t
  misc_feature (2761)..(2761): n is a, c, g, or t
  misc_feature (2930)..(2930): n is a, c, g, or t
  misc_feature (3034)..(3034): n is a, c, g, or t
  misc_feature (3211)..(3211): n is a, c, g, or t
  misc_feature (3276)..(3276): n is a, c, g, or t
  misc_feature (3295)..(3297): n is a, c, g, or t
  misc_feature (3300)..(3301): n is a, c, g, or t
  misc_feature (3305)..(3307): n is a, c, g, or t
  misc_feature (3310)..(3312): n is a, c, g, or t
  misc_feature (3314)..(3318): n is a, c, g, or t
  misc_feature (3320)..(3320): n is a, c, g, or t
  misc_feature (3322)..(3323): n is a, c, g, or t
  misc_feature (3327)..(3327): n is a, c, g, or t
  misc_feature (3329)..(3330): n is a, c, g, or t
  misc_feature (3332)..(3332): n is a, c, g, or t
  misc_feature (3335)..(3336): n is a, c, g, or t
  misc_feature (3339)..(3339): n is a, c, g, or t
  misc_feature (3342)..(3346): n is a, c, g, or t
  misc_feature (3348)..(3350): n is a, c, g, or t
  misc_feature (3356)..(3356): n is a, c, g, or t
  misc_feature (3359)..(3360): n is a, c, g, or t
  misc_feature (3366)..(3366): n is a, c, g, or t
  misc_feature (3368)..(3368): n is a, c, g, or t
  misc_feature (3370)..(3373): n is a, c, g, or t
  misc_feature (3375)..(3375): n is a, c, g, or t
  misc_feature (3377)..(3378): n is a, c, g, or t
  misc_feature (3380)..(3380): n is a, c, g, or t
  misc_feature (3384)..(3386): n is a, c, g, or t
  misc_feature (3388)..(3390): n is a, c, g, or t
  misc_feature (3392)..(3392): n is a, c, g, or t
  misc_feature (3394)..(3394): n is a, c, g, or t
  misc_feature (3396)..(3396): n is a, c, g, or t
  misc_feature (3399)..(3400): n is a, c, g, or t
  misc_feature (3402)..(3402): n is a, c, g, or t
  misc_feature (3404)..(3404): n is a, c, g, or t
  misc_feature (3407)..(3407): n is a, c, g, or t
  misc_feature (3409)..(3409): n is a, c, g, or t
  misc_feature (3411)..(3411): n is a, c, g, or t
  misc_feature (3417)..(3420): n is a, c, g, or t
  misc_feature (3424)..(3424): n is a, c, g, or t
  misc_feature (3427)..(3429): n is a, c, g, or t
  misc_feature (3431)..(3431): n is a, c, g, or t
  misc_feature (3433)..(3435): n is a, c, g, or t
  misc_feature (3437)..(3438): n is a, c, g, or t
  misc_feature (3440)..(3440): n is a, c, g, or t
  misc_feature (3442)..(3442): n is a, c, g, or t
  misc_feature (3444)..(3444): n is a, c, g, or t
  misc_feature (3447)..(3451): n is a, c, g, or t
  misc_feature (3453)..(3454): n is a, c, g, or t
  misc_feature (3457)..(3457): n is a, c, g, or t
  misc_feature (3459)..(3459): n is a, c, g, or t
  misc_feature (3462)..(3462): n is a, c, g, or t
  misc_feature (3468)..(3469): n is a, c, g, or t
  misc_feature (3472)..(3473): n is a, c, g, or t
  misc_feature (3476)..(3476): n is a, c, g, or t
  misc_feature (3479)..(3479): n is a, c, g, or t
  misc_feature (3483)..(3483): n is a, c, g, or t
  misc_feature (3485)..(3485): n is a, c, g, or t
  misc_feature (3487)..(3487): n is a, c, g, or t
  misc_feature (3489)..(3489): n is a, c, g, or t
  misc_feature (3491)..(3491): n is a, c, g, or t
  misc_feature (3493)..(3493): n is a, c, g, or t
  misc_feature (3495)..(3495): n is a, c, g, or t
  misc_feature (3501)..(3502): n is a, c, g, or t
  misc_feature (3504)..(3505): n is a, c, g, or t
  misc_feature (3508)..(3508): n is a, c, g, or t
  misc_feature (3511)..(3511): n is a, c, g, or t
  misc_feature (3515)..(3515): n is a, c, g, or t
  misc_feature (3517)..(3518): n is a, c, g, or t
  misc_feature (3520)..(3521): n is a, c, g, or t
  misc_feature (3523)..(3523): n is a, c, g, or t
  misc_feature (3525)..(3527): n is a, c, g, or t
  misc_feature (3530)..(3530): n is a, c, g, or t
  misc_feature (3532)..(3533): n is a, c, g, or t
  misc_feature (3536)..(3536): n is a, c, g, or t
  misc_feature (3538)..(3538): n is a, c, g, or t
  misc_feature (3540)..(3543): n is a, c, g, or t
  misc_feature (3547)..(3547): n is a, c, g, or t
  misc_feature (3549)..(3551): n is a, c, g, or t
  misc_feature (3556)..(3557): n is a, c, g, or t
  misc_feature (3559)..(3560): n is a, c, g, or t
  misc_feature (3562)..(3562): n is a, c, g, or t
  misc_feature (3564)..(3566): n is a, c, g, or t
  misc_feature (3569)..(3569): n is a, c, g, or t
  misc_feature (3571)..(3575): n is a, c, g, or t
  misc_feature (3577)..(3577): n is a, c, g, or t
  misc_feature (3584)..(3584): n is a, c, g, or t
  misc_feature (3586)..(3586): n is a, c, g, or t
  misc_feature (3588)..(3588): n is a, c, g, or t
  misc_feature (3592)..(3592): n is a, c, g, or t
  misc_feature (3594)..(3594): n is a, c, g, or t
  misc_feature (3596)..(3599): n is a, c, g, or t
  misc_feature (3601)..(3602): n is a, c, g, or t
  misc_feature (3604)..(3604): n is a, c, g, or t
  misc_feature (3606)..(3606): n is a, c, g, or t
  misc_feature (3608)..(3610): n is a, c, g, or t
  misc_feature (3613)..(3614): n is a, c, g, or t
  misc_feature (3618)..(3627): n is a, c, g, or t
  misc_feature (3632)..(3634): n is a, c, g, or t
  misc_feature (3637)..(3640): n is a, c, g, or t
  misc_feature (3645)..(3645): n is a, c, g, or t
  misc_feature (3647)..(3647): n is a, c, g, or t
  misc_feature (3649)..(3652): n is a, c, g, or t
  misc_feature (3655)..(3655): n is a, c, g, or t
  misc_feature (3658)..(3660): n is a, c, g, or t
  misc_feature (3664)..(3664): n is a, c, g, or t
  misc_feature (3670)..(3673): n is a, c, g, or t
  misc_feature (3675)..(3676): n is a, c, g, or t
  misc_feature (3678)..(3679): n is a, c, g, or t
  misc_feature (3683)..(3685): n is a, c, g, or t
  misc_feature (3687)..(3687): n is a, c, g, or t
  misc_feature (3691)..(3692): n is a, c, g, or t
  misc_feature (3694)..(3696): n is a, c, g, or t
  misc_feature (3698)..(3700): n is a, c, g, or t
  misc_feature (3703)..(3703): n is a, c, g, or t
  misc_feature (3706)..(3707): n is a, c, g, or t
  misc_feature (3709)..(3709): n is a, c, g, or t
  misc_feature (3711)..(3714): n is a, c, g, or t
  misc_feature (3718)..(3718): n is a, c, g, or t
  misc_feature (3722)..(3722): n is a, c, g, or t
  misc_feature (3724)..(3724): n is a, c, g, or t
  misc_feature (3726)..(3728): n is a, c, g, or t
  misc_feature (3731)..(3732): n is a, c, g, or t
  misc_feature (3734)..(3735): n is a, c, g, or t
  misc_feature (3738)..(3740): n is a, c, g, or t
  misc_feature (3742)..(3743): n is a, c, g, or t
  misc_feature (3745)..(3745): n is a, c, g, or t
  misc_feature (3747)..(3749): n is a, c, g, or t
  misc_feature (3752)..(3752): n is a, c, g, or t
  misc_feature (3754)..(3754): n is a, c, g, or t
  misc_feature (3756)..(3756): n is a, c, g, or t
  misc_feature (3758)..(3758): n is a, c, g, or t
  misc_feature (3760)..(3760): n is a, c, g, or t
  misc_feature (3762)..(3762): n is a, c, g, or t
  misc_feature (3766)..(3767): n is a, c, g, or t
  misc_feature (3770)..(3770): n is a, c, g, or t
  misc_feature (3772)..(3773): n is a, c, g, or t
  misc_feature (3776)..(3777): n is a, c, g, or t
  misc_feature (3780)..(3784): n is a, c, g, or t
  misc_feature (3787)..(3790): n is a, c, g, or t
  misc_feature (3792)..(3794): n is a, c, g, or t
  misc_feature (3796)..(3797): n is a, c, g, or t
  misc_feature (3800)..(3800): n is a, c, g, or t
  misc_feature (3803)..(3803): n is a, c, g, or t
  misc_feature (3806)..(3806): n is a, c, g, or t
  misc_feature (3809)..(3809): n is a, c, g, or t
  misc_feature (3812)..(3815): n is a, c, g, or t
  misc_feature (3817)..(3817): n is a, c, g, or t
  misc_feature (3819)..(3820): n is a, c, g, or t
  misc_feature (3824)..(3824): n is a, c, g, or t
  misc_feature (3826)..(3827): n is a, c, g, or t
  misc_feature (3830)..(3830): n is a, c, g, or t
  misc_feature (3832)..(3832): n is a, c, g, or t
  misc_feature (3835)..(3835): n is a, c, g, or t
  misc_feature (3839)..(3839): n is a, c, g, or t
  misc_feature (3841)..(3842): n is a, c, g, or t
  misc_feature (3844)..(3844): n is a, c, g, or t
  misc_feature (3848)..(3849): n is a, c, g, or t
  misc_feature (3854)..(3854): n is a, c, g, or t
  misc_feature (3856)..(3856): n is a, c, g, or t
  misc_feature (3859)..(3861): n is a, c, g, or t
  misc_feature (3865)..(3866): n is a, c, g, or t
  misc_feature (3868)..(3868): n is a, c, g, or t
  misc_feature (3874)..(3875): n is a, c, g, or t
  misc_feature (3877)..(3877): n is a, c, g, or t
  misc_feature (3881)..(3885): n is a, c, g, or t
  misc_feature (3887)..(3889): n is a, c, g, or t
  misc_feature (3891)..(3891): n is a, c, g, or t
  misc_feature (3893)..(3893): n is a, c, g, or t
  misc_feature (3895)..(3896): n is a, c, g, or t
  misc_feature (3898)..(3899): n is a, c, g, or t
  misc_feature (3902)..(3905): n is a, c, g, or t
  misc_feature (3907)..(3909): n is a, c, g, or t
  misc_feature (3914)..(3914): n is a, c, g, or t
  misc_feature (3916)..(3916): n is a, c, g, or t
  misc_feature (3918)..(3921): n is a, c, g, or t
  misc_feature (3924)..(3924): n is a, c, g, or t
  misc_feature (3927)..(3934): n is a, c, g, or t
  misc_feature (3937)..(3938): n is a, c, g, or t
  misc_feature (3940)..(3942): n is a, c, g, or t
  misc_feature (3945)..(3945): n is a, c, g, or t
  misc_feature (3951)..(3951): n is a, c, g, or t
  misc_feature (3953)..(3954): n is a, c, g, or t
  misc_feature (3956)..(3959): n is a, c, g, or t
  misc_feature (3961)..(3961): n is a, c, g, or t
  misc_feature (3964)..(3965): n is a, c, g, or t
  misc_feature (3967)..(3967): n is a, c, g, or t
  misc_feature (3970)..(3970): n is a, c, g, or t
  misc_feature (3975)..(3975): n is a, c, g, or t
  misc_feature (3977)..(3979): n is a, c, g, or t
  misc_feature (3982)..(3988): n is a, c, g, or t
  misc_feature (3993)..(3996): n is a, c, g, or t
  misc_feature (4000)..(4000): n is a, c, g, or t
ttcaattcccttttcatcgagctctttctttatttcttctattttgtcgtcaataatagcaaaggcaaaccaggatgattttcctgttccaggctctttctgagaccaccaaccccggttttgacatacttccttccatcgttcggcgttttcacgtcttgcggagataaatccgtcaatcttccttaactgttcaatcccaaccgccgcttgcatttccatcggcctgacgttgtatccagggaaaagaaattcatacgcagatggctttacattaaagacattcttttccggtaagtgccttgtccatccgtgagaacgaagacataaaagcatctggtaataatattcgtcattcgtggtaattatcccgccctccattgtctggatatggtgagaaaaaaacatcgaatgtgaagacatcaacccgaaattaccggttctgaaattactataaaccgcgcccatggactcgcaattgtcttccagaatattcgtggaagggaaccagcgataatcattggggtttcccagcagatttaccgccaggatcaaatccccgncttnataagcttctttcagcgattcaatgtcatagttcagcgtgtctttgtctatgtcaacgaacttcaacgtccatccgtattgctgaaacggagaataggacgtagaccaggaaaccgccggtacaatgaccgtgccggctttattcctgaacgtataggccgcaaccatgagaaggtttgcagaggaaccggaattgaccatgacggcatacttggtccccacccacgccgcgtacgcctcctcgaattcctttaccttcggtcccatcgtgaacatccccgaatccaggacgttcaagatggcttctctttcttccaacccccaggtactaatcgccaatggatgcttctttacaggcttttgcaatttcagactccatcatctctttgattaaagattcaaaggaatactcgggtttccaccccaatgctctgatcctggangaatctccaatcaggctgcctacatcggcggggcggatataatctttatcttgttttacaaaaccagaccaatcttcaataccgatatatctgaatgcctccgtcagaagttctctgactgatctggattctccggtagcaacgatataatcatccggtccaggttgctgcatcatgagccacatggcttctacaaaatctttcgcatgcccccaatctctcctggcatccagattcccgagaaaaatatatctctgtagcccgaattttattctggctactgcctgacagactttcctggttacgaaatccactcctcgaatcggagattcatgattgaataaaattccattacaggcatacagtccataagcctcacggtaattaaccgtcagccaatatgctgcaagcttcgatattccataaggacttcgtggatgaaatggagatttttcattctgcggcggcggtgtcgatccgaataattcggatgttgacgcctgatagaatcgggatccggtggatttcgcaccttccagtacgttcaatgtaccgatagcgtttatctcgaacgtcgttttcgggattttgaacgactctccaacatgcgacattgccgccagatggtaaacttcatccggttgaatatcttgaatcagatcttttatagttggatcggtgacatcgccttcatgtacgataacaccggatggaatgactttggattgcgcggttcttctcgttaaaccatgaaccctataacctttattcaaaagtaattcagataaatatctgccatcctggccggtcagtccggtaataaatgccttcaaacggcctccttacgctggcgcacgccnaggggctttaaatgaacctcaagctcgacggatattgccaacttcctctcgtcggcgcgaaaagaagacttttcgataacgaagaattccgataatttatttatccaccattccggnggntggaccgtaaggtgtgcatttctcccgtccggcaacttcttcgcggccggagaacaactaatagtgaaaaacccggctttaatcatcttggacttgatatgtctcaacacatcatccagacaatccggctctatatgctcaagaacatccgtacacaccaccaaatcagcaggttccggttcgttggaaaactcagtaatagcggggtcgtatttcttgtttacgagaagttttcctttaccgcatccataatcgaggacatcttcatatccgagtgctttgataacggcattcctgaattttgagccggatccgaaggatctatatttttcgtgcatcctgataagttgttttttatacttatcgctaagcagcatgaggcataactcttggtttcgcgcccttctttttagcgcccttggcgtgaaagaaatattcccccaacacagacctttcaacgacatccaggtccgccaatgacattacccggtcttttggaatcttgaaaaacggngatagattgttgccagatatgccggatttctctctggcaaagtcgaatgcttcacaatcatgccaccgtttatgatccttgaaccatccatgccggataaacccgatgtaatatttcaggaattccctgaatttctcattctcggtgtcgaaaccgataaacccggtctcagtatgaaatccttccctccccaaatacgaaagacccttaccgtcgaacagttttatcaaccaatcgtcggtaacgggttttctganaatactgtctgcatcgagccaaataactttgccattataatctttcagcacatcccattgtgccaacatctttcgtgagaatctccatacatcgtagttataattatatttaccgtttaccattccatgacatacgggcgtattcttgatgttttgatagaaattcatngccccttcgatgtcgaagaagtttctaacttctatttttccattgtctgtgtctatgtctatcggtttctcgacatagacaataattttactcggccaattttnaataaccgactccagcatcttcctggcgtaagtctcgtacccggtactggaaaatgtggtgattgctaatgtggtatttgctaacaaatattcaccttataaacatttgaaagaacgttcaacaaccgattttcattttcccagtcgtggttcgggtacggacccgctccggttctngggattgcaaaatttctgtcaaatggaatctttggattcaataatgaatcgaaccctaaaagacnaatctctttcggggaccannnctnnatcnnnatnnnannnnngncnntccngnngnaannatnagnnnnncnnncccccnttnncctgancntnnnntncnngnaatnnnannncncnancgnnancnttncngntttttnnnntttngtnnngncnnnannancngnttnnnnntnnaantnccntttttnnggnnaanccnaatntncntngncntngatttnnannaanttncccntnncnncngnnnaancnnaancngnnnnggtncnnnaaccnnanncngnnnttncnnnnncngaaccgnancntttnancnnnncnncntnannnaannaatnnnnnnnnnntccannnccnnnnttttnangnnnnggnccnnncccnacgatnnnnanntnnatgnnntncttnntnnngnnncgntcnntntnnnnatcncatnantnnnttnntnnacnnnanngntnnnatnananancnantcanntantnntcnnatnnnnncannnntnnnannatntcnctnaantannnntncnnttcnannatntnttntatnanntnatgnnttgtntnatnnnaagnntngtttannantgcnnnnncnnncncnanngnnggnnnnannnttggngnannnnctngannnnnnnnttnnannncantcaacntnncnnnnanagnntncanttctnannnaannnnnnntatannnntcan

SEQ ID NO: 409 - DNA, 4000 bp, Escherichia coli
  misc_feature (4)..(6): n is a, c, g, or t
  misc_feature (9)..(12): n is a, c, g, or t
  misc_feature (14)..(14): n is a, c, g, or t
  misc_feature (17)..(18): n is a, c, g, or t
  misc_feature (21)..(24): n is a, c, g, or t
  misc_feature (26)..(27): n is a, c, g, or t
  misc_feature (30)..(30): n is a, c, g, or t
  misc_feature (33)..(33): n is a, c, g, or t
  misc_feature (35)..(35): n is a, c, g, or t
  misc_feature (38)..(47): n is a, c, g, or t
  misc_feature (49)..(52): n is a, c, g, or t
  misc_feature (54)..(54): n is a, c, g, or t
  misc_feature (56)..(56): n is a, c, g, or t
  misc_feature (58)..(77): n is a, c, g, or t
  misc_feature (79)..(79): n is a, c, g, or t
  misc_feature (81)..(82): n is a, c, g, or t
  misc_feature (86)..(86): n is a, c, g, or t
  misc_feature (91)..(92): n is a, c, g, or t
  misc_feature (94)..(99): n is a, c, g, or t
  misc_feature (101)..(106): n is a, c, g, or t
  misc_feature (108)..(108): n is a, c, g, or t
  misc_feature (110)..(112): n is a, c, g, or t
  misc_feature (114)..(120): n is a, c, g, or t
  misc_feature (122)..(122): n is a, c, g, or t
  misc_feature (124)..(126): n is a, c, g, or t
  misc_feature (128)..(130): n is a, c, g, or t
  misc_feature (134)..(142): n is a, c, g, or t
  misc_feature (145)..(146): n is a, c, g, or t
  misc_feature (152)..(152): n is a, c, g, or t
  misc_feature (155)..(155): n is a, c, g, or t
  misc_feature (159)..(162): n is a, c, g, or t
  misc_feature (168)..(168): n is a, c, g, or t
  misc_feature (170)..(170): n is a, c, g, or t
  misc_feature (177)..(178): n is a, c, g, or t
  misc_feature (180)..(180): n is a, c, g, or t
  misc_feature (186)..(186): n is a, c, g, or t
  misc_feature (188)..(188): n is a, c, g, or t
  misc_feature (190)..(190): n is a, c, g, or t
  misc_feature (192)..(193): n is a, c, g, or t
  misc_feature (195)..(198): n is a, c, g, or t
  misc_feature (200)..(200): n is a, c, g, or t
  misc_feature (203)..(205): n is a, c, g, or t
  misc_feature (208)..(209): n is a, c, g, or t
  misc_feature (211)..(216): n is a, c, g, or t
  misc_feature (219)..(219): n is a, c, g, or t
  misc_feature (225)..(225): n is a, c, g, or t
  misc_feature (230)..(231): n is a, c, g, or t
  misc_feature (233)..(235): n is a, c, g, or t
  misc_feature (237)..(237): n is a, c, g, or t
  misc_feature (240)..(240): n is a, c, g, or t
  misc_feature (242)..(242): n is a, c, g, or t
  misc_feature (244)..(244): n is a, c, g, or t
  misc_feature (246)..(248): n is a, c, g, or t
  misc_feature (250)..(253): n is a, c, g, or t
  misc_feature (256)..(260): n is a, c, g, or t
  misc_feature (262)..(262): n is a, c, g, or t
  misc_feature (266)..(266): n is a, c, g, or t
  misc_feature (269)..(269): n is a, c, g, or t
  misc_feature (272)..(275): n is a, c, g, or t
  misc_feature (278)..(278): n is a, c, g, or t
  misc_feature (280)..(280): n is a, c, g, or t
  misc_feature (284)..(284): n is a, c, g, or t
  misc_feature (286)..(286): n is a, c, g, or t
  misc_feature (288)..(292): n is a, c, g, or t
  misc_feature (294)..(295): n is a, c, g, or t
  misc_feature (297)..(297): n is a, c, g, or t
  misc_feature (299)..(299): n is a, c, g, or t
  misc_feature (301)..(302): n is a, c, g, or t
  misc_feature (306)..(306): n is a, c, g, or t
  misc_feature (309)..(311): n is a, c, g, or t
  misc_feature (313)..(314): n is a, c, g, or t
  misc_feature (317)..(325): n is a, c, g, or t
  misc_feature (327)..(334): n is a, c, g, or t
  misc_feature (336)..(339): n is a, c, g, or t
  misc_feature (342)..(342): n is a, c, g, or t
  misc_feature (354)..(355): n is a, c, g, or t
  misc_feature (357)..(357): n is a, c, g, or t
  misc_feature (360)..(360): n is a, c, g, or t
  misc_feature (362)..(363): n is a, c, g, or t
  misc_feature (365)..(365): n is a, c, g, or t
  misc_feature (367)..(371): n is a, c, g, or t
  misc_feature (373)..(375): n is a, c, g, or t
  misc_feature (381)..(381): n is a, c, g, or t
  misc_feature (385)..(387): n is a, c, g, or t
  misc_feature (389)..(390): n is a, c, g, or t
  misc_feature (392)..(393): n is a, c, g, or t
  misc_feature (395)..(403): n is a, c, g, or t
  misc_feature (406)..(407): n is a, c, g, or t
  misc_feature (409)..(409): n is a, c, g, or t
  misc_feature (411)..(411): n is a, c, g, or t
  misc_feature (413)..(415): n is a, c, g, or t
  misc_feature (417)..(417): n is a, c, g, or t
  misc_feature (419)..(419): n is a, c, g, or t
  misc_feature (422)..(423): n is a, c, g, or t
  misc_feature (425)..(425): n is a, c, g, or t
  misc_feature (427)..(432): n is a, c, g, or t
  misc_feature (434)..(435): n is a, c, g, or t
  misc_feature (438)..(438): n is a, c, g, or t
  misc_feature (441)..(441): n is a, c, g, or t
  misc_feature (444)..(444): n is a, c, g, or t
  misc_feature (446)..(450): n is a, c, g, or t
  misc_feature (452)..(454): n is a, c, g, or t
  misc_feature (458)..(458): n is a, c, g, or t
  misc_feature (460)..(462): n is a, c, g, or t
  misc_feature (464)..(464): n is a, c, g, or t
  misc_feature (466)..(467): n is a, c, g, or t
  misc_feature (469)..(470): n is a, c, g, or t
  misc_feature (477)..(478): n is a, c, g, or t
  misc_feature (484)..(484): n is a, c, g, or t
  misc_feature (491)..(492): n is a, c, g, or t
  misc_feature (496)..(496): n is a, c, g, or t
  misc_feature (500)..(504): n is a, c, g, or t
  misc_feature (506)..(506): n is a, c, g, or t
  misc_feature (509)..(509): n is a, c, g, or t
  misc_feature (512)..(514): n is a, c, g, or t
  misc_feature (516)..(517): n is a, c, g, or t
  misc_feature (521)..(522): n is a, c, g, or t
  misc_feature (524)..(524): n is a, c, g, or t
  misc_feature (534)..(534): n is a, c, g, or t
  misc_feature (536)..(536): n is a, c, g, or t
  misc_feature (541)..(541): n is a, c, g, or t
  misc_feature (543)..(545): n is a, c, g, or t
  misc_feature (549)..(552): n is a, c, g, or t
  misc_feature (555)..(555): n is a, c, g, or t
  misc_feature (558)..(558): n is a, c, g, or t
  misc_feature (560)..(560): n is a, c, g, or t
  misc_feature (571)..(571): n is a, c, g, or t
  misc_feature (574)..(574): n is a, c, g, or t
  misc_feature (579)..(580): n is a, c, g, or t
  misc_feature (590)..(590): n is a, c, g, or t
  misc_feature (600)..(600): n is a, c, g, or t
  misc_feature (636)..(636): n is a, c, g, or t
  misc_feature (714)..(714): n is a, c, g, or t
  misc_feature (780)..(780): n is a, c, g, or t
  misc_feature (795)..(795): n is a, c, g, or t
  misc_feature (840)..(840): n is a, c, g, or t
  misc_feature (870)..(870): n is a, c, g, or t
  misc_feature (978)..(978): n is a, c, g, or t
  misc_feature (993)..(994): n is a, c, g, or t
  misc_feature (1023)..(1023): n is a, c, g, or t
  misc_feature (1080)..(1080): n is a, c, g, or t
  misc_feature (1089)..(1089): n is a, c, g, or t
  misc_feature (1179)..(1179): n is a, c, g, or t
  misc_feature (1200)..(1200): n is a, c, g, or t
  misc_feature (1206)..(1206): n is a, c, g, or t
  misc_feature (1208)..(1208): n is a, c, g, or t
  misc_feature (1220)..(1220): n is a, c, g, or t
  misc_feature (1224)..(1224): n is a, c, g, or t
  misc_feature (1233)..(1233): n is a, c, g, or t
  misc_feature (1245)..(1245): n is a, c, g, or t
  misc_feature (1248)..(1248): n is a, c, g, or t
  misc_feature (1254)..(1254): n is a, c, g, or t
  misc_feature (1260)..(1261): n is a, c, g, or t
  misc_feature (1278)..(1278): n is a, c, g, or t
  misc_feature (1284)..(1284): n is a, c, g, or t
  misc_feature (1311)..(1311): n is a, c, g, or t
  misc_feature (1313)..(1313): n is a, c, g, or t
  misc_feature (1326)..(1326): n is a, c, g, or t
  misc_feature (1332)..(1332): n is a, c, g, or t
  misc_feature (1335)..(1335): n is a, c, g, or t
  misc_feature (1338)..(1338): n is a, c, g, or t
  misc_feature (1341)..(1341): n is a, c, g, or t
  misc_feature (1347)..(1347): n is a, c, g, or t
  misc_feature (1353)..(1353): n is a, c, g, or t
  misc_feature (1356)..(1356): n is a, c, g, or t
  misc_feature (1358)..(1359): n is a, c, g, or t
  misc_feature (1362)..(1362): n is a, c, g, or t
  misc_feature (1371)..(1371): n is a, c, g, or t
  misc_feature (1374)..(1374): n is a, c, g, or t
  misc_feature (1377)..(1377): n is a, c, g, or t
  misc_feature (1380)..(1380): n is a, c, g, or t
  misc_feature (1386)..(1386): n is a, c, g, or t
  misc_feature (1389)..(1389): n is a, c, g, or t
  misc_feature (1391)..(1392): n is a, c, g, or t
  misc_feature (1395)..(1395): n is a, c, g, or t
  misc_feature (1398)..(1399): n is a, c, g, or t
  misc_feature (1404)..(1404): n is a, c, g, or t
  misc_feature (1416)..(1416): n is a, c, g, or t
  misc_feature (1428)..(1428): n is a, c, g, or t
  misc_feature (1431)..(1431): n is a, c, g, or t
  misc_feature (1440)..(1440): n is a, c, g, or t
  misc_feature (1443)..(1443): n is a, c, g, or t
  misc_feature (1446)..(1446): n is a, c, g, or t
  misc_feature (1449)..(1449): n is a, c, g, or t
  misc_feature (1461)..(1461): n is a, c, g, or t
  misc_feature (1467)..(1467): n is a, c, g, or t
  misc_feature (1473)..(1473): n is a, c, g, or t
  misc_feature (1476)..(1476): n is a, c, g, or t
  misc_feature (1479)..(1479): n is a, c, g, or t
  misc_feature (1485)..(1485): n is a, c, g, or t
  misc_feature (1497)..(1497): n is a, c, g, or t
  misc_feature (1506)..(1506): n is a, c, g, or t
  misc_feature (1509)..(1509): n is a, c, g, or t
  misc_feature (1514)..(1514): n is a, c, g, or t
  misc_feature (1519)..(1519): n is a, c, g, or t
  misc_feature (1521)..(1521): n is a, c, g, or t
  misc_feature (1524)..(1525): n is a, c, g, or t
  misc_feature (1527)..(1527): n is a, c, g, or t
  misc_feature (1529)..(1529): n is a, c, g, or t
  misc_feature (1549)..(1549): n is a, c, g, or t
  misc_feature (1553)..(1553): n is a, c, g, or t
  misc_feature (1563)..(1563): n is a, c, g, or t
  misc_feature (1575)..(1575): n is a, c, g, or t
  misc_feature (1578)..(1578): n is a, c, g, or t
  misc_feature (1586)..(1586): n is a, c, g, or t
  misc_feature (1632)..(1632): n is a, c, g, or t
  misc_feature (1635)..(1635): n is a, c, g, or t
  misc_feature (1664)..(1665): n is a, c, g, or t
  misc_feature (1668)..(1668): n is a, c, g, or t
  misc_feature (1680)..(1680): n is a, c, g, or t
  misc_feature (1697)..(1697): n is a, c, g, or t
  misc_feature (1707)..(1707): n is a, c, g, or t
  misc_feature (1710)..(1710): n is a, c, g, or t
  misc_feature (1722)..(1722): n is a, c, g, or t
  misc_feature (1734)..(1734): n is a, c, g, or t
  misc_feature (1752)..(1752): n is a, c, g, or t
  misc_feature (1758)..(1758): n is a, c, g, or t
  misc_feature (1764)..(1764): n is a, c, g, or t
  misc_feature (1791)..(1791): n is a, c, g, or t
  misc_feature (1795)..(1795): n is a, c, g, or t
  misc_feature (1797)..(1797): n is a, c, g, or t
  misc_feature (1827)..(1827): n is a, c, g, or t
  misc_feature (1878)..(1878): n is a, c, g, or t
  misc_feature (1881)..(1881): n is a, c, g, or t
  misc_feature (1936)..(1937): n is a, c, g, or t
  misc_feature (1941)..(1942): n is a, c, g, or t
  misc_feature (1964)..(1964): n is a, c, g, or t
  misc_feature (1971)..(1971): n is a, c, g, or t
  misc_feature (1983)..(1983): n is a, c, g, or t
  misc_feature (1985)..(1985): n is a, c, g, or t
  misc_feature (1989)..(1989): n is a, c, g, or t
  misc_feature (1991)..(1992): n is a, c, g, or t
  misc_feature (1995)..(1995): n is a, c, g, or t
  misc_feature (2008)..(2009): n is a, c, g, or t
  misc_feature (2016)..(2016): n is a, c, g, or t
  misc_feature (2029)..(2031): n is a, c, g, or t
  misc_feature (2042)..(2042): n is a, c, g, or t
  misc_feature (3753)..(3753): n is a, c, g, or t
aagnnnaannnntntanntcnnnnannttnatntnatnnnnnnnnnntnnnntntntnnnnnnnnnnnnnnnnnnnnangnncttnctgcnnannnnnnannnnnngntnnncnnnnnnntntnnntnnncagnnnnnnnnngcnnatattntcngttnnnnagcttnanttcttcnntngtattntntngnntnnnnanggnnnacnntnnnnnnttngcttcnataanncnnngnagnancntnnncnnnnatnnnnngncttnctngannnnatnantatnantnnnnncnnantntnncttntcnnnannatnnnnnnnnntnnnnnnnngnnnntantttttgataatnntnccncnncntnnnnntnnntgttgntggnnnannanntnnnnnnnnnttnncnantnnngnancannancnnnnnntnngcngtngtnannnnnannncctntnnntntnntnnttccganncgacancaacgannaagncatnnnnntnacnttnnntnntatnntnttcgttgttntntttgntnnnactnnnnatntcntnacaaagataantcnaatannggataatctntgaaactgantgatacttttatagttggttaaacttgttcatggcntttgccttaatatcatccgctatgtcaatgtaaggcttcatggctttatagtcactgtgccccgtccatttcattacnacctgtgccggaataccgagagccagcgcattacagatgaatgtccttcttcctgcatgggtactnagtaatgcgtatttnggtgtgacttcatctatacgttcatttcctttgtagtaggtttcncgtacaggctcgttgatttctgccagttcncccagttctttcagataatcattcatcttctgattgctgatgacgggcagtgccatgtggttctcaaaatggatgtccttgtatttttcaagtatggctttgctgtanttgttcagttcaatnntcagactgtctgccgttttgactgtggtnacttcgatatggtcggacttcacatcgcttcttttcaggttacgaacatctgaatancgcagactngtaaagcaacagaacaggaaaacatcccggacacgttccagatattgtttgtctttgggtatctgatagtctttcagcctgttcaattcntcccaagtcaggaagattacntttttngnggtggttttcantttnggtttgaangtatcgtatgcnatnttctgntgatgnnctttcttgaagctccancgcagnaaccatttgaggaatcccatttgtttncngatggtgctgttnctcatntcnttnttntcacgnaggaanttnanntantcgttcaanccnaantcntcgaantantnnaangtnncatcntccttgaactcnttgaggtggttnttnactgctgcnaanttntcntaggtggatgcngtccanttattntgnttnccgcantcttttacaaantcatcgaanacntcccnaaaantnatnngngnttcttcctgctgttcttcgntggnatctttcatncgcaggttgaangcntcctttanttgttgggtagttggcatggcttcctgtacctcaaattccttgaanacnttttgaatttcggcatagtatttcagcanntcngcattgatttcngatgcactttgctttantttgttggtncanccgttctttacncgctgcttgtcngcatcccatttggctacntcaatncggtancccgttgtaaactcgatgcgttggctngcananatgacacgcatacggatgggtacgttctcnacgattggcacaccgttctttttccggctctccaatgcaaaaatgatgttncgnttgatattcataattgggtgcgtttgaaattctacacccaaatatacacccaatnnttgnnatagcaaaagacatttagaaanatttagntttactctatantntaantnntanttgattatcagtnntttgcanttttatgatattnnntgaaagtatangttcgagagcctgtctctccgcgaaagtagaaaagttaaagttgtagattcttgaatttgaacgattcaagaatttttctttttctagtattttccttcatcttttcaaggagcttatgttaaattggaatccggtaatttgatttatgaagacaatttcgatatatgattcgttgcttgttttagggcgtggaataggacaagtcatgtttcagaataatgcgttgtccggtttgttaatgttggtcggaatttttctgaactcgtggcagttgggagtattagcggtaggcggtaatataataagcacgttggcggcttgtatctcaggttatggacgtgacgatataaagaatggactgtatggttttaacggcacattgataggtatagcagtcggagttttcatgcagctgtctttgtggtctttgctgctcatggcggtagcttcatgtttttctacttggatagtacggcttttcagccggcagcattcacttcccggatttactgctcctttcattttttctgtgtggatattattgggaatctgtacttggataacgccggatttattgctggtttccgaaacggtatctgatactgtgcgggaggttgattacgttcaggctttttgtttaggtattggtcaggtcatgtttcaagaaaatttattgaccggactgttctttttggctggtattggggttaattcatggactggaactttttatactgcgctggggacacttcttcctgttctttttgctgtattttgggggatagatccggaaatgttgaatatgggattgatgggctataatggtgtattgtgtgctttggctttaggaggcaaaacttggaaaagctttgtatgggctttatgttcagtcttgctgtccgttgtattgcagtttgcagggatcaagttgggaattactactctgactgcaccttttgtactatctgtatggatgataatgataatgcagaaagtggtgaatacaaaaggtgaataatagacagtatccgtagttcaggcagattgattttataatggatgtaaaacaatctaattgggatattattatggatctaaattgattgacgcaaaggctggaaaagtatagcttacgctcaatgaatcatttatgaagggttcctttcaagatccttcatgacaacacattgaaaaacaatatattgtgtaattatgaaggatttgaaggatttcccggtatctttttatatttataggttttatgataactccaatcccagtgcttcttttaatttcagcagattcgggtttttcttgctcatcatctggaaacgttccacatggctgtaagcacggatgttctcggtaggggcactgacacgtaccgtcatggtgattttccggttgtgcagtcgttcgcgtaaatgattctgaaccgatggtatcaattgtaccatatatttttccaccatatcattgtctactgtcacttcaaaagtcgtgtcattcaacaaatgcggatgcatgttcatcattcgtgcggagttagccttctcttccttgggcagggcggctgcaaattcacgccagtaatagtccagatctttttcattgaaaatataatcttcgtatgtggcatcgttttggacagcggtgcttgccgcttttgcttcttgcttttccgcagcttgctgttcgtgcaaaggacgncgcagggatataccgagtgagcccgccttgaacaccgggatttttttctcttctctggtctgaggcagcgggcttggacggcttgcgttcatactgccggctgtacttgtaccctgtggttgaggaacggcggttgctgcggtctgtgcagcggcagctttagcctgaggctgtggctgcgtggcggctgtggaagccgcttgctgcgtaaataggggttttaatatcttcttagggccacgcccac

SEQ ID NO: 410 - DNA, 4000 bp, Escherichia coli
  misc_feature (468)..(469): n is a, c, g, or t
  misc_feature (472)..(475): n is a, c, g, or t
  misc_feature (478)..(484): n is a, c, g, or t
  misc_feature (486)..(486): n is a, c, g, or t
  misc_feature (488)..(489): n is a, c, g, or t
  misc_feature (491)..(493): n is a, c, g, or t
  misc_feature (495)..(495): n is a, c, g, or t
  misc_feature (499)..(499): n is a, c, g, or t
  misc_feature (501)..(503): n is a, c, g, or t
  misc_feature (584)..(584): n is a, c, g, or t
  misc_feature (709)..(709): n is a, c, g, or t
gccgacgccgccttcgtcggcgaccgactgctgcacctccacgacctgctcgtccgttgggtgcagctgcctgcggtgctgcgcgacggcggtccggcacgtttcgagcgcacaccggagtcgctgcgggcgttcatcggctccatgcgcgtgggcgctcgcgagcgggcccggccgctggccgaccggctcgcggcgctgttcccggcgacgaagaccgtgctcgacgtcggaggcgggccgggcacgcaggcgcttgcctttcgggaacacggctggcaggtgaccgtgctcgacttccccgaagtgatcgacctcatggcaggcgacctcgcgagggccggcatcgccgccatcaagggtgacgcgacgcagggcatccccgcccagggcttcgacctggtctactgcggcaacctcttccactcgatgtcgcctgcggaatgcgcgctggtcgtggagagcgcnnccnnnnccnnnnnnncngnngnnncnttgncnnncacgacttcttgcgcggcacgggcctgccctcgtcgctcttcgccgtgaacatgctcgcggcgacgagcgccggtgacgtntacggtgaggaggactaccgtcgctggtgcgagggcgccgggctgcgggacttcgccgtgcacgaggtggccgggcaatcgcagcggctgctgacggccgacaagcgctagcacacagaccctgnacaggcgactgaccttaggctggccgttgttccgcggtgaacaccagctccgcgatcagcgccgccgccgcctcctgcatcgccgggatggcgtgcgagtaggtgtcgagggtgatcgcgatggtcgcgtgcccgaggcgctctgagacgaccttggggtgcacgccggcctgcagtgccaaggtggcgtgcgtgtgcctgaggtcgtgcaagcggatctgcggcagcatcgactgcttcaccgcctgccggaagtagcgcgagacgctctcggggtcgagcgcggcgccgttctcctgcgtgaagacgaggccggtctcgacccacgcctcgtcccagtcccgctgctcctcgagctggcgtgccgcctgacccttcaagacctcagcggtgcccgggtcgagggcgatgacgcgccgccccttgacggtcttcggctcgctgacgatgacctcgcggccacaggggatgagagcgcgacgcactgagaggcgcccggcctcgaggtcgacgtcactccagcgcaggccgatggcctcgcctctgcgcatgccggtcatggcgatcgtgtgccaagggggggagaggcggtcgtccctcacggcgttgaggaacgccttgagttgctccttggtccaggtccgcatctccttggtgccgtcgcccttcttgcgcggcgggtcggccgcgtcgagggggttacgcgagagctggccccagcgcaccgcgtccttgcaagccttgtgcaagcaggcgcggacatgatggatcgtcatcggggagaggcccttcttgccgtctttgcggccgctctcggcgagcttcgcgtacagggcgttcacctgagagcccgtgagcttctggagcttcacggcgccgatgtgcggcacgatgtgacactcgacgtgctgcacgtaggagttgtaggtcgagggcctgatcgtcgctttgactgccggcagccactccttggtcaagtactgcttcaccgtcgccttcgtcggtgccatgtaggcgtgctggtcgacggcgaccagcagcttgttcatcgccgcttggcactccttgcgcatggcgaagccgcccttggtgtcgcggcggcgctcctcggtctctgtgagcttgccgccgcacttcgggcagctctccttggggcgccgctcgatccaatgcctcttgttgcagctctggcagcgttgcgccgcggccatgccgatgtcgacgatgtactcccagcttccgggctcgccgcgctttcttacgtggcctcgcatgctctcccccagacgcgcgtctactgtgaaatagcagcttcgctctggggcatggcgcgagcaacgagagagagcgcaccagaggcacggattacttgccgacgagcaacctgttcggtgcgctccatgacggcagcgcgtcggcgcgcgacgccgagtgcagccgcttctcgctcgccacaggactggcggtgatgttgctgagggctgaactgggagcctaaccttagtcgtggtcctggtcggcacggcgtccttcggtcgccgcccggaacgcatactccgtcacctgctcttcttgaagcgccgccagatgcggtcgaggttcgacggccacttcttggagtgcgacgccgccgccggtcggaccctacccgcgcgcctgcatcggacatgggccgtatcgttgcggcgaggcacggagcggtcatactggcggcatggagtccctcctcgtgcagatcctgcccatcgccgtcgccatcgctgtcgagcctctgtgcatcatcgccgcgctcatcatgccggcgacgaaccgacccgcggccaacagcttcgcctatttggccgcgctcatcggcgtcatgctggcctatggcgcggcggtgctcctggtcttccagcaccacgccattgccggcggcgcgcgcaccgacgacgtcgtgcagatgctctggctgctcatcggactcggcttcctgagcgcgttcacggtgatcctcatcagacgaccgccggccggccgtgcccgccacgagtcccggtgggcgggctgggtcgagaagatgggtcccgccggcgcaggtgctgtcggtctcttcctcgtcaactgggagatggagacccctgcgctgaccgagatcctcaaagcgcgagtgtcgctggccaccgcactcgcttcgctcctcgtcttcactgccgtcgccgtcagcacctcggtggcgccgctcgccgcctacttggcggctcctgcccgcgtgggcggcatgctctctgcgggcaagggctggctcagccgccacgagcgcgtgctcctgctcgtgctcttctgtctggtcggcgccgtgtacacctacaagggtgcggctgccctcctgcatcagtgagccccgagaccggatggctcggagcgtgcgtggtcgccgcaatggacgggaaagctgacgcgatgggctgggcgtggagcacgcagaaggggatgtgatggaggagatcggcgacgtggcggcgtcatcgccagaggtgtcgccgcggcgcctctcgagcgcctcccgcgtgccgggcctgatcgccgcggcggcgaccgtgttcgcctgtctcagcctcgcggcggcgaccaccggcccttggcacggcgtggtcgccggactgcaggcggcgctcatccccggaggggcgcctcagggggtcgtccgcggcctggtcgtgagcgtgtccatcgggctgctcctcctgacgcgaggtctggcgcgcaggcagcaccgcgcctggctggcggccgtcgtgctcagcgccgccgccaccgggctgttcctgctgcgggacatcgacgtgccggcggccttcatcgcggtcctgctgctgttctgcctctggcactggcgctcggagttctacgccgcggcctcggctcgccggccggcccgggcagccgcagcggccgcagttgccctggccatcgtcttcggctacggcgtggccgccctgatctggcatgccgcggccacgcatctctcctggtcgtggacgggggtcatgagtcaagccggctggggcatgatcggccaggacgccgtggtgcccggcagcgagttctcgcgggaccttgttgcttcgctgaccgtgggcagtgtgctcatcctggcagctgtcgcctgggcaattctgcgaccgccgaggagtggtgccacgagcagcgaccgtgagtggcgcgaggcgcagcgcctggtggcggctgcgggcagcgactccctcgcctatttcgcgctgcgccgcgacaagcgctacttcttcgacg

SEQ ID NO: 411 - DNA, 4000 bp, Escherichia coli
  misc_feature (392)..(393): n is a, c, g, or t
  misc_feature (2518)..(2518): n is a, c, g, or t
  misc_feature (3922)..(3922): n is a, c, g, or t
ggagcttgccccggcctttgagaaacctcaaccgttcaccgagctcttccaggatgcccgcgatggcgcgctccgtctggtcggcgggcgtgacgtagtggctggcgggatagatgcgcgcgccggtgacggtgcccgtggtgacgccgcggagcgggtcgagcgtcgacagcttctcgatggtgtcgccccacagctccacgcgcagcgcctccgcctcggcggcggcgggaaagatctcgaccacgtcgccccgcacccgaaaggtgccccgccggaaatcgacgtcgttgcgctcgtactggatggccacgaggctccggatgagcgcgtcgcgctcgagggtctggcccgtctcgagccccacgtgcatgccctggtaggtctccggnncgccgatgccgtagatgcacgacacggaggcgaccacgatgacgtcgcggcgctcgaagagggacgtggtggcggagtgccgcatccggtcgatctcgtcgttgacgagggcgtccttctcgatgtaggtgtccgactgcggaatgtaggcctcgggctggtagtagtcgtagtacgacacgaagtactcgacggcattgtcgggaaagaacgacttgaactcgccgtagagctgggcggccagcgtcttgttgggcgagatgacgagagcgggccggtcgagctgccggatcacgttggcgagcgtgaaggtcttgccgcttcccgtgatcccgaggagcacggcatgggggtgcccctcggccaccagcgaggcgaggcgctcgatggccccgggctgatcgcccgcgggcgagtactccgaggacagccggaaagacacgctcagggggcggtgggaaccgccaccaggtacttccgccacgagtccaggaagctggtggcgtgggggtgccgcatcaggtggaccgagaagaggaattgcgggtggaccggctcacggatgagccgcatgcgcgactcctcgagggtgcggttgcccttgaagaggttgcatcggagacaggccgccaccacgttggtccacgtcgtctggccgccccgcgagcgcggcatgacgtgatccaccgtgagcttctctccgcgccgggagcagtactggcaggtgtagccgtcgcgacgaaggatattcttcttgttgaaggccacccgctccaggaagggcttccggatataggcggcgagacggatcacggaggggagcgggaaggcccgcgagggcgagcggatcacgcggggcgagctctccacgctctcggccttgcccgcgagcagcagggtgacggcgcgcttggcgttggtgaagtggagcggttcgtacgtgtagttgagcaccaggaccgcgatatcgttcatatcccttcgtcaaggatagtcagcggtcccagcactgtcaacacctgcccctcagaccagggcccgccacacgaccggcgcaaagccggtgagcacgaggaagaccgatcccacccagcgccagtcgcccgtggtgagcgagacggcgatgaggacgatcatgagacagaggaggaggaagcacagagcgtagaatcggatctcgcgccgatccgtccatccgcctttgcccacgagggccggcatcatccccgcgagatagaccggggagtagacgagaaagaacacgacgagggcagcggagaagagcacgatgccggccaggcctccgactacgccccaggcaatccacgccacgggtgacgccgcgggctctgaaaggagacgcggcaccatgtcgggacggaacatgatgaggaggagcgcgcccgcgcatacgggcaggacccattcaagccaggcgagcttgggagggcgcgggccaatctggatcgctgatcggcgctgctgcttggcgctgtactggccggatctgttcgccatggcccctccctctcagcgagcctgggtctcgacgaccaagagcaagctccgctgctcggcaaagcgcccggacgcaagtcttcgcttcatgacctgctcagtatctcacaaggatgccctccgacggtccgcccgcggctgcacccgcccaccccgcagctaggcggacgggcggagacgcagggcgtcggcgagcacggccagcacccgctcgagcctgaagggcttgacgagcatgaggtccacgccggcctcccgcagcttctccggatccagcaaatgcccccaccccgtgatgaggatgaccggtgtgtcgggacgcaggcgcttcaccgagctggcgacgtcgagccccgaacactccggcagcgagaggtcggtcagcacgacgtcgaaggccccgccctggaagcgcgccagccccgtgagcccgtcggtcgcggattcgacgcgatggcccgcagaggccagggcctcgaccagcatcgtgcggatccggtcctcgtcctcgagcaccaggatggaggcgatatccgagagcgcggccgccttcgcttgctcggccgcgggcgggggcacctccacggcacgggcggaggcgacgggnaaccacagcgtcaccgtggtgcccccgcccggctcgctccgcacgtgcacgctgccgcggtggcggctcaccactccctggaccaccgagaggccgagtccagtgcggtgcggggcccgcgtggtgaagaagggatcgaacatgcgccgccgtatgtcctcgcggatcccctctccagtgtccgagacctggagctcgacccccgtgtccacgcggcgcgcggtcaagcccaggcgacctccctgcggcatggcgtcgatggcattgaggatcaggttcatgacgccctcgcgcagcgccgtcgcctgcccgtccaccgagaggtggagatccagatcggtgaccacgtcgatctgcaccccgcgcgcttccgcctcgtccttccacaccgctcgggtcaatgtcatcgcgtcctgcacgacggcgatcaggtccacgggccccgtcgcatcgtccgcgctcgtcgccgcgaagccctggagacggcgcacgatgtcggcagcccgccaccccgcctcctcgatgtcggccaggtcttcgcgcaagggcccgtcgggcacgcgcgagagcatgagctgcgtcttgccgagcacgatggccaggacattgttgaactcgttggcgatgccgcccgccatggcgcccgccgcgcgcgcgctcgacgtctgcacgagctgctcctgggctctctcgaggccctggagggcgccctgcacctcaccgtagagtcgattgttctccatgccgagcgcgagcatggaggcgaggacctggacggcctcgatctggtcggcggagaaatcgcgcgcctcggggtcgcccacgtagagcgcgcccaccgtctgccgccggaggcgcaccggcacggcgaggcaggcgcgcagaccgacctggagcaggaagtcgtcctccgatcccgcgcggccctggatgtcccggcaggccgccgggcgctgcgtcgcgaacatttcccccgtcagtccgcgcgcgctatccacgcggatggtgtcgagggcatctgcggagagccccatgcccgccgcgagagcgaggccgcccgtcccacccggcacgccgatggccgcgacccgcgcctcggccagccggcaggcgacctcgcacgcgcgcgcgagaacggcctccatgtcctggcccacgagcacatggccgaggaagacctcgagctcgcggagccggccgatgtggcctcgcgtggtctcaatggcatcgcgctggcccagggcgttgccgaccctgtcggcgatcacgaggagcagcaagacctcggcctcggaaaagggcggccgcggcgcgcggcggcccgcgtagagaattcccaacgcgctgcctcccgagcggacagggacggcgacggcatcggagacgggaaacagggcgaggaanggatcctccacgatgcgaggggcgccgccggagacgcgcgtgagcctctcgtcctggaaggcctggcccacgagtcct

SEQ ID NO: 412 - DNA, 4000 bp, Escherichia coli
  misc_feature (54)..(54): n is a, c, g, or t
  misc_feature (888)..(888): n is a, c, g, or t
  misc_feature (1065)..(1065): n is a, c, g, or t
  misc_feature (1445)..(1445): n is a, c, g, or t
  misc_feature (1472)..(1472): n is a, c, g, or t
  misc_feature (1847)..(1847): n is a, c, g, or t
  misc_feature (1882)..(1882): n is a, c, g, or t
  misc_feature (1949)..(1950): n is a, c, g, or t
  misc_feature (1958)..(1959): n is a, c, g, or t
  misc_feature (1961)..(1962): n is a, c, g, or t
  misc_feature (1967)..(1967): n is a, c, g, or t
  misc_feature (1974)..(1974): n is a, c, g, or t
  misc_feature (1980)..(1980): n is a, c, g, or t
  misc_feature (1982)..(1982): n is a, c, g, or t
  misc_feature (1988)..(1989): n is a, c, g, or t
  misc_feature (1994)..(1995): n is a, c, g, or t
  misc_feature (2062)..(2062): n is a, c, g, or t
  misc_feature (2221)..(2221): n is a, c, g, or t
  misc_feature (2284)..(2284): n is a, c, g, or t
  misc_feature (2344)..(2344): n is a, c, g, or t
  misc_feature (2350)..(2350): n is a, c, g, or t
  misc_feature (2353)..(2353): n is a, c, g, or t
  misc_feature (2380)..(2380): n is a, c, g, or t
  misc_feature (2397)..(2397): n is a, c, g, or t
  misc_feature (2473)..(2473): n is a, c, g, or t
  misc_feature (2536)..(2536): n is a, c, g, or t
  misc_feature (2954)..(2954): n is a, c, g, or t
  misc_feature (3041)..(3041): n is a, c, g, or t
  misc_feature (3053)..(3053): n is a, c, g, or t
  misc_feature (3059)..(3059): n is a, c, g, or t
  misc_feature (3065)..(3065): n is a, c, g, or t
  misc_feature (3080)..(3083): n is a, c, g, or t
  misc_feature (3085)..(3085): n is a, c, g, or t
  misc_feature (3092)..(3092): n is a, c, g, or t
  misc_feature (3098)..(3098): n is a, c, g, or t
  misc_feature (3125)..(3125): n is a, c, g, or t
  misc_feature (3134)..(3134): n is a, c, g, or t
  misc_feature (3158)..(3158): n is a, c, g, or t
  misc_feature (3170)..(3170): n is a, c, g, or t
  misc_feature (3185)..(3185): n is a, c, g, or t
  misc_feature (3194)..(3194): n is a, c, g, or t
  misc_feature (3229)..(3230): n is a, c, g, or t
  misc_feature (3251)..(3251): n is a, c, g, or t
  misc_feature (3254)..(3254): n is a, c, g, or t
  misc_feature (3266)..(3266): n is a, c, g, or t
  misc_feature (3279)..(3279): n is a, c, g, or t
  misc_feature (3283)..(3284): n is a, c, g, or t
  misc_feature (3287)..(3287): n is a, c, g, or t
  misc_feature (3290)..(3290): n is a, c, g, or t
  misc_feature (3293)..(3293): n is a, c, g, or t
  misc_feature (3295)..(3296): n is a, c, g, or t
  misc_feature (3298)..(3298): n is a, c, g, or t
  misc_feature (3302)..(3302): n is a, c, g, or t
  misc_feature (3308)..(3308): n is a, c, g, or t
  misc_feature (3310)..(3310): n is a, c, g, or t
  misc_feature (3317)..(3318): n is a, c, g, or t
  misc_feature (3321)..(3322): n is a, c, g, or t
  misc_feature (3326)..(3326): n is a, c, g, or t
  misc_feature (3329)..(3329): n is a, c, g, or t
  misc_feature (3332)..(3335): n is a, c, g, or t
  misc_feature (3350)..(3350): n is a, c, g, or t
  misc_feature (3353)..(3353): n is a, c, g, or t
  misc_feature (3370)..(3370): n is a, c, g, or t
  misc_feature (3373)..(3373): n is a, c, g, or t
  misc_feature (3389)..(3389): n is a, c, g, or t
  misc_feature (3439)..(3439): n is a, c, g, or t
  misc_feature (3449)..(3449): n is a, c, g, or t
  misc_feature (3485)..(3485): n is a, c, g, or t
acaaacttttcaaaatgtccttcgatataaacatattcccaccattcaggaagnaacatcgctgcaattttacggcggatattgtacgttgcaaagtgtttcatcaggccataataagagttcatcgtactcacaaacttctcaacatacgcttctgcaaatccattttcagctattctattaaatttcctgacagcgttatatgtgttaccaaccaccctgttagatacataaattctaccaggcaaaatgaacgcccctacaaacaagactccttttttataatgctgaagatacagtttgcgtggatgcaaccgtaaaaggagttgttctttcaggaaaccatcaagaagatggactttggacaatatttcttccggtgatttcactacgatacaaaagtcatcaacaaagcgtacataatatatgaatcccagtatttccatcacgaaataatcatatacagacgccagaaagttggctatgagttgcgacggcaggttcccgatagccactcccctgtcagggtcattatgaaacagacttttattactgggaagtttgtcccacatggagacgggagagcgtctgatacacttattttgtggacaatgaaagatagtaacggctagaaggtaaagcagacattcaatatcatcgcctttataattgtcccttacgaatatgttcagcatttcccataccaacgatttcgagatagacatgaagaaactgaacaggtcatctttgaaaatgtacgcatcggcagtataattctcactgacctcgactatcatgttattcagatagtgcacggcagacagacatccctcacctttccggcagttcttcgagacgttcccttgttcccgaaaacgttcctctaanatcggctcgatacgaagagcgatccagtgatggacaacacgatcaatgaaagcggcggcaaaaacctcccgatataccgggtaagtccgtatgaatacttttgaaaagtccggtacatattcaccgtaaataatagaataccatagccgcaccaatgcagactgataatcattatanaactcaacacaatccgtactcgttcttttctgcctggcacaatcttcggatgcttcgaaaatactgctaagaagtatgtcatagattatattacctgttgcggcgaggggacgaacccggttcgcgttctggcggttgttcgtgttgacgttgccgttgttgaagttcacgttccaactgctggaagccgttgcatccgctatcttagtctttcccggctcatcaccggggggatgcccaataaataattctaattgctcactcataatccccttggcgattatgactccggctttgcgacttgttgcgatccgttagctttttgccgttggagatctgcaaccgtttttttgtaccagccggtactttgcttaccgatnctctctgcaagcagacagatttcggcngtttgagtcaggctggtcaaatgtcgttcttcacacactcttagcagtaatttcaatgcatcaaactcacacaaaaacttcatcagataatctgcacggtgctcaaggttcatatctgtatttgcataacggatatattcgcaacaatgaacggcaagcatcatcaactccgtaccaaattcataccggaacgccttggggaattgttgccgggcatcaatgataaggttcagaagcttatacatcgaatttgatataggaaggtcttgtgtaagtgccatgttaattttttaatattttaatgtatgtattagagggcgcaaagttaataactgtaaagcaattaacacaattttagctcaaaaaagtgaaacnaaaaagcccctaccggggcttttatttagctaacnctctaagggataaagaattaaagggataaagtgtttattgcggcgaggggacgaacccggtacgcgnnctggcggnngnncgtgntgacgtngccgtngntgaagnncacgnnccaactgctggaagcgtcatattcggtactagaccaataccagtcgtttgtaaatatattttgattnccaaacatagaagttatgagctcattgatttcggttttatacttggccataagcataagttcacccaatgcgggcaggttccacacggttgtatcttcaattccgtcagattcaagcgtacaggctttataggctctggcaacttcggcggcaggggcnccgacagttccctgggtgtccttgacgcctgcaagggtttctattataacatcggtattttcnttgccgtcgaaggtatcatagagtccttggttaccactgccgtagtttttcaggccgcgnaggtcngtnccgtagccaccccatttgaacgttttnttgccgcctgcgtcaangcagtcgcttttggcgataatgaactggtggcattcggcgcgaagtcggatgccgatacggatatacttggagcgnttattcgcgctcatggagttccattcggaagccgtgaaaaagacttgttcaccgtcttcaatncggagcgtagccaaagaaaggtcaagaagcgtacctgaccattgcatatatttggcgatgtcgcttgcgggggtgttttcattcacggttgtaaaacctattgattttaaggcttctatctggtcttgtttattcaagcgcagaagcatggcgttggcgatatttttatccattttattgtataatattaagttaatactattcggaagcaacagctctcacatgaagaagggctgaatttttgttttgattcgtaatacgcccggtattcagttcgaacgcccaggcggagttagtatcccaaattgttgatgaccagtagtatttatcagtcatcagcatactgtcactactccaaaaggtacgcatcatctcattgattttatcgcggtagcggtacatcagaagcatttggccngatgaaggaaggaaccagttggattcatcctcgataccgtcactttccaaagtgtaggcacggtatgcacgggcggcttcggcagcnggcgcaccgatnacaccnctattnttttggtctttcagnnnngngataatnaggtcngtatcttcctcacccgtgaagcagccntacatggcncccagtcctttttgattcaggccntctatggctttnccctgaccgccccantagaaggtngtagtcatgtcggcattatagcactcctgggcggnnattacgaaggagtgtccatgngcncggatacgaagnccgcgtttgatanacanntgnttnttngnnancgtnagggantnccattcnncannggtnaantannnnttggagttatccganatncggttacaggcaagatncanatcaagcaggccggcngcccacttgatacgttgtccaaattcagatgcgcgggaattctcggtganatccgagaancccacggcgttcagtgctgccacttgtgcctgtttnttcaagcgaagcagcgttgcgctttgttcattcgtcatagttacttgttgattaaatcattaatatccatattgtcttcagcgaagcgttcgagatattcttcgtaggtttcgccgttataatattcaaggacttcattgatgttgtccagcgttacgttatcgtagtacggttctccgccataagactcattattgaaccagttgatcaggtcgatgtaggcatctatgacggtaaggatgacaaggccgtcgataccggattcaagggattcgatttcatccgtttcacggataactgtcagttcatacgtgccgttgactaccggtttatcctgtctgttgccgtcctcatccattccggcaactccatattcgagaatggcaagaagctcggagccgtcagccttcagtgtcatgttcgagatacggagcatggaaagtttacgggatgccgtttgtgaagcgaggacgtcacggagcatctgaatggcgtcaagtttaggcgacgtttca

SEQ ID NO: 413 - DNA, 4000 bp, Escherichia coli
  misc_feature (1201)..(1201): n is a, c, g, or t
  misc_feature (1992)..(1992): n is a, c, g, or t
  misc_feature (2038)..(2038): n is a, c, g, or t
  misc_feature (2187)..(2187): n is a, c, g, or t
  misc_feature (2191)..(2191): n is a, c, g, or t
  misc_feature (2194)..(2194): n is a, c, g, or t
  misc_feature (3454)..(4000): n is a, c, g, or t
gggatggaactaactattgtttaaatttgagtcaaaagtcacaaaactaagtatttatataagtctgatttggttgtcatttcagacttatataattttttttccatctcaacctcttttagagagaccactgcacttaatattcgcattattattaatttttttttttaatttaaatttaaaaaaaataaaaataactgactcaattatatttattttattactttctttcctaatatattttttttttagttttgaaagattagtttccagaatggaaactgtagatgaaatatttaaaattgatgttatttttggattaattttaatttttcttcttttatattatgtttttaaaattgttggatattcattattttatgtaattctattctttttaatctatgcattttttggaaattattttccttcatggatggaatttagaggttttaaagttgatgagttgattgaaattcttacactttctactagaggtgtatttgggataaccacacaaacttcgttatattttgtgttttatttcataatttttggaggattttattcagctattggtggaagtagttttcttgtcaatttaggactttatctatcaagaaaaagttttggaggaagtgcaaaatcagcaatcatttcttcaagtttgatgggcagtatcactggaagtgctgttgcaaatgtttcttcaacgggagtttttacaattccgttaatgaaaaaaggtggttacaaatctgaacaagctgcttcaatagaggcaatagcatcaactggtggtcaattaatgcctcctgtaatgggaatagcagcatttgttatggctgaaataatgatggttgattattttgaaattgttaaatcagctttgatgcctgcactatttttttatatttccttatttttgcttattcacacaaattcaaaaaaaacaaaaattggatattttgaaacagaaataaaattaaatttcaaaagagatcttaagttattgtttcctttaatattgttagtatttcttttattgaataaatactccccacctttttgtgctttatttagtgttttaagctgtattttaataaatctatttgatgaaagaaaattaaatattaaagaatatcttgatatagcttcaaaaagttgccttcaggcagcaaaagttgcaatccctattgcngcaatagggattgtagttgctgtgtgtattcaatcaaatattgcattgaagttttcatcaacattaatttcagtctcagataaaaatatttggttaaatttacttataataatgataggttgtttgataatgggtatggggttacccactgttgctgcatatgtaattggtgcagttttttttgtacccgctttgaaagatttggggtttagtgagatttcatctaatttttttgtgatgtattactgtgttttgtcaatgcttacccctcctgttgcgttagcttcatacacagcagccggtatagcttctgcaaataattttaaaacaagcattgaagctttcaaaaaaagttttgttatttttttaataccaatttgttttttatttgatgaaaatattttattgataaactttgaattatttaattttctaataagcattatcggattatgtttagtaactttttcatgggtatattttttagaggggtacataaaaagaagaataagcatcattagtagacttacttttctattaatcatatttttattaatttattataaatttgatccaacaataattggggtatcttctgcaatatttataatcaattatttactaactaataagataaattcttaactattaattatactttaaaacttctctaaccaaagtaggatgttactacaatactctacaaaaattaaaaattttaatttctgctccaatagtgctccaatgacattggttcttgactaagattctttaatttgattcaatatcantagaaaggaaagagagcatttacaggagtaattgttctagaggtangctcaagggttcatggcgatagactcataagcccgaggtcagtggttcgatcccacttcccgctaccattaatgtcctggaaattctattaaattttctactttgtagtttttttttcttaaattatcgcatccaccaagatcaaatanattnatnacaaaaataaatgctgcaacttttgcattagacatttctattagttttgcagctgcatcagccgtaccacctgtagcaattaaatcatcaattattaaaacagagtcgttttctttaaaggagtctttgtggacttctatcgttgcggtcccatattcaagttcaaaatcaactgaatgaacatcagctggtaatttatttttttttctcaacataatgaaaggttttttaagcaaatatgatactgctgaggcaaatacaaaacctctactttcaattgccgcgattttatctattttaaaattttttgatctctcaataatttgatcaattgttgcagcaaaagcttcttcatctttaattaaggtagtaatatctctaaataatattccttttttaggataatcaggaatagatcttataaagtcttttaaattcataatagttatttataaatcataattaatttaaatttaacatatgacaataaataaattagcaattattggtggaagtggcttgtatgatgttgaggaatttaaaagtagagagctaattaaacttaatactccctggggaaatccatctgatgaaattttaaaaacagtatataatgataaagaagttttttttcttccaagacatggaagaggccatttcatttctccttccaatattaattttagagccaatattgatgcccttaaacaattaggtgttacagatatagtttctgtttcagcggtaggttcattaaaagaagatttgccaccaggcaagtttgtaattgttgatcagtttattgatagaacttttgcaagaagtaaaaccttttttgaagatgaaattgttgctcatgtttcaatggctcatccaacttcaaatggtttaatgaatgcttgtgaggatgctattaaaaaatcaaatatagaatatcaaagaaatggcacctatgtggtgatggagggaccacagttttcaacattagccgaatctaatttatacagatcctggaaagcagatgtgattggaatgactaatatgcctgaagctaagttagctagagaggcggagattagatatgcatccgtttctatggttacagattttgactgctggcatccagatcatgagaatgttgatgttcagcaagtaataaagattttattaagtaatgctgaaaaagcaaaaacaatgattaaaaatttaatcgataattttgaaaattatattgatccaaatgatccaacaaataattgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 414 - DNA, 4000 bp, Escherichia coli
  misc_feature (64)..(64): n is a, c, g, or t
  misc_feature (256)..(256): n is a, c, g, or t
  misc_feature (886)..(886): n is a, c, g, or t
  misc_feature (1921)..(1921): n is a, c, g, or t
  misc_feature (3508)..(3508): n is a, c, g, or t
  misc_feature (3568)..(3568): n is a, c, g, or t
  misc_feature (3592)..(3592): n is a, c, g, or t
  misc_feature (3634)..(3634): n is a, c, g, or t
  misc_feature (3676)..(3676): n is a, c, g, or t
aaacatacgttttttctgcaggtcattgttcatgagcgtgaaatgatccatatctatgcaagcnaagggctgtcgctcaaatgcgctaattttttggcataattgcggcgaagataagaaaatttggagtcaccgaacaatgtttactgggatcatcacagatattgggcaaattgaacgcgttgaacaacgcggcgatatcagagcaaggttaaaaaccagctatgaccatgaaacgatcgccctgggtgcttcnatcgcgtgcaatggggtgtgcctgaccgttgttgattttggtgacggctggtttgatgttgatattagtgcagaaacggtttcaaaaaccaatattgggccgtctgataccgcgacaaacagcagatccgcttgggttgaaggagggcgcgtaaatctcgagcgtgcgctcaaattgggcgatgaacttggcgggcatattgtatcgggccatgttgatggtatcgctgaaatcacggccatcaccgaggatggcgacagcacgcgggttgaatttaaagtggcgaaagatcttgcgcgttttattgccccaaaagggtcggtggctttgaacggcacctcgctaacggtgaatgaggttggggatgaaagcttcggcgtcaattttattccccacaccaaaacggtcacaacttgggacgacatggctgtaggggatttggtcaacctagaaatagacacgctggcgcgatatgtcgcccgattggccgaaacgcgttaaattatcgaaagcgacgttaagattttcggaattttttctctaaatttgaagaagccttttgtggcatatggccaagaaataatatcgtactcgcgcatcacttgcgttaactgaacgccgtgattactnaatagatgtttacatttttcaagcatctgtgacgtattccctacggcggcgtagggtgtgactatttgctctaatttgttttctagcgcccaagacaagatcccctcgggggtggtcacgtcgcagcaattgagcaggttgggtttccaacgctttgtcgcggcatccaaagctgcgttgttaaattcaagcaatttcgggctcgaaaccagcatagtgcccgcatcaaccgggcgataagcggccgatgcgatgcagtcgctacgatgagtgagatgcgcgatatttagatcgtctgaatgaagcaataacccagttttgcgcccctcgaggtaaggattgggagggtctattattttaggagccatcgtgctcgcggtgtcgttcagcggcggcgcgacctgcgccaatccttttggggcgaacctgccattggtaaagcgttgaatattttcggcgcgcgccagataggttttcccaacagaatgtaaccccaccacccagcgccagctcaacgtgtttgaggcagcatcgccatccagaaggtgccgcaaaaaaaagtcagcgcccaattgccagggcaactgcagcgtgtaaacccagattgaggcaaaccacattctcgcatgattgtgcagatatccggtttcggccagttcttttgcccatgcatcaaagcaatctatcccggtttcgcccaggcaggcggccgcccaacgatcgcgcaggcctgattgagtttgcaactcatgggttaggtgatgcacatcggcgcagtattgcatccaaatatggggcctgctttcgagccatcccttgaagtatgtgcgccaaaaaatctcatcaatgaactttcccgcctcgttgagagaatgcgctgacagcactttcttcaaaacgtcttcttccgttataatgcggcgttttatataagcagagagctgcgacacatgtttatgctggcccgcgcccaggtcaaagtttcggtttcttgtataggatgtgccagcttttggtaaaaaagcggccaaaagnacaagggcctcttctcgcgatcctgaacaaacctgcattgaaaattccgccgtaaccattcttgcgagttagtcctaaagaggatgatttcaagacgataaaaacaaacgagttttggttttcatttgaaaagcatatgaagcttaagagcggtagatttcacctaaaaagcgcgggttttgtctaaaacgaacgagatgcttgcctcggaagcaggtttaatctgcgtgagctattgcagagcgggggttgcagcactaagactcgtactagtcagatatccttaagaataggcagggcagaatgaaagatccaatagacacatatatgaacagcttggttccgatggtggttgagcaaaccagccgcggcgagcgcgcctatgatatcttctcaaggcttttgaaagagcggatcatttttctcagtggtcccgtccatgacgggatgtccagcttgatcgttgcgcagttgctacatctagaggcggaaaacccttctaaagagattagcatgtatatcaacagcccgggcggtgtagtgaccagtggattgtcgatttacgatacgatgcaatatatcaaaccaaaagtttcaacgcttgtgatagggcaggcggcttcgatggggtccctactgcttacggcaggtgaaaaaggcatgcgcttctcgcttccaaatagtcggattatggtacaccaaccctctggtggatatcaggggcaagccactgacatcatgatacacgctgaagaaacattgaagcttaaaaaacgcctcaatgaaatctatgtcacgcataccgggcaggatcttgatcaggttgaaaccgcgctcgagcgcgataattttatgtctcctgaagatgccaaagactgggggttaattgacgaaatcgtgactaatcgcgcgaaagatgacgcggaatagggttcggcttgtgacagcgcccgcaagcgcaggaggttggaagcaaaattttggcattgtagagccgccatgcctagcttaagctagcaggcagtatatgtagacgcgtaaagtttttgggattttgaaaatccaaaagggtagaacatggcatcaaattccggtggtgaaagtaagaatactctttattgcagcttctgcggtaaaagccagcatgaggtgcgaaagctgatcgctgggccgactgtgttcatttgtgacgaatgcgtcgagctctgcatggatatcatccgcgaggaaaccaaaagctcggggttgaaatcctcagaaggggttccaacgccgcgcgaaatttgcggcgttcttgatgattacgtgattggtcaaagcattgccaaacgtgtcttatctgtggcggttcacaaccattataaacgtttgaaccacgctgctaaatcgggcgatatcgaattgtcaaaatccaacattttgctgatcgggccgaccggctgcgggaaaaccttgcttgcccaaaccttggcacggattttagacgtgccctttacaatggcggatgcaaccacgctgaccgaagcgggctatgtgggcgaggatgttgaaaatattattttgaagcttctgcaagcttctgaatanaatgtcgagcgcgcgcagcgtggcatcgtttatatagatgaagttgataaaataacgcgnaaatctgaaaacccatcgatcacncgggatgtatcgggtgagggggttcagcaagctttgctgaancttatggagggcaccgtggcaagcgtgcctccgcaagggggncgaaagcatccgcagcaagaatttttacaagttgatacgaccaatattttattcatttgcggtggcgcttttgccggtttggataagattattgcgcagcgtggcaaaggcagcgcgatggggtttggcgccgatgtgcgcgataatgatgagcgcggtgtgggcgaggttttccaagatttagaacccgaagatcttctgaaatttggccttattcctgaatttgttgggcgcctgccagttttggcgacgctagaagatctggatcaagacgcgctggttacgattttgacgcagcctaaaaatgcgttggtgaagcaatat

SEQ ID NO: 415 - DNA, 4000 bp, Escherichia coli
  misc_feature (1)..(5): n is a, c, g, or t
  misc_feature (8)..(8): n is a, c, g, or t
  misc_feature (10)..(12): n is a, c, g, or t
  misc_feature (15)..(15): n is a, c, g, or t
  misc_feature (17)..(17): n is a, c, g, or t
  misc_feature (23)..(23): n is a, c, g, or t
  misc_feature (26)..(27): n is a, c, g, or t
  misc_feature (29)..(29): n is a, c, g, or t
  misc_feature (33)..(34): n is a, c, g, or t
  misc_feature (36)..(38): n is a, c, g, or t
  misc_feature (40)..(41): n is a, c, g, or t
  misc_feature (43)..(52): n is a, c, g, or t
  misc_feature (54)..(54): n is a, c, g, or t
  misc_feature (56)..(59): n is a, c, g, or t
  misc_feature (61)..(61): n is a, c, g, or t
  misc_feature (64)..(64): n is a, c, g, or t
  misc_feature (66)..(67): n is a, c, g, or t
  misc_feature (70)..(72): n is a, c, g, or t
  misc_feature (74)..(74): n is a, c, g, or t
  misc_feature (76)..(77): n is a, c, g, or t
  misc_feature (80)..(84): n is a, c, g, or t
  misc_feature (86)..(87): n is a, c, g, or t
  misc_feature (90)..(90): n is a, c, g, or t
  misc_feature (94)..(94): n is a, c, g, or t
  misc_feature (99)..(108): n is a, c, g, or t
  misc_feature (111)..(120): n is a, c, g, or t
  misc_feature (122)..(122): n is a, c, g, or t
  misc_feature (124)..(124): n is a, c, g, or t
  misc_feature (127)..(127): n is a, c, g, or t
  misc_feature (130)..(131): n is a, c, g, or t
  misc_feature (133)..(134): n is a, c, g, or t
  misc_feature (137)..(137): n is a, c, g, or t
  misc_feature (139)..(140): n is a, c, g, or t
  misc_feature (143)..(146): n is a, c, g, or t
  misc_feature (148)..(148): n is a, c, g, or t
  misc_feature (151)..(153): n is a, c, g, or t
  misc_feature (155)..(155): n is a, c, g, or t
  misc_feature (157)..(160): n is a, c, g, or t
  misc_feature (165)..(165): n is a, c, g, or t
  misc_feature (167)..(170): n is a, c, g, or t
  misc_feature (174)..(177): n is a, c, g, or t
  misc_feature (179)..(180): n is a, c, g, or t
  misc_feature (185)..(185): n is a, c, g, or t
  misc_feature (187)..(189): n is a, c, g, or t
  misc_feature (191)..(193): n is a, c, g, or t
  misc_feature (196)..(197): n is a, c, g, or t
  misc_feature (201)..(206): n is a, c, g, or t
  misc_feature (210)..(210): n is a, c, g, or t
  misc_feature (214)..(216): n is a, c, g, or t
  misc_feature (218)..(218): n is a, c, g, or t
  misc_feature (220)..(220): n is a, c, g, or t
  misc_feature (223)..(223): n is a, c, g, or t
  misc_feature (226)..(228): n is a, c, g, or t
  misc_feature (230)..(232): n is a, c, g, or t
  misc_feature (234)..(234): n is a, c, g, or t
  misc_feature (237)..(237): n is a, c, g, or t
  misc_feature (239)..(240): n is a, c, g, or t
  misc_feature (243)..(245): n is a, c, g, or t
  misc_feature (247)..(250): n is a, c, g, or t
  misc_feature (252)..(256): n is a, c, g, or t
  misc_feature (260)..(260): n is a, c, g, or t
  misc_feature (263)..(263): n is a, c, g, or t
  misc_feature (265)..(265): n is a, c, g, or t
  misc_feature (268)..(270): n is a, c, g, or t
  misc_feature (275)..(277): n is a, c, g, or t
  misc_feature (279)..(283): n is a, c, g, or t
  misc_feature (285)..(286): n is a, c, g, or t
  misc_feature (288)..(288): n is a, c, g, or t
  misc_feature (290)..(303): n is a, c, g, or t
  misc_feature (306)..(309): n is a, c, g, or t
  misc_feature (311)..(312): n is a, c, g, or t
  misc_feature (314)..(316): n is a, c, g, or t
  misc_feature (318)..(325): n is a, c, g, or t
  misc_feature (327)..(327): n is a, c, g, or t
  misc_feature (331)..(333): n is a, c, g, or t
  misc_feature (336)..(337): n is a, c, g, or t
  misc_feature (339)..(340): n is a, c, g, or t
  misc_feature (344)..(344): n is a, c, g, or t
  misc_feature (346)..(348): n is a, c, g, or t
  misc_feature (352)..(356): n is a, c, g, or t
  misc_feature (358)..(358): n is a, c, g, or t
  misc_feature (364)..(367): n is a, c, g, or t
  misc_feature (369)..(371): n is a, c, g, or t
  misc_feature (373)..(379): n is a, c, g, or t
  misc_feature (382)..(382): n is a, c, g, or t
  misc_feature (384)..(384): n is a, c, g, or t
  misc_feature (386)..(386): n is a, c, g, or t
  misc_feature (391)..(391): n is a, c, g, or t
  misc_feature (393)..(396): n is a, c, g, or t
  misc_feature (399)..(402): n is a, c, g, or t
  misc_feature (405)..(406): n is a, c, g, or t
  misc_feature (410)..(410): n is a, c, g, or t
  misc_feature (417)..(421): n is a, c, g, or t
  misc_feature (423)..(423): n is a, c, g, or t
  misc_feature (425)..(426): n is a, c, g, or t
  misc_feature (428)..(433): n is a, c, g, or t
  misc_feature (435)..(436): n is a, c, g, or t
  misc_feature (438)..(439): n is a, c, g, or t
  misc_feature (442)..(447): n is a, c, g, or t
  misc_feature (451)..(452): n is a, c, g, or t
  misc_feature (454)..(455): n is a, c, g, or t
  misc_feature (458)..(458): n is a, c, g, or t
  misc_feature (461)..(463): n is a, c, g, or t
  misc_feature (465)..(465): n is a, c, g, or t
  misc_feature (467)..(468): n is a, c, g, or t
  misc_feature (470)..(470): n is a, c, g, or t
  misc_feature (474)..(474): n is a, c, g, or t
  misc_feature (477)..(477): n is a, c, g, or t
  misc_feature (481)..(483): n is a, c, g, or t
  misc_feature (486)..(486): n is a, c, g, or t
  misc_feature (488)..(491): n is a, c, g, or t
  misc_feature (493)..(496): n is a, c, g, or t
  misc_feature (499)..(501): n is a, c, g, or t
  misc_feature (503)..(503): n is a, c, g, or t
  misc_feature (505)..(506): n is a, c, g, or t
  misc_feature (509)..(509): n is a, c, g, or t
  misc_feature (511)..(513): n is a, c, g, or t
  misc_feature (515)..(515): n is a, c, g, or t
  misc_feature (517)..(519): n is a, c, g, or t
  misc_feature (521)..(522): n is a, c, g, or t
  misc_feature (524)..(524): n is a, c, g, or t
  misc_feature (527)..(528): n is a, c, g, or t
  misc_feature (530)..(532): n is a, c, g, or t
  misc_feature (534)..(534): n is a, c, g, or t
  misc_feature (536)..(536): n is a, c, g, or t
  misc_feature (539)..(540): n is a, c, g, or t
  misc_feature (544)..(544): n is a, c, g, or t
  misc_feature (546)..(552): n is a, c, g, or t
  misc_feature (554)..(555): n is a, c, g, or t
  misc_feature (557)..(559): n is a, c, g, or t
  misc_feature (562)..(565): n is a, c, g, or t
  misc_feature (568)..(570): n is a, c, g, or t
  misc_feature (572)..(573): n is a, c, g, or t
  misc_feature (576)..(578): n is a, c, g, or t
  misc_feature (580)..(580): n is a, c, g, or t
  misc_feature (582)..(583): n is a, c, g, or t
  misc_feature (585)..(588): n is a, c, g, or t
  misc_feature (591)..(591): n is a, c, g, or t
  misc_feature (608)..(608): n is a, c, g, or t
  misc_feature (635)..(635): n is a, c, g, or t
  misc_feature (638)..(642): n is a, c, g, or t
  misc_feature (644)..(648): n is a, c, g, or t
  misc_feature (651)..(652): n is a, c, g, or t
  misc_feature (656)..(657): n is a, c, g, or t
  misc_feature (660)..(662): n is a, c, g, or t
  misc_feature (665)..(665): n is a, c, g, or t
  misc_feature (667)..(667): n is a, c, g, or t
  misc_feature (670)..(670): n is a, c, g, or t
  misc_feature (676)..(677): n is a, c, g, or t
  misc_feature (679)..(680): n is a, c, g, or t
  misc_feature (682)..(682): n is a, c, g, or t
  misc_feature (685)..(685): n is a, c, g, or t
  misc_feature (688)..(688): n is a, c, g, or t
  misc_feature (691)..(691): n is a, c, g, or t
  misc_feature (695)..(695): n is a, c, g, or t
  misc_feature (697)..(697): n is a, c, g, or t
  misc_feature (712)..(712): n is a, c, g, or t
  misc_feature (716)..(717): n is a, c, g, or t
  misc_feature (719)..(719): n is a, c, g, or t
  misc_feature (721)..(721): n is a, c, g, or t
  misc_feature (728)..(730): n is a, c, g, or t
  misc_feature (733)..(733): n is a, c, g, or t
  misc_feature (742)..(742): n is a, c, g, or t
  misc_feature (747)..(747): n is a, c, g, or t
  misc_feature (779)..(779): n is a, c, g, or t
  misc_feature (793)..(793): n is a, c, g, or t
  misc_feature (808)..(808): n is a, c, g, or t
  misc_feature (831)..(832): n is a, c, g, or t
  misc_feature (838)..(838): n is a, c, g, or t
  misc_feature (883)..(883): n is a, c, g, or t
  misc_feature (892)..(892): n is a, c, g, or t
  misc_feature (913)..(913): n is a, c, g, or t
  misc_feature (926)..(926): n is a, c, g, or t
  misc_feature (928)..(928): n is a, c, g, or t
  misc_feature (931)..(931): n is a, c, g, or t
  misc_feature (937)..(937): n is a, c, g, or t
  misc_feature (940)..(940): n is a, c, g, or t
  misc_feature (955)..(955): n is a, c, g, or t
  misc_feature (972)..(972): n is a, c, g, or t
  misc_feature (994)..(994): n is a, c, g, or t
  misc_feature (1017)..(1017): n is a, c, g, or t
  misc_feature (1225)..(1225): n is a, c, g, or t
  misc_feature (1230)..(1230): n is a, c, g, or t
  misc_feature (1240)..(1240): n is a, c, g, or t
  misc_feature (1289)..(1289): n is a, c, g, or t
  misc_feature (2000)..(2000): n is a, c, g, or t
  misc_feature (2154)..(2154): n is a, c, g, or t
  misc_feature (3747)..(3747): n is a, c, g, or t
nnnnntcngnnnagngnaccgtnacnncncagnngnnncnntnnnnnnnnnncngnnnntntgncnncgnnncncnnatnnnnntnnctncgcnttttnnnnnnnnnntgnnnnnnnnnntntnganatnncnncgncnnatnnnncntgnnntngnnnnagagngnnnncacnnnntnncgcgngnnnannnggnnacannnnnngaantctnnncncncgngcnnnannntntgncnncgnnntnnnntnnnnnctcnctntntgnnntctcnnncnnnnngnngngnnnnnnnnnnnnnngannnncnncnnngnnnnnnnncncccnnntgnnannccgngnnnactnnnnntnttccannnngnnngnnnnnnntcncncncgcgngnnnnacnnnnccnncgcngaccccnnnnncncnncnnnnnntnntnncannnnnntttnnannatntannnangnnanaganaanagannnagngnnnntnnnncannncnannggntnnnangnnncnntngcnntnnngngnaanntttncnnnnnnngnnannncannnnggnnngnnttnnncnanngnnnngtnccatcgccgtgtttatngtgcccacctgcgccgccgaacgaatnttnnnnncnnnnnagnnggcnnggnnncgncngantcgtcnngnntngcntgnagncgangnactcgacgaattacngcanngntngtgtgcnnnttncgtcgcatnttgancaactcccgaaacgctttcgcgataacggcancgttaccgccggtnggcttgccgtgccgncgtgggaaatggctcacgggcanntccttnaccgtcatgccaaacctggatacctgagcgaagatttccgtgttnaccatcgcncccaccgagttgatctgaacnttgtcgaagacangncgnttgaanacnttgaaagcgcaatcnatgtcccggaccctgancccgagcacgagccgcacgagnatattccaaccccaggcaaacancagcctgtgcggcggatcctgccgccgggcccggtaaccagcaacgatgtcgtaggaatccgcctgttcgaggagcgcggcgacttcgtttaagtcgaactgcccatcagcgtcagtgaagaaaattagatcgtagcgcgccagcgtgatgccgctcttgagtgcggcaccgtacccgcggttccggggatgatgaacaacacgcacntcggncaactcctcnacgagccgatcgcaaatctcccccgtgcggtccttgctgccgtcgtttnccacaatgatctcaaaaattggggcaagtttcggtacagtccgatatgcgtcctcaacgacggcccggatatttgcctcttcgttaaatgcaggaaaaacaaccgataacgatttcatattggggtgaaaatttataagctatcaaaatcgaggcggccgctgcaagcaaaatttcgcatcattgtggttggctcatcagttccgcatcgggtttgctctgtgcaaccaaacttactgcttacgacgcgcgaatctgcaagaatggatttgttaaattttggcgacgtttgcgaagcccggttctgagcccgctttgtcgcagcggcagcgcacccttgttattaacgatgcaaaagaggaaagtcaatctgcggcgacgaaatatgccgatcggtcgcgaccgataattcggcaatcctctcgcgaaccgaatgacactgctttaccgggaaatggaaaaccggtggctgttcccgcagcttgcccgcgaactagcctgacggcggatcgctgcgcggatctcctgttggcttcggcacttgaacagttcgctgcacgccgaccgacattcccgcgcgtctgagcgatccaggcagaacgtgcttcacagcatgcctttcttccgagcggtttagtgccgcacggcaagaggcgaaagcatcggttctgtccctaggcgaaaatacttaatagccagccgtaatccctangaaaagaatcctaagaaacagcttgacagatttgtttgcttagcaaaaaaatgccccgccccgtctttggcaaagtgagccgagcgacgaggcaggcaacaaccgaggacccctcagaatgaaaaagaaatccgcttcactattagccttcttnaatccgctcgttttaaccgcacatcgaaaacaatctgcaacgcaaccctgcagactgccggcgttaatcggcatgctgctttgcgttgccgagctgcttgccccgggaaacgtcttcccacaggcggtcaagcctgaccccgctggcatcatcgatttaccgggagcaatttccgccaacgcgcctatcggaacgctcgatgaccacccgtggctaaacccaaacgtggacgggcttcggatcagagtgagctggtctgatatcgagacagccgacaacgtttataattggccgctgattgatgactgtttggctaatgctcttaccagcggaaaatttatcggtctcggggtgattgctggcatcgacaccccgccgtggcttttgggcggtgtcactttcaccgatggctcgaccacaaccgatgtggccacgcttacctcagccactgccaattttgttccggcggatgttggaagggcgatcgcgtgtggcaacttttcaccgggcacgaccatcgtttccattatcaactcaacagtggtgcaaacatccaccgcggcgaccagaaccacttcaagaacaccggccaccttttccatcctggcgcgcaacgcaggaggggccgaatttcgtgtgctcaccgcgcccgacgaaggggcgatgccggtgccatgggatcctctttacagagctaaatgggaggaatttatcaccgctttaggagcccggtacgactttaatccgcaacttggatacatagttatgacgggcttttgtcaggtcgctgaggcttatctggccactgagcaggcggatattgatttctttgacgccaatgcgattgcagctggttataccgggaatgggactttgcctgccggattggtggcatgggaagcgacaatccaggaaatgattgcgcaatacatgattgcattcccgcatacgccgttgttcatcaccggcgcgcgtccttacggcggagattcacaagaagtcggcacaacggcgatgaatgatatttttgactggggcgtcgcgacgtatcccgggaggtttgggatcatgaactcccagttgcatgcaacttctgccgccggttattacctcaacgctgccatctacggcaactacttgtatgagccgaccggcattcagtttctctgcaacagtgctagtgacgacaatgttgcccgcctgagcaattctccaccatatggcgacgacccgcttctctcggcttacgatgccatgaataattcgtttaccgcagcggtgaattttggctgcaagtttgtcgaagtctatgagacggatgtcgagaacccggcatatcaaacgatgttggcgactcagggagcagctcttcaattaagggcggcggaaacgccgacggccgacctcagcgttaccgtaacggacggagtgactacggtaaacgctggtacgtcggttacctgcacaattgtggtgaccaatggcgggccgggtaatgttactggcgcggtggtaagcgacaatttcccggccatttttaccggcgtgaccttcacggcgacgcagaccggtggcgcttcaggattcaccgcnagtggaagtggcaatatcaataatactgttacgatgccagccggcagcgttatcacctaccgagccaccgggacgatcagcccatcggcaaacggcacacttgtggacacagcgacggtaaccgctccaggcgacgttccagatccaaatcttgccaacaacatcgcgactgatattgatacaattgtgttatcggctgacctcaaagttaccgtaacggacggaaagagtaccgttaattcgggtacggcgg

SEQ ID NO: 416 - DNA, 4000 bp, Escherichia coli
  misc_feature (968)..(968): n is a, c, g, or t
  misc_feature (1324)..(1324): n is a, c, g, or t
  misc_feature (1936)..(1936): n is a, c, g, or t
  misc_feature (1992)..(1992): n is a, c, g, or t
  misc_feature (2006)..(2006): n is a, c, g, or t
  misc_feature (2045)..(2045): n is a, c, g, or t
  misc_feature (3083)..(3083): n is a, c, g, or t
  misc_feature (3371)..(3371): n is a, c, g, or t
  misc_feature (3492)..(3492): n is a, c, g, or t
  misc_feature (3494)..(3495): n is a, c, g, or t
  misc_feature (3497)..(3497): n is a, c, g, or t
  misc_feature (3503)..(3503): n is a, c, g, or t
  misc_feature (3509)..(3509): n is a, c, g, or t
  misc_feature (3521)..(3521): n is a, c, g, or t
  misc_feature (3527)..(3527): n is a, c, g, or t
  misc_feature (3530)..(3530): n is a, c, g, or t
  misc_feature (3536)..(3536): n is a, c, g, or t
  misc_feature (3539)..(3539): n is a, c, g, or t
  misc_feature (3545)..(3545): n is a, c, g, or t
  misc_feature (3548)..(3548): n is a, c, g, or t
  misc_feature (3551)..(3551): n is a, c, g, or t
  misc_feature (3557)..(3557): n is a, c, g, or t
  misc_feature (3569)..(3569): n is a, c, g, or t
  misc_feature (3968)..(3968): n is a, c, g, or t
cattaatgtttgacatagctgttgtgtatttcgatcatctaattgtttaattttctaacaacgtgtagcggactacatcaagttataaaaacaagtaatatgcctataagcagccaatttgattaacaatataatgagttcacgagacattattttgccatatcagcagatataagtttgtgttttgtcaaacatattgattattcatctcccaccctatctatcgtttcttgccctatcgtttgtacacttcaatcatttatcgtaactttgttccatattattaatataaggaataaagtgtattaatattaagctctgaaaggatatgctaaacattgcaattataggaggaggggctgcaggattttttgctgctatttcggcaaaaacaaaaatgcccaattccaatgttatagtgtttgaaaagacaaatcgtatactagctaaggttggtatttcggggggtggacgctgtaatctaactaactcgtttgccgatataagcgatttaaaacaagcttatccgcgtggcaacaaactgataaaacgactttttaaaagattcgattataacgatacttttcaatggttcgaggctcatggagttcaattagtaacacaaccagacaattgtgtgttccctttttcgcaaaattcacaaaccattatcgattgtttaacacatacagcacaacaacttggtgttgatgtttgtttgcaacatagacttacaaacattactaaacaaacagaaggaaaaatagaagtacactttaaagataagccttatcgtacattcgacagagttattataaccacaggagggtcgctacgtactgcaaacttacaatatttagagaatttagggcacaaaatagaagcgactataccagcactatttacgtttaatatagccgaaaaggcgttcaaaaaccttatgggaacagtagtagaacacgttttantatctattcctgctactaaatttcatagcaatggggctttgcttattacacattggggtatgagtggacctgctacactaaagttatcgtcgtatgctgcacgatatttagcagagaacaacaataaaacaccagtatctgtgaactgggtgaacgaaacaaatgcgcaatctgttgcacaaaacattactgccattgctactgaaaatgctaaaaagcaaatagtaaacacacgtccatataaccttcctactcgcctttgggaatatttactgcaacgcgctaatatagaaaaggagaaacgctggatagacattggaaagaaagcaatgcacaaacttattgagactcttacnaacgatgtacaccaaatagagggtaagggtagctttcgcgatgagtttgtaacatgcggtggaattagtttgaagagcataaatcctaatacactggaaagcaaagtgtgcaaaggagttttctttgcaggcgaagtgctcgatgtagatgccattactggaggatttaacctacaagctgcatggaccactggttatgttgcaggacaagaagtatgtgtttaagatacatcaacagaatgtaaacaaaacctaaataaaatatatttagcgaatcaaatgttaattcccgaataacaagacagaagtctctaaaaaacaagaaactgcctacttcacactatctaatttggtttcgcaccgcaaaaaagtaggtatcggttagcgaaatataggcttttgcatggtaaaagagccgttttcgcatcacaaaaataggtatttctgcatgaagaaactaatctatatgtattctataatgttctaaacacgaaataattaagacttaattattgcacatatccatttcttttttctataaaaccttatcactcaataattaaagaatgcacacaattggttgcctttttctgaaaaaagaataatattgantgaaaaaacgctcggcatttgctatattaagaggttaaaaataaacacttaacaanatttattaacaaancaaaggtcatataaaaatctatgtatcattactttatcnagtggtatatattagccaagatatacatttgcaaacgtttgcatgatattaatcaaaaaacgagcaaaaaggttttgcaagttcgttttattattactacctttgagccatataactaacaactatatgaacttacaatttaatatagaatacaagacatattacggacaagaacttgttcttaatatagtaggtaacgagggttccgaagccaattcggtgtgccaatacagaatgcacacgtacgatggactggtttggacagtggatattaacaaagaaataaagcccggcacggtgatagactacttttatagtgtacacgttggcgaccacgaggagcgtcgtgggtggagtgttgcaccccatagggtaatgttcaattcatcgcaagcattgaattacaggatattcgaccattggagagaaattcctgacaatgctttcttatactcttctgccgtaaccgactgtattgttggtgcaaaaccagagaacctaaaattagagaaattcagcaaatatgtatgcttaaaggtgcgtgcacctcagcttagtgtaggcgattcgctttatttaataggagcagacccactattgggatcgtggaaagagcagaaagctgtaaaaatgacacaggtttctaccaacgaatgggctgtatgtttcgatgtaaatcgtctggcaagcaacaagttagagttcaagtttattattgtaaactctaacaaagaatactctccaatgtgggagaattgtaacaaccgcaccattgaactaccttcaatggaggaaggcgatgctataatatacgaactagacgaagcctatttcactttacccacaatgcgcgtagccggtacacttgtgccgttattctctctacgatctgatgatagcttcggtgttggagactttggcgacctaaagaaaatgatagattgggtaagttcaactcaacaaaaggcacttcaaatcctgccaataaacgatactaccatcacacacacgtggacagactcttatccttatagctgnatctctatctttgcactgcatccacagtatgtaaacctaaatcttctgcctgcattaaaagacaagatacaacgcgaacgcttcgaaaatgaacgcaaaaaactgaatgcactaccacaaatagactacgaacgtgttaacgaacttaaattagcttatcttaaactcatctttgagcaagaaggaaaagacacaattgcaagtaaagagtataagaaattcttcacagaaaacgaaagttggttggttccttatgcacaatacagcatgctgcgcgataagtacggnactgcagaatttgctaaatggccagaccacaaccaatgggacgaagcagaaagaaagcaactctctacaagtggtagcaaggcttacaagagtgtagagttctactattacgtacaattcntnntnagtagncagctnaaagccgtacangaatangcnatttcnaancacgtnatnctnaaaggngatattcctatnggcgtaaatcgtaatggctgtgatgtgtggatggaaccacgctacttcaatttgaatggtcaggctggtgcaccacccgatgatttctcggtaaatggacagaattggggtttcccaacctacaattgggacgctatgatagccgatggttgtaagtggtggttacatcgtttccagaatatggcaaactattttgatgcttaccgcatagaccacgtgttaggtttcttccgcatttgggaaattccagccaatgcagtgcacggtcttttaggtcagttcgcaccagcattgggtatgacacgcgaagaagtagaaggctatggactacgctggcaagaggaattattcacagaacctttcattaccgattgggtattagaccgtattttccgtgancatacgaacgaagtacgcgacaaatacataga

SEQ ID NO: 417 - DNA, 4000 bp, Escherichia coli
  misc_feature (1)..(120): n is a, c, g, or t
  misc_feature (400)..(407): n is a, c, g, or t
  misc_feature (409)..(410): n is a, c, g, or t
  misc_feature (413)..(421): n is a, c, g, or t
  misc_feature (423)..(430): n is a, c, g, or t
  misc_feature (432)..(436): n is a, c, g, or t
  misc_feature (438)..(438): n is a, c, g, or t
  misc_feature (441)..(443): n is a, c, g, or t
  misc_feature (445)..(447): n is a, c, g, or t
  misc_feature (449)..(452): n is a, c, g, or t
  misc_feature (454)..(454): n is a, c, g, or t
  misc_feature (456)..(457): n is a, c, g, or t
  misc_feature (459)..(460): n is a, c, g, or t
  misc_feature (462)..(466): n is a, c, g, or t
  misc_feature (468)..(472): n is a, c, g, or t
  misc_feature (474)..(474): n is a, c, g, or t
  misc_feature (477)..(477): n is a, c, g, or t
  misc_feature (480)..(480): n is a, c, g, or t
  misc_feature (482)..(483): n is a, c, g, or t
  misc_feature (485)..(491): n is a, c, g, or t
  misc_feature (494)..(494): n is a, c, g, or t
  misc_feature (496)..(496): n is a, c, g, or t
  misc_feature (498)..(506): n is a, c, g, or t
  misc_feature (508)..(508): n is a, c, g, or t
  misc_feature (510)..(512): n is a, c, g, or t
  misc_feature (515)..(518): n is a, c, g, or t
  misc_feature (521)..(523): n is a, c, g, or t
  misc_feature (525)..(531): n is a, c, g, or t
  misc_feature (534)..(534): n is a, c, g, or t
  misc_feature (536)..(537): n is a, c, g, or t
  misc_feature (540)..(543): n is a, c, g, or t
  misc_feature (547)..(549): n is a, c, g, or t
  misc_feature (551)..(551): n is a, c, g, or t
  misc_feature (553)..(553): n is a, c, g, or t
  misc_feature (555)..(555): n is a, c, g, or t
  misc_feature (557)..(565): n is a, c, g, or t
  misc_feature (567)..(568): n is a, c, g, or t
  misc_feature (570)..(571): n is a, c, g, or t
  misc_feature (573)..(576): n is a, c, g, or t
  misc_feature (579)..(579): n is a, c, g, or t
  misc_feature (581)..(583): n is a, c, g, or t
  misc_feature (585)..(589): n is a, c, g, or t
  misc_feature (591)..(598): n is a, c, g, or t
  misc_feature (600)..(600): n is a, c, g, or t
  misc_feature (602)..(602): n is a, c, g, or t
  misc_feature (604)..(609): n is a, c, g, or t
  misc_feature (612)..(614): n is a, c, g, or t
  misc_feature (616)..(617): n is a, c, g, or t
  misc_feature (620)..(620): n is a, c, g, or t
  misc_feature (623)..(627): n is a, c, g, or t
  misc_feature (629)..(629): n is a, c, g, or t
  misc_feature (632)..(634): n is a, c, g, or t
  misc_feature (636)..(636): n is a, c, g, or t
  misc_feature (638)..(646): n is a, c, g, or t
  misc_feature (648)..(650): n is a, c, g, or t
  misc_feature (652)..(653): n is a, c, g, or t
  misc_feature (655)..(657): n is a, c, g, or t
  misc_feature (659)..(667): n is a, c, g, or t
  misc_feature (669)..(670): n is a, c, g, or t
  misc_feature (672)..(676): n is a, c, g, or t
  misc_feature (678)..(690): n is a, c, g, or t
  misc_feature (692)..(701): n is a, c, g, or t
  misc_feature (704)..(704): n is a, c, g, or t
  misc_feature (707)..(707): n is a, c, g, or t
  misc_feature (709)..(716): n is a, c, g, or t
  misc_feature (719)..(721): n is a, c, g, or t
  misc_feature (724)..(726): n is a, c, g, or t
  misc_feature (729)..(731): n is a, c, g, or t
  misc_feature (733)..(735): n is a, c, g, or t
  misc_feature (738)..(741): n is a, c, g, or t
  misc_feature (743)..(743): n is a, c, g, or t
  misc_feature (745)..(746): n is a, c, g, or t
  misc_feature (748)..(752): n is a, c, g, or t
  misc_feature (754)..(755): n is a, c, g, or t
  misc_feature (758)..(758): n is a, c, g, or t
  misc_feature (760)..(762): n is a, c, g, or t
  misc_feature (765)..(765): n is a, c, g, or t
  misc_feature (767)..(772): n is a, c, g, or t
  misc_feature (775)..(783): n is a, c, g, or t
  misc_feature (786)..(789): n is a, c, g, or t
  misc_feature (1034)..(1034): n is a, c, g, or t
  misc_feature (1075)..(1075): n is a, c, g, or t
  misc_feature (1090)..(1090): n is a, c, g, or t
  misc_feature (1093)..(1093): n is a, c, g, or t
  misc_feature (1099)..(1099): n is a, c, g, or t
  misc_feature (1108)..(1108): n is a, c, g, or t
  misc_feature (1114)..(1114): n is a, c, g, or t
  misc_feature (1129)..(1129): n is a, c, g, or t
  misc_feature (1136)..(1136): n is a, c, g, or t
  misc_feature (1183)..(1183): n is a, c, g, or t
  misc_feature (1199)..(1199): n is a, c, g, or t
  misc_feature (1201)..(1201): n is a, c, g, or t
  misc_feature (1210)..(1210): n is a, c, g, or t
  misc_feature (1420)..(1420): n is a, c, g, or t
  misc_feature (1648)..(1648): n is a, c, g, or t
  misc_feature (1729)..(1729): n is a, c, g, or t
  misc_feature (1741)..(1741): n is a, c, g, or t
  misc_feature (1747)..(1747): n is a, c, g, or t
  misc_feature (1765)..(1765): n is a, c, g, or t
  misc_feature (1798)..(1798): n is a, c, g, or t
  misc_feature (1807)..(1807): n is a, c, g, or t
  misc_feature (1828)..(1828): n is a, c, g, or t
  misc_feature (1831)..(1831): n is a, c, g, or t
  misc_feature (1837)..(1837): n is a, c, g, or t
  misc_feature (1990)..(1990): n is a, c, g, or t
  misc_feature (2513)..(2513): n is a, c, g, or t
  misc_feature (3667)..(3667): n is a, c, g, or t
  misc_feature (3679)..(3679): n is a, c, g, or t
  misc_feature (3682)..(3682): n is a, c, g, or t
  misc_feature (3718)..(3718): n is a, c, g, or t
  misc_feature (3734)..(3734): n is a, c, g, or t
  misc_feature (3736)..(3736): n is a, c, g, or t
  misc_feature (3775)..(3775): n is a, c, g, or t
  misc_feature (3966)..(3966): n is a, c, g, or t
  misc_feature (3996)..(3996): n is a, c, g, or t
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntaatgtattatacctaaatcctggtgccgcaggtagacatggttttcataaaaaaagaactatgataagatttgaaattaatgaagataaaattgaaaatatggaagtaattgaactaggaaatcgttcaaagctacctcaatctatttgatgaactaattatagcttgatctttttttattgaactaattgacataaaaattaagaaaaaagagattaaaaaatatataagcccaggatctataattgaaatttttaaagatctttcgtcaaataaatnnnnnnnncnnaannnnnnnnntnnnnnnnnannnnncnatnnntnnntnnnntngnntnntnnnnnannnnnanaantantnntnnnnnnnatnantnnnnnnnnntnannnaannnntannntnnnnnnnatngnntannnnaacnnnantnanannnnnnnnntnntnntnnnngancnnnannnnnannnnnnnnantnannnnnnttnnnannaanatnnnnnanatnnntnannnnnnnnntnnntnnannntnnnnnnnnntnntnnnnncnnnnnnnnnnnnntnnnnnnnnnnttnatnannnnnnnnatnnntannntgnnnannntannnntncnnannnnnanntanannnaancnnnnnnttnnnnnnnnnatnnnncataagaggaattcctactatgctcttatttaaagatggagctgttcaagccacaaaggttggcgctctctcaaaggcgaatctaaacgctttcttggattcaaatatttaactatcaacctaatttcttaaataaataatataaaactctaaataaatcactctttaaaacaaatatttatatccattgttttttcatctggcactttgccatccctcacaaaacttataaatctatatgaaantatcagaacttaaaattaaaacgcctgccgaacttcttgancttgctcagtctctnggnattganaatatttcnagagcnaaaaaacaaaccctnatatttncaattcttaaatacaaggctgacaatgaagaggaggttttgggaganggtgttttagatatantncaagaaggntatggttttttaagatcttcaaatgattcatatgtttctggtccagatgatatttatgtctctcccaaccaaataagacgttttaacttatcaactggagatgttgttactggaaagattagggccccaaagaaaggcgaaaaatattttgcacttgtcaaagtttctgaagttaatgaggattcaccagaaaatataagaaaccgaatnccattttcttccttaacaccacttcatccaaatcaaaggcttggacttgagctaggaaatggtggtacagaagatattacagcaagagttattgatcttgttgcaccttttggaaaaggacaaagaggactattagttgctcctccaaaggccggcaagacaatgattatgcaaaatattgcgtcttcaattgcagtcaaccaccccgagtgtgaactaattgtactnctaattgatgaaaggcccgaagaggttactgaaatggagcgtacagttcgaggagaggtcatttcatctacatttgatganccagctaaaagncatgtncaagttgcagaaattgtnatagaaaaagccaaaagaagagctgaacaaggnaaagatgtnatcattttgcttgactcaatnacncgtctngcgagagcttacaatacagttgccccgtcttcaggtaaggttttaactggtggtgttgatgctaatgcgctccaaagaccaaagcgtttttttggagcagcgcgtaatattgaaaatggtggaagtataactattatcgcgactgctttagtngacacaggatccaagatggatgaagtcatttatcaagagtttaagggtacaggcaatatggagcttcatcttgaaagaaggctgtctgaaaaacgtatctttcctgctataaacattaatgcttcaggtactaggcgtgaagagctcatcactgatgagcaagaacttcaaaagatgtggattttaagaaaaattcttcatccaatggacactgtcgaagctgctgagtttttaattgaaagactgaggttcactaagactaatgatgagttttttgattcgatgaaacaaaagaagtaaaggctcgcttatcagctagagtattttataattaacttaatgctgtcaaaaatctttaattttccaaatacaatcatttcaagatatttactgaaaagtttaatcgtttttcttgtatctattttttttattattgggcttatcgtttttggtaatcagtttgttctaactgttcaggagagtgttgagcatggcattccttttcaggaattaatgccaattnttggttttaatatgctccgtgatattcctattatattttctctttccttattcttggctatcataatttctatatctcagatgtataaaagctctgaagcggtcattatgaattcagttgggataggagataaaggctttatctattatattcagccgattgttattctttcttttattgtagtttttattctaactatttatgctgttccatgggctaaacagcaaaaaagttttgcagaggatcagactgttaatgcttctgagttttcgtttattactgaaggaaagtttgaaagctttaaaaacggtgatattgttttttatgcatcggaatcatcggcaatagattcggcaggtgaacaaaatatggaagaggtgtttatttatgtttctagcaaagagagtcctgtcattgtattggcatctgaggctacgaaatatactgactcaactagtcaaagtatttatttaagactcaaggatggcgttagatatgaaggacttcctggtgatttaaatataaatatcttagattttgatcaatatgatttagagatagtatcaggcgaagttcaaaaatcactctctaatttctctgaaattgaagaaaaaagctctattaatttgttatctgatggaagtttgcttgcaaacgctgaaatgcaatggcgattttcccagccactatcaatattgattttgtcagttattggagtgcttcttgggaaaacttcaccaaggactggcaagggtattaatttgttaattggcgtattaatttttatgctttataacaatggactgctggtagcaaaaacctcaattgaaaatggtgaattagacccatctattggcttatggtcgatacatgtaatgtttattttatttttgttaattttttatcagcttagacagggaaaagtttcttattttattgataaaatagcgtttttaaacaaatagagaaatataatgtctagttcacccagtaaaattttagaagtctttgataatccaaattctgagagagatttcgtcattcgaattgattcatctgaatttacttgcctttgcccattaacagggcagcctgactttgctgatatacatattgaatatattgctgacaagctttgtgttgagttaaaagcnttgaagaattanttntggtcatatagaaatgaaggtgcttttcatgaagcngtaactaataaaattntngatgatttggttgaagttatgaatccaaggtttattagnctaaaagctgtctttaatgtaaggggcggtgtttatacaaatgttgaatgcgaacatagaaaagaaggttggtctccaagagaagttgttagtctatgagtccaattcgtcaaaaggttaaatttgacaaaaaattattagatcaagatgctttaaagatcttaaaaaaattaaataattcaggccatganacttatttagttgggggttgtataagaganattc

SEQ ID NO: 418 - DNA, 4000 bp, Escherichia coli
gctttttgattgtcgacgcggatcttgagtaggcctgccgggcttggaaggctcttggccccagtttgaagaaggaagaaacgctggcgctgattccggaagaaaacgtcctcatggacacggaaaaagcgtggatttcagtccggcaactttctacgggtttcggaatgaggctgacagacgcggccacttcggaggaacgagcccccaagaacccggcaaaaccacggttcaataccagcaacgttccgtgggtttcgaaacggtgccgagacgggaggtcccgccacccaccacgggtagacattgttttggaacccgccatggctcactccggacaggtaaagagggggaacaagcaagatcggccgcgaactgaggtccgccacatcaacgtgttgcccaaatccacgcgcaggaacgatgtcgttctcacccgcccctctgggttgagacctcaagccccgtgccaacacttcgatgtggcgcacggcgcttcgtgggaggttcggacgccaacccgctcccttccggctcggagtgaccgaccgaggtccccaaaaaaaacggtttacgcatggttcatggtgttggcacggggcttgagatccccatccaatggggggtggagaagaacgaccgccgttcctgacgcgtggatttgggtcccgccggcggtctgggattgtgggctcagcctcgggctcccgtgcccaccgtctccgcccagggcgagagggcggccaggaccgactccgccgggaccgacgccatgatccgggtcaattcctcggccgttcccgcgatcgcccgcccgtcgtaccggtagaagtcgagatgccgaccgccgatggccgggttggggatgaggacccagtcgtcccgtcggggatggacgggcggattgaaggtgggcgtctcgatgacccattggcggggcacacccatcgcggcggccacgtgcatgaagaccgtgtccacgctcaggaacccgccggcgtgacccaccagggccatggcctcgcgcaatccgggggtggccgcctcggtgaactccaccccggccgcacgcaatgccgcatgcaagggccgctcctcggccgacccgaataggaccgccggcacgccgggatgccggatgcgccattcccgcaggaagtccgcgaagtgccccaccggccagcgccgaagggccaggttcttggtgccgcccgaacccacatgaatcccgagccacgggcgcccggccagaccgcgctccgccagccaagccccggcccagccgcgctcggccccggagaggaacacctcgtaaccgggacgcgccagccggggcgcgaggcccagcgtcgccagcaggcgcacgttgttctccatcacgtgcaccgagtagtcctgggggatcgaccgggtcaccaggcagcggtccagccacgactggttctcgtaggcatggctgaggcgctcccgggccccgacgagaaaggcgatgagacgataggcccggcgcccctgggtatgggtgttgatcgacaggtcgtagcggcgacgcctcagctccagacaccgcgccaccgaggccatcggcccggaccgcaggaagtcgtggcgcagaacctcgcgcacgtgcggattgcactgcagcacctccgccgcacccgcccacaggaccagcacgtcgatcgccgcgccgggatgttgcaggcgcaactcgtgcagcagcggggtcgccatcagcgtgtcgccgattccggaaagggacaggacgaggattcgggtcaccgggaccgaaccgtagggagccgccgccccggccacaaggcgcggccaaaggccctcgttccaccgtcggtgcggagggcccgccgaggcggccggatcccccgggcccggttgcgccgggccccgcgccgccgagcgcacgagcgcacgggcgcacgattttgtccccgcaaatgacttgcggtgcccccggttcggaacaatgttaaagctccgcaggcgacgatcccttcctcggaatcgtccactttccccaggtcccatccccgtccggaactgcgtcggcgccgttgaaggcaccccgagggaacccatccgatccgaaccgattttccacatgccgcgcgcaccgaaagatccgtccgccccgaagaagccccgggcgccccggaagaaacccgacgcatctgccgggatcgccgaagacccgtccgaacccaccttggccgggccgtctgcgatcgacatcgccaccggcggggtcaccggggacacccggcatcccgggaagtcggccgggaagcccgcggaccgggtgccgtcgggcgccgagggcggcgggaaggcctccggggattcgcccagcctccaggacccgccgaaatccccggagtccgggcacgcacctgcccgacggggccgtcgtgcggccgccgacgacggcaacctgctgagcagcgtgtccgccccgcccgcagacgcacccgtgacgcgtgagaacgaagacgaacccctggtggtcaaggcctccccgctgccgccgagggccccgatggccccgcccaacgaggacaccccggccccggaggctcccgagaaggccacggtggcgatcgaaccccgcacgctgaacctccacgagctgcagccgatgcccatcggcccgctggccgaggtggccaagcatttcggcatcgagaactacggcaccctcaagcggcaggagatcatcttccaaatcgtccagcgcaacctcggcgcgggcggcatcatcaacacccgtggcgtcctggaggtcatgccggagggctttggattcctgcgctcgccggccttcaactacctgccctgccccgaggacatctacgtctccccgtcgcagatccgccgcttcgacctggccaccggcgacgacgtcgaggggcaggtgcgtccacccaaggacaaggagaagttctacgccctgctcaaggtcgagcgggtggccggactggatcccgacaaggccaaggaaaagacccatttcgagaacctcaccccgctcttcccgaaccgccggttcctgctcgagaccacgcccgacgagtacagcacccgcgtggtggacatcgtctgcccggtcggcaagggcacccgcggcctgattgtcgcccctccacgcaccggcaagacggtgctgatgcagaagctggccaacgccatcctcaagaacaacccggactgccacctgatcatcctgctcatcgacgagcgccccgaggaggtcaccgacatggagcgttcctgccgaggcgccgaggtcgtcagctcgaccttcgacgaaccgcccgagcgccacgtgcaggtggccgagatggtcatcgagaaggcccgccggatggtcgaacacaagaaggacgtggtcatcctgctcgattccatcacccgtctcgcgcgcgcctacaacacggtgcagccgcactcgggcaagatcctttccggcggcgtcgacgccaacgcgctgcacaagcccaagcggttcttcggagcggcccggaacatcgaggaaggcggctcgctgaccatcatggccacggcgctggtcgacaccggcagccgcatggacgaggtgatcttcgaggagttcaagggcaccggcaacatggagatccacctcgaccgctcgctggttgatcgccgcatcttcccgtcgatcaacatcgagaagtcgggcacccgcaaggaggagctgctctaccaccccgacgaataccagcgcatctcggtcctgcgccgagccctggtcggcgtgccgccggtcgagtcgatggacctgctgctcggcaagctcaagaagacgccgaacaacatcatgttcctgctctcgatgggcccgtcctcccggtgaggcgatcctccgcggtcttctgaaatagagcctgacagaggggcccgccgacaggacatgccgcgggcggaccatccttggggaacctcccagaaactcaggggagaagcg

SEQ ID NO: 419 - DNA, 4000 bp, Escherichia coli
  misc_feature (2)..(3): n is a, c, g, or t
  misc_feature (6)..(8): n is a, c, g, or t
  misc_feature (10)..(14): n is a, c, g, or t
  misc_feature (17)..(18): n is a, c, g, or t
  misc_feature (20)..(21): n is a, c, g, or t
  misc_feature (23)..(25): n is a, c, g, or t
  misc_feature (27)..(28): n is a, c, g, or t
  misc_feature (30)..(31): n is a, c, g, or t
  misc_feature (35)..(35): n is a, c, g, or t
  misc_feature (37)..(42): n is a, c, g, or t
  misc_feature (44)..(49): n is a, c, g, or t
  misc_feature (51)..(56): n is a, c, g, or t
  misc_feature (59)..(68): n is a, c, g, or t
  misc_feature (70)..(82): n is a, c, g, or t
  misc_feature (84)..(84): n is a, c, g, or t
  misc_feature (86)..(89): n is a, c, g, or t
  misc_feature (91)..(93): n is a, c, g, or t
  misc_feature (95)..(96): n is a, c, g, or t
  misc_feature (100)..(103): n is a, c, g, or t
  misc_feature (398)..(398): n is a, c, g, or t
  misc_feature (931)..(931): n is a, c, g, or t
  misc_feature (1249)..(1249): n is a, c, g, or t
  misc_feature (1989)..(1989): n is a, c, g, or t
  misc_feature (2054)..(2054): n is a, c, g, or t
cnnccnnngnnnnnaannannannntnntnntgtngnnnnnntnnnnnnannnnnnccnnnnnnnnnnannnnnnnnnnnnncngnnnntnnnannaacnnnngcccggaagctcagatcaatccttgtggcccagtaacacacacttcatattagcatttggatcgaccatgtcctgtcatagtgagaggtttctcaaggcaaacaaggccttggtttttgcctcaacaggctcgataatgaaggttcgatcaggccggaaaacatgtctcaagaggctgcccattcatcgatcttattgctcgggatcaacgcaaaatacatccacgcttcctttggtcttaggtgtattcaggctaaccttggtccgctcaaggcccagagctaccttctggagngcgaaatcaaccaacggccggctgagatcgtcgagaaattattggataggcaacccaaaatcatcggtattggcgtctacatttggaatgtggatgtagtcaaatccgtggtcgggattctgaaggctgtttcacctcagacacacatcatcctgggggggcctgaagtgagctttgaaatggatcagcaaacctggctaaaaaccgcagatcatgtggtcacaggggaaggggaggtagcttttcgagacctttgtgagcgtatcctgagcccagcaaactccgagcccctcccgtggatgataccagggggactccctgacttggcacagttagaatgggcttatccactttatttggatgaagatctagcccaacgcgtggtttatgttgaagcttcaagggggtgtccgtttacttgcgaattttgtctctcatcgctggatacgccagtcaggggttttgataccaatgctttccttgatcaaatgcagcttttattggatcggggcctcaagcatttcaaattcgtngatcgcaccttcaatctaaatctacggacaagtcaatcgattctggatttttttctggagcgtatgaaaccaggcttattcctgcacttcgagatgattccagaccgtctccctggggctctcagggagcgaatcgctcaattcccagcaggaagccttcagctggaaataggcatacagaccctcaatccagtggtttcagacctcatcagtcgccgacaaaatgtcaataaattgtgcgaaaacctgcactatctccgaacatccacccacgcccatttgcatgtggatttgattgcaggattacccggggaaganctcatgagttttgggaaaggttttaatcaggtgttgggcttggatcctcaagaaattcagatcggtatccttaaaagactgagaggaacccccattacaaggcatgatcagactcatggcatgatttatgatcagcaagcaccttatgaagtgctcaagacagctgacatgacttacatggcactccaacgggtcaaaaggttggcccgatactgggacttggtcgccaatagcggtaatttcacgcaaactgtccgctacctatgtcacgatagatccaatcctttcgaagctttcctgtcttttagtgattggctctttcagcacactggccagcggcacggcatggctttgacacgtcttttaaaccatatctggttctacctcacggaggttcaaggcatgaatccagctgtcatcgcggactcgctatgggcagattatcgagctggcgggagaagtgatatacccatctgtttgcgagatcacatcaggattaccaagaaagaccaatccgcagcaaaaggatctgatgccaaggatccgctgaaagaagcgaatcaaaccaagggcgacaaagttcaggaaaaggattcttcgaggttacaggccaaccgccgacaaagccgacatgaccgcaaatcgcacccgtaatacgcctcaactaaaggattcctcaaggatcacaggctcaagcaaaagccccgactaaatttcgcacaatatttgttatgtctagntcgtcactgccggcatcttagtggtagtattgggatgtgtggatgagaattatgcatgagttctnagcacaaaccgagactgcctgccccacggatcaatttgagggctttttccagggttgttctggaaacacctcaggtgtccgatagcctgtgggtttgggacgattaacttcgagcgagggttcttcattggcaggctcattgggcgtatccatacccattttccaggaggcaatcttcgcttgaagcccatgatgctcagctttttccttgttgccaattttcacgtaaaaaagcgagaggttggtgtgaagcatcggatgattggggcaaagcgactccacctggtggcccaaccgaatagcctcctgatacgattcttgacgataatgggccatggccagactcatgatggcatccgggtaatctggggcttcggaaaggatctcggtgagtaaattgatagcatggtcgtatttcgcctgagaaaaaagaaacatagcctcgtcatgcttggctaggatggcctcgctttgttgcggtggcagctcatgttcactttccatgactaaatcttagtgaaccgaccttcgcagctcaagctggcatatacatatcgatgtcattgaagcattcgtgcatcatgttttctctttgttcagatccatgatttacccttagcggcggttgagcaaggggccctatcatgctatgagtaacatcaccatgggcaattcctccagtcccgtttctgggaccatgcttaatcgcgaacaactcgcccgtctgtatgatatcagtcaggagcttcaagccacgctcgaacccaaagtcgcactccaactcatcctccgacatgccatcgaattgacggctgccgactcggcaagcatctcgcttgtcaatcccggtaatgcgctccttgaattagaagcctctcggggtttgcctgagtcattaactcaggactatcagctagccttggggcgtgggatcaccggttgggtagccaaacatggctcccctgccctgattgctgacgtcagggaggatgctcgttacatgtctctgtggggcgatgtgcgctccgaattggctgtcccattcgatgtgcacggtgaagtcagaggtgtcctgaatgtcgatagcacgcaagtcaacactttcgatgaaaccgatcaggcaatgctatcggctctggctattcaggcttcaaggattattgggaatacttggcttttccagcaaatccaaggcaaggcagccatgcttgaatcccttgctcaaatcaatgaaaccctgcaacaaacccttagcctagatgaagccttggaggcagtaacccgtgaggcctgccgcctgatgtccgcgaccatgggctcagttctgttacttgatgaatcaaaggactggttggacctcaaggcctcttatggtgctggcaaaacctaccaagctaagcccagactgcatgtcgatgaatcctttgctggtgctgccttgcgccgtgatcatccaatccaattaaaggatgtgcgacattccagtctttatcaaaacacagagttggcttgtgaggaagggcttgtcagtatgttatgtgttccccttcgaaccgagtcgcaagcttttggtgtgctcaatatctacactagcgagcctcatgttttttcagttgaggaaatcaatattctcaaagcctttgccaacatttcagccatgacgattcatcgggccaggatgaataaggaaatgcgccagctggaggaagcactcagggggcgagaaaaattatcagctctaggcttgctggcagctgaggtagcccatgagatccgcaatcccctgaccgttatgaaaatggtttaccacgccctggatctcaaatttgaacccgaggaccctcgccatgaagatgctcaactcttgggcagaaaaatggaccacctcaacaaaatcgtggaacgtgtgctggactttgcccgtcacgatgaacccaaaattgaat

SEQ ID NO: 420 - DNA, 4000 bp, Escherichia coli
  misc_feature (1267)..(1267): n is a, c, g, or t
  misc_feature (1651)..(1651): n is a, c, g, or t
  misc_feature (1663)..(1663): n is a, c, g, or t
  misc_feature (2770)..(2770): n is a, c, g, or t
  misc_feature (2878)..(2878): n is a, c, g, or t
  misc_feature (3249)..(3249): n is a, c, g, or t
  misc_feature (3270)..(3270): n is a, c, g, or t
  misc_feature (3402)..(3402): n is a, c, g, or t
ttgcgccagttgcaccgtatagtagtcacctgttaccaaacgagcactatctgatctaacgatcattccgccggcctgaaatcccacaaaagctgcagaatctgcagaattcgagaggtcgaattgcgcgattgagtctccattggcgtaggtcacggttcgcaaattttcggtgaagtagcaatcgcatcccagccgtgtcgttccatacgaatgaccgaggtattcgaatgaaacagggcaagctcctgcgcagaacagaatctcaaccccctcattcagaccgttgacgttctttacaaaggcccgaaaactgtattcattgctgtactcaaaaggcaggttgacggttaacgttgaatccgctgccaatgacgagaaggcgagcgttgtgtcaccggccgcactcaaatcggcgcggtaccaggagaatcccacggaatctggctgggcaatatcttctgtccatgtaaaacgtgcgttcaaatacgccgtcgaatcggttggattcgtaacaggaagtgtagtgacatccaccaaggtgaaaaactggatagtatcggttttggaggttccaatttcattctcagcaaaccctgcggcgaaatactgcgctccgggcaataagtcaggtaagaccgccgagaatactgagtctgaaggaatgtaagtcagcacagaatcggctgcacctaccaaatcgctcgaaatgccccatttgatgtaggtgctgtctggaccaactccacccgtatccgtcaactttacagctaacttctccaaagagccatcccatgtgatggtgtcgatcactggcgcaatcgccaacgtcttgaatgttaacgtgtcaccgtaagttgttcctgtgctgtttgttgcgctcgcggcgaagtaataatcggtgtaccgcgtcaagccctccgcaatcactgcgtactgatcatcgcatgccgttgtggaattggtgatgccttcgctgtaattgatggtcgagtcttgcgcgcttgccaaacttgccgccgttccccacttgaaactcaaattggtgatggcatcgtcaaatgcgaaacaagcgtttaattccgcttcatgtgccgaaatcgatgcagcagattcagtgactacagccacggacgtcgcaaaggggatggtgtctgaaccggtgcctccaacgttcgccgcgaagcttccgacatgataatttgtgccatctgccagaccggtaaaagccgccgtgaacgtactgtcagaaggttggtatgtgctngacaaggtgtcgccaggtgcactcaaatctgcgtttacgctccaaacgaagtaggtcgaatctggaatcggagtgccgttgttacctccgagatccaaaaggcgcccggtcatgacctccgtctcagcgtcccaagacacgacgcccaacgtgggtgattccggcaaggtcttgaatgtcatgctgctctcggagtttcctcgtccttggacattgtctgcaaaggctcggaaatagtaatccgtgtaacgcgtcagtcctgtaataactgcggagtgtgctgtcccgccggtgctgtcggaactgatgcttccgccgtcaaacgttgctgctgtgaaatcaacgatgtcgtattgaaattgaaccgcgtcgggtccttggccnccggcgtcggtnatactcgtgattaaacgtgcagaagtcgaagtcaccgaagctgtatccaaagtgaaaccagatgctgtgtccgctagtgttcggaacatcaaggtgtctcccatgccgtaaagtccaaggatacttgcattgagttcttgaccattgatggaaatcccttggccattgaattcacgcattaatgaatcgttcgccgcaattggaatggcgatgtattccgagtaacgctcgagtcccacgatggatcgcgtaaagaccgaatcaacgttcaatagagcagtgtccattgctgtatgagtcggcaaatcagtgggcggcgctgttacatcgatcgcgttcacatatgtggtccaatggtccgcaagaagtgaatctgttaggagtgcaaagtccacgtcctcggtaaaaattgagtcaatctcaaaaaaaccaagggaatcattccacacatcctgtttgccataaatgacgccccaaatgcgcatggcggctccaccatcgtcggtcactttggctttgatggaagccgtgtgctgagcgatgctcatcacctcttgggtcaataccgttggcgggccgagcaacgcctcgtccaattggatttgcagggacagaatgctgtcgcggagaacgtaacagtcatgccacatgttgattgtgtttcctgcaatagaacccgacacatagacatcgtatacggtatccacttccaaagcgcctgcaatgcgattttccaagtcccgaatcatgagcatgagcgtcggccaatcgcaatccatttgcagttctaccccagcagtttgatcaatcaattgcccggtcaccggtaacgtcaacaaggtgtcaccttggtatggcacagagtcgtgcaaggcaagttgtgcctgtacatcctggcctataggtgaaaggatgcaaaccatagctaggctaaaggagagtataaaacttttcatagcggattataaattcgattaaacgattaaaatgctcgatttatggagattaaaattacgttttgtgtcgtcggtatgtttctcatgatgatgtcatataattcagacttaatcaggtttaaacttcatgtgatatcactttaggtcaagnagggtgctgaatgaaataccttcgagtgagcatcatcctttgccgccagaaatacaggaattacattgaagggaatccttatcgccttgacccattcatgggtacatngggtcattagttggtttgttgtgagcgttccattcctgctcaatgcgcaagtacaagtggatttgagcggccgcctacttttgaaaaaactttatcacacgtccgaatacaatcaagccagcttagattctgcaacggtagaacttcaacgactcgaagccaaagaagcgcaggatgccgattgtgttgaaagggaaaggttgaaggccattattgctcatggctgcgcacgtggtgggaagtccattgcgctgacatctatccttgaagaggacggagcgtgttgcccggcttccggattgtatcagtatttcttgggctgcgctttaattgacgcgggacaagacaagtcggccgccaatcgatttcancgagccattgaattgatggangaatctgatgaagccactcagccagcgtcggtcgctgaaggcgttgatttattgcgattccttagaaatcctgatctgtctattcattccaaggatttctaccacggacatctttactacgagttgctgttngataccaacttatctgaagatgagtgggtaagaaattgggagatactgaaggccaccaatgcttttcagcgagatgcattttctgagtatgtcaatgagttcttagaggagtctgataacaatgccgttttaaattacatagattccggccacgtggcggagtccaaggttgctcactggccgattgctttctttattctattgggctttgttgcagtgttggtctgcttgatggccatgcgggaaattcgcaagcggcgcgaaatttcagagaaatcatcaatcatgacgcccaaacgtgaatccggcgagaatatagatgcgccggaaggcacctccctcatgctggaagtcacggaagaagatataagtacgttgggtcatgccttgcagcgaggtgatcgtgtgggtgatgcgatgattgtggtgcgaaagctcgaaaatatgtttccaaccgatcggcaatccatcacgctcaactccatttcttcactgcagtattcggaaagtttgagtcatttggaagcgacgattgttttattgaccgttagaggcattcatgcgaaagaaattgcgcaccaattgaacatgagcaacg

SEQ ID NO: 421 - DNA, 4000 bp, Escherichia coli
  misc_feature (99)..(99): n is a, c, g, or t
  misc_feature (132)..(132): n is a, c, g, or t
  misc_feature (210)..(210): n is a, c, g, or t
  misc_feature (279)..(279): n is a, c, g, or t
  misc_feature (321)..(321): n is a, c, g, or t
  misc_feature (570)..(570): n is a, c, g, or t
  misc_feature (663)..(663): n is a, c, g, or t
  misc_feature (795)..(795): n is a, c, g, or t
  misc_feature (1459)..(1459): n is a, c, g, or t
  misc_feature (1462)..(1462): n is a, c, g, or t
  misc_feature (1971)..(1971): n is a, c, g, or t
  misc_feature (1973)..(1973): n is a, c, g, or t
  misc_feature (2265)..(2265): n is a, c, g, or t
  misc_feature (2275)..(2276): n is a, c, g, or t
  misc_feature (2284)..(2284): n is a, c, g, or t
  misc_feature (2286)..(2287): n is a, c, g, or t
  misc_feature (2294)..(2294): n is a, c, g, or t
  misc_feature (2302)..(2302): n is a, c, g, or t
  misc_feature (2306)..(2306): n is a, c, g, or t
  misc_feature (2315)..(2318): n is a, c, g, or t
  misc_feature (2328)..(2328): n is a, c, g, or t
  misc_feature (2332)..(2332): n is a, c, g, or t
  misc_feature (2340)..(2340): n is a, c, g, or t
  misc_feature (2347)..(2347): n is a, c, g, or t
  misc_feature (2350)..(2351): n is a, c, g, or t
  misc_feature (2358)..(2358): n is a, c, g, or t
  misc_feature (2360)..(2361): n is a, c, g, or t
  misc_feature (2363)..(2364): n is a, c, g, or t
  misc_feature (2369)..(2369): n is a, c, g, or t
  misc_feature (2371)..(2373): n is a, c, g, or t
  misc_feature (2376)..(2376): n is a, c, g, or t
  misc_feature (2379)..(2379): n is a, c, g, or t
  misc_feature (2386)..(2386): n is a, c, g, or t
  misc_feature (2395)..(2395): n is a, c, g, or t
  misc_feature (2407)..(2408): n is a, c, g, or t
  misc_feature (2412)..(2412): n is a, c, g, or t
  misc_feature (2416)..(2416): n is a, c, g, or t
  misc_feature (2418)..(2418): n is a, c, g, or t
  misc_feature (2422)..(2422): n is a, c, g, or t
  misc_feature (2429)..(2429): n is a, c, g, or t
  misc_feature (2431)..(2431): n is a, c, g, or t
  misc_feature (2433)..(2433): n is a, c, g, or t
  misc_feature (2455)..(2455): n is a, c, g, or t
  misc_feature (2458)..(2467): n is a, c, g, or t
  misc_feature (2470)..(2470): n is a, c, g, or t
  misc_feature (2475)..(2476): n is a, c, g, or t
  misc_feature (2479)..(2482): n is a, c, g, or t
  misc_feature (2484)..(2484): n is a, c, g, or t
  misc_feature (2486)..(2487): n is a, c, g, or t
  misc_feature (2489)..(2489): n is a, c, g, or t
  misc_feature (2492)..(2495): n is a, c, g, or t
  misc_feature (2497)..(2505): n is a, c, g, or t
  misc_feature (2507)..(2508): n is a, c, g, or t
  misc_feature (2510)..(2510): n is a, c, g, or t
  misc_feature (2512)..(2514): n is a, c, g, or t
  misc_feature (2516)..(2517): n is a, c, g, or t
  misc_feature (2520)..(2520): n is a, c, g, or t
  misc_feature (2525)..(2525): n is a, c, g, or t
  misc_feature (2528)..(2532): n is a, c, g, or t
  misc_feature (2534)..(2540): n is a, c, g, or t
  misc_feature (2542)..(2543): n is a, c, g, or t
  misc_feature (2545)..(2549): n is a, c, g, or t
  misc_feature (2552)..(2554): n is a, c, g, or t
  misc_feature (2556)..(2557): n is a, c, g, or t
  misc_feature (2559)..(2572): n is a, c, g, or t
  misc_feature (2574)..(2574): n is a, c, g, or t
  misc_feature (2576)..(2578): n is a, c, g, or t
  misc_feature (2580)..(2584): n is a, c, g, or t
  misc_feature (2588)..(2598): n is a, c, g, or t
  misc_feature (2601)..(2601): n is a, c, g, or t
  misc_feature (2603)..(2603): n is a, c, g, or t
  misc_feature (2605)..(2612): n is a, c, g, or t
  misc_feature (2614)..(2616): n is a, c, g, or t
  misc_feature (2618)..(2648): n is a, c, g, or t
  misc_feature (2650)..(2680): n is a, c, g, or t
  misc_feature (2682)..(2695): n is a, c, g, or t
  misc_feature (2697)..(2703): n is a, c, g, or t
  misc_feature (2705)..(2720): n is a, c, g, or t
  misc_feature (2722)..(2724): n is a, c, g, or t
  misc_feature (2728)..(2728): n is a, c, g, or t
  misc_feature (2730)..(2738): n is a, c, g, or t
  misc_feature (2740)..(2744): n is a, c, g, or t
  misc_feature (2746)..(2781): n is a, c, g, or t
  misc_feature (2783)..(2784): n is a, c, g, or t
  misc_feature (2786)..(2816): n is a, c, g, or t
  misc_feature (2818)..(2822): n is a, c, g, or t
  misc_feature (2824)..(2844): n is a, c, g, or t
  misc_feature (2846)..(2851): n is a, c, g, or t
  misc_feature (2853)..(2907): n is a, c, g, or t
  misc_feature (2910)..(2971): n is a, c, g, or t
  misc_feature (2973)..(2973): n is a, c, g, or t
  misc_feature (2975)..(3008): n is a, c, g, or t
  misc_feature (3010)..(3036): n is a, c, g, or t
  misc_feature (3038)..(3048): n is a, c, g, or t
  misc_feature (3050)..(3068): n is a, c, g, or t
  misc_feature (3070)..(3149): n is a, c, g, or t
  misc_feature (3151)..(3175): n is a, c, g, or t
  misc_feature (3177)..(3217): n is a, c, g, or t
  misc_feature (3219)..(3220): n is a, c, g, or t
  misc_feature (3222)..(3237): n is a, c, g, or t
  misc_feature (3239)..(3289): n is a, c, g, or t
  misc_feature (3291)..(3291): n is a, c, g, or t
  misc_feature (3293)..(3370): n is a, c, g, or t
  misc_feature (3372)..(3441): n is a, c, g, or t
  misc_feature (3444)..(3450): n is a, c, g, or t
  misc_feature (3452)..(3455): n is a, c, g, or t
  misc_feature (3457)..(3461): n is a, c, g, or t
  misc_feature (3463)..(3465): n is a, c, g, or t
  misc_feature (3468)..(3468): n is a, c, g, or t
  misc_feature (3470)..(3473): n is a, c, g, or t
  misc_feature (3476)..(3477): n is a, c, g, or t
  misc_feature (3479)..(3490): n is a, c, g, or t
  misc_feature (3492)..(3492): n is a, c, g, or t
  misc_feature (3494)..(3507): n is a, c, g, or t
  misc_feature (3509)..(3509): n is a, c, g, or t
  misc_feature (3512)..(3512): n is a, c, g, or t
  misc_feature (3514)..(3514): n is a, c, g, or t
  misc_feature (3516)..(3516): n is a, c, g, or t
  misc_feature (3518)..(3518): n is a, c, g, or t
  misc_feature (3520)..(3520): n is a, c, g, or t
  misc_feature (3522)..(3522): n is a, c, g, or t
  misc_feature (3524)..(3525): n is a, c, g, or t
  misc_feature (3527)..(3528): n is a, c, g, or t
  misc_feature (3530)..(3530): n is a, c, g, or t
  misc_feature (3532)..(3534): n is a, c, g, or t
  misc_feature (3536)..(3537): n is a, c, g, or t
  misc_feature (3539)..(3540): n is a, c, g, or t
  misc_feature (3543)..(3549): n is a, c, g, or t
  misc_feature (3551)..(3551): n is a, c, g, or t
  misc_feature (3553)..(3556): n is a, c, g, or t
  misc_feature (3559)..(3563): n is a, c, g, or t
  misc_feature (3565)..(3565): n is a, c, g, or t
  misc_feature (3567)..(3568): n is a, c, g, or t
  misc_feature (3570)..(3571): n is a, c, g, or t
  misc_feature (3573)..(3574): n is a, c, g, or t
  misc_feature (3577)..(3577): n is a, c, g, or t
  misc_feature (3579)..(3580): n is a, c, g, or t
  misc_feature (3583)..(3584): n is a, c, g, or t
  misc_feature (3586)..(3597): n is a, c, g, or t
  misc_feature (3599)..(3602): n is a, c, g, or t
  misc_feature (3604)..(3616): n is a, c, g, or t
  misc_feature (3618)..(3618): n is a, c, g, or t
  misc_feature (3620)..(3623): n is a, c, g, or t
  misc_feature (3626)..(3627): n is a, c, g, or t
  misc_feature (3629)..(3632): n is a, c, g, or t
  misc_feature (3634)..(3638): n is a, c, g, or t
  misc_feature (3640)..(3641): n is a, c, g, or t
  misc_feature (3644)..(3646): n is a, c, g, or t
  misc_feature (3648)..(3649): n is a, c, g, or t
  misc_feature (3651)..(3651): n is a, c, g, or t
  misc_feature (3654)..(3666): n is a, c, g, or t
  misc_feature (3669)..(3669): n is a, c, g, or t
  misc_feature (3671)..(3677): n is a, c, g, or t
  misc_feature (3679)..(3681): n is a, c, g, or t
  misc_feature (3683)..(3685): n is a, c, g, or t
  misc_feature (3687)..(3688): n is a, c, g, or t
  misc_feature (3691)..(3694): n is a, c, g, or t
  misc_feature (3696)..(3701): n is a, c, g, or t
  misc_feature (3704)..(3707): n is a, c, g, or t
  misc_feature (3709)..(3713): n is a, c, g, or t
  misc_feature (3715)..(3720): n is a, c, g, or t
  misc_feature (3724)..(3724): n is a, c, g, or t
  misc_feature (3727)..(3740): n is a, c, g, or t
  misc_feature (3742)..(3744): n is a, c, g, or t
  misc_feature (3746)..(3751): n is a, c, g, or t
  misc_feature (3753)..(3753): n is a, c, g, or t
  misc_feature (3755)..(3756): n is a, c, g, or t
  misc_feature (3758)..(3758): n is a, c, g, or t
  misc_feature (3760)..(3762): n is a, c, g, or t
  misc_feature (3764)..(3764): n is a, c, g, or t
  misc_feature (3766)..(3769): n is a, c, g, or t
  misc_feature (3771)..(3771): n is a, c, g, or t
  misc_feature (3773)..(3774): n is a, c, g, or t
  misc_feature (3778)..(3778): n is a, c, g, or t
  misc_feature (3780)..(3781): n is a, c, g, or t
  misc_feature (3783)..(3784): n is a, c, g, or t
  misc_feature (3786)..(3788): n is a, c, g, or t
  misc_feature (3790)..(3793): n is a, c, g, or t
  misc_feature (3795)..(3796): n is a, c, g, or t
  misc_feature (3800)..(3810): n is a, c, g, or t
  misc_feature (3812)..(3812): n is a, c, g, or t
  misc_feature (3814)..(3816): n is a, c, g, or t
  misc_feature (3818)..(3827): n is a, c, g, or t
  misc_feature (3829)..(3832): n is a, c, g, or t
  misc_feature (3835)..(3835): n is a, c, g, or t
  misc_feature (3837)..(3838): n is a, c, g, or t
  misc_feature (3840)..(3842): n is a, c, g, or t
  misc_feature (3844)..(3848): n is a, c, g, or t
  misc_feature (3851)..(3856): n is a, c, g, or t
  misc_feature (3858)..(3858): n is a, c, g, or t
  misc_feature (3860)..(3861): n is a, c, g, or t
  misc_feature (3863)..(3867): n is a, c, g, or t
  misc_feature (3869)..(3874): n is a, c, g, or t
  misc_feature (3876)..(3889): n is a, c, g, or t
  misc_feature (3892)..(3898): n is a, c, g, or t
  misc_feature (3900)..(3901): n is a, c, g, or t
  misc_feature (3903)..(3904): n is a, c, g, or t
  misc_feature (3906)..(3906): n is a, c, g, or t
  misc_feature (3908)..(3914): n is a, c, g, or t
  misc_feature (3916)..(3927): n is a, c, g, or t
  misc_feature (3929)..(3931): n is a, c, g, or t
  misc_feature (3934)..(3938): n is a, c, g, or t
  misc_feature (3940)..(3943): n is a, c, g, or t
  misc_feature (3945)..(3946): n is a, c, g, or t
  misc_feature (3948)..(3949): n is a, c, g, or t
  misc_feature (3952)..(3953): n is a, c, g, or t
  misc_feature (3955)..(3972): n is a, c, g, or t
  misc_feature (3974)..(3975): n is a, c, g, or t
  misc_feature (3977)..(3978): n is a, c, g, or t
  misc_feature (3980)..(3981): n is a, c, g, or t
  misc_feature (3984)..(3985): n is a, c, g, or t
  misc_feature (3987)..(3987): n is a, c, g, or t
  misc_feature (3989)..(3992): n is a, c, g, or t
  misc_feature (3994)..(3997): n is a, c, g, or t
  misc_feature (3999)..(3999): n is a, c, g, or t
caccccacgtgtatccccgtccacggcgaattccagtctaagctcacgctgatgtctgagtcgctccgtaacgacggccgtatctgggtgcccaagaanatcgaagacgctaagaagctccaggctggtacncttcgtcctaccgatatcaaggaggaggatcgtgactactacctcgagcgccgctatcccgccttcggtaacctcgtncctcgtgacgtcgccagccgtgctgctaaggaacgctgcgacgctggctacggtgtcaacaacacgggnctggctgtcttcctcgacttctccagcgctatcaagcgtctnggtaaggatgtcgtagaagctcgctatggtaacctcttccagatgtacgaaaagatcaccaacgacaatccctacgagacgccgatgatgatctatcccgctatccactacacgatgggtggtatctgggtggactacgagctcatgacctctgtccctggcctcttcgctatcggtgaagctaacttctccgaccacggtgctaaccgcctcggtgcttcggctctgatgcagggtctcgctgacggntacttcgtactgccctacacgatccagaactatctggctgaccagattcaggtcccccgcttcagcacggaccgtcctgagttcgacgaagcngaaaagggtatccaggatcgtatcgctcgcctgatgagcatcaagggtaagcagtccgtcgacagcctccacaagaagctcggtcacatcatgtgggacttcgtaggtatgggtcgcgagcgcgaaggcctngagaaggctatcgtcgagctcaaggctctgaagaaggagttctggagcgacgtccgtatccctggtaaggctgacgacctcaacgtggagctcgagaaggctcttcgtctggctgacttcatcgagatcggcgaacttatggctcgtgacgctcacgaccgtgaagagagctgcggtggtcacttccgcctcgagcaccagacgcccgaaggtgaagccctgcgccacgatgatcagttcgcttacgtctcctgctgggagtaccagggcgaagatcaggatcccgtccttctgaaggaacctctggactacgagttcgtcgtacgtcagcagcgtaactataagaactaaccccaagccaacatccacaatggacaagaatataaatatcaaggttaaggtctggcgtcagcgtggccccgaggtaaagggtgcgttcgaaacctacgacctgcagaatatctctcagggtagctccttcctggagatgctcgatatcctcaacgagcagctcgtacgcgaaggcaaggagcccgttgtcttcgaccacgactgccgcgaaggtatctgcggtatgtgctcgctctacatcaatgggcacccccacgggcccgatgatagcatcacgacctgtcagctgcacatgcgtcgcttcaacgatggnganacgatcaccatcgagccttggcgctcggctggcttccccatcatccgtgacctcatggtagaccgctcggcctacgacaagatcatccaggctggtggcttcgtgtcggtcaataccggtggtgtacccgatgctaacgctatccccattcctaaggctaacgccgacatggctatggacgctgctgcttgtatcggttgcggtgcctgcgctgcagcttgtaagaacggctcggctatgctcttcgtctctgctaaggtcagccagctggctctcctcccacagggtcgtgtcgaagctgcccgccgtgctaaggctatggtcgctaagatggatgagctgggcttcggtaactgtacgaacactcgtgcttgcgaagtcgaatgccccaagaacatctcgatctccaatatcgctcgtctgaaccgcgagttcctcgctgctaagttcaaggactaagctccgagacgaatccctctcttcggcctcctgtggcggcttctcccccntngcgggagaagtcatacggagccgactaccatcgctctcttcaggattcacctcctggattgaataggttagattggtgtagtatcgcccgccctcctgagcctacggctcctgaggacgggcgatcgcattataggcctctccgtacttcggtgcggggaggcttctttgtttctctgaaaggtgttgaccgtacccataggagacagttgtggtagagtcctgccctccatttagagtgctaaggcatcgtgcgcccagctccccgatacacctctccgaagtgaccgagnaagcccttcnncttatcananntattccncttatccngcgnagggaaaannnnccttctcgtnaagnaaaaagcnccttcangtnntggtttncnncnntctangnnngtngtnttaaagnctaggcacntaaatccaaatnnccangtangnaganattagancnangtacgtagcccaaacttatttnccnnnnnnnnnnaanttttnnccnnnngngnngnaannnncnnnnnnnnngnngntnnngnnaanctatnttnnnnngnnnnnnnanntnnnnnccnnnanncnnnnnnnnnnnnnntncnnngnnnnnctgnnnnnnnnnnngcngngnnnnnnnntnnntnnnnnnnnnnnnnnnnnnnnnnnnnnnnnnngnnnnnnnnnnnnnnnnnnnnnnnnnnnnnnngnnnnnnnnnnnnnngnnnnnnngnnnnnnnnnnnnnnnntnnngggncnnnnnnnnncnnnnntnnnnnnnnnnnnnnnnnnnnnnnnnnnnnnnnnnnncnntnnnnnnnnnnnnnnnnnnnnnnnnnnnnnnngnnnnntnnnnnnnnnnnnnnnnnnnnntnnnnnngnnnnnnnnnnnnnnnnnnnnnnnnnnnnnnnnnnnnnnnnnnnnnnnnnnnnnnnggnnnnnnnnnnnnnnnnnnnnnnnnnnnnnnnnnnnnnnnnnnnnnnnnnnnnnnnnnnnnnngngnnnnnnnnnnnnnnnnnnnnnnnnnnnnnnnnnngnnnnnnnnnnnnnnnnnnnnnnnnnnntnnnnnnnnnnncnnnnnnnnnnnnnnnnnnncnnnnnnnnnnnnnnnnnnnnnnnnnnnnnnnnnnnnnnnnnnnnnnnnnnnnnnnnnnnnnnnnnnnnnnnnnnnnnnnngnnnnnnnnnnnnnnnnnnnnnnnnngnnnnnnnnnnnnnnnnnnnnnnnnnnnnnnnnnnnnnnnnncnntnnnnnnnnnnnnnnnngnnnnnnnnnnnnnnnnnnnnnnnnnnnnnnnnnnnnnnnnnnnnnnnnnnngngnnnnnnnnnnnnnnnnnnnnnnnnnnnnnnnnnnnnnnnnnnnnnnnnnnnnnnnnnnnnnnnnnnnnnnnnnnnnnngnnnnnnnnnnnnnnnnnnnnnnnnnnnnnnnnnnnnnnnnnnnnnnnnnnnnnnnnnnnnnnnnnnnnnnggnnnnnnngnnnncnnnnncnnnggncnnnntanngnnnnnnnnnnnncngnnnnnnnnnnnnnngntcncntntntngnanngnngngnnngnngnngtnnnnnnngngnnnngannnnntngnnannannggngnnctnncnnnnnnnnnnnngnnnntnnnnnnnnnnnnnantnnnntcnngnnnntnnnnntnnagnnncnngnccnnnnnnnnnnnnncgnannnnnnntnnngnnngnnggnnnngnnnnnntcnnnncnnnnntnnnnnnggcnttnnnnnnnnnnnnnncnnncnnnnnntncnncngnnncngnnnngngnnggcntnngnngnnntnnnnannggcnnnnnnnnnnngngnnngnnnnnnnnnngnnnnggngnngnnntnnnnnggnnnnnngncnncnnnnncnnnnnngnnnnnnnnnnnnnngcnnnnnnngnngnngngnnnnnnntnnnnnnnnnnnngnnngcnnnnngnnnnanngnngcnncnnnnnnnnnnnnnnnnnncnncnngnncanngngnnnngnnnngng

SEQ ID NO: 422 - DNA, 4000 bp, Escherichia coli
  misc_feature (2288)..(2288): n is a, c, g, or t
  misc_feature (2594)..(2594): n is a, c, g, or t
  misc_feature (3321)..(3321): n is a, c, g, or t
  misc_feature (3327)..(3327): n is a, c, g, or t
  misc_feature (3597)..(3597): n is a, c, g, or t
  misc_feature (3913)..(3913): n is a, c, g, or t
  misc_feature (3928)..(3928): n is a, c, g, or t
  misc_feature (3955)..(3955): n is a, c, g, or t
  misc_feature (3976)..(3976): n is a, c, g, or t
  misc_feature (3979)..(3979): n is a, c, g, or t
ttagcactgggtcatcaattatgcctcagaaaaaaaatcctgacgctgcggagttaattcgggctaaagttggacgcattacaggatcattagtggggcttttaatggttatgaaaggccttccgctagcgtattcaaaggatatgcaagaagataaagagcaagtatttgatgcatccgatagccttatgttggcacttgcagctatgactggaatgatatcagatatggagcctaatgttgcatctcttgaaacagctgctgcatcaggattttcaacagcgactgatttggctgattggttggttcgagatttagggatgccatttagagaagcccatcacattactggtgctttggtcgcaaaagcagaggagaaaggatgtgatctccccgacttaagtctagcagatatgcaaattgtaaatgaaagaattaatgctgatgtatttaattttctaggcgttcaaaactctgtggcaagccgccaaagttatggtgggacagcacctaaacaagtgcgaaaacaaatagctcgatggaggaagattttatcatgatctataagttactttttgcattgtttttaatttcaagtttaaatgcttgtggaataaaaggtgaccctttgcctattgatgaggagatatcatgtctttcttgcgagtaatttatttaggttttgcaatattgggtggtattaaacccatgatgcattttttagcatggtttaatgaatttggttattcatgggcaggcattgtttctgcttggactataaacgaagcatcacgtggtttaatgtgggatttaacaatttcagcatgtgtattaattatttggatagcttcagaggtagtgcctcgtaaagattggtgggttctactagtgtgcattgttgcaacctttggaattggtgtttcgtgtggtttaccactatatttattcttgcgttcgcgctctattaagtaggtaactatggatcattttatataccgtaatggcgttttgcatgcagaagatgttgctataacagaaatcgcagcttcagttggtacacctttttatgtttattcgcaggcgacattaacgcggcactttagggtatttgatgaagctttaagcggattgaaacatcttatttgttatgcaatgaaagcaaactcaaatattgctatactaaagatcttaggagatttgggtgctggaatggacgttgtttcgggcggtgagtatttacgagctaaagcagcaggcgttcctggaaatagaattgtgttttcgggagttggaaaaactcgtgaagaaatggcattagcaattaaaaatggaattcgccaatttaatgtcgaaagcgaaacagaattaaaagtgttaaatgaagtggctctgtcactatgtgcaatagctccaataacattgcgtgtgaacccagatgttgatgcaaaaacacacgctaaaatagctacaggtaaatctgaaaataagtttggtattcccattgcaaagtcacaagaggtctatgctttagccgcatcaatggaaggcatcgaagttgttggtattgatgttcatataggctcacaattaacagacttggaaccatttaggttagcgtatgagaaagttgctgaattgacaaaaacgctaaggcaagatggtcataatattaggcgtttagatttaggtggtggattgggtataccttatgaaaattcaaaccaatcaccaccaacacctgaagattatgcaaaagttattcatgaaactgttggtaatcttgattgtgaaattgaaatagaaccaggcaggttattagcaggaaatgctggcttaatgatttcgtctgttatttataataagtctggtgaaggacgagattttatgattgtcgatgctgctatgaatgatcttattcgacctgctatgtatgaagcatatcatgaaattattcctgtgcttgagtctaatgcgcagtctaagacaagtgattatgatgtagttggtccagtatgcgaaactggtgatacattcgcaaaaaaaagaactctaacttcagttgctgatggtgaaatggttgcatttagatctgcaggtgcatatggagccgttatggcctctgaatacaacacgaggccactaataccggaagtgttggttcatgaagaccaattttctataattagaaaacgccctagcgttgaatccataattaagagagatcttatacctgattggctttaaatttttttattgaaatttattattctagattaaataatttattnatatttggaacaataaattttgtgtaactgtttcttgtgtttgtataaatatttgtgacttttaatctataaatttccaatggttttttagtttgtggtacatgtttggatatcacaggagataaaatataaattcctgttgtacttagcattataagcaatgttgcaataataatttttgaaccactatttttataggattttttgtttttatttgaaggcctacctttatttttttttacagcaagttttgttatagaattattttcttctattttgaggttaagcttttgcatgtcttttttngatattttaagtcttttagtagagcgacttccatttttatttaaattttttctattttttgcatatgttgcttcttctcgaagtattgattgaatgtcaggcgttatctgaggttgagacttattagatttaaagctctcttgaatggttttttcatgaacgctaggggcagtatatttccaaatttctaagcagtttgagcattctaatatatgcccatcgtttaaaattatattttcagaaatatcatattgtgcattacaatgtggacaatctatcagcatattgcgctctgttgtttctataatatgttttgtttaatttaatcacatattataagataaattaagaaattttcttttggttattattactatcctaatatgctttactttatagtccaatatagaatttcaagataaaggttgtttataaatttggcaatcacatgaggctaattatagggggtatctagttggttgttatacaatttttgttgtctttggtatttatattttcaatgtacttatcaatgacgctttttgcattattgggagctataccgtcacttttgtcgcgtaaggcaacttattgggttgtaagaaactttgctggatctgtcatatttttagcaaggattatttgtggtcttaaggttgaattaaggggcgaagttccaactggaaatgtcgtgatcgcatcaaaacatcagagtttttttgatgtnatattncatgcctactatttagaaaacgtgaattttgtaatgaaacaagaactaacctattttccaattgttgggttctatgggaaaaggcttggagtagctcctgtaaaaagaggtggtaaaggaaaggcagtttctcaaatgatgtctgggttagagaaaagtgatcaagagacacaacttgtaatttatcctcaaggaactcgtgtcgctcctggaaaagttatgccttacaaagtaggcgctgcagtggtgtgtcaacgtatgaaccgaagntgtattttggctgcaactaatgtaggaatgtattggccaaaacacagcttacttcgcaagcgaggtactgtagtattagaatatttagacgaagtaccaagcgacctacaaacaaagagctttgtaaagtacattgaagaaaatattgaaaaagcttcaaatgccttaatggaggaagctatattgaaataaggatgaaccattaatgaaatttattaaatcaataagtgaacttgagaagatttatggttctccaagtgttgcttcattaagaaaagtctctgatcatataactccaacttatcgtaaatggatncaagcatcctcattntgcaccttagcaacagttgggcctaanggtgttgatgctagtccaagnggngataattctaatgttgttcga

SEQ ID NO: 423 - DNA, 4000 bp, Escherichia coli
  misc_feature (1936)..(1936): n is a, c, g, or t
  misc_feature (1977)..(1979): n is a, c, g, or t
  misc_feature (1987)..(1987): n is a, c, g, or t
  misc_feature (2013)..(2013): n is a, c, g, or t
  misc_feature (2016)..(2016): n is a, c, g, or t
  misc_feature (3317)..(3317): n is a, c, g, or t
ggtatctgcaatatgggatgccttgtcatggcgggggacatgcaggagttcttcgtaatttccggatgcatggatatgggtggatatgatacctacttcattggaggcacttaatatgactgcacctgctccgtctccccataaaatggcattacttctatcgtcataatcggtgatggaagacatgcggtccgccccaataaccaaagcattttttgcgctattagttttgatgaatttttcggctatggttaaggcatatacaaacccagtacatactgcctgtacatcaaatgctgggcattccttgatacctaaacgtgcttgaaccgtacacgcggtacttggaaaaattttatcgggtgtcgtggtggcaagaataatcaggtcgatatcgccaggactgatattggcggaagcaatagctcgtaacgccgcctcatatgctaggtcgctagttttttcatctgggcccgcgatatgcctttctttaattcccgttctagaaacaatccattcatctgtggtgtccagacggctttctaagtctttattggttaatatggtttttggtaaataactgcccgtaccaatgattttcgcatgattcatttatttaaccgaaaactcgacttcgagttgttttttgatattctcgataattttactgtctatctcttccacagcggtggcaatagcataccgaaatccataagcatcggttccaccatgactcttaatgacgataccgttgaggccaagaaaggatgcgccattatatcttcgtgggtcaaggcgccgtttgaatgctttgaggacaggaatagctattattcccatcaacttggttagccagttacgcttaaactcttcggataaaaatcgacccatcatctgcgctaaaccttccgtggttttcaatgcaatattaccaacaaatccatcgcataccaccacatccgtagtacctttgaatatatcgttaccttcaacattaccataaaaattcaaatggctgttcttgatgagatgggctgcctgctttaccacttcattgcctttgatttcttcgctaccaatatttaataagccaatcgtcggttttttcttttttgtgtgcgccttagttaacatagagcccatgatggcaaattggaggagttgttctggcgtgcagtctgcattggctcctagatcaagcatacaagtggttcctttttggttcggaaggttggatgcaatagccggcctatcaatgccctttaaggttttaagcacaaatcgggctgttgccatcaatgcaccggtgttgcctgcgcttacacaagcatgcgcctcaccatccttcaccaagttaatagcaatgcgcatcgaggagtcttttttattttttaaagcactttggggggactcatccatcaacacaacctgagtggtagatttgatcgcaatgcgtgggtgattttctgcgttgtgcgattttagcagggcttctatgataacttgattgcccactaaaataatatgaagcttagggtaccgttttaatgcatctagcgaggcgggaatagtgacattgggtccaacatcaccacccattgcatcaatcgctattgattgtgaagtcatatagcttgattaatcaattaatccgtcttaacttcaataacctttttaccacgataaaaaccagacgggctcacatggtgtcttaaatgaacttcaccggtagtgggttctacagccaaaggttgaccagataaattatcatgcgatcgacgcatatttcttcttgatgcggacttcttacttttttgaacagccatgcttactccttaagcctatatatttattaggatactacgttgaaaaattaatgccggattttatcacaaaatcccttttttttgctaataaagattaataaccttttgcnctatagtatttgctaaatttagcatcatggtataattgaannntgacttantgctaatactgcactgacaattagcnctnatcatacaacaaacgaaggaaacctgtttttgatccaaaaaatattaatagcaaatcgaggggaaattgcggtccgaataattagggcatgcaaggaaatgggtatcacgagtgttgctattttctcggaagccgatcgtcatgcattgcatgtgaaaaaagctgatgagtcctatcgcatcggtagtgatcctttatcaggctatttaaatgcgcaccgcattgtcaatactgcagtcaccgcacgatgcgatgcaatccaccccggctatggttttctttctgaaaatcccgagttggctgcgatttgtaaacgaagaggcatcaaatttattggtcctgacgatagcgtaatctctcgtatgggagataaagtcgaggcaagaaaagctatgattgaggcgggagtcccggttattcctggcagtgaaggtaatataaaagatctcgatgaggcggtggtgattgccaaatccattggttaccctgtaatgctcaaagccactaatggtgggggtggtcgtggtatcaggcgttgcgataatgaaaaagaattattgtcaaattatgatcgagtgatctctgaggctaccaaagcatttggaagccctgagctttttattgagaaatgcgttgtaacaccgaagcatattgaggtgcaaattttagccgatcaaaaaggtcatgccattcatttgtatgagcgagactgctctattcaaagaagaaatcaaaaattgattgaaatagccccctctccccagttgtctgaagaccaaagaaattatattggtgatttggcagtcaaggcggcgaaagcggtcaattatgaaaatgccggtacggtggagtttttattagatagtgaagataaattttatttcatggaaatgaatactagactgcaagtagaacataccattactgaaactattactggaatagatatcgttcaggagcagatacgcattgccagtgggatggagttaaggtattcgcaagacgaagtgagctaccgtggttttgctatcgaatttcggattaatgctgaggaccctaaacaagactttcttccctcatttgggaaaattacccgatattttgctgccggtggtcctggggtaagaacagatgcatccatttatactgggtatattattccgccctactatgactctatgtgtgcaaaattaacggtatgggctcttaactgggacgatgccataaaaagaggaagtcgtgcattaggagatatcggggtatttggggtcaaaaccaccattccgtactataaagaaatnttaaaaaatgaactgtttataaatgctaattttaatacgagctttgttgaaagccatccagagctgatcgattacgaagatgaaatgtcgcctgatattattgcagctgctattgctgcggcaattgcggcacacgaagggatataaaaaactatgaaaaaaataaatattactgaattagttctaagagacggtcatcaatgccatatagcaacccgtttgcgtactgaagacatgctccctatttgcccccagctagataatcaaaatttttggtcaatcgaagcatggggcggggcaacttttgacgcctgtgttcgatacctcaaggaagatccttgggaacggttaattaagctacgtaaagccttaccaaatagccaaattcaaatgctacttcgcggtcaaaatttattaggttataggcattattcggatgatgttgtggatctgtttgtaaaaaaagcagcggataacggggttgatgtatttagggtttttgatgccatgaacgatattcgaaatatcgaactatcaatcaagtcggttaaaaaatataaaaaacatgcacaaggcacgattagttataccacctcgcccgttcataatattgagtattttgtgaagctggctaaacaaatagaggaattaggtagtgataccttagcgattaaggatatggc

SEQ ID NO: 424 - DNA, 4000 bp, Escherichia coli
  misc_feature (4)..(4): n is a, c, g, or t
  misc_feature (13)..(13): n is a, c, g, or t
  misc_feature (15)..(15): n is a, c, g, or t
  misc_feature (17)..(18): n is a, c, g, or t
  misc_feature (25)..(26): n is a, c, g, or t
  misc_feature (28)..(28): n is a, c, g, or t
  misc_feature (30)..(30): n is a, c, g, or t
  misc_feature (34)..(34): n is a, c, g, or t
  misc_feature (37)..(38): n is a, c, g, or t
  misc_feature (40)..(40): n is a, c, g, or t
  misc_feature (48)..(49): n is a, c, g, or t
  misc_feature (51)..(52): n is a, c, g, or t
  misc_feature (55)..(56): n is a, c, g, or t
  misc_feature (58)..(58): n is a, c, g, or t
  misc_feature (60)..(64): n is a, c, g, or t
  misc_feature (70)..(70): n is a, c, g, or t
  misc_feature (74)..(74): n is a, c, g, or t
  misc_feature (76)..(80): n is a, c, g, or t
  misc_feature (82)..(85): n is a, c, g, or t
  misc_feature (88)..(88): n is a, c, g, or t
  misc_feature (92)..(92): n is a, c, g, or t
  misc_feature (95)..(97): n is a, c, g, or t
  misc_feature (99)..(99): n is a, c, g, or t
  misc_feature (102)..(102): n is a, c, g, or t
  misc_feature (111)..(113): n is a, c, g, or t
  misc_feature (115)..(115): n is a, c, g, or t
  misc_feature (119)..(120): n is a, c, g, or t
  misc_feature (127)..(128): n is a, c, g, or t
  misc_feature (133)..(134): n is a, c, g, or t
  misc_feature (143)..(143): n is a, c, g, or t
  misc_feature (146)..(146): n is a, c, g, or t
  misc_feature (150)..(150): n is a, c, g, or t
  misc_feature (155)..(155): n is a, c, g, or t
  misc_feature (158)..(159): n is a, c, g, or t
  misc_feature (168)..(168): n is a, c, g, or t
  misc_feature (175)..(176): n is a, c, g, or t
  misc_feature (178)..(178): n is a, c, g, or t
  misc_feature (181)..(181): n is a, c, g, or t
  misc_feature (188)..(188): n is a, c, g, or t
  misc_feature (190)..(190): n is a, c, g, or t
  misc_feature (194)..(194): n is a, c, g, or t
  misc_feature (198)..(198): n is a, c, g, or t
  misc_feature (200)..(200): n is a, c, g, or t
  misc_feature (202)..(202): n is a, c, g, or t
  misc_feature (204)..(204): n is a, c, g, or t
  misc_feature (206)..(206): n is a, c, g, or t
  misc_feature (214)..(214): n is a, c, g, or t
  misc_feature (217)..(217): n is a, c, g, or t
  misc_feature (221)..(221): n is a, c, g, or t
  misc_feature (223)..(224): n is a, c, g, or t
  misc_feature (227)..(228): n is a, c, g, or t
  misc_feature (230)..(230): n is a, c, g, or t
  misc_feature (232)..(232): n is a, c, g, or t
  misc_feature (238)..(239): n is a, c, g, or t
  misc_feature (241)..(241): n is a, c, g, or t
  misc_feature (247)..(247): n is a, c, g, or t
  misc_feature (249)..(249): n is a, c, g, or t
  misc_feature (253)..(253): n is a, c, g, or t
  misc_feature (255)..(256): n is a, c, g, or t
  misc_feature (265)..(265): n is a, c, g, or t
  misc_feature (268)..(268): n is a, c, g, or t
  misc_feature (271)..(271): n is a, c, g, or t
  misc_feature (273)..(273): n is a, c, g, or t
  misc_feature (277)..(277): n is a, c, g, or t
  misc_feature (284)..(284): n is a, c, g, or t
  misc_feature (286)..(286): n is a, c, g, or t
  misc_feature (289)..(289): n is a, c, g, or t
  misc_feature (291)..(291): n is a, c, g, or t
  misc_feature (293)..(293): n is a, c, g, or t
  misc_feature (295)..(296): n is a, c, g, or t
  misc_feature (298)..(298): n is a, c, g, or t
  misc_feature (307)..(307): n is a, c, g, or t
  misc_feature (310)..(310): n is a, c, g, or t
  misc_feature (312)..(312): n is a, c, g, or t
  misc_feature (316)..(317): n is a, c, g, or t
  misc_feature (319)..(320): n is a, c, g, or t
  misc_feature (324)..(325): n is a, c, g, or t
  misc_feature (331)..(331): n is a, c, g, or t
  misc_feature (334)..(337): n is a, c, g, or t
  misc_feature (340)..(341): n is a, c, g, or t
  misc_feature (345)..(345): n is a, c, g, or t
  misc_feature (347)..(347): n is a, c, g, or t
  misc_feature (350)..(350): n is a, c, g, or t
  misc_feature (352)..(353): n is a, c, g, or t
  misc_feature (355)..(356): n is a, c, g, or t
  misc_feature (358)..(358): n is a, c, g, or t
  misc_feature (361)..(361): n is a, c, g, or t
  misc_feature (365)..(365): n is a, c, g, or t
  misc_feature (367)..(367): n is a, c, g, or t
  misc_feature (373)..(374): n is a, c, g, or t
  misc_feature (379)..(379): n is a, c, g, or t
  misc_feature (383)..(383): n is a, c, g, or t
  misc_feature (385)..(387): n is a, c, g, or t
  misc_feature (394)..(394): n is a, c, g, or t
  misc_feature (478)..(478): n is a, c, g, or t
  misc_feature (493)..(493): n is a, c, g, or t
  misc_feature (529)..(529): n is a, c, g, or t
  misc_feature (536)..(537): n is a, c, g, or t
  misc_feature (552)..(552): n is a, c, g, or t
  misc_feature (604)..(604): n is a, c, g, or t
  misc_feature (616)..(616): n is a, c, g, or t
  misc_feature (649)..(649): n is a, c, g, or t
  misc_feature (652)..(652): n is a, c, g, or t
  misc_feature (667)..(667): n is a, c, g, or t
  misc_feature (676)..(676): n is a, c, g, or t
  misc_feature (679)..(679): n is a, c, g, or t
  misc_feature (685)..(685): n is a, c, g, or t
  misc_feature (689)..(689): n is a, c, g, or t
  misc_feature (691)..(691): n is a, c, g, or t
  misc_feature (700)..(700): n is a, c, g, or t
  misc_feature (742)..(742): n is a, c, g, or t
  misc_feature (748)..(748): n is a, c, g, or t
  misc_feature (757)..(757): n is a, c, g, or t
  misc_feature (769)..(769): n is a, c, g, or t
  misc_feature (805)..(805): n is a, c, g, or t
  misc_feature (810)..(810): n is a, c, g, or t
  misc_feature (820)..(821): n is a, c, g, or t
  misc_feature (823)..(823): n is a, c, g, or t
  misc_feature (826)..(826): n is a, c, g, or t
  misc_feature (832)..(832): n is a, c, g, or t
  misc_feature (841)..(841): n is a, c, g, or t
  misc_feature (844)..(844): n is a, c, g, or t
  misc_feature (847)..(849): n is a, c, g, or t
  misc_feature (859)..(859): n is a, c, g, or t
  misc_feature (862)..(862): n is a, c, g, or t
  misc_feature (868)..(868): n is a, c, g, or t
  misc_feature (901)..(901): n is a, c, g, or t
  misc_feature (916)..(916): n is a, c, g, or t
  misc_feature (919)..(919): n is a, c, g, or t
  misc_feature (931)..(932): n is a, c, g, or t
  misc_feature (940)..(940): n is a, c, g, or t
  misc_feature (961)..(961): n is a, c, g, or t
  misc_feature (964)..(964): n is a, c, g, or t
  misc_feature (973)..(973): n is a, c, g, or t
  misc_feature (982)..(982): n is a, c, g, or t
  misc_feature (985)..(985): n is a, c, g, or t
  misc_feature (1009)..(1009): n is a, c, g, or t
  misc_feature (1012)..(1012): n is a, c, g, or t
  misc_feature (1030)..(1030): n is a, c, g, or t
  misc_feature (1033)..(1033): n is a, c, g, or t
  misc_feature (1081)..(1081): n is a, c, g, or t
  misc_feature (1084)..(1084): n is a, c, g, or t
  misc_feature (1087)..(1087): n is a, c, g, or t
  misc_feature (1099)..(1099): n is a, c, g, or t
  misc_feature (1105)..(1105): n is a, c, g, or t
  misc_feature (1114)..(1114): n is a, c, g, or t
  misc_feature (1117)..(1117): n is a, c, g, or t
  misc_feature (1135)..(1135): n is a, c, g, or t
  misc_feature (1137)..(1138): n is a, c, g, or t
  misc_feature (1144)..(1144): n is a, c, g, or t
  misc_feature (1147)..(1147): n is a, c, g, or t
  misc_feature (1153)..(1153): n is a, c, g, or t
  misc_feature (1165)..(1165): n is a, c, g, or t
  misc_feature (1168)..(1168): n is a, c, g, or t
  misc_feature (1183)..(1183): n is a, c, g, or t
  misc_feature (1189)..(1189): n is a, c, g, or t
  misc_feature (1192)..(1192): n is a, c, g, or t
  misc_feature (1201)..(1201): n is a, c, g, or t
  misc_feature (1204)..(1204): n is a, c, g, or t
  misc_feature (1207)..(1207): n is a, c, g, or t
  misc_feature (1237)..(1237): n is a, c, g, or t
  misc_feature (1246)..(1246): n is a, c, g, or t
  misc_feature (1249)..(1249): n is a, c, g, or t
  misc_feature (1258)..(1258): n is a, c, g, or t
  misc_feature (1270)..(1270): n is a, c, g, or t
  misc_feature (1282)..(1283): n is a, c, g, or t
  misc_feature (1285)..(1285): n is a, c, g, or t
  misc_feature (1297)..(1297): n is a, c, g, or t
  misc_feature (1300)..(1300): n is a, c, g, or t
  misc_feature (1303)..(1303): n is a, c, g, or t
  misc_feature (1309)..(1309): n is a, c, g, or t
  misc_feature (1315)..(1315): n is a, c, g, or t
  misc_feature (1321)..(1321): n is a, c, g, or t
  misc_feature (1339)..(1339): n is a, c, g, or t
  misc_feature (1345)..(1345): n is a, c, g, or t
  misc_feature (1351)..(1351): n is a, c, g, or t
  misc_feature (1369)..(1369): n is a, c, g, or t
  misc_feature (1372)..(1372): n is a, c, g, or t
  misc_feature (1375)..(1375): n is a, c, g, or t
  misc_feature (1384)..(1384): n is a, c, g, or t
  misc_feature (1393)..(1393): n is a, c, g, or t
  misc_feature (1396)..(1396): n is a, c, g, or t
  misc_feature (1399)..(1399): n is a, c, g, or t
  misc_feature (1408)..(1408): n is a, c, g, or t
  misc_feature (1414)..(1414): n is a, c, g, or t
  misc_feature (1417)..(1417): n is a, c, g, or t
  misc_feature (1420)..(1420): n is a, c, g, or t
  misc_feature (1423)..(1423): n is a, c, g, or t
  misc_feature (1432)..(1432): n is a, c, g, or t
  misc_feature (1453)..(1453): n is a, c, g, or t
  misc_feature (1474)..(1474): n is a, c, g, or t
  misc_feature (1477)..(1477): n is a, c, g, or t
  misc_feature (1479)..(1480): n is a, c, g, or t
  misc_feature (1486)..(1486): n is a, c, g, or t
  misc_feature (1498)..(1498): n is a, c, g, or t
  misc_feature (1510)..(1510): n is a, c, g, or t
  misc_feature (1525)..(1526): n is a, c, g, or t
  misc_feature (1540)..(1540): n is a, c, g, or t
  misc_feature (1546)..(1546): n is a, c, g, or t
  misc_feature (1549)..(1549): n is a, c, g, or t
  misc_feature (1555)..(1555): n is a, c, g, or t
  misc_feature (1561)..(1561): n is a, c, g, or t
  misc_feature (1564)..(1564): n is a, c, g, or t
  misc_feature (1606)..(1606): n is a, c, g, or t
  misc_feature (1611)..(1611): n is a, c, g, or t
  misc_feature (1618)..(1618): n is a, c, g, or t
  misc_feature (1648)..(1648): n is a, c, g, or t
  misc_feature (1664)..(1666): n is a, c, g, or t
  misc_feature (1669)..(1669): n is a, c, g, or t
  misc_feature (1671)..(1671): n is a, c, g, or t
  misc_feature (1680)..(1682): n is a, c, g, or t
  misc_feature (1689)..(1689): n is a, c, g, or t
  misc_feature (1700)..(1700): n is a, c, g, or t
  misc_feature (1708)..(1708): n is a, c, g, or t
  misc_feature (1806)..(1806): n is a, c, g, or t
  misc_feature (1812)..(1812): n is a, c, g, or t
  misc_feature (1814)..(1816): n is a, c, g, or t
  misc_feature (1819)..(1819): n is a, c, g, or t
  misc_feature (1821)..(1823): n is a, c, g, or t
  misc_feature (1826)..(1826): n is a, c, g, or t
  misc_feature (1828)..(1828): n is a, c, g, or t
  misc_feature (1830)..(1830): n is a, c, g, or t
  misc_feature (1832)..(1834): n is a, c, g, or t
  misc_feature (1836)..(1836): n is a, c, g, or t
  misc_feature (1839)..(1839): n is a, c, g, or t
  misc_feature (1844)..(1844): n is a, c, g, or t
  misc_feature (1846)..(1846): n is a, c, g, or t
  misc_feature (1851)..(1851): n is a, c, g, or t
  misc_feature (1859)..(1859): n is a, c, g, or t
  misc_feature (1862)..(1862): n is a, c, g, or t
  misc_feature (1937)..(1937): n is a, c, g, or t
  misc_feature (1957)..(1958): n is a, c, g, or t
  misc_feature (1960)..(1960): n is a, c, g, or t
  misc_feature (1965)..(1965): n is a, c, g, or t
  misc_feature (1967)..(1967): n is a, c, g, or t
  misc_feature (1971)..(1971): n is a, c, g, or t
  misc_feature (1974)..(1974): n is a, c, g, or t
  misc_feature (1978)..(1978): n is a, c, g, or t
  misc_feature (1980)..(1982): n is a, c, g, or t
  misc_feature (1984)..(1985): n is a, c, g, or t
  misc_feature (1987)..(1987): n is a, c, g, or t
  misc_feature (1989)..(1989): n is a, c, g, or t
  misc_feature (1991)..(1991): n is a, c, g, or t
  misc_feature (1995)..(1995): n is a, c, g, or t
  misc_feature (1997)..(1997): n is a, c, g, or t
  misc_feature (2000)..(2002): n is a, c, g, or t
  misc_feature (2004)..(2005): n is a, c, g, or t
  misc_feature (2008)..(2008): n is a, c, g, or t
  misc_feature (2013)..(2013): n is a, c, g, or t
  misc_feature (2015)..(2015): n is a, c, g, or t
  misc_feature (2021)..(2021): n is a, c, g, or t
  misc_feature (2031)..(2031): n is a, c, g, or t
  misc_feature (2034)..(2034): n is a, c, g, or t
  misc_feature (3396)..(3397): n is a, c, g, or t
  misc_feature (3399)..(3399): n is a, c, g, or t
  misc_feature (3403)..(3404): n is a, c, g, or t
  misc_feature (3406)..(3407): n is a, c, g, or t
  misc_feature (3409)..(3409): n is a, c, g, or t
  misc_feature (3413)..(3413): n is a, c, g, or t
  misc_feature (3416)..(3418): n is a, c, g, or t
  misc_feature (3420)..(3421): n is a, c, g, or t
  misc_feature (3423)..(3423): n is a, c, g, or t
  misc_feature (3425)..(3425): n is a, c, g, or t
  misc_feature (3432)..(3432): n is a, c, g, or t
  misc_feature (3434)..(3434): n is a, c, g, or t
  misc_feature (3436)..(3436): n is a, c, g, or t
  misc_feature (3438)..(3438): n is a, c, g, or t
  misc_feature (3444)..(3446): n is a, c, g, or t
  misc_feature (3448)..(3463): n is a, c, g, or t
  misc_feature (3465)..(3470): n is a, c, g, or t
  misc_feature (3474)..(3477): n is a, c, g, or t
  misc_feature (3481)..(3481): n is a, c, g, or t
  misc_feature (3483)..(3490): n is a, c, g, or t
  misc_feature (3492)..(3492): n is a, c, g, or t
  misc_feature (3494)..(3498): n is a, c, g, or t
  misc_feature (3500)..(3502): n is a, c, g, or t
  misc_feature (3506)..(3506): n is a, c, g, or t
  misc_feature (3509)..(3510): n is a, c, g, or t
  misc_feature (3512)..(3512): n is a, c, g, or t
  misc_feature (3514)..(3515): n is a, c, g, or t
  misc_feature (3517)..(3553): n is a, c, g, or t
  misc_feature (3555)..(3555): n is a, c, g, or t
  misc_feature (3557)..(3560): n is a, c, g, or t
  misc_feature (3562)..(3562): n is a, c, g, or t
  misc_feature (3564)..(3565): n is a, c, g, or t
  misc_feature (3567)..(3571): n is a, c, g, or t
  misc_feature (3574)..(3574): n is a, c, g, or t
  misc_feature (3576)..(3576): n is a, c, g, or t
  misc_feature (3579)..(3585): n is a, c, g, or t
  misc_feature (3587)..(3587): n is a, c, g, or t
  misc_feature (3589)..(3600): n is a, c, g, or t
  misc_feature (3602)..(3607): n is a, c, g, or t
  misc_feature (3609)..(3621): n is a, c, g, or t
  misc_feature (3624)..(3630): n is a, c, g, or t
  misc_feature (3634)..(3634): n is a, c, g, or t
  misc_feature (3637)..(3640): n is a, c, g, or t
  misc_feature (3643)..(3654): n is a, c, g, or t
  misc_feature (3657)..(3657): n is a, c, g, or t
  misc_feature (3663)..(3666): n is a, c, g, or t
  misc_feature (3671)..(3699): n is a, c, g, or t
  misc_feature (3702)..(3706): n is a, c, g, or t
  misc_feature (3710)..(3712): n is a, c, g, or t
  misc_feature (3714)..(3723): n is a, c, g, or t
  misc_feature (3726)..(3729): n is a, c, g, or t
  misc_feature (3731)..(3733): n is a, c, g, or t
  misc_feature (3735)..(3736): n is a, c, g, or t
  misc_feature (3738)..(3745): n is a, c, g, or t
  misc_feature (3748)..(3749): n is a, c, g, or t
  misc_feature (3752)..(3752): n is a, c, g, or t
  misc_feature (3754)..(3756): n is a, c, g, or t
  misc_feature (3758)..(3758): n is a, c, g, or t
  misc_feature (3763)..(3773): n is a, c, g, or t
  misc_feature (3775)..(3790): n is a, c, g, or t
  misc_feature (3794)..(3798): n is a, c, g, or t
  misc_feature (3800)..(3801): n is a, c, g, or t
  misc_feature (3806)..(3807): n is a, c, g, or t
  misc_feature (3810)..(3813): n is a, c, g, or t
  misc_feature (3816)..(3820): n is a, c, g, or t
  misc_feature (3824)..(3835): n is a, c, g, or t
  misc_feature (3837)..(3837): n is a, c, g, or t
  misc_feature (3840)..(3843): n is a, c, g, or t
  misc_feature (3846)..(3846): n is a, c, g, or t
  misc_feature (3848)..(3855): n is a, c, g, or t
  misc_feature (3858)..(3865): n is a, c, g, or t
  misc_feature (3867)..(3898): n is a, c, g, or t
  misc_feature (3900)..(3900): n is a, c, g, or t
  misc_feature (3902)..(3906): n is a, c, g, or t
  misc_feature (3908)..(3917): n is a, c, g, or t
  misc_feature (3922)..(3928): n is a, c, g, or t
  misc_feature (3931)..(3939): n is a, c, g, or t
  misc_feature (3941)..(3953): n is a, c, g, or t
  misc_feature (3958)..(3963): n is a, c, g, or t
  misc_feature (3967)..(3969): n is a, c, g, or t
  misc_feature (3971)..(3971): n is a, c, g, or t
  misc_feature (3973)..(3974): n is a, c, g, or t
  misc_feature (3976)..(3976): n is a, c, g, or t
  misc_feature (3982)..(3983): n is a, c, g, or t
  misc_feature (3986)..(3986): n is a, c, g, or t
  misc_feature (3989)..(3993): n is a, c, g, or t
  misc_feature (3995)..(4000): n is a, c, g, or t
tttntttatcttntntnntatattnntngngcanctnncnatttttannannacnnangnnnnntttacngtanannnnntnnnncanccgntcnnngntantatgtgggnnncntttnncgatagnntcaanntatttatgnaangttnagtcnttnnagcgtattntaatgtnntnggnaatatcntntggnttangncncntngatttttntgnggantnntcnntngnaaaaannanggacantntcgntnnctttggtanggnttntngacntcttttncnatngngntnntncaatttatnttntncacnngnntcanncatatngannnnatnntctntnatntnntnngnagntggntnggtttnntactntatngnnncattatnaaatggaggggaaaataatctatgggaacaatcatcgtgaaacaaaaagcagcgggattgattaaaaaaggaagtccactgatnagtcagatggacctngcgcaagaacttcgcgcagatgaaggcgaagtggtnaaagttnntgaccaacaacgtcntttcttaggaatggcctatgttggattccaaaataagggagttgcgtgggtntatagccgcgangaagacgaagcgttggatgatgcgttctttagnggnatcttcaagacggcnttcgagaancgncgtgcnctcntncattcggangatacgacgactttccgtctcttcaatggggaaggcgacggntttggnggagtgacnattgactggtangacggttttatcgttgtctcttggtatagcgagggngtttntcattaccgnnanctnattttnacgcaggcnctngcnnngtttgaaggngtnaaaggngtctacgaaaagattcgtttcaagaatgaagcngacttgccagaaagncantttgtcggcggnntagaagcnccagaaccattaatcgtattnganaatggtgtnaaatacgcnacntatatgaatgaaggattgatgacnggnatcttcctagaccaacgngangtgcgcgaaacgattcgccagcgttacagtgcaggacgtaccgtattnaanacnttcagttatacnggtgcnttttctgtngcngcagcgatgggtggcgcnannaaaacnacnagcgtngacgttgccaancgnagtcttgagaagacnaaagancantttgcagtnaanggnattgacccagaaacgcaacaaatctatgtnatggacgtnttngattatttnaaatacgccgtnaagaaacagttnnantttgatacggtngtngtngatccnccaagntttgcncgtacgaagaagagaacnttctcngtggcnaaagactacggcaaactngtngcncaaatcacnccattagtngcnccnaaaggaacnctcgtnttntcnacnaacgcagcnaatgtgagcgaatctcaattncaacaaatgattgagaaaggnatncnngaagcngaaggcaatcgnaagttccgcatngtcttgaaaaaaggnntgccaagcgatttngcagtnccngtagcnacaccnctnagcgattatctcaaagttttctttattgaatttaacaactancacanctgcccnaaattcacttataagtgaattttgggcagntttcgtacgcacctcnnnctncntgcacaaannncgtcctnatgccatttcngcagcacnggaggccattagaggcaccgacatgtcattttcatcttttggcacaaatcccattgcaccgcgatttctagcagttcacttttttgcaaaaaaatccnattttntnnnaancnnnaanancntnnngnttntatancnacagnaatggggnatngcaaccaatgtgaattactgactctagggtgaaacccgtagagtcagtttgaagcttggtaggaattgagacganaggctcaatccggtgccccnntncagtngntatnaancaancnnnanngntngnaagngnttnnnannaanaacgnantttttntaaaaaagantanactataaagattgcattgcaaattaagttttgatataataccaaagtgcatgaaaatgcacatgtcggaacaccgtgggaggagaaatcttcatctccattaaaccacgcacgaaacaatcaaggaggtaatgtctcgtggctaaaaaagttgtaaaactagttaaattacaaattcctgcaggtaaagcaactccagctccaccagtaggtccagctttaggtcaagcacaagtgaacatcatgggattctgtaaagaattcaatgctcgtacagctgaccaagcaggtttaatcattccggttgtgatttcagtttatgaagaccgttcattcgacttcatctgtaaaacaccaccagcagcagtattattaaagaaagctgctaaagtagaaaaaggttcaggcgaaccaaacaagaaaaaagttgctactgtaactcgtgatcaagttagagaaattgctgaattaaaagcacctgacttaaatgcagcagacgtagaagctgctatgcgcatggtcgaaggtacagcccgttcaatgggatttgtagtagaaggctaaaaacaaatgcagcttccaaaagtccctagcacgagtgtttcactcatggactttgtgggaggtaaaaccgttaaaaccacacaataggaggaaattatacaatggcaaagaaaagcaaaaaatatttagaagccgctaaaaaaatcgattcttctaaagcttactcagttgaagaagcaatcgcattagcaaaagaaacagatttcgctaaatttgatgcatctgtagaagttgcataccgtttaggtttagatccaaagaaagctgaccaacaattacgtggagcagttgtgcttccaaacggaactggtaaaactcaacgcgtattagtattcgcaaaaggtgaaaaagctaaagaagctgaagcagctggtgcagactacgttggtgacagcgaattagctcaaaaaatccaaggcggatggtttgagttcgacgttatcgttgcaacacctgacatgatgggtgaagttggtcgtttaggtcgtgtattaggacctaaaggcttaatgccaaaccctaaaacaggtactgttacaatggacgtaactaaagctgttgaagaaatcaaagctggtaaagttacttaccgtgttgacaaagctggtaacatccacgttccaatcggtaaagtttcattctcagatgacaaattagtagaaaacttcaaaacaattcacgaaacattattacgtatcaaacctgctacagttaaaggtcaatacgtacgtaacgttgctgtgacaactactttcggccctggggttaaagtagacgtagcttctctataatttaaaannanatannannangccntgnnntnngntnttttttntnantnaaaaannnannnnnnnnnnnnnnnnannnnnntttnnnntttntnnnnnnnnanannnnnannntttnttnntntnnannnnnnnnnnnnnnnnnnnnnnnnnnnnnnnnnnnnnanannnnananngnnnnnttntnaannnnnnntntnnnnnnnnnnnntnnnnnnannnnnnnnnnnnnaannnnnnnaaanaannnnggnnnnnnnnnnnnttnaaaaannnnttttnnnnnnnnnnnnnnnnnnnnnnnnnnnnnaannnnntttnnnannnnnnnnnnaannnngnnnannannnnnnnnaannttntnnnanaaaannnnnnnnnnnannnnnnnnnnnnnnnntttnnnnntnnttttnnctnnnnttnnnnnaaannnnnnnnnnnntntannnnggntnnnnnnnnttnnnnnnnntnnnnnnnnnnnnnnnnnnnnnnnnnnnnnnnncncnnnnngnnnnnnnnnnttttnnnnnnnggnnnnnnnnntnnnnnnnnnnnnnttttnnnnnnaaannncngnnantttttnnttnaannnnntnnnnnn

SEQ ID NO: 425 - DNA, 4000 bp, Escherichia coli
  misc_feature (140)..(140): n is a, c, g, or t
  misc_feature (151)..(151): n is a, c, g, or t
  misc_feature (154)..(154): n is a, c, g, or t
  misc_feature (158)..(158): n is a, c, g, or t
  misc_feature (163)..(163): n is a, c, g, or t
  misc_feature (172)..(172): n is a, c, g, or t
  misc_feature (217)..(217): n is a, c, g, or t
  misc_feature (283)..(283): n is a, c, g, or t
  misc_feature (418)..(418): n is a, c, g, or t
  misc_feature (421)..(421): n is a, c, g, or t
  misc_feature (856)..(856): n is a, c, g, or t
  misc_feature (980)..(980): n is a, c, g, or t
  misc_feature (1051)..(1051): n is a, c, g, or t
  misc_feature (1084)..(1084): n is a, c, g, or t
  misc_feature (1191)..(1191): n is a, c, g, or t
  misc_feature (1540)..(1540): n is a, c, g, or t
  misc_feature (1987)..(1987): n is a, c, g, or t
  misc_feature (1989)..(1989): n is a, c, g, or t
  misc_feature (2052)..(2052): n is a, c, g, or t
  misc_feature (2163)..(2164): n is a, c, g, or t
  misc_feature (2975)..(2975): n is a, c, g, or t
  misc_feature (3094)..(3095): n is a, c, g, or t
  misc_feature (3122)..(3122): n is a, c, g, or t
  misc_feature (3128)..(3128): n is a, c, g, or t
  misc_feature (3134)..(3134): n is a, c, g, or t
  misc_feature (3200)..(3200): n is a, c, g, or t
  misc_feature (3212)..(3212): n is a, c, g, or t
  misc_feature (3371)..(3371): n is a, c, g, or t
  misc_feature (3543)..(3543): n is a, c, g, or t
  misc_feature (3668)..(3668): n is a, c, g, or t
  misc_feature (3671)..(3672): n is a, c, g, or t
  misc_feature (3691)..(3692): n is a, c, g, or t
  misc_feature (3695)..(3695): n is a, c, g, or t
  misc_feature (3710)..(3710): n is a, c, g, or t
  misc_feature (3712)..(3712): n is a, c, g, or t
  misc_feature (3722)..(3722): n is a, c, g, or t
  misc_feature (3725)..(3725): n is a, c, g, or t
  misc_feature (3729)..(3729): n is a, c, g, or t
  misc_feature (3761)..(3761): n is a, c, g, or t
  misc_feature (3763)..(3763): n is a, c, g, or t
  misc_feature (3766)..(3766): n is a, c, g, or t
  misc_feature (3776)..(3776): n is a, c, g, or t
  misc_feature (3794)..(3794): n is a, c, g, or t
  misc_feature (3827)..(3827): n is a, c, g, or t
gccctatccgctgttcgtggaagacgagccttcgcgcaatcagtacctgaccgtcgaggagacggccgtcctccccggcaacctcgtgaacacgctgcgcgtcgccttcaaccgcacggacatgaacgtgcggaaccggncctacccgggngtntcgntcganccggcgctntcgttcatccccggacggccgttcggcgatctgatcatcggcggnctcacgcccaccggcagccagttcgggacggagccgcgcatcccggtggtggccaaccagaagctnttcgaggtcatggacgacctggtctgggtcaagggccgccacaccctgaagacgggggtgctcgcggcgcgctacgcctgggacgacgtccaggacttccagtcgaacggcgagtacctcttcccgagcatcgcngcnttcgtggccggcacgcccagccggttcacggcgacgctgccggggtccgtgcccgaccgcgccaaccgcgcctggctcttcggcgcctatgtccaggacgacttccggatcacgccccgcctcgtgttcaacctgggcgtgcgctactcgcctcagaccgttcccgcggacgcgcagggccgcgactacaacctgcaggacgtcgtaacgggcacgcagacgacgcagggtccgctgttcaagaatccctcctggggcaacgtggcgccgcgcgtcgggttcgcctgggaccccaagggtgacgccaagatgtccatccgcggtggcttcggcgtctaccacgaccacctgctgcactacatgctgaccacccagcgcttccagcccccgctctacctcacgcgcgccatcaccaacccgagcttcccgaacgcngggccgctcaccgcgccgccgacctcgcaactgaacatccagaccgtcgactcgaacatcaagaacccccgcacgctgcagtacagcctcaccctcgagcgcgagctgttctggcgcacgacgntcagcgtcggctacgccgggctgcgaggctacaaccagctccgcgggggcagcgtgaacctggcgacgccngtcatccaggccgacgggaccccgttcttcccngcgggagcgccgcggatcaaccccgcgtgggccgacatcgacaacaagcgcgccgacggcaacctctggtacaacgcgctccaggtcggagcggtgcaccggttctnccgcggcctgcagttccagctcgcctacacgttctcgcgcacgatcgacgacggctccggatatctcttcatcgatacccgcaacagcgtcgccgatccgcagaacccgttcgacaactcccgcgagcgcgggctcgccaactaccacgtggcgcacaacttcgtcgccaacttcaccgcggacatcccggccgggaacctttcgggcgtcgcgggtgcgctcctcaagggctggcaggtcaacggcatcgtcaacctttcctcgggcaacccgttcaccccggccatcgtgggcgaccgtgcccgggccctcctgcggcgggcggggcaggagcgtccgaaccaggtnggcgacccgttctcagggacgtgcccgaacggcgcgcccgtccacaccgccgactgctggtacaacccgagtgccttcgccttgcagccggcgggcaccttcggcaacctcgggaggaacacgctgatcgggccggggctggccaacgtggacctcgcggccaccaagaacatcggcatcgggcgctcgacggtccagctccgcgtcgaggccttcaacgtcttcaatcaccccaacttcggtgccccggacacgctcgtgttctcgggcaccggcgccgacgcggacaagatcctgcccaccgcgggcaagatcttcccgaacacgctcaccacggcgcgtcagatccagctggggatgaaggtcctcttctagagcgttcctgatgtcgtggaagccaccggttggcggtggcttccacccctcaccgcgaccccgaactcgttncnaagaggagtcttgtgatgaagcggatgatggtgctgtccctgatcgcgctcgcccttgcggcncctggtcaggcgtccgacccctatctcgatctcatggccttgccgaacgacttccctgcggagggcttcgcgatcggcaacggcacgagcttctacgtgggttccttcgcnnccaccggaacgacgggccagatcctcgtgggcgacctgcggaccggaaagctctcggagctcgtgcctccgacgggcatccaggtgacgggcatgaagctcgactatcgcagcaatctcctgttcgtgtgccgcgccaccgccgggggcgccgtcgtctacgacgcgggcaccggacgccaggtccgcacctaccagttcagctccgcgcccacgttcatcaacgacgtcgtgctcacccaggacgcggcgtacttcaccgactcgcgccagcccaagctctaccgcgtcgccctcggagcgcgcggggaaccggcgcaggacttcacggtggtcccgctgcccgcggaattcgagtggccggcgggctcgggcacctacaaccccaacatcaacgggaacggaatcaccgcgagcgcgaagggagacttcctgatcgtcgtgcacaccggcaaggggacgctctaccgcgtggagacgtcgaccatgcgcgtggaccggatcacgctcagcgggggtgacgggacggaggcgggcaacggcgacagcctgatgctgtacttcaacacgctcttcgtcgtgaagaaccgccagaacaaggtcgcggtcgtccagatgtcgacggactacctctcggggacgatcgcccgctacatcacggagccgttccagtccaacccggccctgcgggtccctaccgcgatggggtacatcggcaactcgctgtacgtggtgagcggtgccctcaccggggtaccgccgtactacgtctcacggctggatttctagccgtccccggacggctcgctcangcggacgcgcgctcgtggaactccactatggcgctccacgcgcccagaccgatgccactcgccatttgcggcagctcgaccatgttgtgcgccaggaagatcaggaccgagttgtcgcnngggtccgcttgccaccagccgccatangcgccnggccanccgaccgtcccgacaccgccgcgacacgtcaagggatccgccttctccggttccatcaccacggcnacgcccatcccntatccgtggccggccgcaaacaccgaccggcccagcattcgagcggtccgacgctggtccgacgtgagctggttcgaggccatcagggcgcacgtttccgggcgcagcaggcgcacaccgtccacctctccacgaccgaggaagaggcgggcgaaggcnagatagtcgtccaacgtcgaccagagcccctgacctcccgactcgaaggtcatgtcgtcaggccgttccgagagcgcgtgcccgcccggcaccgccgtcaacgcggtcaacttcccctcggcgtcgaacccgcagaggcccgcgcggcgcgctcgcttctctcgagggacgncgaaacccgtatcgcgcatgcccagcggcctgaagacgcgccgctcgaggacaacgccgagagagacaccttcgagacgcgcgatcaggaatccgagcaggtcggtcgacagtccgtagtgaaanccnncccccggctgatcgatcannggnagggtggcgagtcgngngatccactcntcngggncgagggcattgtccatcgtccctccgagggcntnggngcaggcgcgngagatcgggccacgatgnaactcgccgtaggtgaggccggagcggtgagtnaggagatcgccgaacgtgatcggccgctccgccgcatccgtctggtccagaggaccattcgggtcgcgcaggactcgaaggcgtgcgagctcgggagccaggcgcgcgatgggttcgtccagggcaaagcggccttcgtcgtacaagatcaaggcggccacggtcgtcagcgg

SEQ ID NO: 426 - DNA, 4000 bp, Escherichia coli
  misc_feature (1)..(801): n is a, c, g, or t
  misc_feature (1991)..(1992): n is a, c, g, or t
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncgcacctcagcgtcagtatcgagccagtgagccgccttcgccactggtgttcctccaaatatctacgaatttcacctctacacttggaattccactcacctctctcgaactctagactaggagttttagaggcagttccgaggttgagccccgggatttcacccctaactttctaatccgcctacgtgcgctttacgcccagtaattccgaacaacgctaaccccctccgtattaccgcggctgctggcacggagttagccggggtttctttacctgctactgtcattatcatcacaggcgaaagagctttacgaccctaaggccttcatcactcacgcggcatggctagatcaggcttgcgcccattgtctaagattccccactgctgcctcccgtaggagtctgggccgtgtctcagtcccagtgttgctgatcatcctctaaaaccagctatagatcgtaggcttggtaggccattaccccaccaactacctaatctaacgcgggccgatccaaatccgataaatctttcccccgaagggcgtataaggtattactcaccgtttccagtggctattccttagatctgggtacgttcccacgcgttactaacccgtccgccgctcactccgaagagtgcgctcgacttgcatgtgttaggcctgccgccagcgttcgttctgagccaggatcaaactctcaagttgaaaagctgttaccagcttatccttgacgttcgaacctctgcacatcacttccggttttgttcaaaaccggaaaaactgtttgttgtgcttcagtaccaaaagataccgaaagccgtccaaacagtgaagctgacactacatcatcggacataagccctagtagcgttgatatgcgaggtagatccatcgatatgaaccaaactgcccacatatctcttcagtgtcttcaattttcaaataacgttgacacaaaactcaccgaccgcgctaaactcttacctagcgcaaccgcttcattctgcctctattttgcctcaacctcgttgcgtttccgccccgccgtctcggccaccgtagcgatcatcgctgccggtgaaggggcttttacgcataccaccaaaaacccgcaacccctaaaaagcaaaaaaatgaattttcttgtgaattttttgaattttaagtgtaaacagttgtttttattnnatttttataaatccggttttttgcatatttttgatcgcccctattttcatggtcgcataatgacctgatgttagcgtccaaaccacaaatccgtgaatcgtacccacagaatccacatttcagccgcaagaatctgttaccttaacatcggttttgttttggtcgttctctgattcacgcaggatttaggatggaaaaaatgcaatttagaccactgaccgcgaaataccatgtatcaggcccccttacggtggatctgattcctttgttggcggatcaaggattcgcgaaaatcatctgcaatttgccggacggtgaaattgacgggcaaccagaccacgcaacactgtcagaagctgtgacagcctatggaatcgattttgtctatattcccgttacggtcaccgaaatgacgccccaagtggttttacaccacaccaaggcggtgatcgaaaccgaaggggctgttttggcctattgcgcaaccggtcgccgttgcagcatgttatgggcgctggaattcagcgataaatattcgcaagaccagattatgagcaaagcccgtgcgattgggtttgatttttccagcatgcgccagaaactggccgcgttccaacctctgccgtctggggtgcggttttaagccccctgttcaaaccatgtgcacaacgctagggtttccccatgaaaggagcccacacatgcacaaatttctagccagcctagctgcgagctgtattatagccagcgcagcccatgccaatgaccccgttatatacgaggtcacagaccagtcctatgatgatatcatgttcggattggaaaacgcattgatcgatgcgggtctggttattagcgaacacaaccacattgccgaaatgttggaacgcaccaaagcagacgtgggcggcaccgaaacagtgtttgttcatgccgatgtgttggggttctgttccgccgatttatcacgcaaagcgatggaggccgatccgctgaacattcgattctgcccctatcagatatttacctatcaacagacagacgacagcccgattattgtgggctatgattccctgcctgatggcgtaatgcaggatgtacagcagtttttggatcagctggcccgcgatgcgattggattggattgaccaccacatcacaaacccatctattctaaccaaaggcccgcgacagtatcgcgggcctttcgtgtatcagacgtatattcgcaggttaatgaataacggcttgatccggcgtatcgcggtccgatgttcccaaacggtcgccgatgatcaaaccatccgcgctggccgtaatgggcagggtatcgccatctttgacctcgccggccaataacatttctgccaagggatcttgcaacgcccgttggatcacccgtttcaatggtcgcgccccgaacacagggtcatatcctgcatcagccaaccaggtgcgtgcatcttgatccaacactagttcgattttgcgtcccgacaggcgtttttgcaaacgcgccaactggatatcgacaatgccccccatatcgttgcgccccaaacggtcaaagatgatgatttcatccaaacggttcaggaattcgggccggaaatgcgtacgaactgcatccatcacatcgcgtttggcatcggcactgtcggccccttcgggcagttggctaagtgcttgcgcgcccagattcgatgtcagaatgatgatggtctgtttgaaatcgacagtgcgcccttggccatcggtcaaaacaccatcatccaaaacctgcaacagcacgttgaacacatctggatgcgccttttcgacttcgtcaaacagcaccacctgataggggcggcggcgcacggcctcggtcaggaccccgccttcgtcatagccgacatagccggggggtgcaccgatcagacgcgcgaccgaatgtttttccatgaattcggacatatcaatgcgcaccatggcgctgtcatcgtcaaacagaaacgatgccaccgct

SEQ ID NO: 427 - DNA, 4000 bp, Escherichia coli
  misc_feature (1965)..(1965): n is a, c, g, or t
  misc_feature (1979)..(1981): n is a, c, g, or t
  misc_feature (1984)..(1985): n is a, c, g, or t
  misc_feature (1992)..(1992): n is a, c, g, or t
  misc_feature (1996)..(1996): n is a, c, g, or t
cctcgtcatcagggagttcgtccttcttggcatcaacaaggtgctcattcagcgactgagaggctgacgtgtgttgttgccgtatctttgacttcacgataagaccaataatcacgctgattacggtgagcacaccgaacgtaagatcgggtgcgctcgacatggagcgcagcgtggcgtatgctgactttcgcaccggtgcgccgagcgctacagatgatggcgtgcgtccgtgaacttgttgcggtgatatgggagactccaactctgactcctctccaagagcagccgtcgtcaaatgacatcgaacgtccgcgtacatgtacacaacacctgcagagttaccagcattatctgtgataccgctgacggtgaccttgtaccgtccttgcgccgggtacgggaactcaatgacccagttaccttcgtcgacgccgttgaagcagttgatattatacgattgcagctgttccggggtcacaagtacgttctgaaccgcaccagtaccgccacattgactgttcacttttttgacagtgacactcgttgaagaacagtcgatgggttcgtaaaacttgactccatagaaacgctcatctgagcttatgcgcatttgctccatgggcttgacagtgtcaacggacagggtgagcctttgatcggaaacaaactcgtgaacgcttgagatggcgagagaaggaccaccaaagcagaaattcttgactcgaacttcataagttccatccttaaaaccgctcatgagtttctcgtactgattgttcaactcccattcaaaagtacacccatcaagtcgagagctgtcacagagcaagtttttcttcttgttctgctcatctgaatcctccgccttggcggtgatccactctcctgcaccaaccttcctatactgcagacgtacaaagcgcaagcgttcattggcattcgcttcttgtgaccctgaagacggccatagattactggcatcaggattgaagacggtgagagggattgcatcctcgggctgtgacactgcggtgaaagcgtggcgagccatcgttgtagcatcaaaggcaactgaggggcactttgattcccaagtcatttcccctagcgcgatcctatcgttgcttggataacgatagagagaagactcaatgtcagcttcacacagagatagtagctcaagttgtgcgtgcttgatgacacctcgagagcttggagagactttgaggtacagcagtgtttccttcactcgttgtttaccagccaaattatctccctctacgagcatgctgacggtcccactcatatctaaactaccaaatccaacagaaaagtctgaattggcaagttcatcgccaacaggcggcgccgtctgcattgcggcagctgctgcgagagcgacatgcaaagcgtcggctccttggcctgcttttttcgcagcttcgtccttgatgcgcattatgtgtgatgacagagatgcctgcccccattcagcggcagtattgttgacgactgaagatactgaaagtccatcagcacttggtcgagcggcttcattgaacacggcttcgtgaagcgccttcatggcgagatctaacccatctctaatgcgcagtccaaactgtccgcgttcacgatacggggattcattgacgactttcagacggaaaaccgcttgctcgtccggatttaagtgtcgcctatgttcgtaatcgagctcaattcgtactccagattggcggtgcattgtgaggggttcacctgggcaaagacttctgccgcccttagtcacaaacacaggagtgccgaaacgcttgtcagtacctaccgatacgacaaacttatccccaaagtcgtcatcagcaagagagtaactggctgtcacagagccctttttgttccaagcaaagactcgttctgtggacagttgacgctcctgcgatgctgccagctcgatcccgnatccgaagacattnnnganntcgacancgancttgaatttattttcagcggagccgtcaaaggacataccgagattccaactttctccgccgagtccttccttggaagtgaacgtgaaatctagcgtttgacctcctccgctgaatgtcaacaaaatgctttcctccgccgattcaggtgacccacgaacatgcatccctgtttttgccgatgatcctgtcaatgaagccatgattcttgacgcatctgttgccgaaagatccctagtttcaccaagactatcgacagcgccatcataaagagagtggttggaaccttcgagttcacccgaaacgcacttcgatcccccacacctctgaatgtcgctagaaaggtcggcggctgcagctgaatttgaacccatctgataaagcacatcgtccgagggcgtgttgaaaatatcattgaaatgtgcatgaacggcgttgtcttttgtgtacgaaatactcaaacctggtacgtcattttcaatgaaacctaccagacgagccatattcaaatacggcaactgaatggcggggaaacccagagccaagaacccgaagtcgagtaactgaatcgcactagttctcatccattcgtttgccaattctgtagcgaggccggcagagtttgcgtccaaagcatcattgtatttagtttcgccagtttggaaatctcgctgatacagggagttttctccgaagtaaggcgttttgattctttccaactgggagaagtcttttgcgtactgcccgtcgacgccaagttcaggaatcagatacacctgcggtgctgaccacgcaagggtcctcacccatgactctatgcgagtctctagttcgttctgccaaccaaatttcatctcttcccgagtacagtgctctgcatctacgcagtcataaactaaacccgaatcgtcgttttctacggcaccagattggaccaacacctgcagtgagcggagatttggtaccacttgcgactcgattgtgtgtacattgaacaggtaggaggttggctttcgagggagccacgatatgcctacgtccgtgtacaagcacggtcggtcaggaacacctagaccaatgtcgtcgcgaagatcaagaacatcagaaagcttgtacacaagttctatgcctccgccaagaataacatcccctggacgaccaggaatcgctgggtccttgctcgacgttatagttcgcgatgtcgtcgttgtaagactccaaccgtcgtctttcttgcctgtcactgtgaatttcggctgttcaagttcttgtgcaaacttaagcttcgcttcgagtttgcctacttctacatcgacgccaaattcagcaatccagccagcgctgatttgcgaatctagtttgaactccagatcagtaccaaactcgcccgtagacttggacccagcgctgaaagctcgccgatctgagactgtaaatgaaatttcgatgtctgtaccagtgttcaacgaagcgtacgagttatcacctggtggatcgtgcacgacggtgtagaccaatccattgattggcactgttgcccaaaattggtcatcgctctcgccacttcctccgcgcaatttagcgccaaggattacaaattcacgacgaccagtgactgtggtggcgaaatatccatcatatcgatccaccatcacactgagcatgcgtctgtggttgccagcaagtcttggcggccctgcagccagcgtaattccggaagttggatcgacttcttcagcttgtggaaccaacaatcgaccatcctcgtctaaattcacctcaaaatcgcaagtttcaccgcctttaccgcggacgtgacacggtgattcagactcagcgccgatatcgtgccttatctgcacctttgtagaacctgtcttgtcttcagtgttcggaaacttttgacagcggaccaaatcacccccaattctgtgcagctcaaaaaccttgacattgacttgacgcgattgtctaacattcacatatgaggactgcgaagagccgag

SEQ ID NO: 428 - DNA, 4000 bp, Escherichia coli
  misc_feature (12)..(12): n is a, c, g, or t
  misc_feature (1990)..(1990): n is a, c, g, or t
  misc_feature (2009)..(2009): n is a, c, g, or t
cttctgtctcanattgcttcagaaatattcaatacaaagccaccagaaataccttcaggaaataaattattagaaatgatatcaaatcattatcttgagatgcttaatttttatggtgaacaacatggcaataaagttgctaggaaacacttgggttggtacatggattatataggtgtaaatcctatcgatcggagagctttacaaacagaaactgatccccaaaaagtattatcaatgatttcttccttatcagcaacggaggataatccatgccaataattgattttgctcacgtttggaatacaattccgttcccggcatttataattaattcagaatttataattattgaaggtaactcagccgctgaacaagttgttcaaacatctcataatcaaatgtctggaaaagcattaagcgtattctttggtataaattctgtagttttagaaactattaaacaagtaaaacgtgaaaattcatctttaagccaatatggtatagaagtttctacgattgatagggtgtcgtttgaatgtaatcttcatattaatccattggataagaataatgagaattatttgttaataatacaaccaaatagttttgcgcaaaaaataaatcaatcttcttcgcatcgcacatcagcaaggtctgtcactgccatggcatcaatgcttgcgcatgaaatcagaaacccgcttgctggaatttctggtgctgctcaacttttagcgatgaatgcaatagatgatgatgtagaactcgccgatatgataggacaggaaacgaaaagaattggtactttagttgatagatttgaagtattttcagacattagaccttcggtaagaaatgcatataatattcatgacgtcttagacagggctatcagatcatcatctgctggttttgcttcttcaataaagtttgaaaaacaatatgatccatcattaccaaatgcctctggggatgcggatcaaatgttgcaagtttttcaaaacatattgaaaaatgcatgtgaagcaatttcaaaagatcgtggaaaaataaaaatttgtacttcctataattctggagtgagatatacaatttctggtgaccaatcagaaatattgccattacaaattgaaataatagacaatggcagtggaattcctgataatattattaatgaaatatttgaaccttttgtatcttcaaaagttaatggcacaggtttaggattagcttttgtatcaaaaataattaccagtcacggagggttaatcgagtgtacctcacataatgctggaactaaatttattttacgtcttcctgtatcgaaaaaatcttcaaaggataaaatataatggatggaactatattagttgccgatgatgatcggacgataagaacagtattaactcaagcacttacacgcgctgggtgcaaagtaagggcaacaggaagtatagaaacattatggcgttggatagacgagggtaatggagatgtagttatatctgatgttaattttcctgatggcgatggattagaaatgttgcctgcaataaagcgcaaacgcaatgatttgccagttataattatttcagcacaaaacactgtaattactgcaataaaagcctctgaattgggtgcttatgattatttaccaaaaccatttgatctgaaaaaattactttccaaagtcaataaagctttattgaaccaaggagcagaaaaaagtgttattccccaaggtggtatagttgaacctgaattaccacttatcggttcatcaccacttatgcaggatgtatatagatttttagcgcggatcttacatactgatctttctactattattacaggtgaaagtggaactggcaaagatctattagctcgtgcaatgcatgacttaggaccacggtcggcaatggatttcgtacgtataaatatttcttcatcaaatattgataagatagagggaaccttagtaggcggnaaagaagatttaaagatanctccagcatcaaaaggggctacaatttattttgatgaaatttctgagatgtctgatgaaattcagttgcaattattagatttattacgttcagattcagttattgataaaaaatatagattaatctcatcatctagattgtcactacagaatttaattagccaaggtgtaattagggaggatttattttataggctaaatgtagtgaatataaaccttcctcctttaagagataggattggggatattcctgatttaacaaagcattttttgcaattatcagttatgttaggtcttcctcaaaaaactatatcaataaaggcaatgcaattattacaaaatgctcaatggatgggaaacatcagagaattagagaatttcattaatagattagtggttttagtgtccgatgatgagataagcgccaaccatgttgaagaaaacttaaatttaatcccatctatgaattcagatgatttagacacaagtaatggaaagctatcctcttctgttgagaggcatataaaaagatatttcgatttgcatggtgagactttaccaccaccaggattatataaccgaataatgaaagaaattgagttaccattgatagcattatcgttgtctgcaacacgtggaaatcaaataaaaacatctgaattacttggtataaatcgcaatacattaagaaagaaaatcaaagatcttgatattgtagttacaagaagtaaaaaaatgatgtaatgatgccacatagtgtagcaaatatagaactataaataattaaggcacatgatacaaaatttacttaacaaaataaaaaaatggcaaaataggcgtaaatttttagtagttatagcttggtctttaattcttcttggaccaattttaactgggctaacggtatctatattacagggagaatttggaagtaagctaagtaatattttgcgcttaatacttcttgttgatggaatttatcttttagtcgttatttcaattgttggttatgcagtaatgaaaatgtttgctgcccgaagagcaaaatctgcaggttcgcgattacacatgcgattaagtagagtttttgcgattgtagcacttattcctacagtccttgtagcagttttcgcagttgttacattaagtattggtgtagagggttggttttccaaaaatgtacaaaatgtggtgagttcgtctttatccgctgctgaagcatataagaatgaacaaagagatgacttaaagatagatttaaattttatggctgtcagattgaatgaatataaaaataccaattcattcgttagtgacagtgatctaagagttcaattaatcttgatccaaaaacttatccaaagaggactaaaagaagcctatattattgatggaaatgcaaacttaagatccagaggtgagttgagctatctatttggttatgaagagccttcggaaaaaaatatggaaattgctgagttaggtgagttgttgattatcgaagactggcccaataatgaatttagaagtttgattagattaaatagttttgaagataaatatttatatatatcaagaacagtagatggaaaaatactgaatttattagataaaacaatggaatctgccatcacatacaacactatggaatctcaacgtgaaaaaatactttggtcatatggactgttatatttaggttttgccacttttgttattctatcgtcaattttgcttggaatgctatttgcagaacgtctttctcggcctgttggacgattagctggagctgcacaaagacttggggcaggagattttgatgttaaggttatagaagaaaaaggcgatgatgagatagctatgttaagtcgtgtgtttaaccacatgacaaaacaagttaaacgtcaacgagatgatttaataacagcaaatgaatacacagaacgccggcgtagattgtttgatagcgttttatcgggtgtaactgctggagta

SEQ ID NO: 429 - DNA, 4000 bp, Escherichia coli
  misc_feature (364)..(368): n is a, c, g, or t
  misc_feature (370)..(381): n is a, c, g, or t
  misc_feature (383)..(384): n is a, c, g, or t
  misc_feature (387)..(399): n is a, c, g, or t
  misc_feature (401)..(402): n is a, c, g, or t
  misc_feature (405)..(407): n is a, c, g, or t
  misc_feature (415)..(415): n is a, c, g, or t
  misc_feature (420)..(420): n is a, c, g, or t
  misc_feature (428)..(429): n is a, c, g, or t
  misc_feature (433)..(433): n is a, c, g, or t
  misc_feature (444)..(444): n is a, c, g, or t
  misc_feature (448)..(448): n is a, c, g, or t
  misc_feature (451)..(451): n is a, c, g, or t
  misc_feature (454)..(457): n is a, c, g, or t
  misc_feature (460)..(461): n is a, c, g, or t
  misc_feature (471)..(471): n is a, c, g, or t
  misc_feature (484)..(486): n is a, c, g, or t
  misc_feature (496)..(496): n is a, c, g, or t
  misc_feature (501)..(501): n is a, c, g, or t
  misc_feature (509)..(509): n is a, c, g, or t
  misc_feature (527)..(527): n is a, c, g, or t
  misc_feature (530)..(530): n is a, c, g, or t
  misc_feature (540)..(540): n is a, c, g, or t
  misc_feature (542)..(542): n is a, c, g, or t
  misc_feature (544)..(545): n is a, c, g, or t
  misc_feature (551)..(551): n is a, c, g, or t
  misc_feature (553)..(553): n is a, c, g, or t
  misc_feature (557)..(557): n is a, c, g, or t
  misc_feature (565)..(565): n is a, c, g, or t
  misc_feature (568)..(568): n is a, c, g, or t
  misc_feature (570)..(575): n is a, c, g, or t
  misc_feature (578)..(578): n is a, c, g, or t
  misc_feature (580)..(581): n is a, c, g, or t
  misc_feature (588)..(588): n is a, c, g, or t
  misc_feature (590)..(591): n is a, c, g, or t
  misc_feature (594)..(594): n is a, c, g, or t
  misc_feature (596)..(596): n is a, c, g, or t
  misc_feature (598)..(598): n is a, c, g, or t
  misc_feature (669)..(669): n is a, c, g, or t
  misc_feature (696)..(696): n is a, c, g, or t
  misc_feature (698)..(698): n is a, c, g, or t
  misc_feature (706)..(706): n is a, c, g, or t
  misc_feature (708)..(708): n is a, c, g, or t
  misc_feature (750)..(751): n is a, c, g, or t
  misc_feature (753)..(753): n is a, c, g, or t
  misc_feature (762)..(762): n is a, c, g, or t
  misc_feature (783)..(783): n is a, c, g, or t
  misc_feature (819)..(819): n is a, c, g, or t
  misc_feature (821)..(821): n is a, c, g, or t
  misc_feature (1061)..(1061): n is a, c, g, or t
  misc_feature (1990)..(1991): n is a, c, g, or t
  misc_feature (2000)..(2000): n is a, c, g, or t
  misc_feature (2005)..(2006): n is a, c, g, or t
  misc_feature (2011)..(2012): n is a, c, g, or t
  misc_feature (2021)..(2021): n is a, c, g, or t
  misc_feature (2029)..(2030): n is a, c, g, or t
  misc_feature (2038)..(2040): n is a, c, g, or t
  misc_feature (2044)..(2044): n is a, c, g, or t
cgaagtgaagcggcgccatcggtcgcgctttgtggtgcaaaaacaccaagccagaagcttgcactacgattttcggttggagcatgaaggcgtcttaaagtcttgggccgcgcccaaaggcgtgccggagcaagctggcgttaaacggttggccatagcggttgaagaccacccggttgattacataaatttttccggtgtgattccggaaggcgagtacggcgcgggcacggtggagatttgggacaaaggcaaatggcagacactggacggtagtttggagcggggtagtatgaaatttaatctggccggtaaaaagttaaaaggggaatacgtgttagtgaaattgaaagacaaaaagaannnnntnnnnnnnnnnnnannatnnnnnnnnnnnnngnnggnnnaaaggggnttggnttttaaannttanccaaccccaancccnccntgnnnnggnnggggtaaatnaaattttcccccnnntaagggggantaaangggggttnattgaaaaaaaataaaanaanaaaaaattancnannaaattngntttnaaaaaaanggncnnnnnnttnannaaaaaanannacntngncggaaaagaaattatggaaagattttttaaaaaatcataaatataaatttactcgccagaaaccgattaanaattatattgttgatttttattgctcngnattagggntngtgattgaagttgacggcacgacacatttggataaaaaaganntnttatacganaaaaaacgaactgccgacttngcaaaatacggtttaaaaattttgcgtttttggaanancgacattttaaacggagcgcatgttgttggagaaataatagataatgaaataaatagaataacccactccagccctcccttgtcagggaggaagtaaacttgtcttttatctaatattaaattaaaaaagctgggaaacttgcttttttattgtttttatgctaatgtattaaattctttccagaggggaaagatcccaaacctcgggtagaggtggacattaaaaatgggcttttagcntgaaaggagcaataaaatggatcatcatcaggtaagtattgaggaagtcgcaagggtggtttacggcatggggtcagaagcattttctaaattagccgggcaattgccgaaagttggcgttaaatttggctggcagaccttgggtcactttgagctcttcttaaaccagctcaatcccgaggagcgagaagcggtgatacgcggcgataggaaactgaccaccgaagaagtgattcgccttctgattgaccaaaacggccgcggcatacctgcgcatctcggcattaagagtgatgcaaaggatgagaatgcaatcttcacgatcaagcagcttacaaacaactacggtgaaattcgcgactcctatgttgaagcatttgccgactttccggagctgaaatttctttcggcgtctgaatttgaggaccggtcggaaaagaaaaaggaaatgctcctcgcggatggactaatctccaacttagtcagacgggcacacatgccgattcctaccccgtattttgtcgtgaacgactacggcaagggcaaggcgctacaggaaatttttctcgcggtactggagaaaatgtataaaaaacattttcccgatcgtaacttcgaaaattataatgtggagctgaaaaaaaaagtacgtattattaaaaatactggctatgataagttcatcgcgatgatggccagcggtcctgacgcggtttggtattttccgcgggctttgcagggtttttcgatcaatgcggaacgtgaagccatgaaaattctcatcggtcgctcgttggctctttcgggagcgatttctacatcgctcgctattactggaaatgtcgtggaaatggtcggaagttttaatactcctggctatgactgcgcggcagtttcttgggggtcatccgactactcgctttacttcnnggccgatgncgacnngctcnngttcagcantactgacnncctcggcnnngcgnatggcggctattccgccggcctggtcttcctcgggtagcgcggtattcgttattcggaattttttccctggattggagttttggttttttggtctttgggaaaaacaactacggagatgtgaattatgtttcattcacatctccttttattttttaggaaattttgttaaactgattttgaaagtaggctaatgtaccataattccaaaaagattatggtcgccgaaattctatgattcttcatagggcatcagaatcttgctatcatgttttctgattaaatcggtcgattgcaagagcgtatgcgaagatcttagacgctacttgtttttttctagcgctcatcaggggcggaataaaattcagttccgcatagattttgcggggcggtgaaacggacggaagaaaacaaatttcttggaagtcatccgactactcgctttacttcaaggccaatgacgacaagctcaagttcaacaatactgacaacctcggcaaagcgaatgacaactattccgccggcctggtcttcctcgggttgagtctatagaagggcttcttaaccaagaagccccgatcttaatttaaagattttttccagccgccaatcatgcgcccgatttcctgaagctggttttgcagagcgatatattttttattatccagcatgccgatatcattagacaggcgaataaatattttcagggtatcaaattttatgctggcccggccgatatgggcagttttttcatttttaggcgcgctaccggccgcgactaagagctcaagcgtctcaataatatacatttcgcatttatttcccagcgtgtatttgtcttttttaggaaacagtttcgcgtaattataaaaagttttataaagctcatagacctttttaattacggggatttcattgttgatatagatattcatatatgagtgataaattatttagccttgatgatatttttacggcctggcgcgaattcaaaaaagacaagcaggccaagtttgatgtgcaaatttttgaaagatttttagaagacaatattttttctattcacgaagagctggaaaataaaacttatcgccataggccatatgaaacatttcatattcgcgatcctaagcatcggataatcagcaaagccgccgtccgggaccggctagtgcatcatctggtgtttagaaaactctatggcatttttaattcaagctttatttttcattcttattcttcaagaaaaaataaaggaactcatctggccgtaaaaaatctttccgattgtttgcgcggggaaagcagaaactacacgcgcccagtttatgttttaaaatgcgacatcaaaaaattttttcaaagcatttctcacaaaaaacttttacagctgattgaacgcaaaatttccgataaaaatttattatggctgattaaggaaataatcggtagtttccgcctgcctgtggaaaattttacagagacagacagagagagagagagttaaaggcagattttttagaaaagacgggcgtgccgatcggcaatatcacctcgcaaatttttgccaatatatatttgaatgaattagattggttcataaaaagagagttaaaaataaaaaattatttccgctatgccgatgattttataatcgcgcattcggacgcgagctatcttagaaaaattttatcactcattgataaatttctcaaagctgagttaaaattagaacttcatcccgataaggtttctatagagaagtttcataatggaatagattttttagggtatgttgttttacctcattataaagtactacggacaaaaaccaaaagaagaatgtttaagaaaataaaagccggcaaggaaaaaatggaaaaagggctggttaaccatgaaacatttaatcaatcgctgcaatcgtattatggaatgcttaaacattgtaatgccca

SEQ ID NO: 430 - DNA, 4000 bp, Escherichia coli
  misc_feature (4)..(6): n is a, c, g, or t
  misc_feature (8)..(8): n is a, c, g, or t
  misc_feature (10)..(11): n is a, c, g, or t
  misc_feature (13)..(13): n is a, c, g, or t
  misc_feature (15)..(19): n is a, c, g, or t
  misc_feature (23)..(23): n is a, c, g, or t
  misc_feature (25)..(28): n is a, c, g, or t
  misc_feature (30)..(30): n is a, c, g, or t
  misc_feature (32)..(40): n is a, c, g, or t
  misc_feature (42)..(45): n is a, c, g, or t
  misc_feature (47)..(49): n is a, c, g, or t
  misc_feature (51)..(53): n is a, c, g, or t
  misc_feature (55)..(55): n is a, c, g, or t
  misc_feature (57)..(63): n is a, c, g, or t
  misc_feature (65)..(65): n is a, c, g, or t
  misc_feature (68)..(69): n is a, c, g, or t
  misc_feature (71)..(72): n is a, c, g, or t
  misc_feature (74)..(76): n is a, c, g, or t
  misc_feature (78)..(81): n is a, c, g, or t
  misc_feature (83)..(86): n is a, c, g, or t
  misc_feature (89)..(89): n is a, c, g, or t
  misc_feature (92)..(97): n is a, c, g, or t
  misc_feature (100)..(105): n is a, c, g, or t
  misc_feature (107)..(107): n is a, c, g, or t
  misc_feature (109)..(110): n is a, c, g, or t
  misc_feature (113)..(124): n is a, c, g, or t
  misc_feature (126)..(128): n is a, c, g, or t
  misc_feature (133)..(135): n is a, c, g, or t
  misc_feature (137)..(141): n is a, c, g, or t
  misc_feature (144)..(145): n is a, c, g, or t
  misc_feature (147)..(153): n is a, c, g, or t
  misc_feature (156)..(157): n is a, c, g, or t
  misc_feature (159)..(162): n is a, c, g, or t
  misc_feature (164)..(164): n is a, c, g, or t
  misc_feature (166)..(172): n is a, c, g, or t
  misc_feature (174)..(181): n is a, c, g, or t
  misc_feature (183)..(184): n is a, c, g, or t
  misc_feature (186)..(190): n is a, c, g, or t
  misc_feature (192)..(192): n is a, c, g, or t
  misc_feature (194)..(194): n is a, c, g, or t
  misc_feature (196)..(196): n is a, c, g, or t
  misc_feature (198)..(199): n is a, c, g, or t
  misc_feature (201)..(206): n is a, c, g, or t
  misc_feature (208)..(216): n is a, c, g, or t
  misc_feature (219)..(227): n is a, c, g, or t
  misc_feature (229)..(234): n is a, c, g, or t
  misc_feature (236)..(238): n is a, c, g, or t
  misc_feature (240)..(247): n is a, c, g, or t
  misc_feature (249)..(255): n is a, c, g, or t
  misc_feature (257)..(259): n is a, c, g, or t
  misc_feature (264)..(265): n is a, c, g, or t
  misc_feature (269)..(276): n is a, c, g, or t
  misc_feature (278)..(290): n is a, c, g, or t
  misc_feature (294)..(294): n is a, c, g, or t
  misc_feature (296)..(297): n is a, c, g, or t
  misc_feature (299)..(301): n is a, c, g, or t
  misc_feature (304)..(308): n is a, c, g, or t
  misc_feature (311)..(312): n is a, c, g, or t
  misc_feature (314)..(314): n is a, c, g, or t
  misc_feature (317)..(318): n is a, c, g, or t
  misc_feature (320)..(320): n is a, c, g, or t
  misc_feature (322)..(327): n is a, c, g, or t
  misc_feature (330)..(332): n is a, c, g, or t
  misc_feature (335)..(341): n is a, c, g, or t
  misc_feature (343)..(344): n is a, c, g, or t
  misc_feature (347)..(349): n is a, c, g, or t
  misc_feature (351)..(353): n is a, c, g, or t
  misc_feature (355)..(359): n is a, c, g, or t
  misc_feature (361)..(363): n is a, c, g, or t
  misc_feature (368)..(368): n is a, c, g, or t
  misc_feature (370)..(370): n is a, c, g, or t
  misc_feature (372)..(372): n is a, c, g, or t
  misc_feature (374)..(376): n is a, c, g, or t
  misc_feature (378)..(380): n is a, c, g, or t
  misc_feature (383)..(386): n is a, c, g, or t
  misc_feature (388)..(399): n is a, c, g, or t
  misc_feature (401)..(405): n is a, c, g, or t
  misc_feature (407)..(409): n is a, c, g, or t
  misc_feature (411)..(412): n is a, c, g, or t
  misc_feature (416)..(423): n is a, c, g, or t
  misc_feature (425)..(437): n is a, c, g, or t
  misc_feature (440)..(440): n is a, c, g, or t
  misc_feature (442)..(447): n is a, c, g, or t
  misc_feature (449)..(450): n is a, c, g, or t
  misc_feature (452)..(454): n is a, c, g, or t
  misc_feature (456)..(469): n is a, c, g, or t
  misc_feature (471)..(473): n is a, c, g, or t
  misc_feature (476)..(478): n is a, c, g, or t
  misc_feature (481)..(481): n is a, c, g, or t
  misc_feature (483)..(490): n is a, c, g, or t
  misc_feature (494)..(495): n is a, c, g, or t
  misc_feature (497)..(497): n is a, c, g, or t
  misc_feature (499)..(503): n is a, c, g, or t
  misc_feature (505)..(520): n is a, c, g, or t
  misc_feature (522)..(522): n is a, c, g, or t
  misc_feature (524)..(525): n is a, c, g, or t
  misc_feature (527)..(530): n is a, c, g, or t
  misc_feature (532)..(533): n is a, c, g, or t
  misc_feature (535)..(535): n is a, c, g, or t
  misc_feature (537)..(538): n is a, c, g, or t
  misc_feature (540)..(540): n is a, c, g, or t
  misc_feature (543)..(546): n is a, c, g, or t
  misc_feature (548)..(548): n is a, c, g, or t
  misc_feature (550)..(550): n is a, c, g, or t
  misc_feature (552)..(557): n is a, c, g, or t
  misc_feature (559)..(566): n is a, c, g, or t
  misc_feature (569)..(569): n is a, c, g, or t
  misc_feature (572)..(572): n is a, c, g, or t
  misc_feature (574)..(577): n is a, c, g, or t
  misc_feature (579)..(580): n is a, c, g, or t
  misc_feature (582)..(590): n is a, c, g, or t
  misc_feature (593)..(593): n is a, c, g, or t
  misc_feature (595)..(600): n is a, c, g, or t
  misc_feature (602)..(603): n is a, c, g, or t
  misc_feature (605)..(605): n is a, c, g, or t
  misc_feature (607)..(609): n is a, c, g, or t
  misc_feature (611)..(612): n is a, c, g, or t
  misc_feature (614)..(620): n is a, c, g, or t
  misc_feature (622)..(629): n is a, c, g, or t
  misc_feature (631)..(631): n is a, c, g, or t
  misc_feature (633)..(644): n is a, c, g, or t
  misc_feature (646)..(647): n is a, c, g, or t
  misc_feature (649)..(650): n is a, c, g, or t
  misc_feature (652)..(654): n is a, c, g, or t
  misc_feature (656)..(657): n is a, c, g, or t
  misc_feature (659)..(659): n is a, c, g, or t
  misc_feature (661)..(663): n is a, c, g, or t
  misc_feature (666)..(671): n is a, c, g, or t
  misc_feature (674)..(675): n is a, c, g, or t
  misc_feature (677)..(687): n is a, c, g, or t
  misc_feature (689)..(699): n is a, c, g, or t
  misc_feature (701)..(712): n is a, c, g, or t
  misc_feature (714)..(717): n is a, c, g, or t
  misc_feature (719)..(722): n is a, c, g, or t
  misc_feature (724)..(725): n is a, c, g, or t
  misc_feature (727)..(732): n is a, c, g, or t
  misc_feature (735)..(736): n is a, c, g, or t
  misc_feature (739)..(740): n is a, c, g, or t
  misc_feature (742)..(746): n is a, c, g, or t
  misc_feature (748)..(750): n is a, c, g, or t
  misc_feature (752)..(754): n is a, c, g, or t
  misc_feature (756)..(758): n is a, c, g, or t
  misc_feature (761)..(765): n is a, c, g, or t
  misc_feature (768)..(772): n is a, c, g, or t
  misc_feature (774)..(775): n is a, c, g, or t
  misc_feature (777)..(779): n is a, c, g, or t
  misc_feature (782)..(783): n is a, c, g, or t
  misc_feature (785)..(786): n is a, c, g, or t
  misc_feature (788)..(789): n is a, c, g, or t
  misc_feature (791)..(795): n is a, c, g, or t
  misc_feature (797)..(797): n is a, c, g, or t
  misc_feature (801)..(801): n is a, c, g, or t
  misc_feature (803)..(804): n is a, c, g, or t
  misc_feature (806)..(812): n is a, c, g, or t
  misc_feature (815)..(815): n is a, c, g, or t
  misc_feature (818)..(819): n is a, c, g, or t
  misc_feature (822)..(831): n is a, c, g, or t
  misc_feature (833)..(834): n is a, c, g, or t
  misc_feature (836)..(837): n is a, c, g, or t
  misc_feature (839)..(840): n is a, c, g, or t
  misc_feature (842)..(846): n is a, c, g, or t
  misc_feature (848)..(849): n is a, c, g, or t
  misc_feature (853)..(858): n is a, c, g, or t
  misc_feature (861)..(871): n is a, c, g, or t
  misc_feature (873)..(873): n is a, c, g, or t
  misc_feature (875)..(876): n is a, c, g, or t
  misc_feature (878)..(881): n is a, c, g, or t
  misc_feature (883)..(885): n is a, c, g, or t
  misc_feature (887)..(887): n is a, c, g, or t
  misc_feature (890)..(891): n is a, c, g, or t
  misc_feature (893)..(896): n is a, c, g, or t
  misc_feature (898)..(900): n is a, c, g, or t
  misc_feature (902)..(903): n is a, c, g, or t
  misc_feature (905)..(906): n is a, c, g, or t
  misc_feature (909)..(910): n is a, c, g, or t
  misc_feature (912)..(918): n is a, c, g, or t
  misc_feature (921)..(921): n is a, c, g, or t
  misc_feature (923)..(928): n is a, c, g, or t
  misc_feature (930)..(932): n is a, c, g, or t
  misc_feature (935)..(942): n is a, c, g, or t
  misc_feature (945)..(945): n is a, c, g, or t
  misc_feature (947)..(948): n is a, c, g, or t
  misc_feature (950)..(951): n is a, c, g, or t
  misc_feature (953)..(953): n is a, c, g, or t
  misc_feature (955)..(957): n is a, c, g, or t
  misc_feature (959)..(962): n is a, c, g, or t
  misc_feature (965)..(966): n is a, c, g, or t
  misc_feature (968)..(975): n is a, c, g, or t
  misc_feature (977)..(978): n is a, c, g, or t
  misc_feature (981)..(981): n is a, c, g, or t
  misc_feature (983)..(985): n is a, c, g, or t
  misc_feature (987)..(987): n is a, c, g, or t
  misc_feature (989)..(992): n is a, c, g, or t
  misc_feature (994)..(997): n is a, c, g, or t
  misc_feature (999)..(999): n is a, c, g, or t
  misc_feature (1001)..(1002): n is a, c, g, or t
  misc_feature (1004)..(1005): n is a, c, g, or t
  misc_feature (1007)..(1017): n is a, c, g, or t
  misc_feature (1019)..(1023): n is a, c, g, or t
  misc_feature (1025)..(1028): n is a, c, g, or t
  misc_feature (1030)..(1039): n is a, c, g, or t
  misc_feature (1041)..(1046): n is a, c, g, or t
  misc_feature (1049)..(1049): n is a, c, g, or t
  misc_feature (1051)..(1053): n is a, c, g, or t
  misc_feature (1055)..(1065): n is a, c, g, or t
  misc_feature (1067)..(1070): n is a, c, g, or t
  misc_feature (1072)..(1076): n is a, c, g, or t
  misc_feature (1079)..(1081): n is a, c, g, or t
  misc_feature (1083)..(1083): n is a, c, g, or t
  misc_feature (1085)..(1092): n is a, c, g, or t
  misc_feature (1095)..(1097): n is a, c, g, or t
  misc_feature (1099)..(1101): n is a, c, g, or t
  misc_feature (1103)..(1105): n is a, c, g, or t
  misc_feature (1107)..(1110): n is a, c, g, or t
  misc_feature (1112)..(1123): n is a, c, g, or t
  misc_feature (1125)..(1125): n is a, c, g, or t
  misc_feature (1127)..(1127): n is a, c, g, or t
  misc_feature (1129)..(1132): n is a, c, g, or t
  misc_feature (1134)..(1134): n is a, c, g, or t
  misc_feature (1137)..(1140): n is a, c, g, or t
  misc_feature (1142)..(1148): n is a, c, g, or t
  misc_feature (1150)..(1157): n is a, c, g, or t
  misc_feature (1159)..(1177): n is a, c, g, or t
  misc_feature (1179)..(1181): n is a, c, g, or t
  misc_feature (1187)..(1187): n is a, c, g, or t
  misc_feature (1189)..(1190): n is a, c, g, or t
  misc_feature (1194)..(1196): n is a, c, g, or t
  misc_feature (1198)..(1198): n is a, c, g, or t
  misc_feature (1200)..(1200): n is a, c, g, or t
  misc_feature (1202)..(1203): n is a, c, g, or t
  misc_feature (1206)..(1207): n is a, c, g, or t
  misc_feature (1209)..(1210): n is a, c, g, or t
  misc_feature (1212)..(1213): n is a, c, g, or t
  misc_feature (1215)..(1216): n is a, c, g, or t
  misc_feature (1218)..(1221): n is a, c, g, or t
  misc_feature (1224)..(1224): n is a, c, g, or t
  misc_feature (1226)..(1228): n is a, c, g, or t
  misc_feature (1231)..(1233): n is a, c, g, or t
  misc_feature (1235)..(1239): n is a, c, g, or t
  misc_feature (1242)..(1266): n is a, c, g, or t
  misc_feature (1268)..(1275): n is a, c, g, or t
  misc_feature (1277)..(1278): n is a, c, g, or t
  misc_feature (1280)..(1285): n is a, c, g, or t
  misc_feature (1287)..(1288): n is a, c, g, or t
  misc_feature (1290)..(1290): n is a, c, g, or t
  misc_feature (1292)..(1292): n is a, c, g, or t
  misc_feature (1294)..(1309): n is a, c, g, or t
  misc_feature (1311)..(1312): n is a, c, g, or t
  misc_feature (1315)..(1319): n is a, c, g, or t
  misc_feature (1322)..(1323): n is a, c, g, or t
  misc_feature (1325)..(1327): n is a, c, g, or t
  misc_feature (1329)..(1338): n is a, c, g, or t
  misc_feature (1342)..(1342): n is a, c, g, or t
  misc_feature (1345)..(1345): n is a, c, g, or t
  misc_feature (1348)..(1348): n is a, c, g, or t
  misc_feature (1350)..(1351): n is a, c, g, or t
  misc_feature (1353)..(1354): n is a, c, g, or t
  misc_feature (1356)..(1356): n is a, c, g, or t
  misc_feature (1359)..(1359): n is a, c, g, or t
  misc_feature (1361)..(1361): n is a, c, g, or t
  misc_feature (1364)..(1365): n is a, c, g, or t
  misc_feature (1367)..(1369): n is a, c, g, or t
  misc_feature (1371)..(1371): n is a, c, g, or t
  misc_feature (1373)..(1376): n is a, c, g, or t
  misc_feature (1378)..(1379): n is a, c, g, or t
  misc_feature (1381)..(1381): n is a, c, g, or t
  misc_feature (1383)..(1384): n is a, c, g, or t
  misc_feature (1386)..(1388): n is a, c, g, or t
  misc_feature (1390)..(1390): n is a, c, g, or t
  misc_feature (1393)..(1395): n is a, c, g, or t
  misc_feature (1397)..(1400): n is a, c, g, or t
  misc_feature (1404)..(1418): n is a, c, g, or t
  misc_feature (1420)..(1422): n is a, c, g, or t
  misc_feature (1424)..(1432): n is a, c, g, or t
  misc_feature (1435)..(1436): n is a, c, g, or t
  misc_feature (1439)..(1439): n is a, c, g, or t
  misc_feature (1442)..(1442): n is a, c, g, or t
  misc_feature (1444)..(1445): n is a, c, g, or t
  misc_feature (1447)..(1449): n is a, c, g, or t
  misc_feature (1452)..(1453): n is a, c, g, or t
  misc_feature (1455)..(1456): n is a, c, g, or t
  misc_feature (1458)..(1460): n is a, c, g, or t
  misc_feature (1462)..(1466): n is a, c, g, or t
  misc_feature (1470)..(1479): n is a, c, g, or t
  misc_feature (1484)..(1485): n is a, c, g, or t
  misc_feature (1487)..(1489): n is a, c, g, or t
  misc_feature (1492)..(1494): n is a, c, g, or t
  misc_feature (1496)..(1500): n is a, c, g, or t
  misc_feature (1502)..(1506): n is a, c, g, or t
  misc_feature (1508)..(1509): n is a, c, g, or t
  misc_feature (1511)..(1512): n is a, c, g, or t
  misc_feature (1515)..(1515): n is a, c, g, or t
  misc_feature (1517)..(1520): n is a, c, g, or t
  misc_feature (1523)..(1523): n is a, c, g, or t
  misc_feature (1528)..(1528): n is a, c, g, or t
  misc_feature (1530)..(1531): n is a, c, g, or t
  misc_feature (1539)..(1540): n is a, c, g, or t
  misc_feature (1817)..(1817): n is a, c, g, or t
  misc_feature (1822)..(1822): n is a, c, g, or t
  misc_feature (1843)..(1843): n is a, c, g, or t
  misc_feature (1854)..(1854): n is a, c, g, or t
  misc_feature (1864)..(1864): n is a, c, g, or t
  misc_feature (1990)..(1992): n is a, c, g, or t
  misc_feature (2820)..(2820): n is a, c, g, or t
  misc_feature (3460)..(3460): n is a, c, g, or t
  misc_feature (3930)..(3930): n is a, c, g, or t
aaannntncnncntnnnnnaaangnnnntncnnnnnnnnngnnnnannntnnngncnnnnnnncnaannanncnnntnnnncnnnnaanccnnnnnnccnnnnnncnannggnnnnnnnnnnnntnnnaaaannntnnnnnaannannnnnnnaannannnntngnnnnnnnannnnnnnngnntnnnnntncngnannannnnnngnnnnnnnnnaannnnnnnnntnnnnnncnnntnnnnnnnncnnnnnnntnnnaaaanncttnnnnnnnncnnnnnnnnnnnnntttnannannnaannnnnaanncnttnngntnnnnnnaannnaannnnnnnannccnnnannntnnnnntnnnaaaangnangnnntnnnaannnnannnnnnnnnnnngnnnnngnnnanngggnnnnnnnntnnnnnnnnnnnnnaangnnnnnngnntnnnannnnnnnnnnnnnnannnaannnttncnnnnnnnnaaanncntnnnnntnnnnnnnnnnnnnnnncntnngnnnnanngntnnanggnnnncntncnnnnnnannnnnnnnggnaangnnnntnntnnnnnnnnnccnannnnnncnngntnnntnngnnnnnnnannnnnnnngncnnnnnnnnnnnnannannannncnnantnnnaannnnnnttnngnnnnnnnnnnnannnnnnnnnnntnnnnnnnnnnnntnnnngnnnngnngnnnnnnaannaanngnnnnngnnngnnnannnccnnnnnaannnnntnncnnnttnngnngnngnnnnnantttngnngnnnnnnnttnccnnttnnnnnnnnnnanntnntnnannnnnannaaannnnnnttnnnnnnnnnnnancnnannnntnnncnaanntnnnnannngnnannttnnannnnnnnttngnnnnnnannnggnnnnnnnnccntnntnncnannntnnnnttnngnnnnnnnntnnaancnnncnannnncnnnncngnngnntnnnnnnnnnnngnnnnngnnnnannnnnnnnnnannnnnnaangnnngnnnnnnnnnnngnnnngnnnnnccnnnantnnnnnnnnttnnngnnngnnntnnnntnnnnnnnnnnnnangnannnntnccnnnncnnnnnnntnnnnnnnnannnnnnnnnnnnnnnnnnnannnaaaaangnnaaannngnangnnaannannanntnntnnnnttnannnttnnngnnnnnggnnnnnnnnnnnnnnnnnnnnnnnnnannnnnnnnanngnnnnnntnngnantnnnnnnnnnnnnnnnnannaannnnnaannannntnnnnnnnnnncccnaantanannanngnaantnggnntnnntncnnnntnngngnncnnnanttnnntnnnntttnnnnnnnnnnnnnnncnnnannnnnnnnnaannttnaangnnannnttnnanntnnnannnnnaaannnnnnnnnntcccnntnnnttnnngnnnnnannnnnannannaangnnnnttntcctntnngctttccnngtatacaataaaatacaaggtactaagagaacaactcagaacttgaatattacgaaatgataaagtaaatttacagatttaagaatataaggatgaattaagggataggaaatgatttctaaatagttttgtaacacatacattatcaagcaattagaaacaggctcttaaaagggcgtcttttacattgcaaaagggcgtcttttacacttcaaaagggcatcttttgcaattcaaaagagcaccttttagaaggcaaaagagcacctattaaaanccaanagagaatttgttttacaaaangaagttctaantcaccatacnatcattaagaaacagatttcgttttcatttgaatcgacttgattccagatgagagatcatcttctaaaagactcgcatcaggaataaaattctcaaagtatacagtataaaaaaagtctggcaggnnncctgccagactttttttctttatttctcatccccctattctactcgcttgtagtgcagcacctattgctgtacagtactcggaatacttaggaataataaaccttacatcataaatcttctccattactgggaaaagaagctcacattggggcaataatgtaagattaccaatgagaacaaagtccctgatattgctgtttaatgcacttaatatagttgcagaaccaatagattgtagcactaaacctatcaatcctaaagcaatatcttcacggctagcattaccttgggcatttgcaaaaagagaagcagttgcatccattggcaaaccaggcaaaggattagttgatatatccttaatctgaagattgatacgcgagatatcacctttcatagctaaagctataatctcttttatatcatctgtcttcaacaagaggcgggacaagccactaagcgtacctcccccaataccaataccaccaatatgccgtatctcattaccatcacaaagtactagagacgtacctgtacccatagagacaacgatcattcgttgtagctttgattcatattgggcacctaagccatctgcaagaaactcatcagcttttgacgtcggaagcccataaacgggtttatcaatatagtgagcaccgacccctgtaagcataacttgctctacatcagacagatcaatcctattatcatagagatactttccaaaagctccatatagagatgttatagggtctgtagccttgatacgcataggcttcacaacctttccatcccttattccaactattttcgtcgttgaaataccnacatctattcctatggctatcttcatataccttatatattattaggtcgcaaaggtacgaaaaagttgagagttaagaatagaagcaaacagtttttgcaaaaaaagacaaaaacatttctctattaagctgaaaatgagtatctttgcactccgttatgaagagagaataaagatataaacatcaataaagaacaaaacgaaatgacgaaagcagatatcattaatgagattgcgacatctactggcatcgccaagaaggacgtttcagctgtggttgaatcttttatggacgctatcaaaaacagcttattagacaaaaaagagaacgtatacctgcgcggatttggtagctttatcgtaaagcatcgtgcagaaaagactgctcgtaacatctcaaagaatacgactattacaattccagcacatgactttccaagctttaagcctgcaaagacattcatcgaggatatgaagaaataattaaatataaatacaataacaacttaaaacattaaaagctatgccaaacggtaagaagaaaaagggacacaagatggctacgcacaagcgtaaaaagagattaagaaagaacagacataagagcaagtaagcccccattaaggctgaaagaacttatnaacagactttcaaaacatgacggggcgtgtcatcgcagaaagcttctttccctggaagtgcgacgacaggttccgttttttattacctataagtatcgtttagtattactatctatggcagatagataggcttatatcaacagatagtacggctatcaataaccattagagaagctatctgatatttatattaaaagaagaagatgacaagcgaagtaattattgatgcccaaccgaaagagatttcgatagcactacttgaggacaaacgcctggtagaatatcagcgtgaaccaagggaggctagtttctcggttggaaacatctatgtggcaaagattaaaaagcttatgccagggcttaatgcctgtttcgtagatgtaggttatgagcgtgacgcctttcttcattatctcgacttaggaagtcaattcaactcctatgcaaagtatctgaaacaggttcagagngatcgcaagaaactttatcccatacaaaaagccagtcatcagcctgatctacagaaagatggtactgtcc

SEQ ID NO: 431 - DNA, 4000 bp, Escherichia coli
  misc_feature (167)..(167): n is a, c, g, or t
  misc_feature (212)..(213): n is a, c, g, or t
  misc_feature (310)..(310): n is a, c, g, or t
  misc_feature (321)..(321): n is a, c, g, or t
  misc_feature (569)..(569): n is a, c, g, or t
  misc_feature (587)..(587): n is a, c, g, or t
  misc_feature (613)..(614): n is a, c, g, or t
  misc_feature (3200)..(3200): n is a, c, g, or t
  misc_feature (3212)..(3212): n is a, c, g, or t
  misc_feature (3930)..(3930): n is a, c, g, or t
  misc_feature (3945)..(3945): n is a, c, g, or t
  misc_feature (3996)..(3996): n is a, c, g, or t
ttcgaccccgcgagagcatcgagtgcacccgtcgccttgttcgcgaggcgggaatcttcgccggcatctcttcgggtgcatcattggccggcgcgttgaaggtggcgagtgaatggcccagcgattcagagcaagaagcggtgatcgtgttcatcgtctgcgacggnggctggaagtatctttcgacgggcgcctacaccgacgacttgganncggccgaagcccaggcggaaaaaattatctatttttagccgtcagtctttggccgtcaacgaccggcgatcagcacgatcaagccgacgacgacganggttgcacaancgagccggcgacgatggtcgtcttctttgagatatttccagccggccaaggcggcgattacgacgctcaactcgcgcaatgtggcgacaaaaccgacgggtgccaaagaaaacgcgtagaccacgagcgagtagctgacgaaagacatcagcccgcccgaaacagaagacttccatgaggcgacccaaaacgggcgaagttcgcgggcacgggtgaaaagcgcccatgcggtgatcgcgaccgcgccnctgacgaaggtgctgaangcaaacgcgacggcgttcgagtttcnngccccgtatgcgtcgatgaccgaatagatcccgattgtcaaaccgacaccgagcgccggcgagaggttggtgatcggctgactggtggccagaaaccacagaccaaagatcacgattgcgatgccggccatgctcaaagtcgagaggtcgtcgttcaaaatgagcaagccaaaaatcgccgcgcataatgcgcctgatccgcgagcgatcggatatgtcaccgagaaatcatttttttcataggcgcgggccagcaacaaaacatatggcaggtggatgcacccgctgatcgacgaccaaagccacgcgatgttcggcgtgccgtcgaccagcgaccaaacggtcaaggtcgtcgtggcgattaccccggccgaaacataaaggccccacaacgccatgaatcgatcgcctttctgtttgacggcgatgttccaactcgcgtgcagtacggcagcgacaagcgccaaaccggtagcgacaagcaccaggcgagtttaaagcatcaagcggtttatccccggatgtcggcatcgggtcgaggccacggcgtagcgttgagtcgatgaatgcgagtggcgatcgtgcgatcggcatgttcgactcgggttttggcggcttgaccgtggcgagggccgtgatcgatctgatgcccgacgagaaactcatatatataggtgacacggcgcgctacccgtacggcccgaagccggccaaagatgtgcgcgggtatgcgatcgaattggccacgagtcttgtgcacgactttgatgtcaaggtgatcgtcgtcgcctgcaacaccgccgcttcggtggccctcgaagaattgcagcggtctctggccgtgccggtaatcggcgtcgtcgcacctggcgcaaaagccttgctcgggcaaaccagaaacaggcgagtcggcgtgattggcaccacgggcactatcgactcgggagcctacgacgcggcgataaaaagtgcggcgagcgaaactggcgagtcgatcgacttggtgacgatggcgtgccccggtttcgtcgagttcgtcgagcgcgacgaaacttccgggccggcagtcacagaacttgcgcaacgactgctgaccccgatgcgcgaggccgaagtcgacgcgttgctgttgggatgcacgcattatccgtatctgcgcgatgtgatcggtcaggtcatggggtctggagtgcggcttgttgatggtgccgtcgccacggcgatcgccgttcgccagatgctttctgatcgcaaacttctcagggtcgcctcgcgcgacgaagcggcgaccagagatttttattcatccggagatgccgcgcattttgccgcattgggtcgaagattcttgggccccgaactcacgacagccaaggcgtggccgatttgaaaccgaatagatttgtcgagatacgaaagacggcagaaacatgacacgaccagacggaagacaggccgacgaattgcgcaaactcggcttcgaacgcgacttcacggagatggcggctggctcggtgttggtttcgttcggcaagaccagggtgttgtgcacggcgtcgatcgacgaagatgtgcccaggtggatgaaaggcaagggcaaaggttgggtcaccgccgaatattcgatgttgccgggtgcgacgcccgagcgcgccgatcgtgaggcggcaaagggcaagcagggcggtcgaacgatagagatacaacgtctgatcggcaggtcgttgcgttcgtgttgcgacatggcgctgctgggtgaacgacaggtgatcgtcgactgtgatgtcttgcaagccgacggcggcacccgcaccgcgagcatttgtggcgcctacattgcgttgcacgacgccctgacacgtttgcaacagaacaatttgatcgcccagcatccgctgcactcgttgtgcgccgcggtcagcgtgggcatccacaacgggcgaccgatactcgacctgccctacatcgaagacagtgccgccgaggtcgacatgaatgtggtgatgttgcagccgcacgcgggcggcgaggcgaagttcgtcgaggtgcagggcaccgccgagggtgcggccttcagccaggacgaactggcgcaactcttgggtttggcgaaagccggattgcgcgagatcttcgcgatgcagacgaaactgttggccacaaaacctgcgtcgcgaccgcaggcgaaataatttgctgcgcgtagtttgcgcctcggcgaacccgcacaaggtcgccgaaatcgcagacctggtgcgcggtctggtcgacctggttgcgcgaccgatcgatttgcacgacgtggccgagaccgaatcgacgctcatcggcaacgcgcggctgaaggcgaccgcggtttgcgaggcgacgaatcaacccgccttggccgacgacaccgggctcgaagtcgacgcgttgcacggcgagcccggcgtgttcaccgcccgtttcgccggggcaaacgcgactgatgccgagaacagggccaaacttttgctcgcacttcatggcgagaagaatcgatcggcgcgttttcgaaccgtcgccttgttggcctggcccgacggtcgcgagatcgtctgccanggtgtctgcganggtttgatcgccgaaagcgaacagggcgagcgcggctttggttacgacccggtgtttattccggctttgggtgacggacgaaccttcgcccagatgagcgtcgcagaaaagcactcgttttcgcatcgcggcatggcgtttcgcgacttgctgcgtcgactgggcgaatcaccaaccgcgtaggtcgatcgaccaacggtcgatgatttcttctccgcgcacgagccacgcgttttcgtgcatcgccattgtcgggtcgatgtgcgcgggaaccacgcgcagtttgtcgccgacggaaacattgttcgtggtcgaatctttggcgggggcgagcgtcgtgtgttcatccgagcagaacagcacgtcgaagccggccacgctcgggttgccgtggtccatgcccaatgccttcaaaccgacgtcgacgaccagccacttctggctgatcgaaatgaccgtgcccaaaacaaaacacccttgttcgaacggcagacccagtcgcgcatagtgggtgtccatcaacgcgtaagagccggcctgcaattcgttgatgcccgtttcgtcgtgcaggtcgaaggtgccggtgccgccggctgaaattatttcgccgccgacggtctttgccgcatcgacgagcagatgcatcgactcggccacgagttttcttcgtttgtcgcgaccgtcgatcatcatcaggtgaccctcgtaacccatcacncctcgcacggtcaancctgcgtgacgcgccgcgtcggcgagtcggcccgcttgttcgggcgcgacnccac

SEQ ID NO: 432 - DNA, 4000 bp, Escherichia coli
  misc_feature (1985)..(1985): n is a, c, g, or t
  misc_feature (1989)..(1989): n is a, c, g, or t
  misc_feature (2002)..(2002): n is a, c, g, or t
attcttgggatcactggtaaaatcagcatcagtataggcaataatttcctcctgttctttacatgcaattttataatttttttgtataattcaattattttataatatttattaccatcttccaatctggttttcaaaatttcttgaagcttttccttcagcaaaagtgatgtctagatgagtgcatctagccagatagattaatgaacctacagcactcttaccaatagatttgttagtggtttcatttaattgaagtttccctgtacaaagagttttggttttcttatatttgtaatgttaaatttttgttaattaattgtgtttgataaatagtataatttgtttttttctttcaatattaatacctaaaatatagtttattttatcacattttgatactttaaagttatctttaattttattaatgatattataaatatgatattttatacatttaatcaatataccatcaacataaacatcatttatataaacaactctatctccctccattttcttaaaaattttaggttctaaaataagttgaatgaaattattatttttaaggaaattggtgaaatgttgattccactaacggccggattgtttaaaactgtacaaagatttattgagtagctagtattcttttctgaagttttttgacacctggaatgtagattttcttttccaaaggagcgttctaatagacagctttattatcaattccagatggaattttgaagctaaagaaataactaattttgaactatagagactaagagtttgatagtatgtgaaatcataattaataccttttgttttaggagaagcctctagcaacgtgacgagcttcgaattttaccatatttctttcacccgtccaatagaaaagggtttaacgtcacttgataaattcttcacaaaagtcatgacatcattgtcatggaaattttgtatttcagccttcatagcattctttcaaattcttttatactaacatgcaattgttttgcttgtatgtaataggaatatcaataatagtattactattaccattagaaaatttaaaagaacagacaatatatttacagttatttattcgttcaacattttcaagaattaattttgaatttttaccattttcttgttcaataggattagctaaccttttttattaatataattaaatatattatagttaacactttcatcataataaggtgtttcattttatgtaatactgttatggcttgtttttaatattacttattctttcagtatcgaaagtataattttatgaaatataattgtcgttatatttcattatactttttaggtttgctgttttaacctcacatctttaatgcagaagaagtttgttcttcaaacacaacttcattatccaaattaatagtataattaaatttgtccataatgatatagcaatgtgattcattgttaaaacctaataatacgcctggaatacccttagtaatgaatttaactcttttctgagaatagtctttgtagtacgcaatacatccaaaaactttcagatatttacgatcaacactctttcaagagaatatttcaattaaaattctaaaatttatacctttaagaggtacgatattatataaaatgttgtctatttgtgcccattctgatgaagttcttatgctgcttgcaatgatatagttaaaacgttcaaccaatccgaggggaggaagttttaacaattcaatatattttgtcgattttcatccattcctaaaattagaaccgtatttttcccaaattaaatacaaaaatttgcatccatctaatagactttatggtattgttgttcattccggatttagtgctcaatctggccattatattatatgtaatagaagaaaaataggtgactgattctatgttaatgataagagtatcagactatctgattaggatgaaataaaaaaaaaaaaaaaagtgtnattnatatttattattntatgaaaaaataaaataaagaaaatcaattataaactcttaataataatatatattattttttttccttatatttggagtaagtgatatttaatatcaaaattttatcgaatttatatgcaataattatttcaattattgtatcaagattatgtaattaaatttatttattaatatttattattaaaaaatttaatttataaactatgtgataaattttatattataaaaagtatttatattttttcttattcataaatttacttatttattaatttattaaaaaataatttaaattttatttaataaattaatgagatgattgtcataaataaataatattaataattataataattttaataataaccaaataataatataaaacagatacaaaaattaaaaaaaaaaaaaaaaaaattaattatagaaaacatttcatttatttgccatctaattccattaaaacttttctagcagtttcctttggagcatcataaatacctaattttttttctaattcataacgttttatcatttcttcatcttgactaaaagaatgttttttctttggttttgaagtcaatttagcttttctttgttttgtacgacaatcaataattaaaccccaaagcttcaaataaaaaagttttgctcttttctctgttatatttttcgaaagaaggcatcgtcttataaattccatttctggaatattacataattgtacaccattttctttgtttggtactaaaaattctggattaatagccccatttgatgctttttctatccattgcacaacatgtttatattcccaacttgatggatcttttggatcatattctttctttttcaatggatcataactgcttttttgtgtaacttttaaggatgatgcataacgaatggtatttaaagtatgagaatagtctatacagtttgatgatacatttgcaataaaaatagttgtgcaaggacgtgtgcatgattcaatatcaaatgtttcttttaataatgttgttattttgctatttctaaaaggtatatgaatatgcttcctcagtcccatagttgatagagttcttgctctaatacattcttttaacgttaataaagaactattgatttcctttgtttcttttagtctttctttgtcatgaaattttgaatctatatttttataatacaaaaatttaatacaatcaaatttttacttcataaaaatgataaattacaaaaataattaaataaaaattaacaaacctgcatgtctttcagaacccgctaaatccactaaatatataataccatcatttgcttgattaataacagtattatgaattctaatttggcaaattgcatgacttcttgatgaagtatcattcttcaacgtagcatgtgtttttctatgagaaaatccaatattaatatatttcaataaatcgtcagaagttaagcaatcaaattcttgtacaccttttatagtcatatttctaaatttatcttcaagaataaatatttcttctttattatttaataaatcataacatcgattaccaagaatttcaaaaaatgaaacttttatttcaaatggcctattattatatgtttctaaagtatttagttgcatgtcattaataattctatccatctttttaaatagatccactgctaaatattcttcaataccagtaattgtaaatgtcttaattttatttaattttcaatttaatatagtaaatttatataaaataaagtttaaaataaaatattttaattattattattattattattattatattattattattattattttattattattatttttagtatacattttattatatactattattattaattacaaattactcttaataattattttttattaattattcgactatttattattaattattgttattattattattattattattattataaattatttctaaaaagtacctttcccgaaccagtt

SEQ ID NO: 433 - DNA, 4000 bp, Escherichia coli
  misc_feature (1959)..(1972): n is a, c, g, or t
  misc_feature (1974)..(1986): n is a, c, g, or t
  misc_feature (1988)..(1988): n is a, c, g, or t
  misc_feature (2036)..(2065): n is a, c, g, or t
  misc_feature (2113)..(2139): n is a, c, g, or t
  misc_feature (2141)..(2142): n is a, c, g, or t
  misc_feature (2190)..(2205): n is a, c, g, or t
  misc_feature (2207)..(2208): n is a, c, g, or t
  misc_feature (2210)..(2212): n is a, c, g, or t
  misc_feature (2214)..(2219): n is a, c, g, or t
  misc_feature (2267)..(2286): n is a, c, g, or t
  misc_feature (2288)..(2296): n is a, c, g, or t
  misc_feature (2344)..(2345): n is a, c, g, or t
  misc_feature (2347)..(2372): n is a, c, g, or t
  misc_feature (2421)..(2440): n is a, c, g, or t
  misc_feature (2442)..(2449): n is a, c, g, or t
  misc_feature (2451)..(2453): n is a, c, g, or t
  misc_feature (2461)..(2461): n is a, c, g, or t
  misc_feature (2464)..(2466): n is a, c, g, or t
  misc_feature (2470)..(2470): n is a, c, g, or t
  misc_feature (2473)..(2475): n is a, c, g, or t
  misc_feature (2480)..(2481): n is a, c, g, or t
  misc_feature (2485)..(2486): n is a, c, g, or t
  misc_feature (2490)..(2493): n is a, c, g, or t
  misc_feature (2497)..(2517): n is a, c, g, or t
  misc_feature (2519)..(2528): n is a, c, g, or t
  misc_feature (2530)..(2530): n is a, c, g, or t
  misc_feature (2538)..(2538): n is a, c, g, or t
  misc_feature (2542)..(2543): n is a, c, g, or t
  misc_feature (2547)..(2547): n is a, c, g, or t
  misc_feature (2550)..(2552): n is a, c, g, or t
  misc_feature (2557)..(2558): n is a, c, g, or t
  misc_feature (2562)..(2563): n is a, c, g, or t
  misc_feature (2567)..(2567): n is a, c, g, or t
  misc_feature (2570)..(2570): n is a, c, g, or t
  misc_feature (2573)..(2575): n is a, c, g, or t
  misc_feature (2577)..(2579): n is a, c, g, or t
  misc_feature (2581)..(2606): n is a, c, g, or t
  misc_feature (2610)..(2610): n is a, c, g, or t
  misc_feature (2614)..(2615): n is a, c, g, or t
  misc_feature (2617)..(2620): n is a, c, g, or t
  misc_feature (2623)..(2623): n is a, c, g, or t
  misc_feature (2626)..(2629): n is a, c, g, or t
  misc_feature (2633)..(2634): n is a, c, g, or t
  misc_feature (2638)..(2639): n is a, c, g, or t
  misc_feature (2643)..(2646): n is a, c, g, or t
  misc_feature (2649)..(2658): n is a, c, g, or t
  misc_feature (2660)..(2676): n is a, c, g, or t
  misc_feature (2678)..(2683): n is a, c, g, or t
  misc_feature (2688)..(2688): n is a, c, g, or t
  misc_feature (2690)..(2691): n is a, c, g, or t
  misc_feature (2693)..(2695): n is a, c, g, or t
  misc_feature (2700)..(2700): n is a, c, g, or t
  misc_feature (2702)..(2705): n is a, c, g, or t
  misc_feature (2710)..(2711): n is a, c, g, or t
  misc_feature (2715)..(2716): n is a, c, g, or t
  misc_feature (2720)..(2722): n is a, c, g, or t
  misc_feature (2726)..(2744): n is a, c, g, or t
  misc_feature (2746)..(2759): n is a, c, g, or t
  misc_feature (2763)..(2763): n is a, c, g, or t
  misc_feature (2765)..(2765): n is a, c, g, or t
  misc_feature (2767)..(2768): n is a, c, g, or t
  misc_feature (2770)..(2773): n is a, c, g, or t
  misc_feature (2777)..(2777): n is a, c, g, or t
  misc_feature (2779)..(2782): n is a, c, g, or t
  misc_feature (2786)..(2788): n is a, c, g, or t
  misc_feature (2791)..(2793): n is a, c, g, or t
  misc_feature (2796)..(2800): n is a, c, g, or t
  misc_feature (2802)..(2815): n is a, c, g, or t
  misc_feature (2817)..(2817): n is a, c, g, or t
  misc_feature (2819)..(2837): n is a, c, g, or t
  misc_feature (2840)..(2840): n is a, c, g, or t
  misc_feature (2842)..(2842): n is a, c, g, or t
  misc_feature (2844)..(2845): n is a, c, g, or t
  misc_feature (2847)..(2850): n is a, c, g, or t
  misc_feature (2853)..(2854): n is a, c, g, or t
  misc_feature (2856)..(2858): n is a, c, g, or t
  misc_feature (2863)..(2865): n is a, c, g, or t
  misc_feature (2868)..(2869): n is a, c, g, or t
  misc_feature (2873)..(2876): n is a, c, g, or t
  misc_feature (2879)..(2882): n is a, c, g, or t
  misc_feature (2884)..(2895): n is a, c, g, or t
  misc_feature (2897)..(2913): n is a, c, g, or t
  misc_feature (2917)..(2927): n is a, c, g, or t
  misc_feature (2930)..(2935): n is a, c, g, or t
  misc_feature (2940)..(2941): n is a, c, g, or t
  misc_feature (2945)..(2946): n is a, c, g, or t
  misc_feature (2949)..(2953): n is a, c, g, or t
  misc_feature (2956)..(2976): n is a, c, g, or t
  misc_feature (2978)..(2986): n is a, c, g, or t
  misc_feature (2988)..(2989): n is a, c, g, or t
  misc_feature (2991)..(3013): n is a, c, g, or t
  misc_feature (3015)..(3016): n is a, c, g, or t
  misc_feature (3018)..(3021): n is a, c, g, or t
  misc_feature (3023)..(3023): n is a, c, g, or t
  misc_feature (3025)..(3026): n is a, c, g, or t
  misc_feature (3028)..(3029): n is a, c, g, or t
  misc_feature (3031)..(3068): n is a, c, g, or t
  misc_feature (3070)..(3090): n is a, c, g, or t
  misc_feature (3092)..(3100): n is a, c, g, or t
  misc_feature (3102)..(3149): n is a, c, g, or t
  misc_feature (3151)..(3152): n is a, c, g, or t
  misc_feature (3154)..(3165): n is a, c, g, or t
  misc_feature (3167)..(3172): n is a, c, g, or t
  misc_feature (3175)..(3175): n is a, c, g, or t
  misc_feature (3178)..(3189): n is a, c, g, or t
  misc_feature (3191)..(3202): n is a, c, g, or t
  misc_feature (3204)..(3249): n is a, c, g, or t
  misc_feature (3251)..(3288): n is a, c, g, or t
  misc_feature (3290)..(3290): n is a, c, g, or t
  misc_feature (3292)..(3310): n is a, c, g, or t
  misc_feature (3312)..(3331): n is a, c, g, or t
  misc_feature (3333)..(3341): n is a, c, g, or t
  misc_feature (3343)..(3357): n is a, c, g, or t
  misc_feature (3359)..(3362): n is a, c, g, or t
  misc_feature (3364)..(3462): n is a, c, g, or t
  misc_feature (3464)..(3495): n is a, c, g, or t
  misc_feature (3497)..(3556): n is a, c, g, or t
  misc_feature (3558)..(3607): n is a, c, g, or t
  misc_feature (3609)..(3619): n is a, c, g, or t
  misc_feature (3621)..(3651): n is a, c, g, or t
  misc_feature (3653)..(3653): n is a, c, g, or t
  misc_feature (3655)..(3680): n is a, c, g, or t
  misc_feature (3682)..(3698): n is a, c, g, or t
  misc_feature (3700)..(3701): n is a, c, g, or t
  misc_feature (3704)..(3711): n is a, c, g, or t
  misc_feature (3713)..(3722): n is a, c, g, or t
  misc_feature (3725)..(3727): n is a, c, g, or t
  misc_feature (3729)..(3732): n is a, c, g, or t
  misc_feature (3734)..(3744): n is a, c, g, or t
  misc_feature (3747)..(3775): n is a, c, g, or t
  misc_feature (3777)..(3778): n is a, c, g, or t
  misc_feature (3781)..(3787): n is a, c, g, or t
  misc_feature (3789)..(3815): n is a, c, g, or t
  misc_feature (3817)..(3851): n is a, c, g, or t
  misc_feature (3853)..(3857): n is a, c, g, or t
  misc_feature (3859)..(3863): n is a, c, g, or t
  misc_feature (3865)..(3873): n is a, c, g, or t
  misc_feature (3875)..(3878): n is a, c, g, or t
  misc_feature (3880)..(3882): n is a, c, g, or t
  misc_feature (3884)..(3927): n is a, c, g, or t
  misc_feature (3929)..(3952): n is a, c, g, or t
  misc_feature (3954)..(3963): n is a, c, g, or t
  misc_feature (3965)..(3967): n is a, c, g, or t
  misc_feature (3969)..(3986): n is a, c, g, or t
  misc_feature (3988)..(4000): n is a, c, g, or t
gacgaggtggttgtccccttctttgaggctgtaacacgggctaatttaggacttcctattattgataaggattacagaaaaagtgaaggttggcaatttttgtttagcatgaagcagaatgaatatttcgtgttcccgaatgaaaagacaggcttcaatccgaaggaggtggatttgttgaatccggataattatgcaatgattagtccgaatttatttagggtgcagactatgtcaaaagttatgtatggaaataatgttgttcgagattataaatttagacatcatttggaaacaacagtgaaagatatgaaagagttgaaagatattgcttataaacaatataaaacactttcttttggtaatagtgttgtcaagatccgaattaaccacattggacaaatagtatcagtgggagaatattaatagtatctattagaaattgaaataaatagggtgtatgctattctcaaaaaggttgtaccctttttagaaacagacttttatactgattaatagtaatttaaaatctaactgcttatgatcaagaaaaccctttattttggaaaccccgtttatctgtctctgaaaaatgctcagttgatgataaaattaccggaggtagtcaggaatgatacgttacctgaaagtttcaaacgaacttcagaagtgacgaaacccattgaggatattggagttgtggtactggatcacaagcagatcaccatctcttcgggcgtgttggaagctttacttgaaaataattgtgctgtcattacatgtaacagtaaaagtatgccggttggtttgatgcttcctctgtatgggaacacgacgcaaaacgaaagattccggcaacagttggatgcctctctaccgttaaagaaacagctttggcagcagaccataaagacgaagattgaaaatcaggcagccgtattgaaagaatgttctggcgcagaagtgaaatgtatgtacgcatgggcttcggatgtgaaaagcggagatacgagtaacctggaagcccgagcggctgcttattattggaagaatttgttttggatagaaggtttcacaagagacagggagggcattccgcctaacaatttgttgaattatggatatgctattctgcgggcggttgttgctcgtagcttggtggcaagtgggcttttgcctactttaggaatccaccatcataatcgttataatgcttattgcttggcagatgacatcatggagccttatcgtccgtatgtggatcaattggtctgtggtatcataaagcagggagtggattatgcggaactaacgagagagttgaaagcgcagctgcttactattcctgtgctagaaacttatatgtcaggaaaacgtagtccgttgatggtggctgtcgggcaaactacggcttctctgtataagtgctttagtggcgaattgcgtagaatctcctatccggaaatgtaatatggatcggtttagcgaatatcgtgttatgtgggtacttgtgttgtttgatttgcctaccgagacgaagaaggagaaaaaggcgtatgtggatttcaggaaaaatctacaaagagatggatttacgatgtttcagttttctatttatgtccgccattgtgctagtagcgagaatgcggccgtacatgtaaaaagagttaaatcttttcttccggagcatgggaatgtcggaatcatgtgtattacggataagcagtttgggaatattgaacttttttatggaaagaaaacggtggaagtgaatactcctggacagcaattggagttgttctaaaagaaaaatcccgctgtcaagcgggatttttaatggaaacaatatctgttttttttattctgatgtgctttgtaatccattgattaatagtttttaatagataatatgctgtttccaatggctcaaagttactaaaatgaaagcaaatcacaacnnnnnnnnnnnnnntnnnnnnnnnnnnnangctgtttccaatggctcaaagttactaaaatgaaagcaaatcacaacnnnnnnnnnnnnnnnnnnnnnnnnnnnnnngctgtttccaatggctcaaagttactaaaatgaaagcaaatcacaacnnnnnnnnnnnnnnnnnnnnnnnnnnngnngctgtttccaatggctcaaagttactaaaatgaaagcaaatcacaacnnnnnnnnnnnnnnnntnnannnannnnnngctgtttccaatggctcaaagttactaaaatgaaagcaaatcacaacnnnnnnnnnnnnnnnnnnnnannnnnnnnngctgtttccaatggctcaaagttactaaaatgaaagcaaatcacaacnntnnnnnnnnnnnnnnnnnnnnnnnnnngctgtttccaatggctcaaagttactaaaatgaaagcaaatcacaaccnnnnnnnnnnnnnnnnnnnnannnnnnnngnnntttccaanggnnnaaanttnnnaaaannaaannaaannnnaacnnnnnnnnnnnnnnnnnnnnntnnnnnnnnnntntttccaanggcnnaaanttnnnaaaannaaannaaancanaannnannntnnnnnnnnnnnnnnnnnnnnnnnnnntttncaanngnnnnaanttnnnnaaannaaannaaannnnaannnnnnnnnncnnnnnnnnnnnnnnnnntnnnnnntttcnanngnnncaaantnnnnaaaannaaannaaannncaannnnnnnnnnnnnnnnnnnannnnnnnnnnnnnntttncnanngnnnnaaantnnnnaaannnaannnaannnnnannnnnnnnnnnnnntnannnnnnnnnnnnnnnnnnnttncnanngnnnnaanntnnnaaaannnaannaaannnnaannnnannnnnnnnnnnnannnnnnnnnnnnnnnnntttnnnnnnnnnnnaannnnnnaaaannaaannaannnnnaannnnnnnnnnnnnnnnnnnnnannnnnnnnntnntnnnnnnnnnnnnnnnnnnnnnnnannannnnanannannannnnnnnnnnnnnnnnnnnnnnnnnnnnnnnnnnnnnntnnnnnnnnnnnnnnnnnnnnnannnnnnnnnannnnnnnnnnnnnnnnnnnnnnnnnnnnnnnnnnnnnnnnnnnnnnnntnngnnnnnnnnnnnnannnnnnaanaannnnnnnnnnnntnnnnnnnnnnnnannnnnnnnnnnnnnnnnnnnnnnnnnnnnnnnnnnnnnnnnnnnnnannnnnnnnnnnnnnnnnnnnnnnnnnnnnnnnnnnnnntntnnnnnnnnnnnnnnnnnnntnnnnnnnnnnnnnnnnnnnnannnnnnnnngnnnnnnnnnnnnnnntnnnntnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntnnnnnnnnnnnnnnnnnnnnnnnnnnnnnnnnannnnnnnnnnnnnnnnnnnnnnnnnnnnnnnnnnnnnnnnnnnnnnnnnnnnnnnnnnnnannnnnnnnnnnnnnnnnnnnnnnnnnnnnnnnnnnnnnnnnnnnnnnnnntnnnnnnnnnnntnnnnnnnnnnnnnnnnnnnnnnnnnnnnnnntntnnnnnnnnnnnnnnnnnnnnnnnnnntnnnnnnnnnnnnnnnnntnnttnnnnnnnnannnnnnnnnnttnnntnnnntnnnnnnnnnnngtnnnnnnnnnnnnnnnnnnnnnnnnnnnnntnntgnnnnnnntnnnnnnnnnnnnnnnnnnnnnnnnnnntnnnnnnnnnnnnnnnnnnnnnnnnnnnnnnnnnnntnnnnntnnnnnannnnnnnnntnnnntnnnannnnnnnnnnnnnnnnnnnnnnnnnnnnnnnnnnnnnnnnnnnntnnnnnnnnnnnnnnnnnnnnnnnntnnnnnnnnnnannntnnnnnnnnnnnnnnnnnntnnnnnnnnnnnnn

SEQ ID NO: 434 - DNA, 4000 bp, Escherichia coli
  misc_feature (651)..(651): n is a, c, g, or t
caaactcgaatacacaggctatggatacgttctcgtcagcgtcgtcaatgacaacgagtcagttcatggaacaggctcaatatacttcagcgatagaggctgagctgtcgaaaagcattgtgcagatttcatcgatacaatcagctcgtgttcacctcgctgcacctaggcagagctcttatgtgcgcaaccgcgagccagctaaagcctcagtcgtcgtggttgctcaccccggtagatctgttacccaggctcaagtgcaagctgtggtcagccttgtcgcttctagtgtgccttacttgtcgatcgaagatgtttcggttgtggatcaacaaggcagtttattgaccaacgctgtgtctgctggtcttgccatcgccgacgagcaagccgaatttaagcgttcgatagaaacagcatacaaaaataaaatagtcgatcttctgacacctatttacggccgcgacaatatccagtctgatgtagacgtagtaatggatttttccgaattcgaggcaacaaacgaaattttcgatcgtgacggctctggccctaaagcggtatctgagatacttgtcctcgatacaagctcgaatacacctgcgtctggtgtgcctggtgcgcagtcaaatatcgcgccgaatgacactntcctcaccgacggagacggaatgcaaggtggtgctgcgggtttgacaggtgtgcgtagcagtcaaaccacacgtaattatgagatagatcgaacgattcaatatgagaagaaaccaacgggtataatcacacgaatgtctgtcgcagtagtcatcaacgaagaggcttttggtatcaaagcaagcggcgaagacggagaagaagctggcgtaacagccgacactatagatacctcgaggatacaaaatcttgtggctagcgctgtaggctttgatcaagctcgaggtgattctgttgctgttttggtctcaactttcagagccgaagagctaatcgaaaatccgatgaaatggtatgagaatccaatgattttcggcttcgcaaagatgggccttatcgcattctcattcgcagtagtggtcgtctttgttgtccagccgctcattaaatcgtttgctggaccaccgccaccaccgcctgcaagtgttgaggacttaatgctattagatgagacgatttcaaaagaagatgttgaagatctagaactcgaaggttacgagacgcttgaacagatcaaggcgaaactcaaacctaagaaatcttcaatctcagctgacatgctagatacggcaaactcttatgacgacaaagtcgcgttggtgagaatgttagttggtgaagactctggtcgagtagcaaaagtgttaaagaagttggttgcaacgaccacaacaggctaacgactatactcgaaatttattatgaaccgccatagttaatatggcgctgttaatagaaaggaacgtgatcatggctgaagctgaagatgccaaagaagaagcgcgaaaactaagagattcgatgctcagcgaagaggctcgcaatcaattacaaatattaaccggaacgcagagagcagcggttatattgttattggtcggagaagaacaggcagccgacatcatctcgtttatgtctcctcgtgaagttcaagcactcggcgctaacatggtggctgtagcagaactgtctcaagaggcagtcaacgtggtgttggacgatttcatcacaactattaagagtcagacaaatcttggtcttggctctgacgagtacgtaagatcggtgtttaagaaagcgttgggtgaagacaaagccgcgactgtacttggccgaataatgccgacttcttcaagcaaagggcttgaaatacttaagtggatggacgctcgttcaataggcgacatggttatcgaagaacatccacaggttattgcgatcattctatcggtactcgaatttgatattgcagcagatgttcttaaatatattccggaagatattcgtgccgaagtcattcaaagaatcgcttcactcgaaactatccatccgagcgcgatggccgaactcgagcgagtaatgatgaagcagtttacgagttctagcgcgaaatcttcgagttttggcggcgtaaaaactgctgcgaaaattatgaacttcacgaagaccgacatggagtcggcgataatctccggtgtgacgaatcttgatgaagagttggcactgaaaattcaagacaatatgtttacattcgaaaacctatctggccttgacaaccgaagtattcaaactttaatgcgttcgatcgaaaccgacttattgatggtcgcactgaaagcgtgtgatgaacttacccgagagaagttcctagacaatatgtcacagcgagcgaaactcatgttcctcgatgagatggaagcgaaaggtccggtgcgtatgacagatgtagaagatgcgcagaaagatattctccgcatagcgcgtagattgtcagacgcaggcgatatcgtgttagcaggtagaggtgatgattttgtctagtcgacatagccctgacaattctgtcgaattttcggcatggctagcgccgaaaattgaaagtgatttggtttttgaaccaggttttgatatcgcctctggctccgatggcgcacataaagttgataacatagagacttcgagcgagcccggcgagtttgttgtatggcggccaggtatggttgacgaaggtctcttactccagaccgaagcgctaactgcagaaagcaccatcgaagaaatcgagaatactgaaagcggagagagtgaaccttcagcccaatatactcagttagagctacaggaatacggagagaatcaggtccagctcgcgcttgcacaagtgcgagctgatgaagcagccgtgctcagcgggacaaaattacgcttagaggcgttaatcgcgacgataagcgagcagcgtgttgattcgacttcgttttacgatccgctaaaaaaactcttagtaaaaagtgtcgaggccgttctgatgacgccgctcgttgagagtaaagcgtcaatagagtcagtacttgctcgattactcaaagaggtagattcagaaaatgaaggtgaacctgcagggatgcgtctttatttgaaccctgctgatgtagcgctgctcgaagcagagcatatagccgttcgagatgatattaaaatcctcagcgatccgaggctttcgcaaggctctgtgcgggcgttaatgcaagattcaatcatcgaagacttaagtgaaatacgcattcagcaaatcactcaacaactattgagtggattagataagaaagcagacgagacccagctagtcgatagtgacaccactattactgaaacatcgctcgagcaggcttcggatgaagcgttgctcggtgaactcgactcatgaatgacgagaatagattcgccgccgaattggaaaagcttggtgcaaagagtttttctacacgtacagagcgatttggtcgcgtaacgagagtggtcggacttaccgtcgaggcgacaggcattaccgcagagatcggcgctcagtgtgtgattgaaacaagcagagatgagccgcctattgaagcggaagtcgttggtttcgatggaaagcacctctacctaatgcccatccactatctcgaagggataaaagccggcagccttgttcgattcaagcaagcacaatcattagtcggtgttggcgagagtatgcttggccgcgtgataaatggtttaggcgagccgattgatggcaagggatcgatttccttcgatgctcaggttgcgctcgatgctagagcggttaatccgatgcaaagaggcgctgtaaaagacacgcttgatactggcataaaagccattaacggctgccttacttttggtaaagggcaacgaatgggggtgatcgcgggttcaggtgttggtaagagtgttctaatgggcatgcttactagaaatacggccgccgatgttgttgtgatag

SEQ ID NO: 435 - DNA, 4000 bp, Escherichia coli
  misc_feature (3765)..(3766): n is a, c, g, or t
  misc_feature (3834)..(3834): n is a, c, g, or t
  misc_feature (3843)..(3843): n is a, c, g, or t
  misc_feature (3849)..(3849): n is a, c, g, or t
atctgatcatggatttatcattcatgatgatgttcatttactcgatgaaccaggtcaaatcgaattatttaacacgtacaataagtgcaaagactctaaacaaaatatgttggtaacagggctttattctccccgccaaatgaaattaagggatgacttagcaacaagacttgcttggggcgtcacttatgaagtaataggtctgtctgatgaagaaaaaaaattggcacttttgaaacatgctgaagagagaggcatgaagcttaacatggacattattgattattgcctaaaatatctaaaaagggatatgccaaatttattttctatactagaagctttagataaatggtctttaacttacaaaagacctatcacacttccattacttaaagagattatagaagctaataagatctagcttattgacgaataaggtaatcgaaagcaccaagagaagctcttgctccctcccccatcgcaataataatttgcttataaggtacagttgttacatcacctgcagcaaacaaacctggcaatgaagactgattgtgattatctactataatttcaccaaatcttgagaggtctacaatgtttttaacaaaatccgtatttggcaataatccgatctgaataaaaataccctcgagctcaatcgttttcttttcatttgatttacgatctaaataaatcatgccacttactttatctgtaccaatcacttcggtagtttgtgcatctaaaatgacatcgacattggataagctataaagtcttttctgtaaaatatgatcagccttaagttcagatgcaaattcaaaaagggtgacatgtcctacaatatttgcaagatcaattgcagcttcaacaccagaatttcctcctcctataactgcaacatgtttacctttgaatagagggccgtcacagtgagggcaatatgcgacacccttacctttaaattctttttcaccagggacatttaattctctccatcttgcacctgttgcaacaatcactgatttacttttaagttttccaccattttcaagttctatttcaaataatgaatttaaatcatttttttgaacactttttgcacgttgcaaattcataatatcaacttcatattcttttacgtgctcttcaagtgctgtaactaattttggtccctcagttgcttttacagaaataaaattttctatgcctaaagtatccatcacttggccgccaaatcgttcggcaataacacctgtgcgtatgccttttcgagcactataaattgcagctgatgcccctgctggtcctccaccaattactaaaacatcataagtctcttttttagatattttttcagcttcttttagacttgcacttgaatcaattttattgactatttcatcaagttccattcgaccctgtccaaagggctttccattaagataaatagttggtacagccataatctgcttatcttcaacttctttttggaacaatgcgccatcaatcattacatgcgaaatatttggattaatgatagacattacatttaatgcctgcacaacatccggacaattgtggcaacttagtgaaatataagtttcgaaatgaaacttatctttaatatttttaatttgttctattttttcggcatctatttttacagggtacccactagcttgaagaagtgctaatacaaaagatgtaaattcgtgtcctgatggaatacctgcaaaagtgatacctgtaatttctttttctctattaatttcaaacgaaggaattctttttgaaacatccgcttctttgcttaaagtaattttttctgacaaagatgcgacttcctctagcatctctatcatttcgttagatgaggaattttcatcaacataagctacaagcttgattggattcacaagcctagtcatatattcttgaagttgatttttaattgctaaatctagagccattatatttccttgaccatttatctcgaaatgaaacccccaggccaatatgtggcctgggattcattttgtatttagatcttacctacgaggtctaatgatggagcaattgttttagctccttcttgccattttgctgggcaaacttgacctggattgttagctacgtattgtgcagcttttaatttacgcaatgtttctttcacatctcgtgcaattgcattgtcatgaacttccattgttttgatttcaccttttggattaataataaaagtaccgcgcaatgctaaaccttcttcatcaatatgcacttcaaatgctcgtgttaattgatgtgtaggatcaccaattaatggaaattttgccttgctcactgctggtgaagtttcatgccagactttatgcgaaaaatgtgtatcagttgtaacgatataaacttccgcaccagctttttgaaattctgcataatgatctgcagcatcttcaacttctgttggacagttaaatgtaaatgccgctggcataaaaatcactactgaccattttcctttaagatttgcttctgtaacgtcaatgaacttgccattgtgaaatgctgttgctttaaacggttttacttcagtattgactaatgaagacatcgttttctccttttttggttggtttaaaaatgatgattataggtaagtcattttaatatgtataatcaattgttattatatttatgatttattttacttatcatttaatatgacaaaaaataaagctaaatttaataaaaatcaggggttattttttatctttgacgtcttcgagactattctcaaatttcaattgctttaaacgagactccacaatcgatttttgataaaaattaccgtctttagatttaaccgcaaattccatctgctcaattgctctcggcaaattaaatttacggtagtatgcttcagattgggcttgatattgaagtaattctttaccttgttttgcataagctctagaaagtaactcataaaaataactatcatctggataaatattcaatttgtcattaataagtttgatcgatctctcaggctcattggtcattaaataatgctctgctaatccataaattaacgctcgataattaggataaatatttaacgcttttagatatagatttagcgcttgtgttggttgatttgttgcgacttctaatttacatgcgagggtttcaataagaacatctttttttgcatttgtttttaaccattcaacctcttgtcgagctctaacaaaatcgctttttctcatgtaggctattgcaagaccataccgctcggcggattcatttatatatcgcttgtctttgatgctcccctcaaactcatcaaccgcagactgaggggtgccatttgttgccctcaattttgatttgatgtacataaagtccggattatcaggaatttgcctataacgactttctttgactctatttgaaatatcactgatacgttcagctgtaatagggtgagttctcaaaaagctaggggccgcaccttctgaaaagcgtgagcctctttgaagtgtattgaagaatgaaaccattgctcggccatcaaaaccagcatcagtcaaaatttgaaaacctacccgatctgcttctttttcgtgatctcttgtatagtccaattgtttctgaacgcccatagctgaagctgcagtcatagttccagcagataactggggatttgcccttgctacaagaagagctaaagcaatgcctaggacagttttaattgaatcnntcttctgctgagcaatcattcttggcagatgtctttgcgttacgtgtgcaatttcatggcctaatacnctagcaacntctgantcattatttgatgcaagaagtaatcctgtatgaacgcctatcacccctccgatcattgcaaaagcgttaattgaagactcattcactacaaaaaaattaaattgttgccttttattgggactataagcaactaatctatcacctaaatttt

SEQ ID NO: 436 - DNA, 4000 bp, Escherichia coli
  misc_feature (485)..(485): n is a, c, g, or t
  misc_feature (489)..(489): n is a, c, g, or t
  misc_feature (498)..(498): n is a, c, g, or t
  misc_feature (598)..(598): n is a, c, g, or t
  misc_feature (1160)..(1160): n is a, c, g, or t
  misc_feature (1333)..(1333): n is a, c, g, or t
  misc_feature (1931)..(1931): n is a, c, g, or t
  misc_feature (2168)..(2172): n is a, c, g, or t
  misc_feature (2174)..(2174): n is a, c, g, or t
  misc_feature (2176)..(2176): n is a, c, g, or t
  misc_feature (2180)..(2180): n is a, c, g, or t
  misc_feature (2182)..(2183): n is a, c, g, or t
  misc_feature (2185)..(2187): n is a, c, g, or t
  misc_feature (2190)..(2191): n is a, c, g, or t
  misc_feature (2193)..(2193): n is a, c, g, or t
  misc_feature (2195)..(2196): n is a, c, g, or t
  misc_feature (2199)..(2210): n is a, c, g, or t
  misc_feature (2212)..(2216): n is a, c, g, or t
  misc_feature (2218)..(2219): n is a, c, g, or t
  misc_feature (2221)..(2221): n is a, c, g, or t
  misc_feature (2224)..(2226): n is a, c, g, or t
  misc_feature (2229)..(2233): n is a, c, g, or t
  misc_feature (2237)..(2239): n is a, c, g, or t
  misc_feature (2243)..(2245): n is a, c, g, or t
  misc_feature (2247)..(2252): n is a, c, g, or t
  misc_feature (2255)..(2257): n is a, c, g, or t
  misc_feature (2259)..(2269): n is a, c, g, or t
  misc_feature (2271)..(2272): n is a, c, g, or t
  misc_feature (2274)..(2275): n is a, c, g, or t
  misc_feature (2277)..(2279): n is a, c, g, or t
  misc_feature (2281)..(2281): n is a, c, g, or t
  misc_feature (2283)..(2286): n is a, c, g, or t
  misc_feature (2289)..(2292): n is a, c, g, or t
  misc_feature (2294)..(2299): n is a, c, g, or t
  misc_feature (2301)..(2301): n is a, c, g, or t
  misc_feature (2303)..(2309): n is a, c, g, or t
  misc_feature (2311)..(2311): n is a, c, g, or t
  misc_feature (2313)..(2313): n is a, c, g, or t
  misc_feature (2316)..(2317): n is a, c, g, or t
  misc_feature (2319)..(2320): n is a, c, g, or t
  misc_feature (2322)..(2322): n is a, c, g, or t
  misc_feature (2324)..(2324): n is a, c, g, or t
  misc_feature (2326)..(2326): n is a, c, g, or t
  misc_feature (2328)..(2329): n is a, c, g, or t
  misc_feature (2331)..(2331): n is a, c, g, or t
  misc_feature (2333)..(2333): n is a, c, g, or t
  misc_feature (2337)..(2343): n is a, c, g, or t
  misc_feature (2345)..(2345): n is a, c, g, or t
  misc_feature (2347)..(2348): n is a, c, g, or t
  misc_feature (2350)..(2355): n is a, c, g, or t
  misc_feature (2357)..(2360): n is a, c, g, or t
  misc_feature (2364)..(2364): n is a, c, g, or t
  misc_feature (2366)..(2367): n is a, c, g, or t
  misc_feature (2369)..(2373): n is a, c, g, or t
  misc_feature (2377)..(2379): n is a, c, g, or t
  misc_feature (2383)..(2385): n is a, c, g, or t
  misc_feature (2387)..(2390): n is a, c, g, or t
  misc_feature (2392)..(2397): n is a, c, g, or t
  misc_feature (2399)..(2405): n is a, c, g, or t
  misc_feature (2407)..(2416): n is a, c, g, or t
  misc_feature (2418)..(2418): n is a, c, g, or t
  misc_feature (2420)..(2423): n is a, c, g, or t
  misc_feature (2426)..(2428): n is a, c, g, or t
  misc_feature (2430)..(2430): n is a, c, g, or t
  misc_feature (2432)..(2438): n is a, c, g, or t
  misc_feature (2445)..(2445): n is a, c, g, or t
  misc_feature (2449)..(2452): n is a, c, g, or t
  misc_feature (2455)..(2457): n is a, c, g, or t
  misc_feature (2459)..(2464): n is a, c, g, or t
  misc_feature (2467)..(2468): n is a, c, g, or t
  misc_feature (2470)..(2471): n is a, c, g, or t
  misc_feature (2475)..(2476): n is a, c, g, or t
  misc_feature (2479)..(2480): n is a, c, g, or t
  misc_feature (2483)..(2483): n is a, c, g, or t
  misc_feature (2486)..(2488): n is a, c, g, or t
  misc_feature (2490)..(2493): n is a, c, g, or t
  misc_feature (2495)..(2495): n is a, c, g, or t
  misc_feature (2497)..(2499): n is a, c, g, or t
  misc_feature (2501)..(2502): n is a, c, g, or t
  misc_feature (2505)..(2510): n is a, c, g, or t
  misc_feature (2513)..(2514): n is a, c, g, or t
  misc_feature (2516)..(2520): n is a, c, g, or t
  misc_feature (2522)..(2523): n is a, c, g, or t
  misc_feature (2526)..(2526): n is a, c, g, or t
  misc_feature (2528)..(2530): n is a, c, g, or t
  misc_feature (2532)..(2532): n is a, c, g, or t
  misc_feature (2535)..(2547): n is a, c, g, or t
  misc_feature (2549)..(2551): n is a, c, g, or t
  misc_feature (2553)..(2558): n is a, c, g, or t
  misc_feature (2560)..(2565): n is a, c, g, or t
  misc_feature (2567)..(2567): n is a, c, g, or t
  misc_feature (2569)..(2572): n is a, c, g, or t
  misc_feature (2574)..(2574): n is a, c, g, or t
  misc_feature (2576)..(2577): n is a, c, g, or t
  misc_feature (2579)..(2581): n is a, c, g, or t
  misc_feature (2584)..(2587): n is a, c, g, or t
  misc_feature (2590)..(2590): n is a, c, g, or t
  misc_feature (2593)..(2594): n is a, c, g, or t
  misc_feature (2597)..(2597): n is a, c, g, or t
  misc_feature (2600)..(2601): n is a, c, g, or t
  misc_feature (2604)..(2604): n is a, c, g, or t
  misc_feature (2608)..(2611): n is a, c, g, or t
  misc_feature (2613)..(2617): n is a, c, g, or t
  misc_feature (2619)..(2619): n is a, c, g, or t
  misc_feature (2621)..(2623): n is a, c, g, or t
  misc_feature (2625)..(2627): n is a, c, g, or t
  misc_feature (2629)..(2633): n is a, c, g, or t
  misc_feature (2635)..(2636): n is a, c, g, or t
  misc_feature (2639)..(2639): n is a, c, g, or t
  misc_feature (2641)..(2643): n is a, c, g, or t
  misc_feature (2645)..(2645): n is a, c, g, or t
  misc_feature (2647)..(2647): n is a, c, g, or t
  misc_feature (2649)..(2652): n is a, c, g, or t
  misc_feature (2654)..(2656): n is a, c, g, or t
  misc_feature (2659)..(2667): n is a, c, g, or t
  misc_feature (2669)..(2670): n is a, c, g, or t
  misc_feature (2673)..(2678): n is a, c, g, or t
  misc_feature (2680)..(2680): n is a, c, g, or t
  misc_feature (2683)..(2688): n is a, c, g, or t
  misc_feature (2690)..(2693): n is a, c, g, or t
  misc_feature (2695)..(2696): n is a, c, g, or t
  misc_feature (2699)..(2703): n is a, c, g, or t
  misc_feature (2705)..(2707): n is a, c, g, or t
  misc_feature (2710)..(2710): n is a, c, g, or t
  misc_feature (2712)..(2727): n is a, c, g, or t
  misc_feature (2729)..(2730): n is a, c, g, or t
  misc_feature (2732)..(2733): n is a, c, g, or t
  misc_feature (2737)..(2738): n is a, c, g, or t
  misc_feature (2740)..(2744): n is a, c, g, or t
  misc_feature (2750)..(2752): n is a, c, g, or t
  misc_feature (2754)..(2758): n is a, c, g, or t
  misc_feature (2761)..(2763): n is a, c, g, or t
  misc_feature (2766)..(2771): n is a, c, g, or t
  misc_feature (2773)..(2774): n is a, c, g, or t
  misc_feature (2778)..(2781): n is a, c, g, or t
  misc_feature (2783)..(2783): n is a, c, g, or t
  misc_feature (2785)..(2785): n is a, c, g, or t
  misc_feature (2788)..(2788): n is a, c, g, or t
  misc_feature (2792)..(2793): n is a, c, g, or t
  misc_feature (2795)..(2796): n is a, c, g, or t
  misc_feature (2798)..(2799): n is a, c, g, or t
  misc_feature (2801)..(2801): n is a, c, g, or t
  misc_feature (2807)..(2809): n is a, c, g, or t
  misc_feature (2811)..(2816): n is a, c, g, or t
  misc_feature (2819)..(2819): n is a, c, g, or t
  misc_feature (2821)..(2821): n is a, c, g, or t
  misc_feature (2823)..(2824): n is a, c, g, or t
  misc_feature (2826)..(2827): n is a, c, g, or t
  misc_feature (2831)..(2833): n is a, c, g, or t
  misc_feature (2835)..(2837): n is a, c, g, or t
  misc_feature (2840)..(2841): n is a, c, g, or t
  misc_feature (2843)..(2844): n is a, c, g, or t
  misc_feature (2848)..(2849): n is a, c, g, or t
  misc_feature (2851)..(2856): n is a, c, g, or t
  misc_feature (2860)..(2869): n is a, c, g, or t
  misc_feature (2872)..(2873): n is a, c, g, or t
  misc_feature (2876)..(2876): n is a, c, g, or t
  misc_feature (2878)..(2879): n is a, c, g, or t
  misc_feature (2881)..(2884): n is a, c, g, or t
  misc_feature (2886)..(2888): n is a, c, g, or t
  misc_feature (2891)..(2905): n is a, c, g, or t
  misc_feature (2907)..(2907): n is a, c, g, or t
  misc_feature (2909)..(2909): n is a, c, g, or t
  misc_feature (2911)..(2913): n is a, c, g, or t
  misc_feature (2915)..(2917): n is a, c, g, or t
  misc_feature (2920)..(2921): n is a, c, g, or t
  misc_feature (2923)..(2923): n is a, c, g, or t
  misc_feature (2925)..(2926): n is a, c, g, or t
  misc_feature (2929)..(2931): n is a, c, g, or t
  misc_feature (2933)..(2936): n is a, c, g, or t
  misc_feature (2938)..(2940): n is a, c, g, or t
  misc_feature (2942)..(2945): n is a, c, g, or t
  misc_feature (2947)..(2947): n is a, c, g, or t
  misc_feature (2949)..(2949): n is a, c, g, or t
  misc_feature (2951)..(2951): n is a, c, g, or t
  misc_feature (2954)..(2955): n is a, c, g, or t
  misc_feature (2957)..(2964): n is a, c, g, or t
  misc_feature (2966)..(2966): n is a, c, g, or t
  misc_feature (2968)..(2974): n is a, c, g, or t
  misc_feature (2976)..(2976): n is a, c, g, or t
  misc_feature (2978)..(2979): n is a, c, g, or t
  misc_feature (2981)..(2981): n is a, c, g, or t
  misc_feature (2984)..(2984): n is a, c, g, or t
  misc_feature (2987)..(2994): n is a, c, g, or t
  misc_feature (2997)..(2998): n is a, c, g, or t
  misc_feature (3000)..(3001): n is a, c, g, or t
  misc_feature (3003)..(3013): n is a, c, g, or t
  misc_feature (3016)..(3016): n is a, c, g, or t
  misc_feature (3018)..(3020): n is a, c, g, or t
  misc_feature (3022)..(3022): n is a, c, g, or t
  misc_feature (3024)..(3024): n is a, c, g, or t
  misc_feature (3027)..(3028): n is a, c, g, or t
  misc_feature (3030)..(3030): n is a, c, g, or t
  misc_feature (3032)..(3034): n is a, c, g, or t
  misc_feature (3037)..(3037): n is a, c, g, or t
  misc_feature (3040)..(3040): n is a, c, g, or t
  misc_feature (3042)..(3043): n is a, c, g, or t
  misc_feature (3045)..(3046): n is a, c, g, or t
  misc_feature (3049)..(3056): n is a, c, g, or t
  misc_feature (3060)..(3066): n is a, c, g, or t
  misc_feature (3069)..(3070): n is a, c, g, or t
  misc_feature (3072)..(3072): n is a, c, g, or t
  misc_feature (3076)..(3076): n is a, c, g, or t
  misc_feature (3078)..(3083): n is a, c, g, or t
  misc_feature (3085)..(3085): n is a, c, g, or t
  misc_feature (3087)..(3091): n is a, c, g, or t
  misc_feature (3094)..(3096): n is a, c, g, or t
  misc_feature (3098)..(3099): n is a, c, g, or t
  misc_feature (3101)..(3102): n is a, c, g, or t
  misc_feature (3104)..(3106): n is a, c, g, or t
  misc_feature (3108)..(3108): n is a, c, g, or t
  misc_feature (3111)..(3113): n is a, c, g, or t
  misc_feature (3115)..(3115): n is a, c, g, or t
  misc_feature (3118)..(3119): n is a, c, g, or t
  misc_feature (3121)..(3122): n is a, c, g, or t
  misc_feature (3124)..(3128): n is a, c, g, or t
  misc_feature (3130)..(3132): n is a, c, g, or t
  misc_feature (3134)..(3145): n is a, c, g, or t
  misc_feature (3147)..(3147): n is a, c, g, or t
  misc_feature (3150)..(3151): n is a, c, g, or t
  misc_feature (3153)..(3157): n is a, c, g, or t
  misc_feature (3160)..(3161): n is a, c, g, or t
  misc_feature (3163)..(3166): n is a, c, g, or t
  misc_feature (3168)..(3170): n is a, c, g, or t
  misc_feature (3172)..(3172): n is a, c, g, or t
  misc_feature (3174)..(3175): n is a, c, g, or t
  misc_feature (3178)..(3179): n is a, c, g, or t
  misc_feature (3181)..(3181): n is a, c, g, or t
  misc_feature (3184)..(3184): n is a, c, g, or t
  misc_feature (3187)..(3188): n is a, c, g, or t
  misc_feature (3191)..(3193): n is a, c, g, or t
  misc_feature (3195)..(3197): n is a, c, g, or t
  misc_feature (3199)..(3200): n is a, c, g, or t
  misc_feature (3203)..(3206): n is a, c, g, or t
  misc_feature (3208)..(3209): n is a, c, g, or t
  misc_feature (3211)..(3213): n is a, c, g, or t
  misc_feature (3217)..(3217): n is a, c, g, or t
  misc_feature (3220)..(3220): n is a, c, g, or t
  misc_feature (3223)..(3224): n is a, c, g, or t
  misc_feature (3226)..(3227): n is a, c, g, or t
  misc_feature (3229)..(3230): n is a, c, g, or t
  misc_feature (3232)..(3232): n is a, c, g, or t
  misc_feature (3234)..(3234): n is a, c, g, or t
  misc_feature (3238)..(3239): n is a, c, g, or t
  misc_feature (3242)..(3243): n is a, c, g, or t
  misc_feature (3246)..(3248): n is a, c, g, or t
  misc_feature (3252)..(3252): n is a, c, g, or t
  misc_feature (3254)..(3255): n is a, c, g, or t
  misc_feature (3259)..(3260): n is a, c, g, or t
  misc_feature (3262)..(3264): n is a, c, g, or t
  misc_feature (3266)..(3266): n is a, c, g, or t
  misc_feature (3268)..(3269): n is a, c, g, or t
  misc_feature (3271)..(3271): n is a, c, g, or t
  misc_feature (3274)..(3274): n is a, c, g, or t
  misc_feature (3277)..(3278): n is a, c, g, or t
  misc_feature (3280)..(3283): n is a, c, g, or t
  misc_feature (3285)..(3288): n is a, c, g, or t
  misc_feature (3292)..(3295): n is a, c, g, or t
  misc_feature (3297)..(3307): n is a, c, g, or t
  misc_feature (3309)..(3309): n is a, c, g, or t
  misc_feature (3311)..(3312): n is a, c, g, or t
  misc_feature (3315)..(3318): n is a, c, g, or t
  misc_feature (3320)..(3321): n is a, c, g, or t
  misc_feature (3323)..(3323): n is a, c, g, or t
  misc_feature (3326)..(3328): n is a, c, g, or t
  misc_feature (3334)..(3334): n is a, c, g, or t
  misc_feature (3337)..(3337): n is a, c, g, or t
  misc_feature (3340)..(3346): n is a, c, g, or t
  misc_feature (3348)..(3352): n is a, c, g, or t
  misc_feature (3354)..(3361): n is a, c, g, or t
  misc_feature (3363)..(3369): n is a, c, g, or t
  misc_feature (3373)..(3374): n is a, c, g, or t
  misc_feature (3378)..(3380): n is a, c, g, or t
  misc_feature (3382)..(3383): n is a, c, g, or t
  misc_feature (3385)..(3385): n is a, c, g, or t
  misc_feature (3387)..(3390): n is a, c, g, or t
  misc_feature (3392)..(3394): n is a, c, g, or t
  misc_feature (3396)..(3399): n is a, c, g, or t
  misc_feature (3402)..(3403): n is a, c, g, or t
  misc_feature (3405)..(3405): n is a, c, g, or t
  misc_feature (3407)..(3407): n is a, c, g, or t
  misc_feature (3410)..(3410): n is a, c, g, or t
  misc_feature (3412)..(3412): n is a, c, g, or t
  misc_feature (3414)..(3416): n is a, c, g, or t
  misc_feature (3418)..(3421): n is a, c, g, or t
  misc_feature (3423)..(3424): n is a, c, g, or t
  misc_feature (3427)..(3427): n is a, c, g, or t
  misc_feature (3429)..(3434): n is a, c, g, or t
  misc_feature (3436)..(3448): n is a, c, g, or t
  misc_feature (3450)..(3450): n is a, c, g, or t
  misc_feature (3452)..(3453): n is a, c, g, or t
  misc_feature (3455)..(3456): n is a, c, g, or t
  misc_feature (3458)..(3469): n is a, c, g, or t
  misc_feature (3472)..(3472): n is a, c, g, or t
  misc_feature (3474)..(3476): n is a, c, g, or t
  misc_feature (3479)..(3479): n is a, c, g, or t
  misc_feature (3483)..(3483): n is a, c, g, or t
  misc_feature (3486)..(3487): n is a, c, g, or t
  misc_feature (3490)..(3490): n is a, c, g, or t
  misc_feature (3493)..(3493): n is a, c, g, or t
  misc_feature (3496)..(3502): n is a, c, g, or t
  misc_feature (3505)..(3506): n is a, c, g, or t
  misc_feature (3508)..(3512): n is a, c, g, or t
  misc_feature (3514)..(3517): n is a, c, g, or t
  misc_feature (3520)..(3524): n is a, c, g, or t
  misc_feature (3527)..(3528): n is a, c, g, or t
  misc_feature (3530)..(3530): n is a, c, g, or t
  misc_feature (3532)..(3534): n is a, c, g, or t
  misc_feature (3536)..(3536): n is a, c, g, or t
  misc_feature (3538)..(3540): n is a, c, g, or t
  misc_feature (3543)..(3546): n is a, c, g, or t
  misc_feature (3549)..(3550): n is a, c, g, or t
  misc_feature (3553)..(3559): n is a, c, g, or t
  misc_feature (3561)..(3561): n is a, c, g, or t
  misc_feature (3563)..(3563): n is a, c, g, or t
  misc_feature (3565)..(3565): n is a, c, g, or t
  misc_feature (3567)..(3567): n is a, c, g, or t
  misc_feature (3569)..(3569): n is a, c, g, or t
  misc_feature (3571)..(3571): n is a, c, g, or t
  misc_feature (3573)..(3574): n is a, c, g, or t
  misc_feature (3576)..(3576): n is a, c, g, or t
  misc_feature (3583)..(3583): n is a, c, g, or t
  misc_feature (3585)..(3586): n is a, c, g, or t
  misc_feature (3589)..(3589): n is a, c, g, or t
  misc_feature (3593)..(3595): n is a, c, g, or t
  misc_feature (3598)..(3606): n is a, c, g, or t
  misc_feature (3608)..(3612): n is a, c, g, or t
  misc_feature (3615)..(3616): n is a, c, g, or t
  misc_feature (3618)..(3618): n is a, c, g, or t
  misc_feature (3620)..(3623): n is a, c, g, or t
  misc_feature (3627)..(3628): n is a, c, g, or t
  misc_feature (3631)..(3632): n is a, c, g, or t
  misc_feature (3634)..(3634): n is a, c, g, or t
  misc_feature (3636)..(3637): n is a, c, g, or t
  misc_feature (3639)..(3640): n is a, c, g, or t
  misc_feature (3642)..(3647): n is a, c, g, or t
  misc_feature (3649)..(3651): n is a, c, g, or t
  misc_feature (3654)..(3654): n is a, c, g, or t
  misc_feature (3657)..(3659): n is a, c, g, or t
  misc_feature (3662)..(3662): n is a, c, g, or t
  misc_feature (3664)..(3664): n is a, c, g, or t
  misc_feature (3666)..(3666): n is a, c, g, or t
  misc_feature (3669)..(3669): n is a, c, g, or t
  misc_feature (3671)..(3673): n is a, c, g, or t
  misc_feature (3675)..(3676): n is a, c, g, or t
  misc_feature (3678)..(3683): n is a, c, g, or t
  misc_feature (3685)..(3685): n is a, c, g, or t
  misc_feature (3687)..(3688): n is a, c, g, or t
  misc_feature (3691)..(3691): n is a, c, g, or t
  misc_feature (3693)..(3695): n is a, c, g, or t
  misc_feature (3697)..(3699): n is a, c, g, or t
  misc_feature (3702)..(3705): n is a, c, g, or t
  misc_feature (3707)..(3712): n is a, c, g, or t
  misc_feature (3714)..(3714): n is a, c, g, or t
  misc_feature (3717)..(3723): n is a, c, g, or t
  misc_feature (3726)..(3728): n is a, c, g, or t
  misc_feature (3730)..(3732): n is a, c, g, or t
  misc_feature (3735)..(3735): n is a, c, g, or t
  misc_feature (3739)..(3741): n is a, c, g, or t
  misc_feature (3743)..(3743): n is a, c, g, or t
  misc_feature (3746)..(3748): n is a, c, g, or t
  misc_feature (3756)..(3756): n is a, c, g, or t
  misc_feature (3758)..(3766): n is a, c, g, or t
  misc_feature (3770)..(3774): n is a, c, g, or t
  misc_feature (3777)..(3777): n is a, c, g, or t
  misc_feature (3779)..(3779): n is a, c, g, or t
  misc_feature (3781)..(3781): n is a, c, g, or t
  misc_feature (3784)..(3784): n is a, c, g, or t
  misc_feature (3786)..(3786): n is a, c, g, or t
  misc_feature (3789)..(3790): n is a, c, g, or t
  misc_feature (3792)..(3792): n is a, c, g, or t
  misc_feature (3794)..(3795): n is a, c, g, or t
  misc_feature (3800)..(3800): n is a, c, g, or t
  misc_feature (3802)..(3803): n is a, c, g, or t
  misc_feature (3806)..(3806): n is a, c, g, or t
  misc_feature (3809)..(3809): n is a, c, g, or t
  misc_feature (3816)..(3816): n is a, c, g, or t
  misc_feature (3820)..(3820): n is a, c, g, or t
  misc_feature (3823)..(3823): n is a, c, g, or t
  misc_feature (3826)..(3826): n is a, c, g, or t
  misc_feature (3829)..(3829): n is a, c, g, or t
  misc_feature (3831)..(3831): n is a, c, g, or t
  misc_feature (3833)..(3833): n is a, c, g, or t
  misc_feature (3835)..(3836): n is a, c, g, or t
  misc_feature (3838)..(3840): n is a, c, g, or t
  misc_feature (3846)..(3852): n is a, c, g, or t
  misc_feature (3855)..(3856): n is a, c, g, or t
  misc_feature (3860)..(3863): n is a, c, g, or t
  misc_feature (3867)..(3868): n is a, c, g, or t
  misc_feature (3870)..(3874): n is a, c, g, or t
  misc_feature (3880)..(3883): n is a, c, g, or t
  misc_feature (3887)..(3889): n is a, c, g, or t
  misc_feature (3891)..(3891): n is a, c, g, or t
  misc_feature (3893)..(3894): n is a, c, g, or t
  misc_feature (3896)..(3897): n is a, c, g, or t
  misc_feature (3901)..(3903): n is a, c, g, or t
  misc_feature (3907)..(3907): n is a, c, g, or t
  misc_feature (3909)..(3909): n is a, c, g, or t
  misc_feature (3911)..(3915): n is a, c, g, or t
  misc_feature (3918)..(3918): n is a, c, g, or t
  misc_feature (3921)..(3925): n is a, c, g, or t
  misc_feature (3927)..(3931): n is a, c, g, or t
  misc_feature (3933)..(3933): n is a, c, g, or t
  misc_feature (3937)..(3938): n is a, c, g, or t
  misc_feature (3941)..(3943): n is a, c, g, or t
  misc_feature (3946)..(3947): n is a, c, g, or t
  misc_feature (3949)..(3949): n is a, c, g, or t
  misc_feature (3953)..(3956): n is a, c, g, or t
  misc_feature (3958)..(3958): n is a, c, g, or t
  misc_feature (3960)..(3962): n is a, c, g, or t
  misc_feature (3965)..(3965): n is a, c, g, or t
  misc_feature (3969)..(3970): n is a, c, g, or t
  misc_feature (3973)..(3974): n is a, c, g, or t
  misc_feature (3977)..(3979): n is a, c, g, or t
  misc_feature (3981)..(3983): n is a, c, g, or t
  misc_feature (3985)..(3985): n is a, c, g, or t
  misc_feature (3987)..(3987): n is a, c, g, or t
  misc_feature (3990)..(3990): n is a, c, g, or t
  misc_feature (3994)..(3994): n is a, c, g, or t
  misc_feature (3997)..(3998): n is a, c, g, or t
  misc_feature (4000)..(4000): n is a, c, g, or t
ggtgataaggtccatggtcaaaagggaaacagcccagatcatcagataaggtcccaaaatttacgctaagtggaaaaggatgtggagacgcgcaaacagctaggaggttggctcagaagcagccatccttcaaagagtgcgtaacagctcactagtcgagtatctctgcgccgaaaattaaccggggctaagcgtaataccgaatctatggatttatacttaggtataagtggtaggggagcgttccatacagcattgaaggtataccgtaaggagtgctggagcgtatggaagtgagaatgccggtgtgagtagcgagatgtgggtgagaatcccacacaccgaacaaccaaggtttccaggggaaggttcgtccgccctgggtaagtcgggacctaaggccaggccgaaaggcgtagtcgatggacagcaggttgatattcctgcacccgcgagtaaagtgatggagtgacagatagggttancccnagtccttantggattgggcaaggcaagcaggagagtggcgtaggcaaatccgcgccggatactcaaaggcttgactcaagcgaacgcgcgagcaagtagtgaagagggngataccaggtctcaagaaaagcttctagcgataatttactagcggcccgtaccaaaaccgacacaggtggttgaggcgagtagcctaaggtgagcgagagaactgttgccaaggaactcggcaaattgaccccgtacgttagcaataaggggtgctcgaaagagccgcagtgaataggccctagcaactgtttaactaaaacatagctctctgcgaagtcgcaagacgaagtatagggggtgacacctgcccggtgctggaaggtcaaggggatttgtcagacgcaagtcgaagcattgaaccgaagccccagtgaacggcggccgtaactataacggtcctaaggtagcgaaattccttgtcaggtaagttctgacccgcacgaaaggtgtaatgatttgggcactgtctcggcagcagactcggtgaaatcttagtacctgtgaagatgcaggttacccgcaactagacggaaagaccccatggagctttactgtagtctgctattgagtttcggttaagtatgcacaggataggtgggagacgatgagactggtctttngggatcagaggagtcactgttgggataccactcttacttaattgaaattctaactctaagccgtgatccggctagaggaccgtggcagatgggcagtttgactggggcggtcgcctcccaaagagtaacggaggcgcacaaaggtactctcagaatggttggaaatcattcancgagcgcaaacgcagaagagtgcttgactgcgagacaaacaagtcgagcagggacgaaagtcggtgttagtgatccggcggtgcagaatggaatggccgtcgcttaacggataaaagctaccctggggataacaggctgatctcgcccaagagttcacatcgacggcgaggtttggcacctcgatgtcggctcatcgcatcctggaggtgaattcgcttccaagggttgggctgtccgcccattaaagcggtacgcgagctgggttcagaacgtcgtgagacagttcggtccctatctgttgtgggcgttggaaatttgaggagagctgcccctagtacgagaggaccagggtggacgttcctacggtgcaccagttgtcacgccagtggcatagctggatagctgagaacggaccggataaacgctgaaggcatctaagcgtgaaaccgactccaagattagatttcccatcatttcaaatgaataagaccccttgaagacgacgaggttgataggtcagagatgtaagtgtagcgatacattcagttgactgatactaataggtcgaagatttattcacgagagaacgcacacacnactgtttgagaaagacaaagtcagaaactgttatttagttttcagggaacagagtaccctaaagaagcaagatccggtgatgatggcgcagtggccacacctgtacccatcccgaacacagaagttaagcactgtagcggcgaaaatagcgcaagcaaatctagcacgttgccgggtcatcgagagcatggttttccatcgctctccctttttttatactttttatgggtttagatnnnnnantnttancnntnnnaannananntannnnnnnnnnnngnnnnngnntnctnnntgnnnnntttnnnattnnntnnnnnntcnnntnnnnnnnnnnnannanntnnntntnnnntannnnannnnnntnannnnnnnangnttnncnngntngntnntnanttannnnnnngnannannnnnntnnnncagngnntnnnnnaagnnntagnnntnnnncnnnnnntnnnnnnncnnnnnnnnnnantnnnnaannnanannnnnnncgactantgtnnnntcnnntnnnnnnatnncnnatannagnnatncannngnnnntngnnntnnacnnnnnnatnnannnnnanngantnnnanttnnnnnnnnnnnnnannntnnnnnngnnnnnntncnnnngnannannnaannnnttnganncanctnntanagannnnannnnntnannntnnntnnnnngnnatngnnnanangnnnnannnctnnnnnnnnntnntannnnnntnacnnnnnntnnnnanncannnnntnnntantnnnnnnnnnnnnnnnntnntnntgannannnnnttggtnnngnnnnngannnatnnnnnnannatcnnnntnanganattnntnntnnanttgaannnannnnnncanancnntnnttannnannnatnntnntgannannnnnntatnnnnnnnnnnccnngtngnnannnngnnnttnnnnnnnnnnnnnnnantncnnngnnnttnngntnnatnnntnnnnannnannnnanananttnntnnnnnnnngntnnnnnnngnanngnatnatnnnnnnnntgnntnngnnnnnnnnnnnaancnnntntntanntntnnntanaananngnnaannnnnnnnaagnnnnnnnagnngnatanannnnnnancnnnnnaannnannanntnnngnaannntnatnngnnannnnnannnannnnnnnnnnnnanatnntnnnnnaanntnnnnannnantnnttnntnttnaannatnnntnnnannaannnnannannngcanttngtnntnncnnantntttnnagnnatnnnatgnanntaanntnnntnannantgnttnnannnntnnnngaannnnannnnnnnnnnntngnngannnngnnantannngttttncanaannnnnnngnnnnntnnnnnnnntnnnnnnngaanntttnnnanntncnnnntnnnannnnttnntntntgnanannntnnnncnnttntnnnnnntnnnnnnnnnnnnntnanntnngnnnnnnnnnnnnttncnnntantgcngtnngtnctncannnnnnnaannannnnntnnnnaannnnnatnnantnnngntnnncannnngcnnttnnnnnnnantntnanantntnncnttggaantnngtntatnnnatnnnnnnnnnannnnnttnnangnnnnaaannggnntntnncnntnnnnnntnnnaanaannnttntnangangnnnannannnnnntntnntgntnnnannnttnnnngnnnnnnanatnnnnnnnatnnnannnttngaannnanctnnnatgaaacngnnnnnnnnnttannnnngangnanaananatnntntnnaatancnnatnatnacagatnaatnttnatncanantntnntnnngttgtnnnnnnngtnnctannnntatnnannnnnaaaatnnnncaannntnanngnngaannnttananannnnnaanctnnnnntnnnnnanattnntgnnnttnnanatannnnangnnntgntttnnttnnttnnntnnntntnggngtanaannan

SEQ ID NO: 437 - DNA, 4000 bp, Escherichia coli
  misc_feature (1988)..(1988): n is a, c, g, or t
aagatagatcaacaaacaccgtatatagtaccaaaacagaaaatgtttatagagatgaagatggtaattcgacatttgtagatgatatgggcgaagaagtcacctatgatgaattagcacaggatgacccaagatgggcaggtgtaacaaaaagaacagaaaccacgataacatcacatgatgagttagtttcagaagcagatgatcctaatttatattttgatgaaggggatggtgaatataaaccagtggacgaaatggcattggatgatccaagaagggaaccaaaactatccccagaagatgatcctaatatggtatatgatgatgccactggtgaatatgaacctattggcgatcaaccagacaattgggataatggcgaacctgaaccgttattgcctgaaaatgatcctaatatggtatacgatgatgatttgggtgaatatgtaccaaaagacgatataccagccaattgggataatggtgaacctataccacccgaagtggatgctgatgggtgtgaagttgggtattattggtctgaagaagatttgtcatgtgtgccaaacacattagatatgactgaatttggctgcacaaaggatgagagatatgatgatgaggctggttattgcgtgcggaaagacaaatctggggaagattatcaagaaccacctcctgcccctataccaaaagatgtatattcagcaaggcgtgcaaaagcaagcaacaaatcaaccaatgattggcgtgttagactgagtttagcaccacaagcagaatacctttacaataaagctggggatgctggtatattagaaccattgagggctacggatggtgttatattcccatatgtccctaaaattgatacaatttatcatgctacatacaatcagtatgatttaacacatagcaattaccgaggatatttctaccaaaatagttatcctggtgaaatgctgattaatgcaacattcacagcacaagataccaaagaagcaaactatatattggcagtaatccattttttaagatcatgtactaagatgttctatggacaagacgctggaaacccaaacagaggttcaccacctccattggtgtttttaagaggattaggggaacatcagtttaacgaacacccgtgtgttgtgtcgcttatgaactataacttacctgatgatgtagattatatcaaggcaagcgttggtggacgactaggtgcggatacagacccatttacgatgaataatgagtcaaaacctacaggacatcaatcatggagtagtaaaatctctaggttatggcaagctgatctagaacctggtgctacaccgacagcaatggacagtgggggtggtactatgacaataaagggtaggagaagaggaaatcaaggtgtatcaagggttcctactaaattggaggtatcatttaacttattgcctatacaaacaagagatcaagtaagtaatcagtatagtatggacaaatatggcactggtgaattattaaagagaggattctattaatgtataacacaacaagcctgtattttgataccccaataagaggaaatcatttggatatgctagtaaatagaccaattcccaaaagaccagatgataggttgtttgagatcaatgagacttataatttaagacctgatttattggcatatgatttatacaatgattcagaactgtggtgggtattcgcacaaagaaatccaaatacattaaaagacccgttatttgattttaaacagggcactagtataagattgccacaattgacaatattaaaagagacattgggattctaatatgtcagttttgaatagcgcaggtaagatagtattcgatgcacagaaagcgttgttagataaggcgaatacacaaaagccagaactcccacccaaacagatatcagatgcattggctaagttgcctggcacaggaatgaaaattgaacttccgttnaatggaaggttctcttcaaacgcaaacatccccaatatagataatgcaatcccaccatcctctactatgaatgtagatggggccggaactagtaatacaggcactgaatcacctactataccaaataaagaagaacctgtgtcggttaaagatgagacaactgctaatgggacagtgatagctggtgagtttaaagaaaaaatatcagcaaaagagaacccatttaagaaatttggatcatatacttactccgtcagtatgtatatgatgggtgcacaagaatatgcacaaatgatatccacagggaagaaatcagtaaagggattgcctttaatattacagagtggtggaataaacaatactgacccaaccagtaatttcggcgcagtaagaagttcagcgtttgatttggatttttatgtggatgatattgaattcaaagggttagtatctggcacatctactggttcagcgcataatacctttgagatgagttttaaaattactgaacccaatgggttatcattcttggatcggttgcataagatggttcaagattataacattgtcaagggtgttagtgtggatagaattaattatgcatcgcaaaactacttaatggtggttaggttttacgggtatgatgaacaagggaatgcattaagtgcaaaggatttaggaatggccactgatactactgattcgtcaacggtgtcagagaaattcataccattccaatttactgagattaaatttgctattaataatgggttagttgattatcaatgtagggctgtgtgtccacaaacacatttgccaaataatgttgctaacgctagtatattgtttaatgttgagttagaagggcaaacactaaaccaattgtttggtggtgataccttattagttgctgatgcattaaatggcaattcaacaaccccgcccgtgaaagcgacagataaaattgtgacacgagggttagttggtgcattgaatgcagagcagaagcgactagttgaaacaatggtggttgaacatgctaacgtttatgaaataaaatttgaagagacgggtgatggatattcaatagctaatgaatcggtggcaaacctgggggggctagaaaatacaccgatgcagaataattattataatgaacgtgcaattgacaagtatatggagtctaagaagtttgtaaataacgacaaaaaagtattctcagtcccagctgggatgaagattgctgaattcattgacctagcagttagaacaagcacatatatatctaatcaacaaactgttataattgacgaggaaggaaaagcattaaaacaaaaaccaggtggggtatttcagtggttcaaaattagaacacagatagttccattggaatatgataacaaacggcatgattatgcatacaagataacatatgttgttactcgatattttgtaaatgatataaaagcagaaaacttctcgccctctacctatagaggagttcataaatcgtatgattattggtttactggtaaaaatacagaagtattaaactttgaacaggaatacaattatttgtattttcaaacgatgggtgcacaagaaccagttgtagtacgccagaataatgcaagggaattgacaaaacggtactatttacctggtgatgcagaaggttctattggtggcaaaggtggaagtaataaatcagcagataatgcagcaagtattttgtatagtcctagtgaccaagcaaatgcgaagatagatatagttggtgatccagattggattgcccaaagtgaagttttttatagtccacatgtagcattagaagaggttggtttaggcccatttatgcaagatggatcagtgaactatgatgcatcggaagtattattttccataaattacaacaccaatactgactataatgcaatgaatgggttggcagaggtaggcaaggataactatggtaggcaggtaggaagtggtattcctggtgaaagtag

SEQ ID NO: 438 - DNA, 4000 bp, Escherichia coli
  misc_feature (1193)..(1193): n is a, c, g, or t
  misc_feature (1209)..(1210): n is a, c, g, or t
  misc_feature (1214)..(1214): n is a, c, g, or t
  misc_feature (1216)..(1216): n is a, c, g, or t
  misc_feature (1315)..(1315): n is a, c, g, or t
  misc_feature (1327)..(1327): n is a, c, g, or t
  misc_feature (1355)..(1355): n is a, c, g, or t
  misc_feature (1597)..(1597): n is a, c, g, or t
  misc_feature (1933)..(1933): n is a, c, g, or t
  misc_feature (2029)..(2029): n is a, c, g, or t
  misc_feature (2071)..(2071): n is a, c, g, or t
  misc_feature (2122)..(2122): n is a, c, g, or t
  misc_feature (2335)..(2335): n is a, c, g, or t
  misc_feature (2833)..(2833): n is a, c, g, or t
  misc_feature (2840)..(2840): n is a, c, g, or t
  misc_feature (2876)..(2876): n is a, c, g, or t
  misc_feature (2902)..(2902): n is a, c, g, or t
  misc_feature (3664)..(3664): n is a, c, g, or t
tacggatcttgtgaagagtgcagtttcttcctaccattgtaatggggtaaactctattgatgaaacaaagtggtaccagcttgttgtctctgaagaaggagataaagaaggcgaacaagctaatcacgtagacggcactggggcaaacatgacagtgctgacaatggaacgtgattacactaccggaaatttgactttgaccgtaaaaaaaatcgaagaagcagcattgactcattctttatggaagatcacaacggttagagataacgtgaactctcgcgacctgtttgcttatgaaaacatggaaactggctataagctgactttcgatgaattcaacgctttggatctaaatggaagttcagatgcaacaactgttgttaaagaggtagaggctactatcctgaacggttgtacggataattggagatggtatactcacaaggctcaaacgagtgacttcgcacagaaaactgtcttctcttttttccatggcaaagactctgtgatggctatggctttgaatcagaacaacgaagtcgttttggtaaaggagagtgcggtaaaggctgaagacgaagcaaaaagtattaagggactgcttgctgttcgtccgatcattgccggtgcaaaggttttgaatgcggctgaaatcaattcgatgatcgatgctgatggttcttataagaattttattgatatcgctaacaataacacctctgagaatgttacgttaggaggaacgaaagtcaatttcaagttcagcaagacattagataaaaatccgctgaccgaaacttacaaggctgtggcaagcccttatcgtttgttggaccgtgataagtggaatgaaaatactaatgaagtttattccggttacgacatccttcttcaaaacgtaaagacaggtaaatacctgatggtgtctcctgatcgttttgaaaaaccgactgctccaggtgtgtatggcggtttgctgttgaaggatgctgattatcagaagttgaatagtaaaacaaatccgaccgcattggtgaatgccgatccaacaatcttgccggatgtcatcggtaatttggatgctcatcaagctcgttatcatttcaaattcacttattatcctacaaacgacagtttggtgatcgaaccgttgaatgcttctgtaaaagaaagtgaagagatcgactatttgnagagtgacttggtgcnnaaananggtgatgctgtaaagatggtagattacttcaatacggttaatgccggtatcgcttataataatggctcttggggaaatgtcttgtttaacaaggctgcnggtgttccggtngctttaggtgccatcaacaatggaacgngcacttctgatgcaagcgaaatcctgacagtttcagttccttctaacattgcagctgcccaggctaaatataagactttgtgcaaggaagaatttgcttgttcgaaaagttcagttgccggaaatcctgcttatgtgactaattattgtgttaatcatgtaggtgataaaggcactgttgagtacttggcaaacatgggcgtgaagataagctttgacaacttccgcactccattggtacgnacgactgtcaaatccggtctgtatttcattcagttgtctacaactgttcaggatgatcctacttatacggaaaaacgtcataacggttcttatatcgtagctgatatggctggccatttggtttatgatgttaaagatgctaatcaggactttactcatatgcctgccactcagtgggttgttgaagaactgaattgtgatgtgtatgataacgatgtgaatacgaacgaagctgctttagtcaagattactaaccgtgagtatggtatcgaaggtttcgtaggtcagttgtattctgccggtaaggatgccaatgggcaggataagtactatttnatcaatcataagtattctgacggaatgtggaatgaaggtacagatatccattactggggagagaaattcgcatgtcacgatacgttgactttcacngccgtagatccgaagactacttttggttatgaagtgatttcngatgatgtattaaaagaaaacgtctatgcattgcagcagttggtaaacggngaagcagcatggtatctgggtattagtgcagatagcaagaacttaggtttgttgaaagaagatccgactatgttcgaattgcacttgatcggtgaagctacggattatggttatactccggcacaaaagactactcaaccgggcttggctggcattgacactttgaagagagctgtttacgctgttaaggtaaaagatacaaacaaaataganaacgatcatacttatgtagccttggatcatatgcaccgctacgtagttgctgacgaaaaagatatccaggctggtaaggatggtttgacttgggctttgttctatctgaagaacaataatcacgtaggtgaagatcattattactctttggtaaatgcagtaggggtagaaaccggatctttgaaaaatgtcaataccatagctggaaagttggtagtagaagcatctactttcttgacgaaggttgacaacttgtgcagcacatcatctgatgtattcaaattggcaggagatcctcgtcctttgtatgcaaatctggaaggtgacgacgtaatcggagcagcttatagcaatttggtaaacaacaaagaaaaaggcttgaaattaggtgtggatcgcacaggcggttatttgtatgaagatgaaactccgggcctgaactatctgtctcatgaaaacttgaacacaggtgcagacaagagctattctttctatgtngacaaanttgcaaaatccaatgcacgcatgccgcagtatttgnttgtaacagcagcagatagcgtaccngcttacacatattgcattacagaaaaacacggtatcaatccgggatgtgaccatgctgtttcttatccgggttatgtaagcggtcgtttcttggttaacttgaacgattctgttcgtacttctatcgataaagtttctgctacagacaagtttatgtctgacggctatgtaagactggcatttgttgaggctgttcatcgcggtgattctctctatgtgctgaaagctccttacacgttggcttctatctctgttaaggatgtggatggtacatcgtacgttcttcctccttatctgtcaaaagacagtttgggcgttgtttatgacattgtcgatctgaatggcgaacacaacaatgctgcattctctttgagatatgtcggcgatacggaaaatgacggtttcttgctggaatctttcgattatggaatgaaaaatgaagaagatggtacgattgaacatctttctggtatcggttcattcgaaggtgcatgggtgaaattacagaatggtgttcctgttttggctcagatttctgacgatacagataagggcgaccacaatacaggtgacaaccttgctggttcggagtactatgataagatgagttggagtgaagtattgaaccaggctgctatctttggtttgactgaaggtgtaaacggtggtgatgctactgcaaacgaagacgtagaagtatcttctgtaacagtcatcgccggtaacggtcagatcacagttgcaggtgctgccggcaagaangtggttatcactaacatcttaggccagacagtcgctaatacagtggttacttctgataatgctactatcgctgctcctgctggtgtagttgtagttgctattgaaggtgaagacgctgtaaaagcaattgtaaagtaatctcagaataataacattacaattataatcaaataattctaaataagatcgtgcgccgtagagatgcacggcggtgcatctctacaaataacggcaattatcctgcgacaggtgaacaagcgatcgtattattaatactaaagtattgaaataaagttcttctgccagtagcctgtgaaggtcgaaggcagttaaaaa

SEQ ID NO: 439 - DNA, 4000 bp, Escherichia coli
  misc_feature (15)..(15): n is a, c, g, or t
  misc_feature (41)..(41): n is a, c, g, or t
  misc_feature (134)..(134): n is a, c, g, or t
  misc_feature (448)..(448): n is a, c, g, or t
  misc_feature (757)..(758): n is a, c, g, or t
  misc_feature (853)..(853): n is a, c, g, or t
  misc_feature (1272)..(1272): n is a, c, g, or t
  misc_feature (1364)..(1364): n is a, c, g, or t
  misc_feature (1416)..(1416): n is a, c, g, or t
  misc_feature (1458)..(1458): n is a, c, g, or t
  misc_feature (1494)..(1494): n is a, c, g, or t
  misc_feature (1650)..(1650): n is a, c, g, or t
  misc_feature (1791)..(1791): n is a, c, g, or t
  misc_feature (1983)..(1983): n is a, c, g, or t
  misc_feature (1991)..(1991): n is a, c, g, or t
  misc_feature (2481)..(2481): n is a, c, g, or t
  misc_feature (2754)..(2754): n is a, c, g, or t
  misc_feature (2769)..(2769): n is a, c, g, or t
  misc_feature (2874)..(2874): n is a, c, g, or t
  misc_feature (3432)..(3432): n is a, c, g, or t
  misc_feature (3447)..(3447): n is a, c, g, or t
  misc_feature (3510)..(3510): n is a, c, g, or t
  misc_feature (3522)..(3522): n is a, c, g, or t
  misc_feature (3573)..(3573): n is a, c, g, or t
  misc_feature (3705)..(3708): n is a, c, g, or t
  misc_feature (3712)..(3725): n is a, c, g, or t
  misc_feature (3728)..(3728): n is a, c, g, or t
  misc_feature (3731)..(3736): n is a, c, g, or t
  misc_feature (3738)..(3738): n is a, c, g, or t
  misc_feature (3740)..(3747): n is a, c, g, or t
  misc_feature (3749)..(3751): n is a, c, g, or t
  misc_feature (3753)..(3754): n is a, c, g, or t
  misc_feature (3756)..(3756): n is a, c, g, or t
  misc_feature (3758)..(3758): n is a, c, g, or t
  misc_feature (3761)..(3763): n is a, c, g, or t
  misc_feature (3765)..(3766): n is a, c, g, or t
  misc_feature (3768)..(3770): n is a, c, g, or t
  misc_feature (3773)..(3773): n is a, c, g, or t
  misc_feature (3775)..(3776): n is a, c, g, or t
  misc_feature (3778)..(3784): n is a, c, g, or t
  misc_feature (3787)..(3788): n is a, c, g, or t
  misc_feature (3790)..(3790): n is a, c, g, or t
  misc_feature (3792)..(3796): n is a, c, g, or t
  misc_feature (3798)..(3800): n is a, c, g, or t
  misc_feature (3803)..(3806): n is a, c, g, or t
  misc_feature (3809)..(3809): n is a, c, g, or t
  misc_feature (3811)..(3811): n is a, c, g, or t
  misc_feature (3814)..(3815): n is a, c, g, or t
  misc_feature (3817)..(3817): n is a, c, g, or t
  misc_feature (3819)..(3819): n is a, c, g, or t
  misc_feature (3821)..(3821): n is a, c, g, or t
  misc_feature (3824)..(3824): n is a, c, g, or t
  misc_feature (3831)..(3833): n is a, c, g, or t
  misc_feature (3836)..(3836): n is a, c, g, or t
  misc_feature (3838)..(3839): n is a, c, g, or t
  misc_feature (3841)..(3841): n is a, c, g, or t
  misc_feature (3844)..(3846): n is a, c, g, or t
  misc_feature (3848)..(3848): n is a, c, g, or t
  misc_feature (3850)..(3850): n is a, c, g, or t
  misc_feature (3853)..(3853): n is a, c, g, or t
  misc_feature (3855)..(3861): n is a, c, g, or t
  misc_feature (3863)..(3864): n is a, c, g, or t
  misc_feature (3866)..(3882): n is a, c, g, or t
  misc_feature (3884)..(3891): n is a, c, g, or t
  misc_feature (3893)..(3901): n is a, c, g, or t
  misc_feature (3903)..(3909): n is a, c, g, or t
  misc_feature (3911)..(3922): n is a, c, g, or t
  misc_feature (3924)..(3928): n is a, c, g, or t
  misc_feature (3932)..(3938): n is a, c, g, or t
  misc_feature (3940)..(3942): n is a, c, g, or t
  misc_feature (3944)..(3947): n is a, c, g, or t
  misc_feature (3949)..(3949): n is a, c, g, or t
  misc_feature (3951)..(3958): n is a, c, g, or t
  misc_feature (3960)..(3985): n is a, c, g, or t
  misc_feature (3988)..(4000): n is a, c, g, or t
caatgcccggcttgngcaggaatgtcgcttcccgtgccgcnccgacggttccggacacatacaccgacatgccgacgttgtagcccaaattgatgccgctgatgacggcgtccgcgtccggcgcaaggttcatngctccgatgcggcagctgtccaccggcgtaccgaaaattgcccacgcttcatccgcatcgggcacttcgcgcttctccgccagaatcggctgctcgatgctgaatgcatgtgcctttgcgctctgctgcgtcgctggcacgcagaccgtcacccgatgcccggcacgcttgaccgcctgcgtcagaatcggcagaaacgggctgttgatgccgtcatcgttcacaatcagaaagtgcatggttattctccttccgcaggggtcagcgcgaccaagagcgtctgcatgttctcgcgcatccgatcctcatagtangtcagcggcacgtcggtttccgggccggtcacaacggggtcaagcgtgtaaatcggcgcgcccgtctcgcgggaaatcgtctgcgccgccatatcatcgtactgcggctcggtgaacagcggcggattgttcagctcacggatagtgcgcaccagctccgccaattgcgcgggggacagcgcgtcgcccggctcgtggttgacgacggcggcgactgtcaagccatacgcccgcgcaaaatacgggaatgcctcgtggaaggtgacgatgttcttgttcggcacggctgcaagcgtctctttcagctcnncatccagcgccgtcaagcgcgacacataatccgcgcggttttgctcaatctgcgcttcgtactgcggcatggcgctgataagcccgtctgccagnttgtccaccatctggatggcgttctgcgcatcaagccagatatgggcgttcgcttcgcccgcgtggtgatgcccgtggtcgtcggcgtcttcctcctcgtggtcatggtcatggtcgtccacatactcgtccatgccgtcctcggtcagcagcgtgatgccggcggacgcatccaccacgggcagcttcgggaacgtgtccatcacgcgggtgaggtagctttccatgcccgcgccgttgatgaggaatacatccgccttgttcagcaccttcatatcgccggtggaaagctgataatcatgcagacagccggtgttcggcgcggcgaggttgcggatggtgatgccgtcgatgccctgcgtgaggttgagggcgaagaggtagatgggatagaacgacgtgacgacggtttccgccgncgcgaaggtgggggagaggaagatgagcagcgtcaaaagggctgcaagcagctttttggttttcatgtgatgatgattccttcctaaaacantggttgattgggggatgcagtggctgcctgcggcgcattttcccgaaggatncgctccagcagcgctttttccgccgatgacagcgggtaaaantgcatcagcgtccgcatagcgcacaggctgccggangtcatggcgaacgccatcagcgtgtccttcggcattccggttgtgccgagggattcaaagaggacggcaagcagctcatccgccagcaggggaaactcctccatgcggaaacggcgggttcgtccgtccggcatggaaacgcgcatctgcgggccnagaatggcgtataaatcgcggaacaagccatcgcgaagcgcttcgcacaaggcggaaaggtcgtcgcccacgcggtagtgccgcagccgttctgccgcatgtgttccgaccccggaatgcgccagcgctgtcccgattcgnatcgccagcacctgctgcacccggtcaagcggaattgcaatcgccatagcctgtcctcctttgggggagatgcagaatccccgcccttttcatttcgacatccaaaggcaaaatcccttgtttccaaactttttttgcactttttttcgggcggtaattcccagaaaaatatgcaggattcagcataaaatncgccgccncatgaaattatccacaggaacttgtggagaacatagcttctttccacaagattttgttccgccgggctgcaaaacggcatgggtcatgcacaaaaatgacggaatcggaatgcttgcgattttggcgaacctgtggtatgatacaaaaggatgcgaatggacatgaatgcaaaagcatcacaggctcacggccgcaggtcggtcgtgcgcctttttcgcccccttgcgtccccaacgcggacaaaaaagccggtcggacaatgcgtccgcgcaaagaatacggaggaatcccctgatggacatggaagagctgtggtcaaagacacgcgaggtgcttcgcgcggaagtcaacgccgtagtgtacaattctctgctgggcagcaacaacctcgttccggcgctgcttgacggcgatacgcttgtgcttcgcgtggtgatggacaatctgaagctgctgattaccaaccagtggtattcgacgattgtccgngcgctcagccaggtggcgggccatcagatggatgtggaaatcctgacgcaggaggaaatcgaggcgcgtccgcagctgaagcagaaggcggtggaggagcaggagacggtgctggaaagctcggtcgccctgaacccgaagtacaccttcgagacgttcgtcgtcggcagcggcaaccgttttgcccatgccgccgcgctgtccgtcgccactgacccggctcattcctacaacccgctgtttatctacggcggtgtaggccttggcaaaacncacctcatgcacgcngtcggcaacttcatccgcgagcatgaccccagcaaacgcatcctctatatccccggtgaaaccttcaccaacgagttgatttccgctatccagcaggggcggaanattcagttccgcaaccgcttccgcagcgttgatgtgctgatggtggacgatattcagttcatcgccggcaaagaatccacacaggaagaattcttccacaccttcaacaccctgcataccgccggaaagcagattatcctcacatccgaccgtccgccgcaggaaattgcccgccttgaggatcgcctgaagagccgctttgcgtgggggctgacctgcgatatcaagaaaccggacgtggaaacacgaatcgccatcctgcgcgaaaaggcacggcaggaaaacatcacgatggatgaggacgtgtacgaggccattgcgacgcgcgtcgaatccaacatccgtgaactggaaggcagcctgacccgccttgtcgcctatgcgcagctgacgaatcgcccgattaccgtgcagctgtgcgaagaggcgctgcacgacattttcgccaagaaggtgcgcaaggaagtgacggcgcaggttatcatgcaggcggtggcgaactactactccatcacggtggatgacctgattcgccccacgcgccgccgcgaaattgcngttccgcgccaaatngcgatgtacatcacgcgcgacctgacgaacctctccctgccgcagattgggcaggtgttcggnaaccgcgaccanacgacggtgctgcatggctgcaaccagattgccaacgccatcaagaacganccgtcgatggcgagcgtggtgaatgatttgaaggaaatcattgtggacaacaagtgattgcatcaatatgtatattccccctcgtgctgtgttaatacaggcgagggggaattttttatgcggcttgatttnnnncggnnnnnnnnnnnnnngcntcnnnnnngnannnnnnnntnnntnnananacnnncnngnnntgnannannnnnnnacnnantnnnnngnnnggnnnngtnanggnngnancnccnttgcggnnnccngnngnagnnncncnggngnnnnnnngnngnnnnnnnnnnnnnnnnncnnnnnnnncnnnnnnnnnannnnnnngnnnnnnnnnnnngnnnnncccnnnnnnncnnncnnnncncnnnnnnnncnnnnnnnnnnnnnnnnnnnnnnnnnnggnnnnnnnnnnnnn

SEQ ID NO: 440 - DNA, 4000 bp, Escherichia coli
  misc_feature (3)..(51): n is a, c, g, or t
  misc_feature (53)..(60): n is a, c, g, or t
  misc_feature (62)..(69): n is a, c, g, or t
  misc_feature (71)..(82): n is a, c, g, or t
  misc_feature (84)..(97): n is a, c, g, or t
  misc_feature (99)..(99): n is a, c, g, or t
  misc_feature (101)..(217): n is a, c, g, or t
  misc_feature (219)..(241): n is a, c, g, or t
  misc_feature (243)..(246): n is a, c, g, or t
  misc_feature (248)..(260): n is a, c, g, or t
  misc_feature (262)..(264): n is a, c, g, or t
  misc_feature (266)..(316): n is a, c, g, or t
  misc_feature (318)..(357): n is a, c, g, or t
  misc_feature (359)..(417): n is a, c, g, or t
  misc_feature (419)..(421): n is a, c, g, or t
  misc_feature (423)..(509): n is a, c, g, or t
  misc_feature (511)..(536): n is a, c, g, or t
  misc_feature (538)..(551): n is a, c, g, or t
  misc_feature (553)..(560): n is a, c, g, or t
  misc_feature (562)..(568): n is a, c, g, or t
  misc_feature (570)..(580): n is a, c, g, or t
  misc_feature (582)..(609): n is a, c, g, or t
  misc_feature (611)..(612): n is a, c, g, or t
  misc_feature (614)..(649): n is a, c, g, or t
  misc_feature (651)..(665): n is a, c, g, or t
  misc_feature (667)..(672): n is a, c, g, or t
  misc_feature (674)..(690): n is a, c, g, or t
  misc_feature (692)..(702): n is a, c, g, or t
  misc_feature (704)..(722): n is a, c, g, or t
  misc_feature (724)..(727): n is a, c, g, or t
  misc_feature (729)..(729): n is a, c, g, or t
  misc_feature (731)..(733): n is a, c, g, or t
  misc_feature (735)..(739): n is a, c, g, or t
  misc_feature (741)..(741): n is a, c, g, or t
  misc_feature (743)..(773): n is a, c, g, or t
  misc_feature (775)..(815): n is a, c, g, or t
  misc_feature (817)..(837): n is a, c, g, or t
  misc_feature (839)..(840): n is a, c, g, or t
  misc_feature (843)..(913): n is a, c, g, or t
  misc_feature (915)..(938): n is a, c, g, or t
  misc_feature (940)..(950): n is a, c, g, or t
  misc_feature (952)..(963): n is a, c, g, or t
  misc_feature (965)..(981): n is a, c, g, or t
  misc_feature (983)..(984): n is a, c, g, or t
  misc_feature (986)..(986): n is a, c, g, or t
  misc_feature (988)..(1017): n is a, c, g, or t
  misc_feature (1019)..(1046): n is a, c, g, or t
  misc_feature (1048)..(1049): n is a, c, g, or t
  misc_feature (1052)..(1064): n is a, c, g, or t
  misc_feature (1066)..(1070): n is a, c, g, or t
  misc_feature (1072)..(1093): n is a, c, g, or t
  misc_feature (1095)..(1124): n is a, c, g, or t
  misc_feature (1126)..(1177): n is a, c, g, or t
  misc_feature (1179)..(1182): n is a, c, g, or t
  misc_feature (1184)..(1203): n is a, c, g, or t
  misc_feature (1205)..(1237): n is a, c, g, or t
  misc_feature (1239)..(1241): n is a, c, g, or t
  misc_feature (1243)..(1294): n is a, c, g, or t
  misc_feature (1296)..(1296): n is a, c, g, or t
  misc_feature (1298)..(1307): n is a, c, g, or t
  misc_feature (1309)..(1332): n is a, c, g, or t
  misc_feature (1334)..(1346): n is a, c, g, or t
  misc_feature (1348)..(1383): n is a, c, g, or t
  misc_feature (1385)..(1396): n is a, c, g, or t
  misc_feature (1398)..(1402): n is a, c, g, or t
  misc_feature (1404)..(1414): n is a, c, g, or t
  misc_feature (1416)..(1417): n is a, c, g, or t
  misc_feature (1419)..(1429): n is a, c, g, or t
  misc_feature (1432)..(1443): n is a, c, g, or t
  misc_feature (1445)..(1449): n is a, c, g, or t
  misc_feature (1452)..(1468): n is a, c, g, or t
  misc_feature (1470)..(1471): n is a, c, g, or t
  misc_feature (1474)..(1474): n is a, c, g, or t
  misc_feature (1476)..(1478): n is a, c, g, or t
  misc_feature (1485)..(1485): n is a, c, g, or t
  misc_feature (1487)..(1492): n is a, c, g, or t
  misc_feature (1496)..(1497): n is a, c, g, or t
  misc_feature (1499)..(1499): n is a, c, g, or t
  misc_feature (1507)..(1507): n is a, c, g, or t
  misc_feature (1509)..(1510): n is a, c, g, or t
  misc_feature (1512)..(1512): n is a, c, g, or t
  misc_feature (1525)..(1526): n is a, c, g, or t
  misc_feature (1529)..(1529): n is a, c, g, or t
  misc_feature (2237)..(2237): n is a, c, g, or t
  misc_feature (2240)..(2240): n is a, c, g, or t
  misc_feature (2246)..(2248): n is a, c, g, or t
  misc_feature (2251)..(2251): n is a, c, g, or t
  misc_feature (2253)..(2256): n is a, c, g, or t
  misc_feature (2258)..(2269): n is a, c, g, or t
  misc_feature (2272)..(2272): n is a, c, g, or t
  misc_feature (2274)..(2276): n is a, c, g, or t
  misc_feature (2278)..(2279): n is a, c, g, or t
  misc_feature (2282)..(2288): n is a, c, g, or t
  misc_feature (2290)..(2291): n is a, c, g, or t
  misc_feature (2293)..(2297): n is a, c, g, or t
  misc_feature (2299)..(2302): n is a, c, g, or t
  misc_feature (2304)..(2305): n is a, c, g, or t
  misc_feature (2308)..(2308): n is a, c, g, or t
  misc_feature (2310)..(2311): n is a, c, g, or t
  misc_feature (2313)..(2317): n is a, c, g, or t
  misc_feature (2323)..(2323): n is a, c, g, or t
  misc_feature (2325)..(2325): n is a, c, g, or t
  misc_feature (2327)..(2335): n is a, c, g, or t
  misc_feature (2338)..(2343): n is a, c, g, or t
  misc_feature (2345)..(2346): n is a, c, g, or t
  misc_feature (2348)..(2351): n is a, c, g, or t
  misc_feature (2355)..(2358): n is a, c, g, or t
  misc_feature (2360)..(2370): n is a, c, g, or t
  misc_feature (2372)..(2374): n is a, c, g, or t
  misc_feature (2376)..(2376): n is a, c, g, or t
  misc_feature (2378)..(2388): n is a, c, g, or t
  misc_feature (2390)..(2398): n is a, c, g, or t
  misc_feature (2403)..(2405): n is a, c, g, or t
  misc_feature (2407)..(2418): n is a, c, g, or t
  misc_feature (2420)..(2421): n is a, c, g, or t
  misc_feature (2424)..(2431): n is a, c, g, or t
  misc_feature (2433)..(2440): n is a, c, g, or t
  misc_feature (2442)..(2446): n is a, c, g, or t
  misc_feature (2448)..(2448): n is a, c, g, or t
  misc_feature (2450)..(2452): n is a, c, g, or t
  misc_feature (2454)..(2471): n is a, c, g, or t
  misc_feature (2473)..(2505): n is a, c, g, or t
  misc_feature (2508)..(2533): n is a, c, g, or t
  misc_feature (2535)..(2539): n is a, c, g, or t
  misc_feature (2541)..(2542): n is a, c, g, or t
  misc_feature (2544)..(2545): n is a, c, g, or t
  misc_feature (2547)..(2556): n is a, c, g, or t
  misc_feature (2558)..(2575): n is a, c, g, or t
  misc_feature (2577)..(2579): n is a, c, g, or t
  misc_feature (2581)..(2583): n is a, c, g, or t
  misc_feature (2585)..(2596): n is a, c, g, or t
  misc_feature (2599)..(2601): n is a, c, g, or t
  misc_feature (2603)..(2645): n is a, c, g, or t
  misc_feature (2647)..(2657): n is a, c, g, or t
  misc_feature (2660)..(2661): n is a, c, g, or t
  misc_feature (2663)..(2668): n is a, c, g, or t
  misc_feature (2670)..(2796): n is a, c, g, or t
  misc_feature (2798)..(2804): n is a, c, g, or t
  misc_feature (2806)..(2828): n is a, c, g, or t
  misc_feature (2830)..(2891): n is a, c, g, or t
  misc_feature (2893)..(2957): n is a, c, g, or t
  misc_feature (2959)..(2982): n is a, c, g, or t
  misc_feature (2984)..(2991): n is a, c, g, or t
  misc_feature (2993)..(3020): n is a, c, g, or t
  misc_feature (3022)..(3026): n is a, c, g, or t
  misc_feature (3028)..(3044): n is a, c, g, or t
  misc_feature (3046)..(3052): n is a, c, g, or t
  misc_feature (3054)..(3149): n is a, c, g, or t
  misc_feature (3151)..(3182): n is a, c, g, or t
  misc_feature (3184)..(3202): n is a, c, g, or t
  misc_feature (3204)..(3411): n is a, c, g, or t
  misc_feature (3413)..(3444): n is a, c, g, or t
  misc_feature (3446)..(3651): n is a, c, g, or t
  misc_feature (3653)..(3951): n is a, c, g, or t
  misc_feature (3953)..(3961): n is a, c, g, or t
  misc_feature (3963)..(3968): n is a, c, g, or t
  misc_feature (3970)..(4000): n is a, c, g, or t
atnnnnnnnnnnnnnnnnnnnnnnnnnnnnnnnnnnnnnnnnnnnnnnnnnannnnnnnntnnnnnnnntnnnnnnnnnnnntnnnnnnnnnnnnnntnannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntnnnnnnnnnnnnnnnnnnnnnnntnnnntnnnnnnnnnnnnntnnnannnnnnnnnnnnnnnnnnnnnnnnnnnnnnnnnnnnnnnnnnnnnnnnnnngnnnnnnnnnnnnnnnnnnnnnnnnnnnnnnnnnnnnnnnntnnnnnnnnnnnnnnnnnnnnnnnnnnnnnnnnnnnnnnnnnnnnnnnnnnnnnnnnnnntnnnannnnnnnnnnnnnnnnnnnnnnnnnnnnnnnnnnnnnnnnnnnnnnnnnnnnnnnnnnnnnnnnnnnnnnnnnnnnnnnnnnnnnnnannnnnnnnnnnnnnnnnnnnnnnnnntnnnnnnnnnnnnnnannnnnnnntnnnnnnnannnnnnnnnnnannnnnnnnnnnnnnnnnnnnnnnnnnnntnntnnnnnnnnnnnnnnnnnnnnnnnnnnnnnnnnnnnngnnnnnnnnnnnnnnntnnnnnnannnnnnnnnnnnnnnnntnnnnnnnnnnntnnnnnnnnnnnnnnnnnnnannnntntnnntnnnnntntnnnnnnnnnnnnnnnnnnnnnnnnnnnnnnnannnnnnnnnnnnnnnnnnnnnnnnnnnnnnnnnnnnnnnnnannnnnnnnnnnnnnnnnnnnngnnaannnnnnnnnnnnnnnnnnnnnnnnnnnnnnnnnnnnnnnnnnnnnnnnnnnnnnnnnnnnnnnnnnnnnnntnnnnnnnnnnnnnnnnnnnnnnnntnnnnnnnnnnngnnnnnnnnnnnnannnnnnnnnnnnnnnnnannanannnnnnnnnnnnnnnnnnnnnnnnnnnnnntnnnnnnnnnnnnnnnnnnnnnnnnnnnngnnaannnnnnnnnnnnnannnnntnnnnnnnnnnnnnnnnnnnnnnannnnnnnnnnnnnnnnnnnnnnnnnnnnnntnnnnnnnnnnnnnnnnnnnnnnnnnnnnnnnnnnnnnnnnnnnnnnnnnnnnannnntnnnnnnnnnnnnnnnnnnnntnnnnnnnnnnnnnnnnnnnnnnnnnnnnnnnnntnnntnnnnnnnnnnnnnnnnnnnnnnnnnnnnnnnnnnnnnnnnnnnnnnnnnnnntntnnnnnnnnnntnnnnnnnnnnnnnnnnnnnnnnnntnnnnnnnnnnnnntnnnnnnnnnnnnnnnnnnnnnnnnnnnnnnnnnnnnannnnnnnnnnnntnnnnntnnnnnnnnnnntnnannnnnnnnnnngannnnnnnnnnnntnnnnnatnnnnnnnnnnnnnnnnntnnagntnnnaaatatntnnnnnntagnnanatttttantnnanttattttcatagnnagntttaacccgcgtaatttttaccatttgcaaccacctgttttgttgcgttttaccaaatcaagacagattttatgaatggaatcattttgcatttgtggaattttatccaatgctaatacaatggaatctatacatacaaagtccgtatagctcatatctcctcttataattcctaatagaaataaatcacctgatattgacaaattatatacaggaaaagattctggatcatattctccactatttctgactttcaagtatttaaattctattaaacgacctattatcgtttttatcttataacttgaaatatcttctatatttagtttagaaaaataataacttaaactttcttttccttctttcttatctgctatcctcaaattaacaatctcttctatttttttataaatctcttctttacttaaaatagtatctttttgggtttctattttttcagaaaagacaataccttttttaggtgtattaaaacaacttaaaaaacatatacctattagtaagctatatagaaatattttctggatcataatcttttataattttaattacgtctatttttttacctaaatccgtaacacgagtttctactatttctgtattagtgtggggttcactattttcaggaatgacagtaattttatagagtttttctatttttttgaaaacaccatcggtttttacttttcnttnaaaaannnatnannnntnnnnnnnnnnnnacnannnannagnnnnnnntnngnnnnnannnngnnatntnntnnnnntataantntnnnnnnnnntcnnnnnnannannnntttnnnnannnnnnnnnnntnnntntnnnnnnnnnnnannnnnnnnnttatnnntnnnnnnnnnnnnannaannnnnnnntnnnnnnnnannnnntnannntnnnnnnnnnnnnnnnnnnannnnnnnnnnnnnnnnnnnnnnnnnnnnnnnnntannnnnnnnnnnnnnnnnnnnnnnnnntnnnnntnntnntnnnnnnnnnnannnnnnnnnnnnnnnnnntnnnannnannnnnnnnnnnnaannnannnnnnnnnnnnnnnnnnnnnnnnnnnnnnnnnnnnnnnnnnntnnnnnnnnnnnttnntnnnnnntnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntnnnnnnntnnnnnnnnnnnnnnnnnnnnnnnannnnnnnnnnnnnnnnnnnnnnnnnnnnnnnnnnnnnnnnnnnnnnnnnnnnnnnnnnnnnntnnnnnnnnnnnnnnnnnnnnnnnnnnnnnnnnnnnnnnnnnnnnnnnnnnnnnnnnnnnnnnnnntnnnnnnnnnnnnnnnnnnnnnnnntnnnnnnnntnnnnnnnnnnnnnnnnnnnnnnnnnnnntnnnnnannnnnnnnnnnnnnnnntnnnnnnnannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntnnnnnnnnnnnnnnnnnnnnnnnnnnnnnnnnannnnnnnnnnnnnnnnnnntnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntnnnnnnnnnnnnnnnnnnnnnnnnnnnnnnnntnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnannnnnnnnntnnnnnntnnnnnnnnnnnnnnnnnnnnnnnnnnnnnnn

SEQ ID NO: 441 - DNA, 4000 bp, Escherichia coli
  misc_feature (805)..(805): n is a, c, g, or t
  misc_feature (1066)..(1066): n is a, c, g, or t
  misc_feature (1072)..(1072): n is a, c, g, or t
  misc_feature (1279)..(1279): n is a, c, g, or t
  misc_feature (1364)..(1364): n is a, c, g, or t
  misc_feature (1513)..(1513): n is a, c, g, or t
  misc_feature (1590)..(1590): n is a, c, g, or t
  misc_feature (1989)..(1989): n is a, c, g, or t
  misc_feature (1991)..(1991): n is a, c, g, or t
  misc_feature (2002)..(2002): n is a, c, g, or t
  misc_feature (3024)..(3024): n is a, c, g, or t
  misc_feature (3354)..(3354): n is a, c, g, or t
aaacacgatgacaaacaccacaaggaaagtgtacatagccataaaaggcgtagagaacacatacgtttcaatcactccacctcgtgaaactcgtccttctgtgctttcgacgcgaccaagcgaaggttctatggtatgaactggagctgcagctttctcgacggaaagtggaccgactacagccttctcctcctcggtcgcttcacgctgcacgtcgggcttctgatcggctaaaaagctctttttgaactcgcatttggatccacctccatgcttcaatttgcaatggtactcaaagtgttccttgaacgtgtttggtgccaacttgccaggaattttcatcgcttcgtccaaaacatcctgaactaacttgccatccaaccttaaattcgccgccttacctttcgttaacgagagagagaccgcccagctgtataacatttctgtcacgtcaatttctgagtcatctgaataatgcgttgccgttttcctcgagacaaagagcggcggcgtagccagttggaaattttcatccaacttgacaccgtcagacaacaaacactcttcaaactccacgcacgtcatcgagcacacatcgatcttctcagtcggcgttcggtacgcacgtactaatctcttcattcctcgtcgacttatcaagtacgcctgcgtccctcgaagcgacctggaaccctttggcagcgtcggcaggctccagcccggcgagagccgcctcttgcgctgccagtcgaaaaataatttctcaaccgtctcggcagatcccgaggcggaaagctgagccacngtccaaccctctggcaagctatcgacgtagcttcctaacgtcttcgtccacgtcggcagcaaatctggcgtgacgccgtcttctaagatgagcgcaacctccgctcccgaatcaaaggctgtgtagatcgctcctaagtgcgacagagacgtccctaacgctcgtagatacctatcgctaaatctctgagccactttatcaccgtaatagctctcgggccagctctttcgactgcacgtactagtatctaaagtcttgcgnagagtngacgctctcgtggcgtccaccgtcaacaccctcgttaacttcccgaaagcggcgaacgatctctccatctcgaggctcgacgcgccatccgctctgctattcaaataataaacgtttgacatgagcttttcccgtccactcgcgctcacgctcggctcgcccgcggcgacgatccccgagaacaccaaaccgatcgcgcagcttaanaacatcatcgcgagcctgcctctcccgtcgcgctcacgcccgcgtcggcggtatctggcgttcgagcgcgctcgcgacgcgtccnacatgatacctccgccttcttgcggggtttcgtccgtcgtctcgtcccgatgtcgtcgcgctctgacgctcgcgcgacgcacgtgtcggcggctccgaattcggattcgtctttcgagtcttcacgaatgacgaatcattactcgtcancacgagcgtttggaaaagccaccagaaaacacggcttaggcggcagagttcgttacgcgttgacctcgtctcgtctngtctcgctcgctcgctcaccggggcgatggatgaggacgacgatctcacggacttctcgcgcacgatgtcgtcctcgggcccgtcgtcgtcgtcgtcgtcgtcggaatctggtgaggacgacgaggacagtcgcggacgaagggcagtatcggagcgtctcggtgagccagacatggagccagatatggacatcgacgagcttcgcgagcgacgctggaggttgcgatgggaaaagaattggctcggtaacgacgcctacgtggattggtacgcgggtttacccttgacagtgaagcagacgctcgaagtcaaggctgacttcgaacgtttccaagcgtgtgttcgcgttgcagaagaacgcgtgcggaactacagccgaggtgagcggtctggcctgngntggggggcggnagagggccagaaaggtaggaaatatgagcactttgcgacgaccaaagctggtgcccctccaatcgtgatgagtagcgattcaattcttcaggccctcggtggtttggttccgggagaaagattctacgctccggtccagcaagttgatgaattgactcgtcaatggccggcggatgtttccgagtattcaggaatagagtttccattgggatttcaggctacgcattcagaggatgcgctgagaggctttgttcgtcagcagcacctcgtaacatatgcgagaggtccagacgcaggtttctcattggaaggtctgcgcgaaggagaggatcccgagtggtgttttagaggcggagagctcgagatggtcgatgggaccacttttaaaacaggactcgtcgtcttcatgagagatcccacacgcctgatggacatggctgtcttggaaaaacgtgtctgtcttggaacaaagcacggcggcatcggcactctggttcagtggatagctagaaatgaagacggctcgcccacaagtttggaagataactaccccgcaccagcttgtcacgctaaaaatatgatcgagttccgagctattagcatagtttggtgcgagttaccatccggattcgatctgaaggccgctcagcaaacctatttcctgcacctcttgagatcaagaggagacaggtgctttgccgactgttggtacggcaaaaacataccagactggaagatatactctctagggatctattcgcgccaagattctcgggtgcgtgacagtcgtaaagtgatgactaagattttagaaaagcttcgcagtgttactcacaaatttacagaacacgtcctttggcctgagcagacgtgggaagaaactgaaaactcgctaccaaaatttgctctacatccatcaggcttttcatactgggtgctcaatcaaataccttgtttccattccaagttccgctggcttgtcatgtccgtagatgacacatgttcacgtctcaacctcattntggcgtatctgagtcttcaggaccgaatgcctcagaacaacattccagtgacacacatttgcggacacgttttgacttcaacgagaatgttgcgcccattctcgaacacgttcggtttccttacgtcacacagggaagaagatcatgtgttcccgccgaaagtgatgagtcgtatacttttcaatcccagcggcgactacggtcgatatagcatcgtggcatccgccccgatagacagaaatcacgcggcgcaaccggtcgacgcgtacgaaatgatgacgcaagacgctgcaactgacgtgttcgtgtttactaatcaagcgagtacgnactatacgtggtttgaaggctttggatgggacgcagttcaatgtcctcggtgtgcctggccagccggctttagattcacgccacaaccgcagtcttcggtcaattctgatgaaaacgcgcaacaggccaaattttggtgtctgcatgaaattgatgtcaactggggaggggctatcaagagcgaattgttcacattcctactcggtggcgataccatgaacaatggtttgtacctgccgcaccagttcgacgcggcgtcgcatgcacgtattttcggggcgagacatattacgctgaggcaccaagcttttcctacaggccaagttccttatttaccaacctagatcattttttcgtagttttagcgcagtcgagccacgcggaacacatctggcgcgcaacacgaggatttcgagcaatgcttagggtacacagctcgcgtcaactatccattttgtgaatcatctacgccgcacgcgcatcacacgttgcctcgtcacgcgctgcaaacgccccgggaggtagtacaagtgcgtcttaaatcaccccggtgctccctttcgcttggactggttcgaggcgcgcgtgctcatcgtctaaacgtcactcatgtcgctctctggcggcgttttggttggaacgtccc

SEQ ID NO: 442 - DNA, 4000 bp, Escherichia coli
  misc_feature (374)..(375): n is a, c, g, or t
  misc_feature (377)..(378): n is a, c, g, or t
  misc_feature (380)..(381): n is a, c, g, or t
  misc_feature (385)..(387): n is a, c, g, or t
  misc_feature (389)..(391): n is a, c, g, or t
  misc_feature (393)..(393): n is a, c, g, or t
  misc_feature (396)..(396): n is a, c, g, or t
  misc_feature (398)..(404): n is a, c, g, or t
  misc_feature (406)..(406): n is a, c, g, or t
  misc_feature (410)..(418): n is a, c, g, or t
  misc_feature (420)..(421): n is a, c, g, or t
  misc_feature (423)..(424): n is a, c, g, or t
  misc_feature (428)..(428): n is a, c, g, or t
  misc_feature (431)..(431): n is a, c, g, or t
  misc_feature (434)..(436): n is a, c, g, or t
  misc_feature (438)..(438): n is a, c, g, or t
  misc_feature (440)..(448): n is a, c, g, or t
  misc_feature (450)..(455): n is a, c, g, or t
  misc_feature (458)..(458): n is a, c, g, or t
  misc_feature (462)..(464): n is a, c, g, or t
  misc_feature (468)..(469): n is a, c, g, or t
  misc_feature (471)..(472): n is a, c, g, or t
  misc_feature (474)..(480): n is a, c, g, or t
  misc_feature (483)..(487): n is a, c, g, or t
  misc_feature (490)..(490): n is a, c, g, or t
  misc_feature (492)..(495): n is a, c, g, or t
  misc_feature (497)..(503): n is a, c, g, or t
  misc_feature (505)..(507): n is a, c, g, or t
  misc_feature (509)..(510): n is a, c, g, or t
  misc_feature (513)..(513): n is a, c, g, or t
  misc_feature (515)..(515): n is a, c, g, or t
  misc_feature (517)..(520): n is a, c, g, or t
  misc_feature (523)..(523): n is a, c, g, or t
  misc_feature (527)..(529): n is a, c, g, or t
  misc_feature (531)..(536): n is a, c, g, or t
  misc_feature (539)..(544): n is a, c, g, or t
  misc_feature (546)..(550): n is a, c, g, or t
  misc_feature (553)..(555): n is a, c, g, or t
  misc_feature (558)..(558): n is a, c, g, or t
  misc_feature (560)..(560): n is a, c, g, or t
  misc_feature (562)..(568): n is a, c, g, or t
  misc_feature (571)..(572): n is a, c, g, or t
  misc_feature (575)..(575): n is a, c, g, or t
  misc_feature (577)..(577): n is a, c, g, or t
  misc_feature (579)..(580): n is a, c, g, or t
  misc_feature (582)..(582): n is a, c, g, or t
  misc_feature (584)..(584): n is a, c, g, or t
  misc_feature (587)..(587): n is a, c, g, or t
  misc_feature (590)..(592): n is a, c, g, or t
  misc_feature (594)..(598): n is a, c, g, or t
  misc_feature (604)..(604): n is a, c, g, or t
  misc_feature (606)..(607): n is a, c, g, or t
  misc_feature (609)..(612): n is a, c, g, or t
  misc_feature (614)..(616): n is a, c, g, or t
  misc_feature (619)..(619): n is a, c, g, or t
  misc_feature (621)..(625): n is a, c, g, or t
  misc_feature (631)..(631): n is a, c, g, or t
  misc_feature (633)..(633): n is a, c, g, or t
  misc_feature (635)..(637): n is a, c, g, or t
  misc_feature (640)..(640): n is a, c, g, or t
  misc_feature (642)..(647): n is a, c, g, or t
  misc_feature (649)..(654): n is a, c, g, or t
  misc_feature (656)..(658): n is a, c, g, or t
  misc_feature (660)..(661): n is a, c, g, or t
  misc_feature (665)..(667): n is a, c, g, or t
  misc_feature (672)..(674): n is a, c, g, or t
  misc_feature (676)..(682): n is a, c, g, or t
  misc_feature (684)..(684): n is a, c, g, or t
  misc_feature (686)..(692): n is a, c, g, or t
  misc_feature (694)..(694): n is a, c, g, or t
  misc_feature (697)..(697): n is a, c, g, or t
  misc_feature (699)..(705): n is a, c, g, or t
  misc_feature (707)..(709): n is a, c, g, or t
  misc_feature (712)..(717): n is a, c, g, or t
  misc_feature (719)..(729): n is a, c, g, or t
  misc_feature (731)..(731): n is a, c, g, or t
  misc_feature (734)..(734): n is a, c, g, or t
  misc_feature (736)..(744): n is a, c, g, or t
  misc_feature (746)..(746): n is a, c, g, or t
  misc_feature (749)..(749): n is a, c, g, or t
  misc_feature (751)..(752): n is a, c, g, or t
  misc_feature (754)..(758): n is a, c, g, or t
  misc_feature (761)..(764): n is a, c, g, or t
  misc_feature (766)..(768): n is a, c, g, or t
  misc_feature (770)..(770): n is a, c, g, or t
  misc_feature (772)..(779): n is a, c, g, or t
  misc_feature (781)..(788): n is a, c, g, or t
  misc_feature (791)..(791): n is a, c, g, or t
  misc_feature (793)..(797): n is a, c, g, or t
  misc_feature (801)..(802): n is a, c, g, or t
  misc_feature (805)..(808): n is a, c, g, or t
  misc_feature (810)..(812): n is a, c, g, or t
  misc_feature (815)..(815): n is a, c, g, or t
  misc_feature (817)..(821): n is a, c, g, or t
  misc_feature (823)..(824): n is a, c, g, or t
  misc_feature (826)..(828): n is a, c, g, or t
  misc_feature (832)..(834): n is a, c, g, or t
  misc_feature (836)..(836): n is a, c, g, or t
  misc_feature (838)..(838): n is a, c, g, or t
  misc_feature (840)..(844): n is a, c, g, or t
  misc_feature (849)..(853): n is a, c, g, or t
  misc_feature (856)..(858): n is a, c, g, or t
  misc_feature (860)..(860): n is a, c, g, or t
  misc_feature (862)..(864): n is a, c, g, or t
  misc_feature (866)..(869): n is a, c, g, or t
  misc_feature (871)..(874): n is a, c, g, or t
  misc_feature (878)..(880): n is a, c, g, or t
  misc_feature (882)..(882): n is a, c, g, or t
  misc_feature (884)..(885): n is a, c, g, or t
  misc_feature (989)..(989): n is a, c, g, or t
  misc_feature (993)..(994): n is a, c, g, or t
  misc_feature (996)..(996): n is a, c, g, or t
  misc_feature (1005)..(1006): n is a, c, g, or t
  misc_feature (1009)..(1009): n is a, c, g, or t
  misc_feature (1013)..(1013): n is a, c, g, or t
  misc_feature (1015)..(1015): n is a, c, g, or t
  misc_feature (1019)..(1029): n is a, c, g, or t
  misc_feature (1031)..(1032): n is a, c, g, or t
  misc_feature (1034)..(1035): n is a, c, g, or t
  misc_feature (1037)..(1038): n is a, c, g, or t
  misc_feature (1040)..(1041): n is a, c, g, or t
  misc_feature (1043)..(1051): n is a, c, g, or t
  misc_feature (1053)..(1054): n is a, c, g, or t
  misc_feature (1056)..(1057): n is a, c, g, or t
  misc_feature (1059)..(1060): n is a, c, g, or t
  misc_feature (1062)..(1063): n is a, c, g, or t
  misc_feature (1065)..(1066): n is a, c, g, or t
  misc_feature (1068)..(1068): n is a, c, g, or t
  misc_feature (1072)..(1075): n is a, c, g, or t
  misc_feature (1080)..(1081): n is a, c, g, or t
  misc_feature (1083)..(1087): n is a, c, g, or t
  misc_feature (1089)..(1090): n is a, c, g, or t
  misc_feature (1092)..(1095): n is a, c, g, or t
  misc_feature (1097)..(1099): n is a, c, g, or t
  misc_feature (1101)..(1113): n is a, c, g, or t
  misc_feature (1115)..(1118): n is a, c, g, or t
  misc_feature (1120)..(1127): n is a, c, g, or t
  misc_feature (1129)..(1167): n is a, c, g, or t
  misc_feature (1169)..(1189): n is a, c, g, or t
  misc_feature (1191)..(1192): n is a, c, g, or t
  misc_feature (1194)..(1200): n is a, c, g, or t
  misc_feature (1202)..(1202): n is a, c, g, or t
  misc_feature (1205)..(1209): n is a, c, g, or t
  misc_feature (1211)..(1212): n is a, c, g, or t
  misc_feature (1214)..(1214): n is a, c, g, or t
  misc_feature (1217)..(1218): n is a, c, g, or t
  misc_feature (1221)..(1221): n is a, c, g, or t
  misc_feature (1223)..(1224): n is a, c, g, or t
  misc_feature (1226)..(1231): n is a, c, g, or t
  misc_feature (1233)..(1241): n is a, c, g, or t
  misc_feature (1244)..(1244): n is a, c, g, or t
  misc_feature (1247)..(1247): n is a, c, g, or t
  misc_feature (1250)..(1256): n is a, c, g, or t
  misc_feature (1258)..(1268): n is a, c, g, or t
  misc_feature (1270)..(1276): n is a, c, g, or t
  misc_feature (1278)..(1278): n is a, c, g, or t
  misc_feature (1281)..(1282): n is a, c, g, or t
  misc_feature (1284)..(1290): n is a, c, g, or t
  misc_feature (1292)..(1292): n is a, c, g, or t
  misc_feature (1294)..(1304): n is a, c, g, or t
  misc_feature (1306)..(1311): n is a, c, g, or t
  misc_feature (1314)..(1317): n is a, c, g, or t
  misc_feature (1319)..(1329): n is a, c, g, or t
  misc_feature (1332)..(1332): n is a, c, g, or t
  misc_feature (1335)..(1336): n is a, c, g, or t
  misc_feature (1342)..(1344): n is a, c, g, or t
  misc_feature (1348)..(1349): n is a, c, g, or t
  misc_feature (1352)..(1352): n is a, c, g, or t
  misc_feature (1355)..(1355): n is a, c, g, or t
  misc_feature (1357)..(1358): n is a, c, g, or t
  misc_feature (1362)..(1362): n is a, c, g, or t
  misc_feature (1365)..(1366): n is a, c, g, or t
  misc_feature (1368)..(1368): n is a, c, g, or t
  misc_feature (1371)..(1371): n is a, c, g, or t
  misc_feature (1373)..(1373): n is a, c, g, or t
  misc_feature (1375)..(1377): n is a, c, g, or t
  misc_feature (1381)..(1381): n is a, c, g, or t
  misc_feature (1383)..(1385): n is a, c, g, or t
  misc_feature (1387)..(1387): n is a, c, g, or t
  misc_feature (1389)..(1390): n is a, c, g, or t
  misc_feature (1394)..(1394): n is a, c, g, or t
  misc_feature (1397)..(1397): n is a, c, g, or t
  misc_feature (1400)..(1400): n is a, c, g, or t
  misc_feature (1406)..(1406): n is a, c, g, or t
  misc_feature (1412)..(1412): n is a, c, g, or t
  misc_feature (1417)..(1418): n is a, c, g, or t
  misc_feature (1422)..(1422): n is a, c, g, or t
  misc_feature (1424)..(1424): n is a, c, g, or t
  misc_feature (1429)..(1430): n is a, c, g, or t
  misc_feature (1432)..(1432): n is a, c, g, or t
  misc_feature (1446)..(1447): n is a, c, g, or t
  misc_feature (1449)..(1450): n is a, c, g, or t
  misc_feature (1454)..(1455): n is a, c, g, or t
  misc_feature (1457)..(1458): n is a, c, g, or t
  misc_feature (1462)..(1462): n is a, c, g, or t
  misc_feature (1464)..(1465): n is a, c, g, or t
  misc_feature (1467)..(1468): n is a, c, g, or t
  misc_feature (1470)..(1470): n is a, c, g, or t
  misc_feature (1472)..(1472): n is a, c, g, or t
  misc_feature (1474)..(1476): n is a, c, g, or t
  misc_feature (1478)..(1478): n is a, c, g, or t
  misc_feature (1480)..(1481): n is a, c, g, or t
  misc_feature (1484)..(1488): n is a, c, g, or t
  misc_feature (1490)..(1490): n is a, c, g, or t
  misc_feature (1492)..(1493): n is a, c, g, or t
  misc_feature (1495)..(1517): n is a, c, g, or t
  misc_feature (1519)..(1530): n is a, c, g, or t
  misc_feature (1536)..(1566): n is a, c, g, or t
  misc_feature (1568)..(1568): n is a, c, g, or t
  misc_feature (1571)..(1571): n is a, c, g, or t
  misc_feature (1574)..(1574): n is a, c, g, or t
  misc_feature (1576)..(1576): n is a, c, g, or t
  misc_feature (1578)..(1580): n is a, c, g, or t
  misc_feature (2000)..(2000): n is a, c, g, or t
  misc_feature (2005)..(2005): n is a, c, g, or t
ttaagcggtcgcgcaggacactcagtggcagacgcgcgaggcgtttcatcaacccaatcttgatagtatgtggtgcgccaactgcggacgagagcgcggagcgcgtaaagtatacagatttgcggatacctaagatgagggcgagagcacaccctacaaacacgccaagaaccaatccaagcgctaagatgaggtttcgcttaggttcagagggtgcgagagggggcgtggcatattcaaagactttgaaggtctcaggtttgtatccagcagtaagtgactgcgcttttacttgctcgatcatcacggtgtaagtggcttcggctattgttgcctcacgcgtcaggcgcgcaaattcttctacacttgccgcnntnncnnctgnnncnnntnccncnnnnnnnanttcnnnnnnnnngnncnnaagncgntcnnnangnnnnnnnnntnnnnnntcnacannntcannanncnnnnnnngcnnnnngcncnnnncnnnnnnngnnncnnttntncnnnngangcgnnngnnnnnnacnnnnnnannnnntgnnngtntngnnnnnnnagnnttntnanncntntcnctnnnannnnntgcagnanntnnnncnnntangnnnnntaggancntnnngancnnnnnnannnnnncnnnannctcnnnaagcnnntnnnnnnnantnnnnnnncnaancnnnnnnncnnntgnnnnnncnnnnnnnnnnncnganannnnnnnnngnctntnntnnnnntcnnnnannncnannnnnnnnannnnnnnnagntnnnnnaggnnttnnnngnnntcntnnnnntnntnnncttnnncnantnnnnncagtnnnnncannngntnnntnnnntnnnntgcnnnangnncaggatctgcatgagaaacggtgatggatagggcgcctgtatctgtgctctcgatactcacagatttcaagaaactacgaacaatattatcctctacaattgcncgtnnancacgttcannacnttcncnaccnnnnnnnnnnntnntnntnntnntnnnnnnnnnannannannannannantatnnnnattannannnnnannannnncnnncnnnnnnnnnnnnntnnnngnnnnnnnnannnnnnnnnnnnnnnnnnnnnnnnnnnnnnnnnnnnnnncnnnnnnnnnnnnnnnnnnnnntnntnnnnnnncngcnnnnncnncnagnnctncnngnnnnnnannnnnnnnnccnccnccnnnnnnngnnnnnnnnnnnannnnnnntnctnntnnnnnnntntnnnnnnnnnnngnnnnnnagnnnnannnnnnnnnnnatnatnntgatgnnnatgnnatnaanannatanacnncnaanangnnnaaangnnntngnngagntcnatntcatcntcatcntcgtnnttcncntgttnntnttaatttattaatnntnntagnngnngaanannannancntnnncntnntcnnnnncnannannnnnnnnnnnnnnnnnnnnnnntnnnnnnnnnnnnaaaaannnnnnnnnnnnnnnnnnnnnnnnnnnnnnncnacnacnantnnnttgttgttgttgttgttgttgttgttgttgttgttgttgccttctctgttgccgccacaaccgcggctactgccgcgacagcgactgcagcaactgctattgctgaaacagcgacacctccagcgacggcgccagctgccgctgcgccagctgcggccccggcacctgctgcacccgcgcctgctgctcctgcagcaccgccagctgcaccgccggccgcgccaccggctgccccgccagatgcaccacctgctgcgccaccagatgcaccgctgcttgctccacccgaagcaccacttcccgcacttccggaagagccggcttcttgggcgtacactggcattgcactcaaggccacgactgataatgttaacaataactttttcatagcaattcctgtttctatagagttgcaccttntctancgtttacctcggcttacgatttcaatcaagtctcactttgaaatgatatgatcatttttttgctatgagcgctaatttggagttaaacacacagaataaagcttatttgttgctgcttcggatgaccaaggattgctgaaaacaggcaatcgaaatgctgtaatttgaccaattttggtgggcgacttgtacaacggaaaattaaaatgttgtgcgcgaatcatttaccttgtttgctatgtagggaaaattataaacgttcagtatcaaatccgcggtatttttgctgcgtttggagtcgagattgtgttgaattataagagcctttttacagccgcgttgatttcgagccttgcttggtccgcaactgcgcagactgtgatcaaacaagatacattatctttcgaaggatgcttgaaagtaattgaaataacagcagaacaaatcggggcgccaccaaaagtaaaagtagattttgacaatcggcgcgtggcagaatttatggcgccagatgggacagtcgtgattgaatgtgatggagaaacagaacaggttacagtatccataaagtaagctcatattaaacgacgttttgtccaaagatctgtcattaacgaggatcaagcggatctatttacagtcgattgtatcgcttttgtcctgttgactacttgtgcatttgcagctccttaggaacgcaagccttatcgtatgaacatactatccggttttgatgtcttcgcggcaaattagagaatattaagcatcaacttgtcatgtgtccctgcccagcaatcagcaaatattattatttaaagaacatcgctatgccggcacgaggtgacaaatgttgttttcgaaatttgcattttgggattatttttgagtataacgaattcgaccctgtcgttcacgatttttagatctttcacaatatgtatcattgtgatacttaatttaactattaggttgaaaacacctgagtccgtaatgactttaatggaatatttctttatcaatcgctccacgcgccgtgtagtctcattcagcgtaacacaacattatggtcgcacattgaatgtagggaaaatttaaagataaaaaagcaaagctgatggatagtgtagtgtttcaattgattttaaagcgaactgcaataatgcgatgatagacgtctcaaccatacaaatgattgtgaagaatgtcgtctctgcgcaattgatgatcccatcgattgtgacattcctcatctgtattacaattacgctgttaacgcccgcgcttttcaaattggttcagcgtgaagatgacttaagtgcagtccaggcctctcacattaagccaacattgcgagttggcggactaggtattctgattggcctgctcgttgggctttttctgttaaagcttgatcgtgatttggtatcatttggatccatcatattagtaactgccattccactcgtacttgcagggtttgctgaggacatagggttgcatctgcgtccgtcctttcgcctcggtgcaatagcactttcttcacttttttgtgccgttttactacctaatgttataagtaagcttggtctgatttggttggatgatgcacttgggtattatcccgtagcgcttttgtttacaatttttgccgcgagcggtgtgaccaatgcctttaatcttattgacggattgaatggattggcgagcttcactgcgataacgacgtccgtcgccttggctgcaatcgcgaagatcgctggcttagaccatctacaatatttttatactctgctcaccattgttaccttcgggttctttttgttaaattacccttttggaaagctctttttaggggatggaggagcttatctgttaggtttctgtcttgtgtgggggggtattacacttgccaaccaggtcgcaggattaagtgcatttgccgtactccttattttcttctggccaattgcagacacttttcttgcgatatggcgg

SEQ ID NO: 443 - DNA, 4000 bp, Escherichia coli
  misc_feature (1985)..(1985): n is a, c, g, or t
  misc_feature (1991)..(1991): n is a, c, g, or t
  misc_feature (1999)..(1999): n is a, c, g, or t
  misc_feature (2012)..(2012): n is a, c, g, or t
  misc_feature (2023)..(2024): n is a, c, g, or t
  misc_feature (2026)..(2026): n is a, c, g, or t
gttgccctaataacagggttcacgaaagggcacatatatcgcctgacaagcgggcaaaaaatcccgcactacaagcccaacggacgtactctctatttcaagaaagaggaaatcgaagattggatgctgcaaaacaagatacaaacaaacaccgagattgaaagtgcagccaccacctacacagcaatcaacaaaaaaaagtgagttatggacgatagcctcaatacagcgaaagcccgcatccgggcagcctttgaatccggaatcaggatgacaacggcacagggaaaccgcatcggcaaaaccgtcgatttccgcaaaattgtatcgctcctcaaaagcgagggattcgacatacaaagctattggaacgaaaaggacgggcggcgttggaaaacctactaccaccaatacccgctgccgcagaaagggacacgcatgaatgaattggggcaatccaaactgcaattataaaccggctggggaggcgaggcggcattacgctaaggtggtgatttaagtgcgctcacggacttcgccacctctatttcgcaggttcgaaccctgcccccagcgcaagcaaagcccgaagctgtaagagggcaaaaaaaatcagcaattatgagtgacatcatcgaaatcaaacaggctgagatgctgcaagcaatcaaccgggcggaggtagatacccaaatcgccaccgcaaagcagtaccctcgtgatatttacggggcattgaacaacatcaagacaatcgccacgctcgacaattcgacggcagaagattgtttctatgccctgcgccgacaggggacactcatcgagggcgtatcggtacgcctcgcagagattatcgccggagcgtggggaaatatgcgggtacaaacccgtatcatcggcaacgacggcaagacgatcacggcacagggcgtatgccatgaccttgaaaccaatcttgccgtttcggtcgaagtgaaacgccgtatcacggacaaaagcggcaaaacctactcggaagatatgcaggttacaaccggcaacgcagcatcggcaatcgctttccgaaatgcagttctgaaagtagttcccaaagccgtaacaaaacgggtcatcgacgaaatcaaacaggttgcgctcggcaaagccatagacctcgaaacccgcaggcagaatatgattgcctacttcggcaaactgggtgtatcgcagacggacatcctcacctactgcggcgtgaaacgtatcgaggaaatcaccagcgaaatggtgttcgagttgagcggcttgaaaaacgccataaaggagggcacaacgaccgtagccgaaacattcaagcagaacaccgccgacgcagagaagttggccgaggacgcccgaaaacaagccgaggccaaacgccgcaaggtggcagaggctgccgccgcagctacggctgcaacacaaggtggcggacaaccctccgaaacatcggaggccgtgaatcccgaaacaggcgaagtaacaaaaaaataaccgctcgaaagagcataattcaatataacaatggataacgtagaaatcaaaaaatcgaatctcgaagcagcgtacaaacaagctgacgacaacacgaaaaaactgctcgccacattgttcggcgatgcggtaacaaccaaagacgaccgcccagtaacggagcgtatcaagacgttcgaggacgcaatggctgcactcgacagcaaccacccatttgtatgcgattcccgagcgttttgcgcccaatccgacaacatcagccctgatatgctggcgtatctcaaactccgcatcatctgcgctgccttaaacgagggctgggaaccacagtttacagaggatgagtggcggtattatccttggttttacctctacacacaggcggaactcgacgacatgggcaacggggaaaagcaggagcggcgaatgattgacaccgctgactatgtaactgaatatgcgggcttcggctntgcgtnttcggatnacgccccctcgtntacgaatgcgnncntcggctctcgcctttgcttgcggagcagcgacctcgccatttactgcggaaagcagttcatcaaattatgggctgatttcaacttaacccgcaaataaaaatatcagggagggattttcaccctccctattttcaaaacctcaaaattaacagaaatggatattcaaaacatcgtaaaagacctgcaaaagtggcaggaggaaaacaaagaaaaccggagcgtaatcattattacctctgaatgtatcgcaaaatccgagggggggggtaaacgcaccagcgcatctctcataggggttgttggttcagaagggatgctcgtgccctcccttgcaaatgccattacccaacactccgatttcatcgacctactccgtaaggccacaaaagttgcggcaatagatacaatttcccaaaccattaaagacgtaaattagtatgagcaatacagtaatacgacccaaagaccgagccgaatggctcgaataccgcaaagacggtatcggtagttccgaagtagcgacaatcctcggcctcaatccgtgggaaactccttaccagctatggagacgcaaaaaagggctggacgcccccaaagacgaaacctttgcgatgaaagccgggcattatctcgaagatgccgtatcgcagttttgggctgacgcaacaggccgagaggtcatcaaaagttcagccggagattggttgttcaagaacaacgaaaaagggttcttgcaagcctcccccgaccgtacttattggctggacggccaccgaaacccgaacaacaaagggatattggagtgtaaaacaacccaaatgtcaatcgaccccgacgacctgccgaagcattggttctgccaggttcaatacctgctcggagtttcggaatttaagcaaggttcgctggcttggctctgttccggccgagaattcgggtacaaggacatcgcatttgttccggacttcttcggatggatgattgaggaggttgaacgcttttgggttgataacatcatcggaaacgtggaaccggatgcgactaccgttacggacgttatcacgaaatacgcccgccatacggagggaaaaatcattgaggttagcgatgacatcctctcggcctgcaatcaactgaaagtggtaaaagcagaacttgccaaactcgaagccaccaaagaagaactcgaatcgaaaatcaaaatgggcttcggggatgcagaagccatcagttacggaggccaaaccctcgcaacgtggaaaacgtccaaagacagcgcaaaattcgatagcaaggctttcgggaaagtccaccccgaccttgcacaagagttcacgaagatagtaccgggcacacgccgatttatcctaaaatagagggaatgtatgcaatatcaaaccagcagcgagaggaaattatcaaacttctcgctgctttacaagacctgcccgacaaagataccaagactatcaatatcaaacgccgagcggtcatactgacaaggaagttgaacaataaaaagcagatagacaatgacaccaaatgattttttagggcaattatgggagtataaactgaacagttaaattttcttcgctcaaaatatgattgtattataatcattttattattttcgcaaaaccaaaagtaacagagtatgaataagaaagaacatagcactgtatatgggtgggagtggccgaaaggcctccctacgctcctgttatgcgtggtagccctaaatacggtgctttttaacactatacggctatgattacgttacgttccaatcaatcagagccgataaacaaggcgattgcattcttcaacgaaaagaagccgaaaccgagtttgatagtactccccacagcgtggggaaaatcaatccttactgctttcgttgcgaagaactgcacggataaattgctcgttttacagccctcaaaggagctgttggagcagaactacaaaaa

SEQ ID NO: 444 - DNA, 4000 bp, Escherichia coli
  misc_feature (460)..(460): n is a, c, g, or t
  misc_feature (3370)..(3370): n is a, c, g, or t
  misc_feature (3379)..(3379): n is a, c, g, or t
caatgttgacgtgtcccaagccgcccttaaaccggccaaacacacccacacaaaaatttaacaaacgctcgctgatcgagccggcattcataatgtttgccgcaacgataaacaatggcaccgccagcaatacaaaactgtcataaagaccgtaaattatttgctcaccagcgagtcccacatcttgaccaacaagggtcaaatacacaactgcacaagaaataatggcatagccaatcggcgtaccaatcgacgcgagcaggaacaatgttgtcagacacaatccaaaagccagactcatacaatgcctccagctgcgccaggatcactgagctcttgaccacgccaaagacgcagcaggcctcggccataaattgcaatgctagacagcataaacaccaaataaattgaaaagatataggctagaggaatgcgcaacgttccgctttttttaatctgnaagaacgacacgaaatcgtaagttctcgggaaagccaccaacattgtgacaataattgccagcgccgaaatggcagctaatttgcgacgggtcccgctactaacaatcaaataaatcatgtcaaagcggacatgctcgtcatggcgcaaacaaaatgaagaaccccaaaacacagtccaaagccacaaaataagacacagttctaacgtccatcccaatgggtagttaaaaacatagcgtgcagtaatctggacaacaaatgtcaaaaacagtgccgacagcattaaaacagccacatcgtcagcgcggcgttgcaaccaaatctgtaaatttttcatagctacacaaatgcaattacaaaaaacgcaacgggcactctgagcgcgttgcgttttttatttcaaaacgacggctttacagcgcgtttattttctcaagggcacctttttcccaagactttgacaggtcagatttcaagtaagccgcttgcacgacgcttctgaaagcatttaaatctggtgaataaaccttcaaaccttttgacttcatgaacgcttccaactcaccttcaagtttcaactgcttttgacgaccagattcggcagctgcatcagcggctttttgaacagtggcttgctgatcggctgtcagcttgttccagaccttctggctgatcgtgacgtaattcaaatcgaccaaatggttggtcaacacaatttgcttagtcacttcgtaaaatttagatttttgaaccgttggaagtgggttgtcttgaccgtcaacggcacctgtttgaagggctgtatacacctcaccaaaagccattggtacaggatttgcacctaacgctttacccaaaaattgccatgactctgaacccggcatgcgcagcttgatgcctgccatatctgccggggttttaatgacattgtcagttcgcaagttaagctgtcgacggcccagatacatgatggtcaggagttttacgcccaacttgtcttcaacagtttttttgtatgacttgaaaaaatctgaattgaatactgcaacttgatgagctgcatcgcggtgaacataacccgccgcgaacacaccaaattcaggaaaaaattctgccagctcttgtgcagaagcaatagacatatccaggttgccgcgggaaatagcttccagttcagttccctgcttgaacaacgacgcgttccaatgagggtcaaattcagcaaagctgctgacagctggagcaaaaatttccgttaaagcgatggcacgctcgtcgtttgcggacgcaggcgatgacagacgcagcttgatggtgtcagcagctagcgctgacccaccaaccgcaactaaagacagggcagccgctgcaccgataagactgcgacgaatttttgaaacaaacatgaaaaatctccttgataggtattagcgtgaccagcacccaatggtgcaacggttctaaatcctaacagtgttttagttcatgtactatttagtaaatgacattttcactaggtgtttaccactatttaaggcgttatagcatcttctatttgtgttttttgtaccgagtggtacataataaaaacaccatcagtcttgatgaaagtacagctatgaataagaagtccgaattgcctgatcagctgatgcaggcacatctagaaccgtttaaaaacacatccaaacgtgcagaagatgcacaacggaccaaagccgacatactcaaagctgccgcccatgagtttggtgagaaaggtctggcgggtgcccgcgtcgatgaaattgctgcggccacacgcaccagcaagcgaatgatctattactacttcgccagcaaagatggcttgtacttggccaccctagaagctgtataccgtgcggttagggagtctgaatctcagttgaatcttgatgcaatggcgccagaaactgcccttcgctgcctaaccgccgtgacgtttgatcaccatctcaacaacgaagactacattcgcatggtcatgtctgaaaacatcaaccgtggccggtacttagccaaaagcgcacacgtcaaagagctcaaccgtcctgccattaggctgttaacgcgcatttatgaaagaggcttaaaaaccaatatatttcgccctaatttagaccctgccgacattcatgcatccatctccgcattgtcgtttttcaatgtgtcaaaccaatacacgtttggactcatttttcagcaagacaaccgtgcaccagagtacatagcgaatcgacgcgaaaacgttgttcagatggtacttcgctacgtaatgttgtaacactatgcaacctacttcttacactacaaaccctccggtccgaatcgcagttgcaggcgctggctatataggacaggctcacataggggcgattcttaaaaacaacagctcaactttgagtgccattgttgacccaagtcctaacgccaaaatttatgcagccaacttgcaggtcccatacttcgaggatctagacgtgctgctgaaaagcaacttaacgcaacaacacaccgacgctgtgatcattgctacgcccaaccatctacatgcgcagcaagctttaacgtgcatgcgtatggacatgccagtgcttgtagaaaagcctgtgacacacgatctagcaagtgggcagcagttgcttgaagccttgaccatgtccaaggcgcccgttttggtagggcaccatagagcgcacagcgccattatgaaaaatgcacgggcaatggttcattctggccaactggggaaaatcgtcagtgttgttggcactgcctggttttttaaaccggatgactattttgaaagtagcccatggcgcaaaagcaaagcagcaggtcctttgctactgaacatgattcatgaggtgcacaacttgcgaatgctntgtggcgangtgacgcaagttcaagccatgaccagtcaagccacacgcggttttgaggtggaagatactgcaagcatcacaatgcgctttgacagcggtgtgctggcaagctttgcaatatcagacactgcagcaagcccaaaaagttgggaacaaaccagccaagaaaacccagcctacagcagctacccagaccaaaactgctattacattgcgggcacacatgctagcttggccatacccaccatgaccattcacagctatacaaatacacaacaacgatcttggtggaaaccatttcaagttagtgcgcaacctgccataacagatgacccaattgcaaaccaaatagatcacttcgtgcgcgttgtccgcgcagaagaaacgccgcttgtaagcctacatgacggacttgaaaacctcaaagttgtgcaagctatcgtagttgcggcgagccaagacattacggtacatatggccagttttaaccactcatctgcgatagcttgaaattcaaagaggcacaagtctccaaagtacgcacatgaaaaataactgacgcccaataattcttaccaaccatgtcttcaaaaagaccttctttctaggctgtgatggacatgagaacta

SEQ ID NO: 445 - DNA, 4000 bp, Escherichia coli
  misc_feature (258)..(258): n is a, c, g, or t
  misc_feature (263)..(263): n is a, c, g, or t
  misc_feature (265)..(265): n is a, c, g, or t
  misc_feature (269)..(269): n is a, c, g, or t
  misc_feature (275)..(277): n is a, c, g, or t
  misc_feature (280)..(283): n is a, c, g, or t
  misc_feature (286)..(287): n is a, c, g, or t
  misc_feature (289)..(289): n is a, c, g, or t
  misc_feature (292)..(293): n is a, c, g, or t
  misc_feature (295)..(295): n is a, c, g, or t
  misc_feature (297)..(297): n is a, c, g, or t
  misc_feature (300)..(300): n is a, c, g, or t
  misc_feature (303)..(303): n is a, c, g, or t
  misc_feature (305)..(306): n is a, c, g, or t
  misc_feature (308)..(314): n is a, c, g, or t
  misc_feature (317)..(322): n is a, c, g, or t
  misc_feature (326)..(332): n is a, c, g, or t
  misc_feature (334)..(334): n is a, c, g, or t
  misc_feature (336)..(340): n is a, c, g, or t
  misc_feature (342)..(343): n is a, c, g, or t
  misc_feature (345)..(347): n is a, c, g, or t
  misc_feature (349)..(351): n is a, c, g, or t
  misc_feature (353)..(353): n is a, c, g, or t
  misc_feature (355)..(355): n is a, c, g, or t
  misc_feature (357)..(357): n is a, c, g, or t
  misc_feature (359)..(362): n is a, c, g, or t
  misc_feature (366)..(366): n is a, c, g, or t
  misc_feature (368)..(368): n is a, c, g, or t
  misc_feature (370)..(370): n is a, c, g, or t
  misc_feature (372)..(374): n is a, c, g, or t
  misc_feature (376)..(378): n is a, c, g, or t
  misc_feature (380)..(384): n is a, c, g, or t
  misc_feature (391)..(391): n is a, c, g, or t
  misc_feature (393)..(393): n is a, c, g, or t
  misc_feature (395)..(395): n is a, c, g, or t
  misc_feature (397)..(403): n is a, c, g, or t
  misc_feature (407)..(408): n is a, c, g, or t
  misc_feature (410)..(410): n is a, c, g, or t
  misc_feature (412)..(413): n is a, c, g, or t
  misc_feature (415)..(415): n is a, c, g, or t
  misc_feature (417)..(418): n is a, c, g, or t
  misc_feature (420)..(420): n is a, c, g, or t
  misc_feature (422)..(424): n is a, c, g, or t
  misc_feature (426)..(435): n is a, c, g, or t
  misc_feature (437)..(441): n is a, c, g, or t
  misc_feature (444)..(446): n is a, c, g, or t
  misc_feature (449)..(449): n is a, c, g, or t
  misc_feature (451)..(453): n is a, c, g, or t
  misc_feature (455)..(455): n is a, c, g, or t
  misc_feature (458)..(460): n is a, c, g, or t
  misc_feature (462)..(463): n is a, c, g, or t
  misc_feature (466)..(468): n is a, c, g, or t
  misc_feature (470)..(473): n is a, c, g, or t
  misc_feature (478)..(480): n is a, c, g, or t
  misc_feature (482)..(486): n is a, c, g, or t
  misc_feature (489)..(489): n is a, c, g, or t
  misc_feature (491)..(491): n is a, c, g, or t
  misc_feature (493)..(498): n is a, c, g, or t
  misc_feature (500)..(500): n is a, c, g, or t
  misc_feature (502)..(502): n is a, c, g, or t
  misc_feature (504)..(505): n is a, c, g, or t
  misc_feature (507)..(507): n is a, c, g, or t
  misc_feature (514)..(514): n is a, c, g, or t
  misc_feature (516)..(516): n is a, c, g, or t
  misc_feature (519)..(519): n is a, c, g, or t
  misc_feature (521)..(521): n is a, c, g, or t
  misc_feature (523)..(527): n is a, c, g, or t
  misc_feature (529)..(534): n is a, c, g, or t
  misc_feature (536)..(538): n is a, c, g, or t
  misc_feature (542)..(543): n is a, c, g, or t
  misc_feature (546)..(546): n is a, c, g, or t
  misc_feature (550)..(555): n is a, c, g, or t
  misc_feature (558)..(561): n is a, c, g, or t
  misc_feature (563)..(565): n is a, c, g, or t
  misc_feature (570)..(571): n is a, c, g, or t
  misc_feature (574)..(574): n is a, c, g, or t
  misc_feature (576)..(580): n is a, c, g, or t
  misc_feature (582)..(584): n is a, c, g, or t
  misc_feature (587)..(587): n is a, c, g, or t
  misc_feature (590)..(590): n is a, c, g, or t
  misc_feature (593)..(593): n is a, c, g, or t
  misc_feature (595)..(595): n is a, c, g, or t
  misc_feature (598)..(598): n is a, c, g, or t
  misc_feature (600)..(600): n is a, c, g, or t
  misc_feature (603)..(605): n is a, c, g, or t
  misc_feature (607)..(607): n is a, c, g, or t
  misc_feature (611)..(611): n is a, c, g, or t
  misc_feature (615)..(618): n is a, c, g, or t
  misc_feature (620)..(624): n is a, c, g, or t
  misc_feature (626)..(627): n is a, c, g, or t
  misc_feature (631)..(631): n is a, c, g, or t
  misc_feature (633)..(633): n is a, c, g, or t
  misc_feature (635)..(636): n is a, c, g, or t
  misc_feature (638)..(639): n is a, c, g, or t
  misc_feature (641)..(643): n is a, c, g, or t
  misc_feature (645)..(646): n is a, c, g, or t
  misc_feature (648)..(648): n is a, c, g, or t
  misc_feature (650)..(655): n is a, c, g, or t
  misc_feature (660)..(660): n is a, c, g, or t
  misc_feature (665)..(666): n is a, c, g, or t
  misc_feature (668)..(670): n is a, c, g, or t
  misc_feature (672)..(672): n is a, c, g, or t
  misc_feature (674)..(675): n is a, c, g, or t
  misc_feature (681)..(681): n is a, c, g, or t
  misc_feature (685)..(685): n is a, c, g, or t
  misc_feature (687)..(687): n is a, c, g, or t
  misc_feature (689)..(689): n is a, c, g, or t
  misc_feature (692)..(695): n is a, c, g, or t
  misc_feature (700)..(702): n is a, c, g, or t
  misc_feature (856)..(856): n is a, c, g, or t
  misc_feature (1963)..(1963): n is a, c, g, or t
  misc_feature (1992)..(1992): n is a, c, g, or t
ccgcttggcctcgatcacctcggccaccagggtgatggcgtcggtgtgcaggcctggatctccgcccgcggccagccaggggagattggcggagttgccgcctgagcaccaggaaagccgccacatcgcgcaaagcctggtcggaggccgcctggccccagcgatgccgcacctggctgaagtggtcgagctgcaaagccagcagggccaggggctgaccgctcagacgggcgcgaccgatctccggctccgcttgcnccagnangctncttcgnnncannnngcnncnganngnangcncgntnncnnnnnnncgnnnnnngagnnnnnnngncnnnnntnngnnnannncntncngnnnncgcncntngnnncnnntnnnnnggcgagncnancnnnnnnngacnnananngngnngngnnngnnnnnnnnnngnnnnngcnnnggngnnncngcnnngnngcnnntnnnngggtnnngnnnnncgngngnnnnnntncngnngngtgggtncnggngngnnnnngnnnnnncnnnggtnncgncgcnnnnnntgnnnngnnngcaannggncnnnnncnnnggngtntcngnggngnccnnncngtgntggnnnngnnnnnannggcngncnncnncnnncnngnannnnnnggcgntcggnntnnncngnncggtgnaggncnancgnnnnagccnnnctaaatatgcgtcgccgggatgattcagcaccccgatgcgttccaggtcccgttgccgcagcgcttcgtccgcgggaatcggacagtcgggatacggtgtaaccgcgtgccgaggatctccagcctaggaaggttgatctcgccatgattgagngatcccgaatggctgcgatcccatgtccctctctcaggaagcctgcatcccctgcaccgaaggtgctcccaccctcagcgacaccgagcttgccgccctgctgctggagctgccgggttgggaggtgatcgaggcgcaccacctgcacaaggcctggacctttcccgattttcagcaggccctcgattgggtgaaccgtgctggcgcgatctgcgaggccgagggccatcacgccgagttcactctgggctggggccacgctgaagcgctggtgtacacccacaaggtggatggactcacccgcgccgatgcggtgctcgcagccaagttggatcaggcctaggtcgaggtgctcaggtcgaggtgctcaagtcgaggtgctggcacttagaccggttgggcggcgttcttcacataatcttccgtagagaacctgctgctccagcctcgatctgctccaaatctccatagggtccgcaaaacgtgtagttccgtcatggcttcccgggaggagctccactccagcggtgatctgtttgagccccgcagcttggagtggcaagacaacggtgagctggctgccagcgaagtctttgagctggtcaagcgtttgcgggcggtggaatctggcgagcacgtcaacgagttgtggcggctcagccagaagccctgaacccaacattgcagcgcccgcgctgcagatttgcgtgcattgaacaccgccagatcgcatcaaactgatgacagcgatggaaggaggatgtgttgtttctcaaattgcatgatgcaaacgacgagagcctggtggaggtgctcgatctgaagcacctgatggatccgtttgtcgccgatgtgctggtgcgtctccatgccggggaggagcttcaggaaccgggtcccgttcggaaggatcatctggtctttccctccggggaggtgctgccccgctgctggttgcagctcaacggccaggcctgaggccttccgcctttgggggagggcgccatcgtgttggcctggtttgctcccgctgacagcaaagccccgctgatcccctggcccgctgctcccggatcgtgatctgctgatacgcccgaccaaaagganggaagaccgacaaaattgccgcacctctnatcgatatgcgcagtggcgtgctcctcaggttttccgatgtccggtaacaaccttgatgcgagcgacctcaccctgcggcagttgcgccacctggccagcaacctcggcatcgggcgctacagccgcatgctcaaggagcagctgctgcgagcgatcgagcgtcaggcgccctctcccggcgagcctgggcagggcccggctgatctccgcgccctggaggcgggcatggctccggcccctcggccggaagcccagacctcggtggtctttctgccgcgtgatcctcaatgggcctatgtgttctgggagctgtctgattccgatcggcgtcaggcgatggccgacggagccaatcagttggtgttgcgcatcgccgatgtcaccggcctgggcgatggaggcacccatccccacaccatgcaggaagtggtggtcaacagccatgccaccgagtggtacctgccggttcccctgagtgaccgtgcctaccgggttgaactggggtatcgggatgcggggggtggttggcgctcgttggcgtattccgccgtggcccacgtgccctcgctccatcccagcgagctgatcctggatcaattcgtgcctttcacccttgaggctccggtgacggaggcagccgctgcgccgctgctgtccgaggccgcgccgggaattcacgaacgcgtttaccaggtggccacctccacctggcgggcgacgggccgcggttctgaggccttccatgagatggatgctttcgctgattccagccaggggctcaacgcctccggtgctggtgtttgggccagcggccgcactgcatcgggtgccggtggggtggcctcacgccagcgctccttctggctggttgccgatgccgaattgatcgtctacggcgctaccgatccctcggccaccctgcgcatcggcgaggagttggtgcccctcgccgaagacggcaccttccgcatccaggtgccgttccgcgatggacagcagctgtatccgatcacggcggtggcggccgatggcgaacagcgccgccacatcaccctcgacttcagccgctccacccccgacgccaacgtcaacacggtggaggacgcggtcgccgagtggttctgaggccctcagggcaccagattgacgagcttgcctggcaccacgatcacgcggctgggtggtttgccctccagccatttgctggcgatgtcactgtccagggccaggcgctccaaggtggccttgtcggcatcagcgggcacgtcgaggttgccccttaccttccccttcacctggatcaccagcgggatcgtgtcgcgcaccagggcgctggcatcggcacgcggccaggcctggtggtgcacgctcgtttggccatcgggattgccccccaaccgctgccagagctcctcggccaggtgcggcgcgaacggcgccagcagcacgagcagggcattcagggcttcggaggccacggccggggaagccgcctgcacgtgctcgcccatggcgttgctcagcttcatcagctctgagacggccgtattgaattgatagtcgccgtcgaggtcgtcgctgatctcggtgatcgcggtgtgaacggcgcggcgcagcgctttgtcttccgggctgagggtggagagatcgctctctacaccgtcggcgtccagtccaaggccccgcgccacggccccctccaccaggcgccagagccgctgcaggaagcggaactgaccctccacatcggcgtcatcccactcgagatccttctcgggcggcgccttgaacaggatgaacatgcgggcggtgtcggcgccgtacttgtcgatcaccacagccggatcaacgccgttgtacttcgacttcgacatcttttcgtagaaggtttccagcacctcgcccgtgatcggatcccggggatcgctgggatcggtcacatcggccggggcgatgtacttgccgctgtgggggttcttgtaggtgatgccttgcaccatgccctgg

SEQ ID NO: 446 - DNA, 4000 bp, Escherichia coli
  misc_feature (1)..(5): n is a, c, g, or t
  misc_feature (7)..(14): n is a, c, g, or t
  misc_feature (16)..(18): n is a, c, g, or t
  misc_feature (21)..(30): n is a, c, g, or t
  misc_feature (33)..(33): n is a, c, g, or t
  misc_feature (36)..(38): n is a, c, g, or t
  misc_feature (41)..(48): n is a, c, g, or t
  misc_feature (51)..(63): n is a, c, g, or t
  misc_feature (65)..(65): n is a, c, g, or t
  misc_feature (67)..(67): n is a, c, g, or t
  misc_feature (69)..(69): n is a, c, g, or t
  misc_feature (72)..(74): n is a, c, g, or t
  misc_feature (76)..(80): n is a, c, g, or t
  misc_feature (82)..(82): n is a, c, g, or t
  misc_feature (84)..(84): n is a, c, g, or t
  misc_feature (90)..(90): n is a, c, g, or t
  misc_feature (93)..(93): n is a, c, g, or t
  misc_feature (95)..(95): n is a, c, g, or t
  misc_feature (97)..(97): n is a, c, g, or t
  misc_feature (99)..(105): n is a, c, g, or t
  misc_feature (107)..(108): n is a, c, g, or t
  misc_feature (110)..(112): n is a, c, g, or t
  misc_feature (115)..(116): n is a, c, g, or t
  misc_feature (119)..(120): n is a, c, g, or t
  misc_feature (122)..(122): n is a, c, g, or t
  misc_feature (124)..(125): n is a, c, g, or t
  misc_feature (127)..(128): n is a, c, g, or t
  misc_feature (130)..(134): n is a, c, g, or t
  misc_feature (136)..(143): n is a, c, g, or t
  misc_feature (145)..(145): n is a, c, g, or t
  misc_feature (151)..(151): n is a, c, g, or t
  misc_feature (153)..(154): n is a, c, g, or t
  misc_feature (157)..(162): n is a, c, g, or t
  misc_feature (164)..(164): n is a, c, g, or t
  misc_feature (166)..(170): n is a, c, g, or t
  misc_feature (172)..(173): n is a, c, g, or t
  misc_feature (177)..(177): n is a, c, g, or t
  misc_feature (180)..(180): n is a, c, g, or t
  misc_feature (200)..(200): n is a, c, g, or t
  misc_feature (205)..(205): n is a, c, g, or t
  misc_feature (227)..(227): n is a, c, g, or t
  misc_feature (252)..(253): n is a, c, g, or t
  misc_feature (295)..(295): n is a, c, g, or t
  misc_feature (303)..(303): n is a, c, g, or t
  misc_feature (312)..(312): n is a, c, g, or t
  misc_feature (316)..(316): n is a, c, g, or t
  misc_feature (334)..(334): n is a, c, g, or t
  misc_feature (383)..(383): n is a, c, g, or t
  misc_feature (424)..(424): n is a, c, g, or t
  misc_feature (472)..(472): n is a, c, g, or t
  misc_feature (497)..(497): n is a, c, g, or t
  misc_feature (742)..(742): n is a, c, g, or t
  misc_feature (916)..(916): n is a, c, g, or t
  misc_feature (1474)..(1474): n is a, c, g, or t
  misc_feature (1546)..(1546): n is a, c, g, or t
  misc_feature (1732)..(1732): n is a, c, g, or t
  misc_feature (1765)..(1765): n is a, c, g, or t
  misc_feature (2006)..(2006): n is a, c, g, or t
  misc_feature (3223)..(3223): n is a, c, g, or t
nnnnngnnnnnnnngnnnggnnnnnnnnnnccntannnccnnnnnnnnctnnnnnnnnnnnnngncncnccnnncnnnnnangnaaaaanaanangntnnnnnnntnngnnnttnnaannanannanntnnnnntnnnnnnnntncccccntnnaannnnnnancnnnnnannaaanatntacaaaataaaaaagacgtnttcgntgtcttcgccctgagggttaangtccctcaggtcccttcccttcacnnctggacccctgtccagcctccgacgtcttctgcctcccaacnggggaggnctttttagngatngccccggtgttctggggnggtcccttgatcgtcaacacgatcttggcaccctcggtggtgttgggtnccttggcagcctgaatgaccttggctgccttggctgctttngcagccagcctcttccgcttccgtttctccgctggagtggctttgggnggatccagggcgagtcccgggattnccctcggcgtgccagtcgccaacttgcccctggttcccgtgggtccagacgcgcctcggctctgtgatgtctcgttggaagatgtcgataacttggccagcttatcctccaaacctgtggaggctggtttagttaccgactcttttccaacgacctccgcgtaagatattggctgttcggaagctgtaagtacttctggaggagggttgggagaaggctgagcagtgctcaagtgagcctgctcntaaacgaccaacttaccatctaccaagtgataaatttggccttctctcaaatctcctacaggcagggcaacagcgggtgtcatctccacatctgtgtccaaggactcaggtgtagagctgaccacagctgaacttgctagttcccgagctggagcttgaaccagaatttcttcnggttctgctgccagcttggaaactttgttagccaagcttttagccttgcgcttactgagtcgatcacgattcttctgctttttctttaaagaatcgtctaactcagcctcttcagacttgtcaatcaagtctaccatttcgccttcatggatgctttcaccaaagcgccggttatgataaaccaggctacggcgaaacctatccatagcggactggtagagatgagccttcctagtaagcctggcaaaagactcagtcctcttggcagcccgcaattgcacggcctgttcttgaggactaagtttgccaaccttaataggcaaactgacagcttttgctgaacctgctttgggctgtgacccagaagcaacttcagccacctttctcttcttagagtcagacggagctgacttctttgaaggagcagatggtttgggctgtccttgactagcgctaatagcttgattaccctggtaattgtattgtacctgagggggtggggccattggaggagcgccccacaccggtccataaggcccatagtaaggcatcctccanggctccggaggaccccagtatgctgggtttgtggcccatggacgcccgtaggtccaaggaccgctcttttgncctcgccccttctgcggataggattgttggtccgacatctggaatgttttgaaaaagccaacattagaaactgagaataagtttcccgtagttgccttgtagcaagcaacttctctaacttattctaattgttcacagattttgaaaaatggcttacacaaatttcatctcttcctgttatggcangctcgctttttgcacaaggcaaaaatgctagantgaacacacaggaacttagaaagctagagccttgcctatggcgcgaacgccaaagctctagctttgcagtattttaaagtaaaataacaatgcaaagatgaaattcattttattagatccaacaatcattaggaagttatgttttctctaatcgttattcagcgggttacaattagctacttcagcagagcccctaaataacttttgattaagtggtattagattcacaatgggtctaagntactgacccttgctattacggattgtgactttgcgaactttagagtcatcagaaggatgaatttgctcaacaatagctagcttccagcaacctcttggctgggtggaatcaacttccacaactaaatctccctctgccaattgtgtgtgttctacttgccacttcttggtgttcctaagctccaataaagttttgttcaagaagatactccaaaattggtctaaaacttcgcaaactctatgccacctttgggaatgtgaggtaaaagtttcagtagttacgctaccaccaagattaccaaaaagaaagtgatttggggtaaggatgatatccccctcactaagtgaaagtctactcagtggtctactgtttactaaatttgccactttgtaagctacagtccgaaattcatccacagttaggtctgaatagtggcacagactttccagagctcttttagctactcctaccatacgttcatatacacccccatggtgaggtcccctgggtgggataaagtaccaatgaactttggctttagtagtagagatgagatcatttaactgtattgttcttacccagctttctaagtccttatctttagatacgaaagtcgagaaattgtcagaaagaatggacatcggcatacccctaatatcgacaaaccttgatatcgcattaagagttgcagacatcgacattgcctctgtcaactccaagtgaactgctcgagtctggagacaagtaaatagaagtaagtaagttttcggtttagctttacctctacctgctgcttttaattcaaaaggaccagcaaaatctaagccacactgagcaaacgcccttaaaggtttctgaaagcgccaactaggtagcgctgacatctgttgcttcagcggaattgctaaatatctctgacaggtgagacatttcgatcttactgttttaagaaagttttctaaacctaacatcacgtagcctttgcttatttctgacttgcaacagtcattccctactgtatgtgcaaacttaaaatgaaaagagcatatcatgagttgagtaaaaggatcttgtctatcaaggatagcaggaaatcttacctcgtagtctaagtagtcaacctttgctagcctactttttgaccttaaaatacctgctttgtctatgaatggcaagaaacttctatagggtttagaaattgacttttctgtccttanttgatgcataatttcttgaagagccagactattagcttgtgaccttcttattagaaatcttagagctactttgctagccttaggataatccctcctagggtttgctagcttaaagacttcagttgccaaacttataagtcggtcaaagccatcccagactttccctacactatatctgcatggatctaatagactaagttgagctatgtctatattgccaatgaacagtttcttaaactcatttttagcttcatcatctacttcagtaggtggaacaaatggcttaggccaacttgtcatggaatcagacaagaagcgtggcccattccaccaaagagaactttccgctaaatcagagatttttggtagtctagttgggatatctgctggattcatatcagttggaatatgcttccattgacttggattgctatgcgtatggacttctcctactctattagaaacaaatgtttttaagttgctggatggggaatttatccagtacaaacaatttgtggaatcagtccaaaatgtaatagtgcttttatctaagtccaaagcattcgcaactgtcagaccaagtcttgtgccaatgacacatgctgctagttcaagtctactaacagattctgtcttagttggcgttactctagctttcgctgtaatgagtgttactgcaatacaatgattctgattttccccccttgcagtgacaccattatcaagatcattagcttctggtttctctaaaattcgtgcatagactgtagctgcaaa

SEQ ID NO: 447 - DNA, 4000 bp, Escherichia coli
  misc_feature (1032)..(1032): n is a, c, g, or t
  misc_feature (2723)..(2723): n is a, c, g, or t
  misc_feature (2768)..(2768): n is a, c, g, or t
gtgttttcgcgccatgccacaaccgtaactttgtgcctattcgataacgcggggatcgaggttcgccagattgctttgcctgaaagacaaggtcatgtctggcatggttacatccccggacttagaaaggggcagcagtacggtttccggatggacggcccgtataagccagagcaaggtcacaggttcaatcataacaaactgctgattgatccctatgctaagcaactgaccgggcaccccacgtggaatgatgcgttgttcagttatcaaccgggccacaagaacaaagacctcagtttcaacaaacaggacagtggaccatatatgccgcgtagcgtggttgttgatccgtatttcgattgggggacagtgacggccccgggtcatcatttgaaagacaccatagtttacgaggctcatgtcaaagggttgaccgcagggcatccacggattccaaatcctggaacctatgcggccatggcgtctgatccaatgttggaacacctgaacaaattgggaattacggcggtggagctgttgcctgttcaggctttcatgaacgacaagtttttactggatcgagggctcacgaattactgggggtacatgacttacggcttttttgcccctgacccgcgttacatgaaggggggcgatattgctgagtttcagcaaatggtccgccgttttcattctgctgatatcgaagtcattctggacgtcgtttacaaccatactgccgaagggtccgaactgggtccgacgctgatgttccgtggtttggacaatgccagctattaccgcctacacgaaaacccgcgctactatactgatgattccggttgcgggaacacgctggattttgaaaacccgtttgtcatccgtcttgtgatggacagcttgcggtactgggtcgaagtcatgaaggtcgatggtttccggtttgatttgtgttccaccctgggacgcaccgcacgcgggtttgaacgcgatggcccgttttttcgtgccatcgggcaggaccctgtnctcaacaaggtcaagttgattgctgaaccgtgggacattggtccgggcgggtatcaattgggggcctatccgtcgccgtttttggaatggaatgataaataccgcgacgacacccgagaattttggcgcaggggcagtggtacgtttacgcgtatggctgaacgtttggtaggatctgcaccctattttgaccatgatgggcggcgcgcgaacagttcattgaactttgtgactgctcacgatggattcacgctgcaagatacggtcagctataatagcaaacataatctggccaacggcgaagacaaccgcgatggccattccaacaaccagtcggacaatatgggcgttgaaggaccgactgatgatcccgccatccgtgcggcccgtcaacagcgcaagcgaaacctgatcacgacacttatgctgtcgcaaggcacgccgatgatcttggccggtgacgagttggggaattcgcagcagggtaacaataatgcctattgccaggacaatgaaatcggctgggttgattggtcgggcatcgacaaagattttttggagttctgccagcaggctattgttttacgcaagtcacacccgatcctgcgccagacgcggttcctgcattcacgtcaacgcaaatatgatggagaatccgatctgttctggcgacgcgctgatggaaaactaatgcagcaatcagattgggacaattctgatctaggaactttgattgcggaactccgcaccgctgcaggatcgccgacttacgtaaatcgccaacgtgcattgctggtcgttctgaaccgtggccctgcggttgaagtgatcctgccgggtttgcgtgaaggggatatctggacgcgtagttttgatactgcgcacaatcagtccttagacggcacgtatattgatgcggacagcgttgtcgtgtttaccaatgaggccgacgctatataaagcaaaattcacccttgaccaacggagattacaccatgccaatgcaaactgttcgaacgactcccattgaaggtcagaaacccggaactagtggattgcgtaaaaagacggcggtgttccgattgcctcattttctggaaaattatgttcaatcaatttttgatggaataggtgggatcgaaggaaagacgttggtcgtgggcggtgatggtcgcttctttaacgacgatgcgatccagatcattttgcggatggcatcggccaatggggccgttcggtgtattgttgggcaagacggcatcctttctacacccgcggcgtctcatttgatccgcctgctggaatctgacggtgggctaatcctatcggccagtcacaatcctggcgggccagacgcagacttcgggttaaagtataatggcaaaaatggcggaccagcgtcggaggccataacggacaagattttcgcccgaacccaaacgatagattgttacaagatcgtcgccgcggacaatatcgacctgtcaacgcttggcacgcttcatatcgaaggcatggcggtggacatcgtcgaccctgtttccgattatgcagccttgatggaaacgatttttgatttcgataaaattcgcgcgttgttcgcgggtgggtttaccatgtgctttgatgcaatgcatgccgtcactggaccttatgcgcatactattctggaagacatgttgggggcaganaaaggaactgtaatcaatggtttgcctcgttctgatttcggcaanggtcatcctgatcccaacccaatttgggcaaaggaactgatggacacaatgtatagtggggctgccccagattttggggcagcgtccgatggggatggcgatcgcaatatgatcgtgggacctggcacctatattacaccgtctgatagcttggcactgttgactttcaaggcgcatttggcccctgcttatcgagccgggttatcgggcgtggcgcgatccatgcccacatcgcgcgctgtagatcgtgtggccgaagggctaggcattccctgttttgaaacacccaccggttggaaattttttggaaatctgttagatgcaggcaaggtcacactgtgtggcgaagaaagtgcaggcaccgggtctgatcacgttcgtgaaaaagacgggctgtgggctgtgctactttggctgaacattttggcagaaacaaagacatctgtggccggtttgatgacggatttgtgggcgacgtacggacgttgttattattcccgtttggattatgaaaatgtggatagcgataaagccacgcagttattcggctctctgcgagcaaaacttgacggtttatcgggtcaaaactttggtgaccttgaagtcgaaaatgcagacgagtttgaatatttggatcctgtggacggatcaacgtcagccggccaaggctttcgcgtttcatttatcgggcagtcgcgcgcggtgttccgtttgtctggtaccggaaccagtggtgctacaatccgcatttatctggaacagctgcaaacggatgcaaatcacctggatgatgatccgacgcaggtgctgcacccggttcgggatgcagctttggaactgtcagatctggcggcaatcaccggccgcacgaaacccgatgtgataacgtgacctaaataaccgccatgtcactgtgggtcagataagcaaacccgttgccatccaaagttaggatggaactatcgatggatgcgcttgacccacagatgatatcagccgcaccaatcaaggaaatggtgtgcttgtctttggacaggttgaagacacaggtgatatgttcagcaccctgcgtacgggtgaatgccaacaagggttccgccaacgcgataaaacgcgtcgaaccatgcgagagaacagagctgtttttgcgaaacgcaatcatggatttgtagaatgccataatcccgtcatcgggttgttgtttaactgcatttgcggtttgcggtggcttt

SEQ ID NO: 448 - DNA, 4000 bp, Escherichia coli
  misc_feature (74)..(74): n is a, c, g, or t
  misc_feature (146)..(146): n is a, c, g, or t
  misc_feature (257)..(257): n is a, c, g, or t
  misc_feature (386)..(386): n is a, c, g, or t
  misc_feature (389)..(389): n is a, c, g, or t
  misc_feature (404)..(404): n is a, c, g, or t
  misc_feature (644)..(644): n is a, c, g, or t
  misc_feature (842)..(842): n is a, c, g, or t
  misc_feature (884)..(884): n is a, c, g, or t
  misc_feature (1234)..(1234): n is a, c, g, or t
  misc_feature (1258)..(1258): n is a, c, g, or t
  misc_feature (1297)..(1297): n is a, c, g, or t
  misc_feature (1432)..(1432): n is a, c, g, or t
  misc_feature (2403)..(2403): n is a, c, g, or t
  misc_feature (2555)..(2555): n is a, c, g, or t
  misc_feature (2777)..(2777): n is a, c, g, or t
  misc_feature (2982)..(2982): n is a, c, g, or t
  misc_feature (3179)..(3179): n is a, c, g, or t
  misc_feature (3279)..(3279): n is a, c, g, or t
  misc_feature (3293)..(3293): n is a, c, g, or t
  misc_feature (3380)..(3380): n is a, c, g, or t
  misc_feature (3425)..(3425): n is a, c, g, or t
  misc_feature (3530)..(3530): n is a, c, g, or t
  misc_feature (3623)..(3623): n is a, c, g, or t
  misc_feature (3725)..(3725): n is a, c, g, or t
  misc_feature (3851)..(3851): n is a, c, g, or t
  misc_feature (3905)..(3905): n is a, c, g, or t
  misc_feature (3974)..(3974): n is a, c, g, or t
acttgggtactgctaacaccctaattatccataatgatagggtagtagtggatagtccttctattgtagctttngatagaagcactaaaaaaattatagctgtgggacaagaagcgcgccttatgcaggggaaaacacaccccagnattagcactattcgtccgctaaaagacggggttatcgccgatttcgacgcttctgagcaaatgattagtatgctcatcaagagtattcctgcgcttaaaaagcgtttcttntcgccttcactccgtatggtggtgtgtattccttcgggcattaccgaggtagaaacacgtgcggtacgcgagtcgtgcgaacgcgtaaacggaaaagatatttacttagtacacgaacctatggcagcngcnataggtattgggctngacattatgcagcctaaaggtaatatgattatagatataggagggggtactactgaaattgctgttattgcacttggcggtatcgtttgcgataagtcggtgaagatagcaggggatattttcaactctgatatagtgcattatatgcgtacccaacacaacctatatgtgggcgaaagtactgccgaaaacatcaaaataacagtaggggcagccatcgaagacctcgattcgccaccngaagatattatggtgcaaggtcgcgacctgctaaccggcaaacctaagcaggtacaggtatcgtaccgcgaaatggtgaaagccttagacaagtcgattttgcgtatagaagacgctattatggaaacgctttcgcaaacgcctcctgagcttgctgccgacatctataacaccggtatctatatggcaggcggtggngcgatgctacgcggtttagacaagcgtatttcgcttaaaacngatttgcctgtatatgttgccgaagacccattgcgcgcagtagtacgcggtacgggtatcaccctaaagaatattaataaatttaagagtatattgcttaaatagtgaatcaaatcatacagttctttattcgttcgagggacttcttactgtttttgctactctttgggctgtctattagcttagtattcaaaagtaattactattcgcagagtgcttatctgcattcggctaatgctattagtggcaaactgtacggcttttctaactattgggcgcagtatttcaacctcagaagccaaaacgagttgctcagcgaggaaaatcgcacccttcgcaaagagttattncagctacagcagcaggtcagcagnttatctcataccgattcgcttacctttgctcacgctganactttgcgcttcaaggtgcttactgccaatgtgataaagaatagcttcagattgcacaaaaactatttaacgatagacaaaggtagcaatgacggagtgaagcaagatatgggggtagtgtcgccacaagggatngtggggatagtagagaatacctcagggcgatttgctaccgtgcagagtgtgctaaacactaaatcagcccttaatgcgatgataaaacgcacccgccatttcggttcgctacattgggatgcccaatcattgaataaagtgcagctattggaagtgcctaatattgcgcctatacaatacggcgatactatagtaactgggggaatgtctaacatcttccctaaagggatacctattggcaaaatagtacattatcagaaaagtcagcacgataatacttacattatcgatgtacagctttttaccgatatgtctaacctcgactacgtatatatcatagaagataccgaccgtactgccgtaaaggcaattgaaaaacaagacagcaaatgaatcaccctatagtaaaaaatacatttctctttgtagtattggtattgttgcaggtgcttatttttaacaatgtagcttattgggggtatgtaaacccgatgatttacatcgtttacctattggcagccccttatagagagaatagggtaccctatctgctgacggcatttttgttggggctctgtatagatatgttttctaatacaggcggcttgcacgctgccagtagtgtgtttatagcttattggcgctcgcctatcttgcaccttgtgtttggcaagaattttgagtaccaagagttagaccttttggcctatccgtttaccaaagtgtttagttataccactctgatggtggtgttacaccacatattattctattttttagagattttcaactttaatcacgtactgattacccttgtaaaaatcatttgtgcctcagtattcaccatcattgtttgtttgctatacatttatctgtttagtaaaagtaaaaaatgagaaaatttctgttgccattcatcatattatttacaaccattgtgataatcttgcgcttattcttcttgcaagtgntttatcacgatgagaatacttctggtatcgacaatatcgctatcgaaacggtatacgactatcccgaacgcggctatatatacgaccgcaatggcgaattgctggtctctaatcagcctgcttatgacgtgatggtgatacccagtgaggtnaagaacttagataccctcgaactttgcagcttattagaactctctaaagctgatttcaccgaaaaactacagaaagccaaagattattcgcgcaaaaaaccatcagtaatagtgcatcagctctctaacaccgactatgcagtgctacaagagaagatgcgcaaattcgagggtttttatatacaaaagcgaatgctgcgcagctatctgacccataacgcnggtaatgtgttgggctacatcagcgaggtaaacgagtgggaactgaagaagaacccttattatctggcgggagagctcattgggcgcagtggggtagagaagcagtacgaagagtttttgcgcggcaaaaaaggggtacaatacttccaaaaagacaaacacaatgcggcgatagagcgttataaaaatggagcgctcgacaccntgcctattatggggcaaccgctacaactgaccatagacattgggctacaggcttatggcgaactgctgatgcagcacaagcacggcggtatagtagctatcgagcctaagacgggcgagatactcgctttggtatcggcgccttcttttgaccccagtctgttggtagggcgcgaccgctctaagaactacacggcnctctataacgactctataggcaagcctttatacgaccgcacgctattggcgcagtacccccctgggtcgccttttaaggtggtcaatgctcttatagggntgcaagagggggtnattactcctcagagcgttttcagttgcggtgggggctatcgctatggggggcatataatgcgttgccactgcgggcgcggttcgaangacctgctatacggtattgccctatcgtgcaacgcctattttgcnaatacttataagcgggctatcgatatgaaaacttcttcggaagtgggaatggaaaaatggactgcccacgtgaagagttttgggctcggtaacttcttaggttcngatttgcctacaggtacccctgggaaggtgcccgacatcaacctctacaacaaacaatacggcaaagggcggtggaatggcacttctaacatntctaacgctattgggcagggcgagatactcaccacccctatacagcttgccaatgtaatggcagccatagctaataagggctattactacacccctcacatngtgaagaagatagacaataaggtaactccttttaaggaatacactgagcctaaacatactaccatcgaccctaaacattttgaccctatcatcagaggaatgaatatggcgtacttagccggtacngcacggcgtacccagatagatggcataaatattgcggctaaaacagggacggcngagaactttatcagggtaaatggcaagcgtatgcagctaaccgaccactctatatttgtagctttggcncctgtagaagaccctaagatagccat

SEQ ID NO: 449 - DNA, 4000 bp, Escherichia coli
  misc_feature (1989)..(1989): n is a, c, g, or t
  misc_feature (1996)..(1996): n is a, c, g, or t
  misc_feature (2845)..(2848): n is a, c, g, or t
  misc_feature (2850)..(2851): n is a, c, g, or t
  misc_feature (2853)..(2853): n is a, c, g, or t
  misc_feature (2857)..(2857): n is a, c, g, or t
  misc_feature (2859)..(2861): n is a, c, g, or t
  misc_feature (2864)..(2864): n is a, c, g, or t
  misc_feature (2866)..(2866): n is a, c, g, or t
  misc_feature (2873)..(2874): n is a, c, g, or t
  misc_feature (2876)..(2876): n is a, c, g, or t
  misc_feature (2879)..(2879): n is a, c, g, or t
  misc_feature (2881)..(2881): n is a, c, g, or t
  misc_feature (2883)..(2884): n is a, c, g, or t
  misc_feature (2889)..(2890): n is a, c, g, or t
  misc_feature (2892)..(2892): n is a, c, g, or t
  misc_feature (2896)..(2899): n is a, c, g, or t
  misc_feature (2902)..(2903): n is a, c, g, or t
  misc_feature (2953)..(2953): n is a, c, g, or t
  misc_feature (2955)..(2966): n is a, c, g, or t
  misc_feature (2968)..(2970): n is a, c, g, or t
  misc_feature (2975)..(2979): n is a, c, g, or t
  misc_feature (2981)..(2990): n is a, c, g, or t
  misc_feature (2992)..(2992): n is a, c, g, or t
  misc_feature (2995)..(2995): n is a, c, g, or t
  misc_feature (2997)..(3002): n is a, c, g, or t
  misc_feature (3005)..(3006): n is a, c, g, or t
  misc_feature (3009)..(3009): n is a, c, g, or t
  misc_feature (3011)..(3014): n is a, c, g, or t
  misc_feature (3016)..(3016): n is a, c, g, or t
  misc_feature (3018)..(3019): n is a, c, g, or t
  misc_feature (3021)..(3022): n is a, c, g, or t
  misc_feature (3024)..(3027): n is a, c, g, or t
  misc_feature (3029)..(3031): n is a, c, g, or t
  misc_feature (3033)..(3036): n is a, c, g, or t
  misc_feature (3039)..(3042): n is a, c, g, or t
  misc_feature (3046)..(3046): n is a, c, g, or t
  misc_feature (3051)..(3051): n is a, c, g, or t
  misc_feature (3055)..(3055): n is a, c, g, or t
  misc_feature (3058)..(3058): n is a, c, g, or t
  misc_feature (3060)..(3060): n is a, c, g, or t
  misc_feature (3063)..(3067): n is a, c, g, or t
  misc_feature (3069)..(3069): n is a, c, g, or t
  misc_feature (3073)..(3073): n is a, c, g, or t
  misc_feature (3075)..(3081): n is a, c, g, or t
  misc_feature (3083)..(3084): n is a, c, g, or t
  misc_feature (3087)..(3087): n is a, c, g, or t
  misc_feature (3089)..(3093): n is a, c, g, or t
  misc_feature (3096)..(3097): n is a, c, g, or t
  misc_feature (3101)..(3102): n is a, c, g, or t
  misc_feature (3104)..(3105): n is a, c, g, or t
  misc_feature (3108)..(3110): n is a, c, g, or t
  misc_feature (3112)..(3112): n is a, c, g, or t
  misc_feature (3114)..(3115): n is a, c, g, or t
  misc_feature (3117)..(3121): n is a, c, g, or t
  misc_feature (3123)..(3124): n is a, c, g, or t
  misc_feature (3127)..(3127): n is a, c, g, or t
  misc_feature (3129)..(3129): n is a, c, g, or t
  misc_feature (3131)..(3131): n is a, c, g, or t
  misc_feature (3133)..(3133): n is a, c, g, or t
  misc_feature (3136)..(3137): n is a, c, g, or t
  misc_feature (3139)..(3141): n is a, c, g, or t
  misc_feature (3143)..(3144): n is a, c, g, or t
  misc_feature (3146)..(3146): n is a, c, g, or t
  misc_feature (3148)..(3151): n is a, c, g, or t
  misc_feature (3156)..(3157): n is a, c, g, or t
  misc_feature (3161)..(3163): n is a, c, g, or t
  misc_feature (3166)..(3166): n is a, c, g, or t
  misc_feature (3172)..(3174): n is a, c, g, or t
  misc_feature (3179)..(3179): n is a, c, g, or t
  misc_feature (3182)..(3184): n is a, c, g, or t
  misc_feature (3191)..(3191): n is a, c, g, or t
  misc_feature (3205)..(3205): n is a, c, g, or t
  misc_feature (3208)..(3209): n is a, c, g, or t
  misc_feature (3212)..(3213): n is a, c, g, or t
  misc_feature (3215)..(3215): n is a, c, g, or t
  misc_feature (3218)..(3218): n is a, c, g, or t
  misc_feature (3221)..(3221): n is a, c, g, or t
  misc_feature (3225)..(3225): n is a, c, g, or t
  misc_feature (3227)..(3227): n is a, c, g, or t
  misc_feature (3229)..(3229): n is a, c, g, or t
  misc_feature (3232)..(3233): n is a, c, g, or t
  misc_feature (3235)..(3236): n is a, c, g, or t
  misc_feature (3238)..(3239): n is a, c, g, or t
  misc_feature (3241)..(3241): n is a, c, g, or t
  misc_feature (3244)..(3245): n is a, c, g, or t
  misc_feature (3247)..(3247): n is a, c, g, or t
  misc_feature (3249)..(3251): n is a, c, g, or t
  misc_feature (3253)..(3256): n is a, c, g, or t
  misc_feature (3259)..(3259): n is a, c, g, or t
  misc_feature (3262)..(3262): n is a, c, g, or t
  misc_feature (3264)..(3264): n is a, c, g, or t
  misc_feature (3270)..(3270): n is a, c, g, or t
  misc_feature (3273)..(3274): n is a, c, g, or t
  misc_feature (3276)..(3277): n is a, c, g, or t
  misc_feature (3281)..(3281): n is a, c, g, or t
  misc_feature (3285)..(3286): n is a, c, g, or t
  misc_feature (3288)..(3289): n is a, c, g, or t
  misc_feature (3294)..(3294): n is a, c, g, or t
  misc_feature (3316)..(3316): n is a, c, g, or t
  misc_feature (3321)..(3323): n is a, c, g, or t
  misc_feature (3325)..(3325): n is a, c, g, or t
  misc_feature (3328)..(3329): n is a, c, g, or t
  misc_feature (3331)..(3331): n is a, c, g, or t
  misc_feature (3333)..(3333): n is a, c, g, or t
  misc_feature (3336)..(3339): n is a, c, g, or t
  misc_feature (3343)..(3343): n is a, c, g, or t
  misc_feature (3346)..(3347): n is a, c, g, or t
  misc_feature (3350)..(3353): n is a, c, g, or t
  misc_feature (3355)..(3356): n is a, c, g, or t
  misc_feature (3359)..(3360): n is a, c, g, or t
  misc_feature (3363)..(3363): n is a, c, g, or t
  misc_feature (3367)..(3369): n is a, c, g, or t
  misc_feature (3371)..(3371): n is a, c, g, or t
  misc_feature (3373)..(3378): n is a, c, g, or t
  misc_feature (3380)..(3387): n is a, c, g, or t
  misc_feature (3389)..(3390): n is a, c, g, or t
  misc_feature (3392)..(3394): n is a, c, g, or t
  misc_feature (3396)..(3398): n is a, c, g, or t
  misc_feature (3400)..(3400): n is a, c, g, or t
  misc_feature (3403)..(3403): n is a, c, g, or t
  misc_feature (3405)..(3405): n is a, c, g, or t
  misc_feature (3411)..(3414): n is a, c, g, or t
  misc_feature (3416)..(3416): n is a, c, g, or t
  misc_feature (3418)..(3424): n is a, c, g, or t
  misc_feature (3430)..(3433): n is a, c, g, or t
  misc_feature (3435)..(3437): n is a, c, g, or t
  misc_feature (3439)..(3441): n is a, c, g, or t
  misc_feature (3444)..(3446): n is a, c, g, or t
  misc_feature (3448)..(3449): n is a, c, g, or t
  misc_feature (3451)..(3451): n is a, c, g, or t
  misc_feature (3454)..(3459): n is a, c, g, or t
  misc_feature (3462)..(3464): n is a, c, g, or t
  misc_feature (3468)..(3470): n is a, c, g, or t
  misc_feature (3472)..(3472): n is a, c, g, or t
  misc_feature (3475)..(3475): n is a, c, g, or t
  misc_feature (3477)..(3479): n is a, c, g, or t
  misc_feature (3481)..(3482): n is a, c, g, or t
  misc_feature (3485)..(3487): n is a, c, g, or t
  misc_feature (3489)..(3489): n is a, c, g, or t
  misc_feature (3491)..(3491): n is a, c, g, or t
  misc_feature (3493)..(3494): n is a, c, g, or t
  misc_feature (3499)..(3499): n is a, c, g, or t
  misc_feature (3875)..(4000): n is a, c, g, or t
tttaattaaagaattagaagaacagaaaaggttggtcgaagagttagaacatgttaaggaaaagcaaaaagaaatgaaacaattagaattggcgaaattgaaaaataaaccgaaaaaaaccaacaaaataccaacgaagaatgaagaaaataataagaatttaaatagtaaacagaaagaacaagaaatattacaaaaaaatctagaagaaaatgagcaacagaagaaaagagaagctgagcaaacagagttacaaaagcaaaaaaagaatgaattaaaaaatttacaggaaaataaaaaagagagagagcaaaaaataatggaagagaaaaataaaaaacgtttgcagacgcaactaaaatctttcaataaattacttaaagaatacgaagatcaaaaagtatctatggaagaacgagaagcagaacaaaaagtattattagaagaacaaaaaaaccaacttagaaaacgactttcggaagaaagaaacgaaagagaaagattaaaaatggaatggataaaaaaagaaaaacaagaacaaaaacaaaaagaagatttaattaatgaaatagaaaatcagaaacgcatgatagaaaaacttaaagaaacagagcatttaaattatgaaaacttaaaaaaagattatggaaaaaaaatgcacctatataagaaaaaagaaaaatctgagaatcaaaagttaataaaaaatttagaagaacaaagagatttaattgaaaaattagagtatctgttagaaaaaaagaataatattaggggtttacaggaaaaaaggggaaattcagaaaataataatttaatacaaggaaatgaattaaaaaatttaaagaaagaaagaaaagttaacgaaaaaataaatacataaatatatatctgatatatatgtttattttataaatacaaaactaatatgaatatatataacaaattattattattattattattattattattattattattattattactatttatttaaaattatgatatacatatttatttactaaatttatagttaaatacattctatttatacatattaacgtgtatatatatttaatgaattattattcttatctatttatttaaacttatgtacatatatttacctattaaatatacagttaaatatattccatttatacatatgtataaaaagataatatttttatttttatttttatttaaaagaaaaaaaaaagataataaaatatctgaaagtatttttaaatttcccatctctttttttttttttaatgtttttaataatttattaattcttatatataataaatgtgttttaatgaattgaatattatattttgtatgtattactatcataaattaattttaaaattaaataaaaacaatacattaatgtcatattatatatctctgtaattgttaatgcagaaagcactttatcaatgaaaggattagtgtagttgttcttccctcgatgatggttcaagagatcactgaaaagaaacctattatatacaacggcgtataaggagtacctttcatattagccttgcttagagaaatgtccgtgttgatgccgaaatggtatggtaaagaatccagtgaaagtcgaaaccattcacccctccagtgggtgtaatcattggcgtgtgggcatattatcatcagtgcctatgattaagtcgtagcgtagtatcaccggggttgggtccaatatgctgccaagggaaagtcttttggataccactgtggttttatgataccccaggatagaaacctcaaagcatattatatggccatgtcgggatcgaaccaaggtttctacagtaacatgtattgtccttacctgattgagccaacacagcggccccaagtcatgggtaataacttcatcggtttaaatagatgattaatctataaatttatatagttcatactaacttatgatcaatatactaaaaaaaaaaaaaaaaaataaantataatntgaaaataagcattttttctctgaattagttggcctagactaattcctaaatattttaataaagttaatttaataatgattattatatatcattatttattaatattgaaattcaaataactgaattattgaaatagaaattgaattaaattgaaattcaattattatcttaacattagtaaatttagttgtatttaattttcatttttcatttggtctcgtaccatttttgatacgatattttattaaataccgtatatgttagttgtgcgtttatgcaaaagggaattactccaagaatattatattacaataattatatttatttatttactttttatttatttatttttattattttatttattatattttatcatataaaaaatacatgttgcaattattattcattaaaaaaaaaatatttatttataaactattttcataattatattttactaattttataaatattatttgtcgaaacactaaaattaataaatataaattttcataactttttacttaaaatagtttttagataatgttaaacaatatgaattaaaaattattcatattgtttaacattatctaaaaactattttaatattaacacattcaatctccgttataattaatataactaattttgctatataatcaacaattatttaatttaatattttaattattattaataaattatctttaataatatattttaagattcattatataaaaataatttttaataaatatttatattaataatttttctaaataatttttctaaataatttttctaaataatttttctaaataatttttctaaataatttttctaaatannnntnntntttntnnntantntttctanntnatntntnnaaatnntntttnnnnatnntttttctattattttctattatttctattggacatgcacaaactttattntnnnnnnnnnnnntnnnctaannnnntnnnnnnnnnnanttntnnnnnnaannttncnnnntnanntnncnnnntnnntnnnntannnntttntattntttntantngannnnnanaaantnnnnnnnannttntnnnnnatnnatannanntannntnannannnnnannatntnantnttnntnnntnnantnnnnatgtnnaagnnntanatttannnaatanaannnaatagtnaaaataaaaatagnaannatnntnaantanaaantntntannanntnntnttnnantnnnannnnatnttnanactatntanntnntaanaatnntnnttttntttttttttttaatgaacgaantaaannnanaannantnatnnnnatanatnntannnntnntannaantaannntnannnnnnannnnnnnntnnannnannnanatnanaaaaannnntntnnnnnnntttttnnnnannnannnaannnannantannnnnntannnatannnanatnannnannttnnnancnanntattnaggatgataatatctcgagtacgcaaaaataaaaatgaaatattatgtatataaaagaattttacaggattattttgattatataaaaattaaaaaacaaataaaataaaaaaatttttttaataataaatagtctgttatcatattataaatataagatatatatttagaaaataaaaggaaataataataataatatattaataaaaataataaaaaagaataatataaataataaaaataaataaattcataatacatatatttataataatattatatgtatatacagaaactatcattacaatacaaattacatatatttttttcttttttctttttaatgatttgcttttattttttttttttttatttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

(The sequence listing continues in the following parts.)

What is claimed is:

1. A self-diversifying system comprising an in vitro engineered vector, wherein the vector comprises a promoter, a polynucleotide sequence, and a nucleic acid template region, wherein the polynucleotide sequence is operably linked to the promoter, is the nucleotide sequence selected from SEQ ID Nos. 98-123, and comprises one or more open reading frames, wherein at least one of the open reading frames comprises a self-diversifying element, wherein the nucleic acid template region is operably linked to a nucleic acid variable region of the polynucleotide sequence, and wherein the self-diversifying element is a diversity generating retroelement (DGR) or a non-DGR.

2. The system of claim 1, wherein the self-diversifying element is a (DGR).

3. The system of claim 1, wherein the self-diversifying element is a non-DGR.

4. The system of claim 1, further comprising a reverse transcriptase or functional domain thereof.

5. The system of claim 1, wherein the polynucleotide sequence encodes c-type lectin fold or a fragment thereof.

6. The system of claim 1, wherein the polynucleotide sequence encodes a protein or polypeptide capable of binding to a protein or a nucleic acid.

7. The system of claim 1, wherein the nucleic acid variable region and the nucleic acid template region have a sequence homology less than 80%.

8. The system of claim 1, wherein the system is capable of generating a population of proteins.

9. The system of claim 1, wherein the system is capable of generating a population of polynucleotides.

10. The system of claim 1, wherein the system is capable of generating one or more binding partners of a target molecule.

11. The system of claim 10, wherein the target molecule is a protein.

12. The system of claim 10, wherein the target molecule is an antigen.

13. The system of claim 10, wherein the target molecule is a polynucleotide.

14. The system of claim 1, wherein the system generates a library of diversified molecules when the vector is introduced to cells.

15. The system of claim 14, wherein the diversified molecules are polynucleotide-binding proteins or polypeptide-binding proteins.

16. The system of claim 15, wherein the polynucleotide-binding proteins or polypeptide-binding proteins are selected from SEQ ID NOs: 3 and 4.

17. The system of claim 16, wherein SEQ ID NOs: 3 and 4 are encoded by SEQ ID NO: 1 and 2 respectively.

18. The system of claim 1, wherein the nucleic acid variable region is within an open reading frame of the one or more open reading frames.

19. The system of claim 1, wherein the self-diversifying element comprises one or more initiation of mutagenic homing (IMH) sequences.

* * * * *